United States Patent 11,078,247 (RNA ENCODING A THERAPEUTIC PROTEIN) - sequence listing, part 29

SEQ ID NO: 50044 - RNA, 543 nt, Artificial Sequence
  derived and/or modified sequence opt2 from SPCS3__Homo_sapiens__NP_068747
augaacaccguccucucccgcgccaacucccucuucgccuucucccucuccgucauggccgcccucaccuucggcugcuucaucaccaccgccuucaaggaccgcuccguccccguccgccuccacgucucccgcaucaugcucaagaacgucgaggacuucaccggcccccgcgagcgcuccgaccucggcuucaucaccuucgacaucaccgccgaccucgagaacaucuucgacuggaacgucaagcagcucuuccucuaccucuccgccgaguacuccaccaagaacaacgcccucaaccaggucguccucugggacaagaucguccuccgcggcgacaaccccaagcuccuccucaaggacaugaagaccaaguacuucuucuucgacgacggcaacggccucaagggcaaccgcaacgucacccucacccucuccuggaacgucguccccaacgccggcauccucccccucgucaccggcuccggccacgucuccguccccuuccccgacaccuacgagaucaccaaguccuacuga

SEQ ID NO: 50045 - RNA, 960 nt, Artificial Sequence
  derived and/or modified sequence opt2 from SPDEF__Homo_sapiens__NP_001239223
augggcuccgccucccccggccucuccuccgucucccccucccaccuccuccucccccccgacaccgucucccgcaccggccucgagaaggccgccgccggcgccgucggccucgagcgccgcgacuggucccccuccccccccgccacccccgagcagggccucuccgccuucuaccucuccuacuucgacaugcucuaccccgaggacuccuccugggccgccaaggcccccggcgccuccucccgcgaggagccccccgaggagcccgagcagugccccgucaucgacucccaggcccccgccggcucccucgaccucguccccggcggccucacccucgaggagcacucccucgagcagguccaguccauggucgucggcgagguccucaaggacaucgagaccgccugcaagcuccucaacaucaccgccgaccccauggacuggucccccuccaacguccagaaguggcuccucuggaccgagcaccaguaccgccucccccccaugggcaaggccuuccaggagcucgccggcaaggagcucugcgccauguccgaggagcaguuccgccagcgcuccccccucggcggcgacguccuccacgcccaccucgacaucuggaaguccgccuccaccuccgaggaguccuggaccgacuccgaggucgacuccuccugcuccggccagcccauccaccucuggcaguuccucaaggagcuccuccucaagccccacuccuacggccgcuucauccgcuggcucaacaaggagaagggcaucuucaagaucgaggacuccgcccaggucgcccgccucuggggcauccgcaagaaccgccccgccaugaacuacgacaagcucucccgcuccauccgccaguacuacaagaagggcaucauccgcaagcccgacaucucccagcgccucgucuaccaguucguccaccccaucuga

SEQ ID NO: 50046 - RNA, 1818 nt, Artificial Sequence
  derived and/or modified sequence opt2 from SPDL1__Homo_sapiens__NP_060255
auggaggccgacaucaucaccaaccuccgcugccgccucaaggaggccgaggaggagcgccucaaggccgcccaguacggccuccagcucgucgagucccagaacgagcuccagaaccagcucgacaagugccgcaacgagaugaugaccaugaccgaguccuacgagcaggagaaguacacccuccagcgcgaggucgagcucaagucccgcaugcucgagucccucuccugcgagugcgaggccaucaagcagcagcagaagaugcaccucgagaagcucgaggagcagcucucccgcucccacggccaggaggucaacgagcucaagaccaagaucgagaagcucaaggucgagcucgacgaggcccgccucuccgagaagcagcucaagcaccaggucgaccaccagaaggagcuccucuccugcaaguccgaggagcuccgcgucauguccgagcgcguccaggaguccauguccuccgagaugcucgcccuccagaucgagcucaccgagauggaguccaugaagaccacccucaaggaggaggucaacgagcuccaguaccgccaggagcagcucgagcuccucaucaccaaccucaugcgccaggucgaccgccucaaggaggagaaggaggagcgcgagaaggaggccgucuccuacuacaacgcccucgagaaggcccgcgucgccaaccaggaccuccagguccagcucgaccaggcccuccagcaggcccucgaccccaacuccaagggcaacucccucuucgccgaggucgaggaccgccgcgccgccauggagcgccagcucaucuccaugaaggucaaguaccagucccucaagaagcagaacgucuucaaccgcgagcagaugcagcgcaugaagcuccagaucgccacccuccuccagaugaagggcucccagaccgaguucgagcagcaggagcgccuccucgccaugcucgagcagaagaacggcgagaucaagcaccuccucggcgagauccgcaaccucgagaaguucaagaaccucuacgacuccauggaguccaagcccuccgucgacuccggcacccucgaggacaacaccuacuacaccgaccuccuccagaugaagcucgacaaccucaacaaggagaucgaguccaccaagggcgagcucuccauccagcgcaugaaggcccucuucgagucccagcgcgcccucgacaucgagcgcaagcucuucgccaacgagcgcugccuccagcucuccgaguccgagaacaugaagcuccgcgccaagcucgacgagcucaagcucaaguacgagcccgaggagaccgucgagguccccguccucaagaagcgccgcgagguccuccccgucgacaucaccaccgccaaggacgccugcgucaacaacuccgcccucggcggcgaggucuaccgccuccccccccagaaggaggagacccaguccugccccaacucccucgaggacaacaaccuccagcucgagaaguccgucuccaucuacacccccgucgucucccucuccccccacaagaaccuccccgucgacaugcagcucaagaaggagaagaagugcgucaagcucaucggcguccccgccgacgccgaggcccucuccgagcgcuccggcaacacccccaacuccccccgccucgccgccgaguccaagcuccagaccgaggucaaggagggcaaggagaccuccuccaagcucgagaaggagaccugcaagaagcuccaccccauccucuacgucuccuccaaguccacccccgagacccagugcccccagcaguga

SEQ ID NO: 50047 - RNA, 861 nt, Artificial Sequence
  derived and/or modified sequence opt2 from SPDYA__Homo_sapiens__NP_001008779
augcgccacaaccagaugugcugcgagaccccccccaccgucaccgucuacgucaaguccggcuccaaccgcucccaccagcccaagaagcccaucacccucaagcgccccaucugcaaggacaacuggcaggccuucgagaagaacacccacaacaacaacaaguccaagcgccccaagggccccugccucgucauccagcgccaggacaugaccgccuucuucaagcucuucgacgacgaccucauccaggacuuccucuggauggacugcugcugcaagaucgccgacaaguaccuccucgccaugaccuucgucuacuucaagcgcgccaaguucaccaucuccgagcacacccgcaucaacuucuucaucgcccucuaccucgccaacaccgucgaggaggacgaggaggagaccaaguacgagaucuuccccugggcccucggcaagaacuggcgcaagcucuuccccaacuuccucaagcuccgcgaccagcucugggaccgcaucgacuaccgcgccaucgucucccgccgcugcugcgaggaggucauggccaucgcccccacccacuacaucuggcagcgcgagcgcuccguccaccacuccggcgccguccgcaacuacaaccgcgacgagguccagcucccccgcggccccuccgccacccccgucgacugcucccucugcggcaagaagcgccgcuacguccgccucggccucuccuccuccuccucccucuccucccacaccgccggcgucaccgagaagcacucccaggacuccuacaacucccucuccauggacaucaucggcgaccccucccaggccuacaccggcuccgagggcaugaucuga

SEQ ID NO: 50048 - RNA, 2130 nt, Artificial Sequence
  derived and/or modified sequence opt2 from SPECC1__Homo_sapiens__NP_001028726
augggcaaccacuccggccgccccgaggaccccgagcccggcgccuucaccaccaccaagcgcaccggcauccccgccccccgcgaguucuccgucaccgucucccgcgagcgcuccgucccccgcggccccuccaacccccgcaaguccgucuccucccccaccuccuccaacacccccacccccaccaagcaccuccgcacccccuccaccaagcccaagcaggagaacgagggcggcgagaaggccgcccucgagucccagguccgcgagcuccucgccgaggccaaggccaaggacuccgagaucaaccgccuccgcuccgagcucaagaaguacaaggagaagcgcacccucaacgccgagggcaccgacgcccucggccccaacgucgacggcaccuccgucucccccggcgacaccgagcccaugauccgcgcccucgaggagaagaacaagaacuuccagaaggagcucuccgaccucgaggaggagaaccgcguccucaaggagaagcucaucuaccucgagcacucccccaacuccgagggcgccgccucccacaccggcgacuccuccugccccaccuccaucacccaggaguccuccuucggcucccccaccggcaaccagauguccuccgacaucgacgaguacaagaagaacauccacggcaacgcccuccgcaccuccggcuccuccuccuccgacgucaccaaggccucccucucccccgacgccuccgacuucgagcacaucaccgccgagacccccucccgcccccucuccuccaccuccaaccccuucaaguccuccaagugcuccaccgccggcuccucccccaacuccgucuccgagcucucccucgccucccucaccgagaagauccagaagauggaggagaaccaccacuccaccgccgaggagcuccaggccacccuccaggagcucuccgaccagcagcagaugguccaggagcucaccgccgagaacgagaagcucgucgacgagaagaccauccucgagaccuccuuccaccagcaccgcgagcgcgccgagcagcucucccaggagaacgagaagcucaugaaccuccuccaggagcgcgucaagaacgaggagcccaccacccaggagggcaagaucaucgagcucgagcagaagugcaccggcauccucgagcagggccgcuucgagcgcgagaagcuccucaacauccagcagcagcucaccugcucccuccgcaaggucgaggaggagaaccagggcgcccucgagaugaucaagcgccucaaggaggagaacgagaagcucaacgaguuccucgagcucgagcgccacaacaacaacaugauggccaagacccucgaggagugccgcgucacccucgagggccucaagauggagaacggcucccucaagucccaccuccagggcgagaagcagaaggccaccgaggccuccgccgucgagcagaccgccgaguccugcgagguccaggagaugcucaaggucgcccgcgccgagaaggaccuccucgagcucuccugcaacgagcuccgccaggagcuccucaaggccaacggcgagaucaagcacgucuccucccuccucgccaaggucgagaaggacuacuccuaccucaaggagaucugcgaccaccaggccgagcagcucucccgcaccucccucaagcuccaggagaaggccuccgaguccgacgccgagaucaaggacaugaaggagaccaucuucgagcucgaggaccaggucgagcagcaccgcgccgucaagcuccacaacaaccagcucaucuccgagcucgaguccuccgucaucaagcucgaggagcagaaguccgaccucgagcgccagcucaagacccucaccaagcagaugaaggaggagaccgaggaguggcgccgcuuccaggccgaccuccagaccgccgucgucgucgccaacgacaucaagugcgaggcccagcaggagcuccgcaccgucaagcgcaagcuccucgaggaggaggagaagaacgcccgccuccagaaggagcucggcgacguccagggccacggccgcgucgucaccucccgcgccgccccccccucccucggcuccgucuccuga

SEQ ID NO: 50049 - RNA, 3354 nt, Artificial Sequence
  derived and/or modified sequence opt2 from SPECC1L__Homo_sapiens__NP_001138940
augaagaaggccucccgcuccgucggcuccguccccaaggucuccgccaucuccaagacccagaccgccgagaagaucaagcccgagaacuccuccuccgccuccaccggcggcaagcucgucaagcccggcaccgccgccucccucuccaagaccaaguccuccgacgaccuccucgccggcauggccggcggcgucaccgucaccaacggcgucaagggcaagaaguccaccugccccuccgccgcccccuccgccuccgcccccgccaugaccaccgucgagaacaaguccaagaucuccaccggcaccgccuccuccaccaagcgcuccaccuccaccggcaacaaggaguccuccuccacccgcgagcgccuccgcgagcgcacccgccucaaccaguccaagaagcuccccuccgccggccagggcgccaacgacauggcccucgccaagcgcucccgcucccgcaccgccaccgagugcgacguccgcauguccaaguccaaguccgacaaccagaucuccgaccgcgccgcccucgaggccaaggucaaggaccuccucacccucgccaagaccaaggacgucgagauccuccaccuccgcaacgagcuccgcgacaugcgcgcccagcucggcaucaacgaggaccacuccgagggcgacgagaaguccgagaaggagaccaucauggcccaccagcccaccgacgucgaguccacccuccuccagcuccaggagcagaacaccgccauccgcgaggagcucaaccagcucaagaacgagaaccgcaugcucaaggaccgccucaacgcccucggcuucucccucgagcagcgccucgacaacuccgagaagcucuucggcuaccagucccucucccccgagaucacccccggcaaccaguccgacggcggcggcacccucaccuccuccgucgagggcuccgcccccggcuccgucgaggaccuccucucccaggacgagaacacccucauggaccaccagcacuccaacuccauggacaaccucgacuccgagugcuccgaggucuaccagccccucaccuccuccgacgacgcccucgacgcccccuccuccuccgaguccgagggcauccccuccaucgagcgcucccgcaagggcuccuccggcaacgccuccgaggucuccgucgccugccucaccgagcgcauccaccagauggaggagaaccagcacuccaccuccgaggagcuccaggccacccuccaggagcucgccgaccuccagcagaucacccaggagcucaacuccgagaacgagcgccucggcgaggagaaggucauccucauggagucccucugccagcaguccgacaagcucgagcacuucucccgccagaucgaguacuuccgcucccuccucgacgagcaccacaucuccuacgucaucgacgaggacgucaaguccggccgcuacauggagcucgagcagcgcuacauggaccucgccgagaacgcccgcuucgagcgcgagcagcuccucggcguccagcagcaccucuccaacacccucaagauggccgagcaggacaacaaggaggcccaggagaugaucggcgcccucaaggagcgcucccaccacauggagcgcaucaucgaguccgagcagaagggcaaggccgcccucgccgccacccucgaggaguacaaggccaccgucgccuccgaccagaucgagaugaaccgccucaaggcccagcucgagaacgagaagcagaaggucgccgagcucuacuccauccacaacuccggcgacaaguccgacauccaggaccuccucgaguccguccgccucgacaaggagaaggccgagacccucgccuccucccuccaggaggaccucgcccacacccgcaacgacgccaaccgccuccaggacgccaucgccaaggucgaggacgaguaccgcgccuuccaggaggaggccaagaagcagaucgaggaccucaacaugacccucgagaagcuccgcuccgaccucgacgagaaggagaccgagcgcuccgacaugaaggagaccaucuucgagcucgaggacgaggucgagcagcaccgcgccgucaagcuccacgacaaccucaucaucuccgaccucgagaacaccgucaagaagcuccaggaccagaagcacgacauggagcgcgagaucaagacccuccaccgccgccuccgcgaggaguccgccgaguggcgccaguuccaggccgaccuccagaccgccgucgucaucgccaacgacaucaaguccgaggcccaggaggagaucggcgaccucaagcgccgccuccacgaggcccaggagaagaacgagaagcucaccaaggagcucgaggagaucaagucccgcaagcaggaggaggagcgcggccgcgucuacaacuacaugaacgccgucgagcgcgaccucgccgcccuccgccagggcaugggccucucccgccgcuccuccaccuccuccgagcccacccccaccgucaagacccucaucaaguccuucgacuccgccucccagguccccaaccccgccgccgccgccaucccccgcaccccccucucccccucccccaugaagaccccccccgccgccgccgucucccccaugcagcgccacuccaucuccggccccaucuccaccuccaagccccucaccgcccucuccgacaagcgccccaacuacggcgagauccccguccaggagcaccuccuccgcaccuccuccgccucccgccccgccucccucccccgcguccccgccauggaguccgccaagacccucuccgucucccgccgcuccuccgaggagaugaagcgcgacaucuccgcccaggagggcgccucccccgccucccucauggccaugggcaccaccuccccccagcucucccucuccuccucccccaccgccuccgucacccccaccacccgcucccgcauccgcgaggagcgcaaggacccccucuccgcccucgcccgcgaguacggcggcuccaagcgcaacgcccuccucaaguggugccagaagaagaccgagggcuaccagaacaucgacaucaccaacuucuccuccuccuggaacgacggccucgccuucugcgcccuccuccacaccuaccuccccgcccacauccccuaccaggagcucaacucccaggacaagcgccgcaacuucaugcucgccuuccaggccgccgaguccgucggcaucaaguccacccucgacaucaacgagaugguccgcaccgagcgccccgacuggcagaacgucaugcucuacgucaccgccaucuacaaguacuucgagaccuga

SEQ ID NO: 50050 - RNA, 5469 nt, Artificial Sequence
  derived and/or modified sequence opt2 from SPEF2__Homo_sapiens__NP_079143
auguccgagauccucugccaguggcucaacaaggagcucaaggucucccgcaccgucucccccaaguccuucgccaaggccuucuccuccggcuaccuccucggcgagguccuccacaaguucgagcuccaggacgacuucuccgaguuccucgacucccgcgucuccuccgccaagcucaacaacuucucccgccucgagcccacccucaaccuccucggcguccaguucgaccagaacgucgcccacggcaucaucaccgagaagcccggcgucgccaccaagcuccucuaccagcucuacaucgcccuccagaagaagaagaaguccggccucaccggcgucgagaugcagaccaugcagcgccucaccaaccuccgccuccagaacaugaaguccgacaccuuccaggagcgccuccgccacaugaucccccgccagaccgacuucaaccucaugcgcaucaccuaccgcuuccaggagaaguacaagcacgucaaggaggaccucgcccaccuccacuucgagaagcucgagcgcuuccagaagcucaaggaggagcagcgcugcuucgacaucgagaagcaguaccucaaccgccgccgccagaacgagaucauggccaagauccaggccgccaucauccagauccccaagcccgccuccaaccgcacccucaaggcccucgaggcccagaagaugaugaagaagaagaaggaggccgaggacgucgccgacgagaucaagaaguucgaggcccucaucaagaaggaccuccaggccaaggaguccgccuccaagaccucccucgacaccgccggccagaccaccaccgaccuccucaacaccuacuccgacgacgaguacaucaagaagauccagaagcgccucgaggaggacgccuucgcccgcgagcagcgcgagaagcgccgccgcaagcuccucauggaccagcucaucgcccacgaggcccaggaggaggccuaccgcgaggagcagcucaucaaccgccucaugcgccagucccagcaggagcgccgcaucgccguccagcucaugcacguccgccacgagaaggagguccucuggcagaaccgcaucuuccgcgagaagcagcacgaggagcgccgccucaaggacuuccaggacgcccucgaccgcgaggccgcccucgccaagcaggccaagaucgacuucgaggagcaguuccucaaggagaagcgcuuccacgaccagaucgccgucgagcgcgcccaggcccgcuacgagaagcacuacuccgucugcgccgagauccucgaccagaucgucgaccucuccaccaaggucgccgacuaccgcaugcucaccaacaaccucauccccuacaagcucaugcacgacuggaaggagcucuucuucaacgccaagcccaucuacgagcaggccuccgucaagacccuccccgccaaccccucccgcgagcagcucaccgagcucgagaagcgcgaccuccucgacaccaacgacuacgaggaguacaagaacauggucggcgagugggcccuccccgaggagauggucgacaaccucccccccuccaacaacugcauccucggccacauccuccaccgccucgccgagaagucccuccccccccgcgccgaguccaccacccccgagcuccccuccuucgccgucaagggcugccuccucggcaagacccucuccggcaagaccaccauccuccgcucccuccagaaggacuuccccauccagauccucuccaucgacacccucguccaggaggccauccaggccuuccacgacaacgagaaggucuccgagguccuccccauccagaagaacgacgaggaggacgcccuccccguccuccaggaggagaucaaggagucccaggacccccagcacgucuucuccgccggccccgucuccgacgagguccuccccgagaccgagggcgagaccaugcucuccgccaacgccgacaagacccccaaggccgaggaggucaaguccuccgacuccuuccucaagcucaccacccgcgcccagcucggcgccaaguccgagcagcuccucaagaagggcaaguccauccccgacguccuccucgucgacaucaucgucaacgccaucaacgagauccccgucaaccaggacugcauccucgacggcuuccccaugacccucaaccaggcccagcuccucgaggaggcccucaccggcugcaaccgcaaccucaccgaggucgagcgcaagaaggcccagaaguccacccucgccaucgaccccgccaccuccaaggagaucccccuccccucccccgccuucgacuucgucauccuccucgacgucuccgacaccuccuccaugucccgcaugaacgacaucaucgccgaggagcucuccuacaagaccgcccacgaggacaucucccagcgcgucgccgccgagaaccaggacaaggacggcgaccagaaccuccgcgaccagauccagcaccgcaucaucggcuuccucgacaacuggccccuccucgagcagugguucuccgagcccgagaacauccucaucaagaucaacgccgagaucgacaaggagucccucugcgagaaggucaaggagauccucaccaccgagaucgccaagaagaagaacaaggucgagaagaagcucgaggagaaggaggccgagaagaaggccgccgccucccucgccgagcucccccuccccacccccccccccgcccccccccccgagcccgagaaggagaaggagauccaccagucccacgucgccuccaagacccccaccgccaagggcaagccccaguccgaggccccccacggcaagcaggagucccuccaggagggcaagggcaagaagggcgagaccgcccucaagcgcaagggcucccccaagggcaaguccuccggcggcaagguccccgucaagaagucccccgccgacuccaccgacaccucccccgucgccaucgucccccagccccccaagcccggcuccgaggagugggucuacgucaacgagcccguccccgaggagaugccccucuuccucguccccuacugggagcucaucgagaacuccuacaucaacaccaucaagaccguccuccgccaccuccgcgaggaccagcacaccguccucgccuaccucuacgagauccgcaccuccuuccaggaguuccucaagcgccccgaccacaagcaggacuucgucgcccaguggcaggccgacuucaacucccuccccgacgaccucugggacgacgaggagaccaaggccgagcuccaccagcgcgucaacgaccuccgcgaccgccucugggacaucugcgacgcccgcaaggaggaggccgagcaggagcgccucgacaucaucaacgaguccuggcuccaggacacccucggcaugaccaugaaccacuucuucucccucaugcaggccgagcucaaccgcuuccaggacaccaagcgccuccuccaggacuacuacuggggcauggaguccaagauccccgucgaggacaacaagcgcuucacccgcaucccccucguccagcucgacuccaaggacaacuccgagucccagcuccgcaucccccucgucccccgcaucuccaucucccucgagaccgucacccccaagcccaagaccaaguccguccucaagggcaagauggacaacucccucgagaacgucgaguccaacuucgaggccgacgagaagcucgucauggacaccuggcagcaggccucccucgccgucucccacauggucgccgccgagauccaccagcgccucauggaggaggagaaggagaaccagcccgccgaccccaaggagaaguccccccagaugggcgccaacaagaaggucaagaaggagccccccaagaagaagcaggaggacaagaagcccaagggcaaguccccccccauggccgaggccacccccgucaucgucaccaccgaggagaucgccgagaucaagcgcaagaacgagcuccgcgucaagaucaaggaggagcaccucgccgcccuccaguucgaggagaucgccacccaguuccgccucgagcucaucaagaccaaggcccucgcccuccucgaggaccucgucaccaaggucgucgacgucuacaagcucauggagaaguggcucggcgagcgcuaccucaacgagauggccuccaccgagaagcucaccgacgucgcccgcuaccacaucgagaccuccaccaagauccagaacgagcucuaccucucccaggaggacuucuucaucaacggcaacaucaaggucuuccccgaccccccccccuccauccgccccccccccgucgagaaggaggaggacggcacccucaccaucgagcagcucgacucccuccgcgaccaguuccucgacauggcccccaagggcaucaucggcaacaaggccuucaccgacauccucaucgaccucgucacccucaaccucggcaccaacaacuuccccuccaacuggaugcaccucacccagcccgagcuccaggagcucaccucccuccucaccgucaacuccgaguucgucgacuggcgcaaguuccuccucgucaccuccaugcccuggcccaucccccucgaggaggagcuccucgagacccuccagaaguucaaggccgucgacaaggagcagcucggcaccaucaccuucgagcaguacaugcaggccggccucugguucaccggcgacgaggacaucaagauccccgagaacccccucgagccccuccccuucaaccgccaggagcaccucaucgaguucuucuuccgccucuucgccgacuacgagaaggaccccccccagcucgacuacacccagaugcuccucuacuucgccugccaccccgacaccgucgagggcgucuaccgcgcccucuccgucgccgucggcacccacgucuuccagcaggucaaggccuccauccccuccgccgagaagaccuccuccaccgacgccggccccgccgaggaguuccccgagcccgaggagaacgccgcccgcgaggagcgcaagcucaaggacgacaccgagaagcgcgagcagaaggacgaggagauccccgagaacgccaacaacgagaagauguccauggagacccuccucaaggucuucaagggcggcuccgaggcccaggacuccaaccgcuucgccucccaccucaagaucgagaacaucuacgccgagggcuucaucaagaccuuccaggaccucggcgccaagaaccucgagcccaucgaggucgccguccuccucaagcaccccuucauccaggaccucaucuccaacuacuccgacuacaaguuccccgacaucaagaucauccuccagcgcuccgagcacguccagggcuccgacggcgagcgcucccccucccgccacaccgaggagaagaaguga

SEQ ID NO: 50051 - RNA, 342 nt, Artificial Sequence
  derived and/or modified sequence opt2 from SPEG__Homo_sapiens__NP_001166947
augaagcccucccccucccagaaccgccgcuccuccgacaccggcuccaaggccccccccaccuucaaggucucccucauggaccaguccguccgcgagggccaggacgucaucauguccauccgcguccagggcgagcccaagcccgucgucuccuggcuccgcaaccgccagcccguccgccccgaccagcgccgcuucgccgaggaggccgagggcggccucugccgccuccgcauccucgccgccgagcgcggcgacgccggcuucuacaccugcaaggccgucaacgaguacggcgcccgccagugcgaggcccgccucgagguccgcggcgaguga

SEQ ID NO: 50052 - RNA, 1053 nt, Artificial Sequence
  derived and/or modified sequence opt2 from SPESP1__Homo_sapiens__NP_663633
augaagccccucguccuccucgucgcccuccuccucuggcccuccuccguccccgccuaccccuccaucaccgucacccccgacgaggagcagaaccucaaccacuacauccagguccucgagaaccucguccgcuccguccccuccggcgagcccggccgcgagaagaaguccaacucccccaagcacgucuacuccaucgccuccaagggcuccaaguucaaggagcucgucacccacggcgacgccuccaccgagaacgacguccucaccaaccccaucuccgaggagaccaccaccuuccccaccggcggcuucacccccgagaucggcaagaagaagcacaccgaguccacccccuucugguccaucaagcccaacaacgucuccaucguccuccacgccgaggagcccuacaucgagaacgaggagcccgagcccgagcccgagcccgccgccaagcagaccgaggccccccgcaugcuccccgucgucaccgaguccuccaccucccccuacgucaccuccuacaagucccccgucaccacccucgacaaguccaccggcaucggcaucuccaccgaguccgaggacgucccccagcucuccggcgagaccgccaucgagaagcccgaggaguucggcaagcaccccgaguccuggaacaacgacgacauccucaagaagauccucgacaucaacucccagguccagcaggcccuccucuccgacaccuccaaccccgccuaccgcgaggacaucgaggccuccaaggaccaccucaagcgcucccucgcccucgccgccgccgccgagcacaagcucaagaccauguacaagucccagcuccuccccgucggccgcaccuccaacaagaucgacgacaucgagaccgucaucaacaugcucugcaacucccgcuccaagcucuacgaguaccucgacaucaagugcgucccccccgagaugcgcgagaaggccgccaccgucuucaacacccucaagaacaugugccgcucccgccgcgucaccgcccuccucaaggucuacuga

SEQ ID NO: 50053 - RNA, 6993 nt, Artificial Sequence
  derived and/or modified sequence opt2 from SPG11__Homo_sapiens__NP_001153699
auggccgccgaggagggcgucgccuccgccgccuccgccggcggcuccuggggcaccgccgccaugggccgcguccuccccaugcuccucguccccguccccgccgaggccaugggccagcucggcucccgcgcccagcuccgcacccagcccgaggcccucggcucccucaccgccgccggcucccuccagguccucucccucacccccggcucccgcggcggcggccgcugcugccucgagggccccuucuggcacuuccucugggaggacucccgcaacuccuccacccccaccgagaagcccaagcuccucgcccucggcgagaacuacgagcuccucaucuacgaguucaaccucaaggacggccgcugcgacgccaccauccucuacuccugcucccgcgaggcccuccagaagcucaucgacgaccaggacaucuccaucucccuccucucccuccgcauccucuccuuccacaacaacaccucccuccucuucaucaacaagugcgucauccuccacaucaucuuccccgagcgcgacgccgccauccgcguccucaacugcuucacccucccccuccccgcccaggccgucgacaugaucaucgacacccagcucugccgcggcauccucuucguccucuccucccucggcuggaucuacaucuucgacgucgucgacggcaccuacgucgcccacgucgaccucgcccuccacaaggaggacaugugcaacgagcagcagcaggagcccgccaagaucuccuccuucaccucccucaaggucucccaggaccucgacgucgccgucaucgucuccuccuccaacuccgccgucgcccucaaccucaaccucuacuuccgccagcaccccggccaccuccucugcgagcgcauccucgaggaccuccccauccagggccccaagggcgucgacgaggacgaccccgucaacuccgccuacaacaugaagcucgccaaguucuccuuccagaucgaccgcuccuggaaggcccagcucuccucccucaacgagaccaucaagaacuccaagcucgaggucuccugcugcgcccccugguuccaggacauccuccaccucgagucccccgaguccggcaaccacuccaccuccguccaguccugggccuucaucccccaggacaucaugcacggccaguacaacguccuccagaaggaccacgccaagaccuccgaccccggccgcuccuggaagaucaugcacaucuccgagcaggaggagcccaucgagcucaagugcgucuccgucaccggcuucaccgcccucuucaccugggaggucgagcgcaugggcuacaccaucacccucugggaccucgagacccagggcaugcagugcuucucccucggcaccaagugcauccccgucgacuccuccggcgaccagcagcucugcuucguccucaccgagaacggccucucccucauccucuucggccucacccaggaggaguuccucaaccgccucaugauccacggcuccgccuccaccgucgacacccucugccaccucaacggcuggggccgcugcuccauccccauccacgcccucgaggccggcaucgagaaccgccagcucgacaccgucaacuucuuccucaaguccaaggagaaccucuucaaccccuccuccaaguccuccgucuccgaccaguucgaccaccucuccucccaccucuaccuccgcaacgucgaggagcucauccccgcccucgaccuccucugcuccgccauccgcgaguccuacuccgagccccaguccaagcacuucuccgagcagcuccucaaccucacccucuccuuccucaacaaccagaucaaggagcucuucauccacaccgaggagcucgacgagcaccuccagaagggcgucaacauccucaccuccuacaucaacgagcuccgcaccuucaugaucaaguuccccuggaagcucaccgacgccaucgacgaguacgacguccacgagaacguccccaaggucaaggaguccaacaucuggaagaagcucuccuucgaggaggucaucgccuccgccauccucaacaacaagauccccgaggcccagaccuucuuccgcaucgacucccacuccgcccagaagcucgaggagcucaucggcaucggccucaaccucgucuucgacaaccucaagaagaacaacaucaaggaggccuccgagcuccucaagaacaugggcuucgacgucaagggccagcuccucaagaucugcuucuacaccaccaacaagaacauccgcgacuuccucgucgagauccucaaggagaagaacuacuucuccgagaaggagaagcgcaccaucgacuucguccaccaggucgagaagcucuaccucggccacuuccaggagaacaugcagauccaguccuucccccgcuacuggaucaaggagcaggacuucuucaagcacaaguccguccucgacuccuuccucaaguacgacugcaaggacgaguucaacaagcaggaccaccgcaucguccucaacugggcccucuggugggaccagcucacccaggaguccauccuccucccccgcaucucccccgaggaguacaaguccuacucccccgaggcccucuggcgcuaccucaccgcccgccacgacuggcucaacaucauccucuggaucggcgaguuccagacccagcacuccuacgccucccuccagcagaacaaguggccccuccucaccgucgacgucaucaaccagaacaccuccugcaacaacuacaugcgcaacgagauccucgacaagcucgcccgcaacggcgucuuccucgccuccgagcucgaggacuucgagugcuuccuccuccgccucucccgcaucggcggcgucauccaggacacccuccccguccagaacuacaagaccaaggagggcugggacuuccacucccaguucauccucuacugccucgagcacucccuccagcaccuccucuacgucuaccucgacugcuacaagcucucccccgagaacugccccuuccucgagaagaaggagcuccacgaggcccaccccugguucgaguuccucguccagugccgccaggucgccuccaaccucaccgaccccaagcucaucuuccaggccucccucgccaacgcccagauccucauccccaccaaccaggccuccgucuccuccaugcuccucgagggccacacccuccucgcccucgccaccaccauguacucccccggcggcgucucccaggucguccagaacgaggagaacgagaacugccucaagaaggucgacccccagcuccucaagauggcccucacccccuaccccaagcucaagaccgcccucuucccccagugcaccccccccuccguccuccccuccgacaucaccaucuaccaccucauccagucccucucccccuucgaccccucccgccucuucggcuggcaguccgccaacacccucgccaucggcgacgccuggucccaccucccccacuucuccucccccgaccucgucaacaaguacgccaucgucgagcgccucaacuucgccuacuaccuccacaacggccgccccuccuucgccuucggcaccuuccucguccaggagcucaucaaguccaagacccccaagcagcucauccagcaggucggcaacgaggccuacgucaucggccucuccuccuuccacauccccuccaucggcgccgccugcgucugcuuccucgagcuccucggccucgacucccucaagcuccgcgucgacaugaaggucgccaacaucauccucuccuacaagugccgcaacgaggacgcccaguacuccuucauccgcgaguccgucgccgagaagcucuccaagcucgccgacggcgagaagaccaccaccgaggagcuccucguccuccucgaggagggcaccuggaacuccauccagcagcaggagaucaagcgccucuccuccgaguccuccucccagugggcccucgucguccaguucugccgccuccacaacaugaagcucuccaucuccuaccuccgcgagugcgccaaggccaacgacuggcuccaguucaucauccacucccagcuccacaacuaccaccccgccgaggucaagucccucauccaguacuucucccccgucauccaggaccaccuccgccucgccuucgagaaccuccccuccguccccaccuccaagauggacuccgaccaggucugcaacaagugcccccaggagcuccagggcuccaagcaggagaugaccgaccucuucgagauccuccuccagugcuccgaggagcccgacuccuggcacuggcuccucgucgaggccgucaagcagcaggcccccauccucuccguccucgccuccugccuccagggcgccuccgccaucuccugccucugcgucuggaucaucaccuccgucgaggacaacgucgccaccgaggccaugggccacauccaggacuccaccgaggaccacaccuggaaccucgaggaccucuccgucaucuggcgcacccuccucacccgccagaaguccaagacccucauccgcggcuuccagcucuucuucaaggacuccccccuccuccucgucauggagauguacgagcucugcauguucuuccgcaacuacaaggaggccgaggccaagcuccucgaguuccagaagucccucgagacccucaacaccgccgccaccaagguccaccccgucauccccgccauguggcucgaggaccaggucugcuuccuccucaagcucaugcuccagcagugcaagacccaguacgagcucggcaagcuccuccagcucuucgucgagcgcgagcaccucuucuccgacggccccgacgucaagaagcucugcauccucugccagauccucaaggacaccuccaucgccaucaaccacaccaucaucaccuccuacuccaucgagaaccuccagcacgagugccgcuccauccucgagcgccuccagaccgacggccaguucgcccucgcccgccgcgucgccgagcucgccgagcuccccgucgacaaccucgucaucaaggagaucacccaggagaugcagacccucaagcacaucgagcaguggucccucaagcaggcccgcaucgacuucuggaagaagugccacgagaacuucaagaagaacuccaucuccuccaaggccgccuccuccuucuucuccacccaggcccacgucgccugcgagcaccccaccggcugguccuccauggaggagcgccaccuccuccucacccucgccggccacuggcucgcccaggaggacgucgucccccucgacaagcucgaggagcucgagaagcagaucuggcucugccgcaucacccagcacacccucggccgcaaccaggaggagaccgagccccgcuucucccgccagaucuccaccuccggcgagcucuccuucgacucccucgccuccgaguucuccuucuccaagcucgccgcccucaacaccuccaaguaccucgagcucaacucccuccccuccaaggagaccugcgagaaccgccucgacuggaaggagcaggagucccucaacuuccucaucggccgccuccucgacgacggcugcguccacgaggccucccgcgucugccgcuacuuccacuucuacaaccccgacgucgcccucguccuccacugccgcgcccucgccuccggcgaggccuccauggaggaccuccaccccgagauccacgcccuccuccaguccgccgagcuccucgaggaggaggcccccgacaucccccuccgccgcguccacucccgccacaagcagauguucaaccccaccgaggagucccagaccuuccuccagcucaccacccucugccaggaccgcacccucgucggcaugaagcuccucgacaagaucuccuccgucccccacggcgagcucuccugcaccaccgagcuccucauccucgcccaccacugcuucacccucaccugccacauggagggcaucauccgcguccuccaggccgcccacaugcucaccgacaaccaccucgcccccuccgaggaguacggccucgucguccgccuccucaccggcaucggccgcuacaacgagaugaccuacaucuucgaccuccuccacaagaagcacuacuucgagguccucaugcgcaagaagcucgaccccuccggcacccucaagaccgcccuccucgacuacaucaagcgcugccgccccggcgacuccgagaagcacaacaugaucgcccucugcuucuccaugugccgcgagaucggcgagaaccacgaggccgccgcccgcauccagcucaagcucaucgagucccagcccugggaggacucccucaaggacggccaccagcucaagcagcuccuccucaaggcccucacccucaugcucgacgccgccgaguccuacgccaaggacuccugcguccgccaggcccagcacugccagcgccucaccaagcucaucacccuccagauccacuuccucaacaccggccagaacaccaugcucaucaaccucggccgccacaagcucauggacugcauccucgcccucccccgcuucuaccaggccuccaucgucgccgaggccuacgacuucguccccgacugggccgagauccucuaccagcaggucauccucaagggcgacuucaacuaccucgaggaguucaagcagcagcgccuccucaaguccuccaucuucgaggagaucuccaagaaguacaagcagcaccagcccaccgacauggucauggagaaccucaagaagcuccucaccuacugcgaggacgucuaccucuacuacaagcucgccuacgagcacaaguucuacgagaucgucaacguccuccucaaggacccccagaccggcugcugccucaaggacaugcucgccggcuga

SEQ ID NO: 50054 - RNA, 2001 nt, Artificial Sequence
  derived and/or modified sequence opt2 from SPG20__Homo_sapiens__NP_055902
auggagcaggagccccagaacggcgagcccgccgagaucaagaucauccgcgaggccuacaagaaggccuuccucuucgucaacaagggccucaacaccgacgagcucggccagaaggaggaggccaagaacuacuacaagcagggcaucggccaccuccuccgcggcaucuccaucuccuccaaggaguccgagcacaccggccccggcugggaguccgcccgccagaugcagcagaagaugaaggagacccuccagaacguccgcacccgccucgagauccucgagaagggccucgccaccucccuccagaacgaccuccaggagguccccaagcucuaccccgaguucccccccaaggacaugugcgagaagcuccccgagccccaguccuucuccuccgccccccagcacgccgaggucaacggcaacaccuccacccccuccgccggcgccgucgccgcccccgccucccucucccuccccucccaguccugccccgccgaggccccccccgccuacaccccccaggccgccgagggccacuacaccgucuccuacggcaccgacuccggcgaguucuccuccgucggcgaggaguucuaccgcaaccacucccagccccccccccucgagacccucggccucgacgccgacgagcucauccucauccccaacggcguccagaucuucuucgucaaccccgccggcgaggucuccgcccccuccuaccccggcuaccuccgcaucguccgcuuccucgacaacucccucgacaccguccucaaccgcccccccggcuuccuccaggucugcgacuggcucuacccccucguccccgaccgcucccccguccucaagugcaccgccggcgccuacauguuccccgacaccaugcuccaggccgccggcugcuucgucggcgucguccucuccuccgagcuccccgaggacgaccgcgagcucuucgaggaccuccuccgccagauguccgaccuccgccuccaggccaacuggaaccgcgccgaggaggagaacgaguuccagauccccggccgcacccgccccuccuccgaccagcucaaggaggccuccggcaccgacgucaagcagcucgaccagggcaacaaggacguccgccacaagggcaagcgcggcaagcgcgccaaggacaccuccuccgaggaggucaaccucucccacaucguccccugcgagcccguccccgaggagaagcccaaggagcuccccgagugguccgagaaggucgcccacaacauccucuccggcgccuccugggucuccuggggccucgucaagggcgccgagaucaccggcaaggccauccagaagggcgccuccaagcuccgcgagcgcauccagcccgaggagaagcccgucgaggucucccccgccgucaccaagggccucuacaucgccaagcaggccaccggcggcgccgccaaggucucccaguuccucgucgacggcgucugcaccgucgccaacugcgucggcaaggagcucgccccccacgucaagaagcacggcuccaagcucguccccgagucccucaagaaggacaaggacggcaaguccccccucgacggcgccauggucgucgccgccuccuccguccagggcuucuccaccgucuggcagggccucgagugcgccgccaagugcaucgucaacaacgucuccgccgagaccguccagaccguccgcuacaaguacggcuacaacgccggcgaggccacccaccacgccgucgacuccgccgucaacgucggcgucaccgccuacaacaucaacaacaucggcaucaaggccauggucaagaagaccgccacccagaccggccacacccuccucgaggacuaccagaucgucgacaacucccagcgcgagaaccaggagggcgccgccaacgucaacguccgcggcgagaaggacgagcagaccaaggaggucaaggaggccaagaagaaggacaaguga

SEQ ID NO: 50055 - RNA, 846 nt, Artificial Sequence
  derived and/or modified sequence opt2 from SPG21__Homo_sapiens__NP_001121362
augggcgagaucaaggucucccccgacuacaacugguuccgcggcaccgucccccucaagaagaucaucgucgacgacgacgacuccaagaucuggucccucuacgacgccggcccccgcuccauccgcugcccccucaucuuccucccccccgucuccggcaccgccgacgucuucuuccgccagauccucgcccucaccggcuggggcuaccgcgucaucgccguccaccucuucggcgccucccucggcggcuuccucgcccagaaguucgccgaguacacccacaaguccccccgcguccacucccucauccucugcaacuccuucuccgacaccuccaucuucaaccagaccuggaccgccaacuccuucuggcucaugcccgccuucaugcucaagaagaucguccucggcaacuucuccuccggccccgucgaccccaugauggccgacgccaucgacuucauggucgaccgccucgagucccucggccaguccgagcucgccucccgccucacccucaacugccagaacuccuacgucgagccccacaagauccgcgacauccccgucaccaucauggacgucuucgaccaguccgcccucuccaccgaggccaaggaggagauguacaagcucuaccccaacgcccgccgcgcccaccucaagaccggcggcaacuuccccuaccucugccgcuccgccgaggucaaccucuacguccagauccaccuccuccaguuccacggcaccaaguacgccgccaucgaccccuccauggucuccgccgaggagcucgagguccagaagggcucccucggcaucucccaggaggagcaguga

SEQ ID NO: 50056 - RNA, 2388 nt, Artificial Sequence
  derived and/or modified sequence opt2 from SPG7__Homo_sapiens__NP_003110
auggccguccuccuccuccuccuccgcgcccuccgccgcggccccggccccggcccccgcccccucuggggccccggccccgccuggucccccggcuuccccgcccgccccggccgcggccgccccuacauggccucccgcccccccggcgaccucgccgaggccggcggccgcgcccuccagucccuccagcuccgccuccucacccccaccuucgagggcaucaacggccuccuccucaagcagcaccucguccagaaccccguccgccucuggcagcuccucggcggcaccuucuacuucaacaccucccgccucaagcagaagaacaaggagaaggacaaguccaagggcaaggcccccgaggaggacgaggaggagcgccgccgccgcgagcgcgacgaccagauguaccgcgagcgccuccgcacccuccucgucaucgccgucgucaugucccuccucaacgcccucuccaccuccggcggcuccaucuccuggaacgacuucguccacgagaugcucgccaagggcgagguccagcgcguccaggucguccccgaguccgacgucgucgaggucuaccuccaccccggcgccgucgucuucggccgcccccgccucgcccucauguaccgcaugcaggucgccaacaucgacaaguucgaggagaagcuccgcgccgccgaggacgagcucaacaucgaggccaaggaccgcauccccgucuccuacaagcgcaccggcuucuucggcaacgcccucuacuccgucggcaugaccgccgucggccucgccauccucugguacgucuuccgccucgccggcaugaccggccgcgagggcggcuucuccgccuucaaccagcucaagauggcccgcuucaccaucgucgacggcaagaugggcaagggcgucuccuucaaggacgucgccggcaugcacgaggccaagcucgagguccgcgaguucgucgacuaccucaagucccccgagcgcuuccuccagcucggcgccaagguccccaagggcgcccuccuccucggcccccccggcugcggcaagacccuccucgccaaggccgucgccaccgaggcccagguccccuuccucgccauggccggccccgaguucgucgaggucaucggcggccucggcgccgcccgcguccgcucccucuucaaggaggcccgcgcccgcgcccccugcaucgucuacaucgacgagaucgacgccgucggcaagaagcgcuccaccaccauguccggcuucuccaacaccgaggaggagcagacccucaaccagcuccucgucgagauggacggcaugggcaccaccgaccacgucaucguccucgccuccaccaaccgcgccgacauccucgacggcgcccucaugcgccccggccgccucgaccgccacgucuucaucgaccuccccacccuccaggagcgccgcgagaucuucgagcagcaccucaagucccucaagcucacccaguccuccaccuucuacucccagcgccucgccgagcucacccccggcuucuccggcgccgacaucgccaacaucugcaacgaggccgcccuccacgccgcccgcgagggccacaccuccguccacacccucaacuucgaguacgccgucgagcgcguccucgccggcaccgccaagaaguccaagauccucuccaaggaggagcagaaggucgucgccuuccacgaguccggccacgcccucgucggcuggaugcucgagcacaccgaggccgucaugaaggucuccaucaccccccgcaccaacgccgcccucggcuucgcccagaugcucccccgcgaccagcaccucuucaccaaggagcagcucuucgagcgcaugugcauggcccucggcggccgcgccuccgaggcccucuccuucaacgaggucaccuccggcgcccaggacgaccuccgcaaggucacccgcaucgccuacuccauggucaagcaguucggcauggcccccggcaucggccccaucuccuuccccgaggcccaggagggccucaugggcaucggccgccgccccuucucccagggccuccagcagaugauggaccacgaggcccgccuccucgucgccaaggccuaccgccacaccgagaagguccuccaggacaaccucgacaagcuccaggcccucgccaacgcccuccucgagaaggaggucaucaacuacgaggacaucgaggcccucaucggcccccccccccacggccccaagaagaugaucgccccccagcgcuggaucgacgcccagcgcgagaagcaggaccucggcgaggaggagaccgaggagacccagcagcccccccucggcggcgaggagcccaccuggcccaaguga

SEQ ID NO: 50057 - RNA, 1197 nt, Artificial Sequence
  derived and/or modified sequence opt2 from SPHK1__Homo_sapiens__NP_068807
auggaccccgucgucggcugcggccgcggccucuucggcuucgucuucuccgccggcggcccccgcggcguccucccccgccccugccgcguccucguccuccucaacccccgcggcggcaagggcaaggcccuccagcucuuccgcucccacguccagccccuccucgccgaggccgagaucuccuucacccucaugcucaccgagcgccgcaaccacgcccgcgagcucguccgcuccgaggagcucggccgcugggacgcccucgucgucauguccggcgacggccucaugcacgaggucgucaacggccucauggagcgccccgacugggagaccgccauccagaagccccucugcucccuccccgccggcuccggcaacgcccucgccgccucccucaaccacuacgccggcuacgagcaggucaccaacgaggaccuccucaccaacugcacccuccuccucugccgccgccuccucucccccaugaaccuccucucccuccacaccgccuccggccuccgccucuucuccguccucucccucgccuggggcuucaucgccgacgucgaccucgaguccgagaaguaccgccgccucggcgagaugcgcuucacccucggcaccuuccuccgccucgccgcccuccgcaccuaccgcggccgccucgccuaccuccccgucggccgcgucggcuccaagacccccgccucccccgucgucguccagcagggccccgucgacgcccaccucgucccccucgaggagcccguccccucccacuggaccgucguccccgacgaggacuucguccucguccucgcccuccuccacucccaccucggcuccgagauguucgccgcccccaugggccgcugcgccgccggcgucaugcaccucuucuacguccgcgccggcgucucccgcgccaugcuccuccgccucuuccucgccauggagaagggccgccacauggaguacgagugccccuaccucgucuacguccccgucgucgccuuccgccucgagcccaaggacggcaagggcgucuucgccgucgacggcgagcucauggucuccgaggccguccagggccagguccaccccaacuacuucuggauggucuccggcugcgucgagcccccccccuccuggaagccccagcagaugcccccccccgaggagccccucuga

SEQ ID NO: 50058 - RNA, 1788 nt, Artificial Sequence
  derived and/or modified sequence opt2 from SPHK2__Homo_sapiens__NP_001191087
augaacggccaccucgaggccgaggagcagcaggaccaggcccuccacauccagcgccuccgccccaagcccgaggcccgcccccgcggcggccucgucccccucgccgaggucuccggcugcugcacccuccgcucccgcucccccuccgacuccgccgccuacuucugcaucuacaccuacccccgcggccgccgcggcgcccgccgccgcgccacccgcaccuuccgcgccgacggcgccgccaccuacgaggagaaccgcgccgaggcccagcgcugggccaccgcccucaccugccuccuccgcggccucccccuccccggcgacggcgagaucacccccgaccuccucccccgccccccccgccuccuccuccucgucaaccccuucggcggccgcggccucgccuggcaguggugcaagaaccacguccuccccaugaucuccgaggccggccucuccuucaaccucauccagaccgagcgccagaaccacgcccgcgagcucguccagggccucucccucuccgagugggacggcaucgucaccgucuccggcgacggccuccuccacgagguccucaacggccuccucgaccgccccgacugggaggaggccgucaagaugcccgucggcauccuccccugcggcuccggcaacgcccucgccggcgccgucaaccagcacggcggcuucgagcccgcccucggccucgaccuccuccucaacugcucccuccuccucugccgcggcggcggccacccccucgaccuccucuccgucacccucgccuccggcucccgcugcuucuccuuccucuccgucgccuggggcuucgucuccgacgucgacauccaguccgagcgcuuccgcgcccucggcuccgcccgcuucacccucggcaccguccucggccucgccacccuccacaccuaccgcggccgccucuccuaccuccccgccaccgucgagcccgccucccccacccccgcccacucccucccccgcgccaaguccgagcucacccucacccccgaccccgccccccccauggcccacuccccccuccaccgcuccgucuccgaccucccccucccccucccccagcccgcccucgccucccccggcucccccgagccccuccccauccucucccucaacggcggcggccccgagcucgccggcgacuggggcggcgccggcgacgccccccucucccccgacccccuccucuccuccccccccggcucccccaaggccgcccuccacucccccgucuccgagggcgcccccgucaucccccccuccuccggccucccccuccccacccccgacgcccgcgucggcgccuccaccugcggcccccccgaccaccuccuccccccccucggcaccccccucccccccgacugggucacccucgagggcgacuucguccucaugcucgccaucucccccucccaccucggcgccgaccucgucgccgccccccacgcccgcuucgacgacggccucguccaccucugcuggguccgcuccggcaucucccgcgccgcccuccuccgccucuuccucgccauggagcgcggcucccacuucucccucggcugcccccagcucggcuacgccgccgcccgcgccuuccgccucgagccccucaccccccgcggcguccucaccgucgacggcgagcaggucgaguacggcccccuccaggcccagaugcaccccggcaucggcacccuccucaccggcccccccggcugccccggccgcgagcccuga

SEQ ID NO: 50059 - RNA, 5103 nt, Artificial Sequence
  derived and/or modified sequence opt2 from SPHKAP__Homo_sapiens__NP_001136116
auggacggcaacucccuccucuccguccccuccaaccucgaguccucccgcauguacgacguccucgagccccagcagggccgcggcugcggcuccuccggcuccggccccggcaacuccaucaccgccugcaagaagguccuccgcuccaacucccuccucgaguccaccgacuacuggcuccagaaccagcgcaugcccugccagaucggcuucgucgaggacaaguccgagaacugcgccuccgucugcuucgucaaccucgacgucaacaaggacgagugcuccaccgagcaccuccagcagaagcucgucaacgucucccccgaccuccccaagcucaucuccuccaugaacguccagcagcccaaggagaacgagaucgucguccucuccggccucgccuccggcaaccuccaggccgacuucgaggucucccagugccccuggcuccccgacaucugccucguccagugcgcccgcggcaaccgccccaacuccaccaacugcaucaucuucgagaucaacaaguuccucaucggccucgagcucguccaggagcgccagcuccaccucgagaccaacauccucaagcucgaggacgacaccaacugcucccucuccuccaucgaggaggacuuccucaccgccuccgagcaccucgaggaggaguccgaggucgacgagucccgcaacgacuacgagaacaucaacgucuccgccaacguccucgaguccaagcagcucaagggcgccacccaggucgaguggaacugcaacaaggagaaguggcucuacgcccucgaggacaaguacaucaacaaguaccccaccccccucaucaagaccgagcgcucccccgagaaccucaccaagaacaccgcccuccagucccucgaccccuccgccaagcccucccaguggaagcgcgaggccgucggcaacggccgccaggccacccacuacuaccacuccgaggccuucaagggccagauggagaagucccaggcccucuacauccccaaggacgccuacuucuccaugauggacaaggacguccccuccgccugcgccgucgccgagcagcgcuccaaccucaaccccggcgaccacgaggacacccgcaacgcccuccccccccgccaggacggcgaggucaccaccggcaaguacgccaccaaccucgccgaguccguccuccaggacgccuucauccgccucucccagucccaguccacccucccccaggaguccgccgucuccgucuccgucggcuccucccuccuccccuccugcuacuccaccaaggacaccgucgucucccgcuccuggaacgagcuccccaagaucgucgucguccagucccccgacggcuccgacgccgccccccagcccggcaucuccuccuggcccgagauggaggucuccgucgagaccuccuccauccucuccggcgagaacuccucccgccagccccaguccgcccucgaggucgcccucgccugcgccgccaccgucaucggcaccaucuccuccccccaggccaccgagcgccucaagauggagcaggucgucuccaacuucccccccggcuccuccggcgcccuccagacccaggccccccagggccucaaggagcccuccaucaacgaguacuccuuccccuccgcccucugcggcaugacccaggucgccuccgccgucgccgucugcggccucggcgagcgcgaggaggucaccugcuccgucgcccccuccggcucccucccccccgccgccgaggccuccgaggccaugcccccccucugcggccucgccuccauggagcucggcaaggaggccaucgccaagggccuccucaaggaggccgcccucguccucacccgccccaacaccuacuccuccaucggcgacuuccucgacuccaugaaccgccgcaucauggagaccgccuccaagucccagacccucugcuccgagaacgucguccgcaacgagcucgcccacacccucuccaacgucauccuccgccacuccaucgacgagguccaccacaagaacaugaucaucgaccccaacgacaaccgccacuccuccgagauccucgacacccucauggaguccaccaaccagcuccuccucgacgucaucugcuucaccuucaagaagaugucccacaucguccgccucggcgagugccccgccguccucuccaaggagaccauccgccgccgcgagaccgagcccuccugccagcccuccgaccccggcgccucccaggccuggaccaaggccaccgaguccuccuccuccuccccccucuccaacucccacaacaccucccucgucaucaacaaccucgucgacggcauguacuccaagcaggacaagggcggcguccgccccggccucuucaagaaccccacccuccagucccagcucucccgcucccaccgcguccccgacuccuccaccgccaccaccuccuccaaggagaucuaccucaagggcaucgccggcgaggacaccaaguccccccaccacuccgagaacgagugccgcgccuccuccgagggccagcgcucccccaccgucucccagucccgcuccggcucccaggaggccgaggaguccauccaccccaacacccaggagaaguacaacugcgccaccucccgcaucaacgagguccaggucaaccucucccuccucggcgacgaccuccuccuccccgcccaguccacccuccagaccaagcaccccgacaucuacugcaucaccgacuucgccgaggagcucgccgacaccgucgucuccauggccaccgagaucgccgccaucugccucgacaacuccuccggcaagcagcccugguucugcgccuggaagcgcggcuccgaguuccucaugacccccaacguccccugccgcucccucaagcgcaagaaggagucccagggcuccggcaccgccguccgcaagcacaagcccccccgccucuccgagaucaagcgcaagaccgacgagcaccccgagcucaaggagaagcucaugaaccgcgucgucgacgaguccaugaaccucgaggacguccccgacuccgucaaccucuucgccaacgaggucgccgccaagaucaugaaccucaccgaguucuccauggucgacggcauguggcaggcccagggcuacccccgcaaccgccuccucuccggcgaccgcuggucccgccucaaggccuccuccugcgaguccauccccgaggaggacuccgaggcccgcgccuacgucaacucccucggccucauguccacccucucccagcccgucucccgcgccuccuccgucuccaagcaguccuccugcgaguccaucaccgacgaguucucccgcuucauggucaaccagauggagaacgagggccgcggcuucgagcuccuccucgacuacuacgccggcaagaacgccuccuccauccucaacuccgccaugcagcaggccugccgcaaguccgaccaccucuccguccgccccuccugccccuccaagcaguccuccaccgaguccaucaccgaggaguucuaccgcuacaugcuccgcgacaucgagcgcgacucccgcgaguccgccuccucccgccgcuccucccaggacuggaccgccggccuccucucccccucccuccgcucccccgucugccaccgccaguccuccaugcccgacucccgcucccccugcucccgccucaccgucaacguccccaucaaggccaacucccucgacggcuucgcccagaacugcccccaggacuuccucuccguccagcccgucuccuccgccuccuccuccggccucugcaaguccgacuccugccucuaccgccgcggcggcaccgaccacaucaccaacaugcucauccacgagaccugggccuccuccaucgaggcccucaugcgcaagaacaagaucaucgucgacgacgccgaggaggccgacaccgagcccgucuccggcggcucccccucccaggccgagaagugcgccaaccgccucgccgccucccgcaugugcuccggccccacccuccucguccaggagucccucgacugcccccgcaaggacuccgucaccgagugcaagcagccccccgucuccucccucuccaagaccgccucccucaccaaccacuccccccucgacuccaagaaggagaccuccuccugccaggaccccguccccaucaaccacaagcgccgcucccucugcucccgcgaggucccccucauccagaucgagaccgaccagcgcgaggccugcgccggcgagcccgagcccuuccucuccaaguccucccuccucgaggaggccgagggccacuccaacgacaagaacauccccgacgucguccgcggcggcgacaccgccgucuccgccugccagauccacuccgacucccucgacacccgcgacguccccgaggccgaggccuccaccgaggcccgcgcccccgacgaggcccccaacccccccuccuccuccgaggaguccaccggcuccuggacccagcucgccaacgaggaggacaaccccgacgacaccuccuccuuccuccagcucuccgagcgcuccauguccaacggcaacuccuccgccaccuccucccucggcaucauggaccucgacaucuaccaggaguccaugcccuccucccccaugaucaacgagcucgucgaggagaagaagauccucaagggccaguccgaguccaccgaggcccccgccuccggcccccccaccggcaccgccuccccccagcgcucccuccucgucaucaacuucgaccucgagcccgagugccccgacgccgagcuccgcgccacccuccaguggaucgccgccuccgagcucggcauccccaccaucuacuucaagaagucccaggagaaccgcaucgagaaguuccucgacgucguccagcucguccaccgcaaguccuggaaggucggcgacaucuuccacgccgucguccaguacugcaagaugcacgaggagcagaaggacggccgccucucccucuucgacuggcuccucgagcucggcuga

SEQ ID NO: 50060 - RNA, 816 nt, Artificial Sequence
  derived and/or modified sequence opt2 from SPI1__Homo_sapiens__NP_001074016
augcuccaggccugcaagauggagggcuucccccucguccccccccagcccuccgaggaccucguccccuacgacaccgaccucuaccagcgccagacccacgaguacuaccccuaccucuccuccgacggcgagucccacuccgaccacuacugggacuuccacccccaccacguccacuccgaguucgaguccuucgccgagaacaacuucaccgagcuccaguccguccagcccccccagcuccagcagcucuaccgccacauggagcucgagcagaugcacguccucgacacccccaugguccccccccaccccucccucggccaccaggucuccuaccucccccgcaugugccuccaguaccccucccucucccccgcccagcccuccuccgacgaggaggagggcgagcgccagucccccccccucgaggucuccgacggcgaggccgacggccucgagcccggccccggccuccuccccggcgagaccggcuccaagaagaagauccgccucuaccaguuccuccucgaccuccuccgcuccggcgacaugaaggacuccaucuggugggucgacaaggacaagggcaccuuccaguucuccuccaagcacaaggaggcccucgcccaccgcuggggcauccagaagggcaaccgcaagaagaugaccuaccagaagauggcccgcgcccuccgcaacuacggcaagaccggcgaggucaagaaggucaagaagaagcucaccuaccaguucuccggcgagguccucggccgcggcggccucgccgagcgccgccaccccccccacuga

SEQ ID NO: 50061 - RNA, 516 nt, Artificial Sequence
  derived and/or modified sequence opt2 from SPIB__Homo_sapiens__NP_001230927
auggccuccuccaugaccuggaccgccgccuccauccccgccacccucauccagcgcggccuccucacccucgucccccccgccuacgcccccuaccccucccccguccucuccgaggaggaggaccucccccucgacucccccgcccucgaggucuccgacuccgaguccgacgaggcccucgucgccggccccgagggcaagggcuccgaggccggcacccgcaagaagcuccgccucuaccaguuccuccucggccuccucacccgcggcgacaugcgcgagugcgucuggugggucgagcccggcgccggcgucuuccaguucuccuccaagcacaaggagcuccucgcccgccgcuggggccagcagaagggcaaccgcaagcgcaugaccuaccagaagcucgcccgcgcccuccgcaacuacgccaagaccggcgagauccgcaaggucaagcgcaagcucaccuaccaguucgacuccgcccuccuccccgccguccgccgcgccuga

SEQ ID NO: 50062 - RNA, 747 nt, Artificial Sequence
  derived and/or modified sequence opt2 from SPIC__Homo_sapiens__NP_689536
augaccugcgucgagcaggacaagcucggccaggccuucgaggacgccuucgagguccuccgccagcacuccaccggcgaccuccaguacucccccgacuaccgcaacuaccucgcccucaucaaccaccgcccccacgucaagggcaacuccuccugcuacggcguccuccccaccgaggagcccgucuacaacuggcgcaccgucaucaacuccgccgccgacuucuacuucgagggcaacauccaccagucccuccagaacaucaccgagaaccagcucguccagcccacccuccuccagcagaagggcggcaagggccgcaagaagcuccgccucuucgaguaccuccacgagucccucuacaaccccgagauggccuccugcauccagugggucgacaagaccaagggcaucuuccaguucgucuccaagaacaaggagaagcucgccgagcucuggggcaagcgcaagggcaaccgcaagaccaugaccuaccagaagauggcccgcgcccuccgcaacuacggccgcuccggcgagaucaccaagauccgccgcaagcucaccuaccaguucuccgaggccauccuccagcgccucucccccuccuacuuccucggcaaggagaucuucuacucccagugcguccagcccgaccaggaguaccucucccucaacaacuggaacgccaacuacaacuacaccuacgccaacuaccacgagcucaaccaccacgacugcuga

SEQ ID NO: 50063 - RNA, 2748 nt, Artificial Sequence
  derived and/or modified sequence opt2 from SPIDR__Homo_sapiens__NP_001073863
augccccgcggcucccgcgcccgcggcuccaagcgcaagcgcuccuggaacaccgagugccccuccuuccccggcgagcgcccccuccagguccgccgcgccggccuccgcaccgccggcgccgccgccucccucuccgaggccuggcuccgcugcggcgagggcuuccagaacaccuccggcaaccccucccucaccgccgaggagaagaccaucaccgagaagcaccucgagcucugcccccgccccaagcaggagaccaccaccuccaaguccaccuccggccucaccgacaucaccugguccuccuccggcuccgaccucuccgacgaggacaagacccucucccagcuccagcgcgacgagcuccaguucaucgacugggagaucgacuccgaccgcgccgaggccuccgacugcgacgaguucgaggacgacgagggcgccgucgagaucuccgacugcgccuccugcgccuccaaccagucccucaccuccgacgagaagcucuccgagcuccccaagcccuccuccaucgagauccucgaguacuccuccgacuccgagaaggaggacgaccucgagaacguccuccucaucgacuccgaguccccccacaaguaccacguccaguucgccuccgacgcccgccagaucauggagcgccucaucgacccccgcaccaaguccaccgagaccauccuccacaccccccagaagcccaccgccaaguucccccgcacccccgagaacuccgccaagaagaagcuccuccgcggcggccucgccgagcgccucaacggccuccagaaccgcgagcgcuccgccaucucccucuggcgccaccagugcaucuccuaccagaagacccucuccggccgcaaguccggcguccucaccgucaagauccucgagcuccacgaggagugcgccaugcaggucgccaugugcgagcagcuccucggcucccccgccaccuccuccucccaguccgucgccccccgccccggcgccggccucaagguccucuucaccaaggagaccgccggcuaccuccgcggccgcccccaggacaccguccgcaucuucccccccuggcagaagcucaucauccccuccggcuccugccccgucauccucaacaccuacuucugcgagaaggucgucgccaaggaggacuccgagaagaccugcgaggucuacugccccgacaucccccucccccgccgcuccaucucccucgcccagauguucgucaucaagggccucaccaacaacucccccgagauccaggucgucugcuccggcgucgccaccaccggcaccgccuggacccacggccacaaggaggccaagcagcgcauccccaccuccaccccccuccgcgacucccuccucgacgucgucgagucccagggcgccgccuccuggcccggcgccggcguccgcgucgucguccagcgcgucuacucccuccccucccgcgacuccacccgcggccagcagggcgccuccuccggccacaccgaccccgccggcacccgcgccugccuccucguccaggacgccugcggcauguucggcgagguccaccucgaguucaccauguccaaggcccgccagcucgagggcaaguccugcucccucgucggcaugaagguccuccagaaggucacccgcggccgcaccgccggcaucuucucccucaucgacacccucuggccccccgccaucccccucaagacccccggccgcgaccagcccugcgaggagaucaagacccaccuccccccccccgcccucugcuacauccucaccgcccaccccaaccucggccagaucgacaucaucgacgaggaccccaucuacaagcucuaccagccccccgucacccgcugccuccgcgacauccuccagaugaacgaccucggcacccgcugcuccuucuacgccaccgucaucuaccagaagccccagcucaagucccuccuccuccucgagcagcgcgagaucuggcuccucgucaccgacgucacccuccagaccaaggaggagcgcgacccccgccuccccaagacccuccucgucuacgucgccccccucugcguccucggcuccgagguccucgaggcccucgccggcgccgccccccacucccucuucuucaaggacgcccuccgcgaccagggccgcaucgucugcgccgagcgcaccguccuccuccuccagaagccccuccucuccgucgucuccggcgccuccuccugcgagcuccccggccccgucaugcucgacucccucgacuccgccacccccgucaacuccaucugcuccguccagggcaccgucgucggcgucgacgaguccaccgccuucuccuggcccgucugcgacaugugcggcaacggccgccucgagcagcgccccgaggaccgcggcgccuucuccugcggcgacugcucccgcgucgucaccucccccguccucaagcgccaccuccaggucuuccucgacugccgcucccgcccccagugccgcgucaaggucaagcuccuccagcgcuccaucuccucccuccuccgcuucgccgccggcgaggacggcuccuacgaggucaaguccguccucggcaaggaggucggccuccucaacugcuucguccaguccgucaccgcccaccccaccuccugcaucggccucgaggagaucgagcuccucuccgccggcggcgccuccgccgagcacuga

SEQ ID NO: 50064 - RNA, 789 nt, Artificial Sequence
  derived and/or modified sequence opt2 from SPIN1__Homo_sapiens__NP_006708
augaagacccccuucggcaagacccccggccagcgcucccgcgccgacgccggccacgccggcgucuccgccaacaugaugaagaagcgcaccucccacaagaagcaccgcuccuccgucggccccuccaagcccgucucccagccccgccgcaacaucgucggcugccgcauccagcacggcuggaaggagggcaacggccccgucacccaguggaagggcaccguccucgaccagguccccgucaaccccucccucuaccucaucaaguacgacggcuucgacugcgucuacggccucgagcucaacaaggacgagcgcgucuccgcccucgagguccuccccgaccgcgucgccaccucccgcaucuccgacgcccaccucgccgacaccaugaucggcaaggccgucgagcacauguucgagaccgaggacggcuccaaggacgaguggcgcggcaugguccucgcccgcgcccccgucaugaacaccugguucuacaucaccuacgagaaggaccccguccucuacauguaccagcuccucgacgacuacaaggagggcgaccuccgcaucaugcccgacuccaacgacuccccccccgccgagcgcgagcccggcgaggucgucgacucccucgucggcaagcaggucgaguacgccaaggaggacggcuccaagcgcaccggcauggucauccaccaggucgaggccaagcccuccgucuacuucaucaaguucgacgacgacuuccacaucuacgucuacgaccucgucaagaccuccuga

SEQ ID NO: 50065 - RNA, 777 nt, Artificial Sequence
  derived and/or modified sequence opt2 from SPIN2A__Homo_sapiens__NP_061876
augaagacccccaacgcccaggaggccgagggccagcagacccgcgccgccgccggccgcgccaccggcuccgccaacaugaccaagaagaaggucucccagaagaagcagcgcggccgccccuccucccagccccgccgcaacaucgucggcugccgcaucucccacggcuggaaggagggcgacgagcccaucacccaguggaagggcaccguccucgaccagguccccaucaaccccucccucuaccucgucaaguacgacggcaucgacugcgucuacggccucgagcuccaccgcgacgagcgcguccucucccucaagauccucuccgaccgcgucgccuccucccacaucuccgacgccaaccucgccaacaccaucaucggcaaggccgucgagcacauguucgagggcgagcacggcuccaaggacgaguggcgcggcaugguccucgcccaggcccccaucaugaaggccugguucuacaucaccuacgagaaggaccccguccucuacauguaccagcuccucgacgacuacaaggagggcgaccuccgcaucaugcccgaguccuccgaguccccccccaccgagcgcgagcccggcggcgucgucgacggccucaucggcaagcacgucgaguacaccaaggaggacggcuccaagcgcaucggcauggucauccaccaggucgagaccaagcccuccgucuacuucaucaaguucgacgacgacuuccacaucuacgucuacgaccucgucaagaaguccuga

SEQ ID NO: 50066 - RNA, 240 nt, Artificial Sequence
  derived and/or modified sequence opt2 from SPINK1__Homo_sapiens__NP_003113
augaaggucaccggcaucuuccuccucuccgcccucgcccuccucucccucuccggcaacaccggcgccgacucccucggccgcgaggccaagugcuacaacgagcucaacggcugcaccaagaucuacgaccccgucugcggcaccgacggcaacaccuaccccaacgagugcguccucugcuucgagaaccgcaagcgccagaccuccauccucauccagaaguccggccccugcuga

SEQ ID NO: 50067 - RNA, 405 nt, Artificial Sequence
  derived and/or modified sequence opt2 from SPINK2__Homo_sapiens__NP_001258647
auggcccucuccguccuccgccucgcccuccuccuccucgccgucaccuucgccggcuccgcccgcuccggccccggcgagcgcggcccccccgagaaguccggcuucggcucccagaccggcggcggccccugccccgcccccggcggccucggcgacggcacccgcgcccccgucaccggcggcucccccgaggaccuccccgccucccucaucccccaguucggccucuucuccaaguaccgcacccccaacugcucccaguaccgccuccccggcugcccccgccacuucaaccccgucugcggcuccgacauguccaccuacgccaacgagugcacccucugcaugaagauccgcgagggcggccacaacaucaagaucauccgcaacggccccugcuga

SEQ ID NO: 50068 - RNA, 261 nt, Artificial Sequence
  derived and/or modified sequence opt2 from SPINK4__Homo_sapiens__NP_055286
auggccguccgccagugggucaucgcccucgcccucgccgcccuccucgucgucgaccgcgagguccccgucgccgccggcaagcuccccuucucccgcaugcccaucugcgagcacauggucgagucccccaccugcucccagauguccaaccucgucugcggcaccgacggccucaccuacaccaacgagugccagcucugccucgcccgcaucaagaccaagcaggacauccagaucaugaaggacggcaagugcuga

SEQ ID NO: 50069 - RNA, 3285 nt, Artificial Sequence
  derived and/or modified sequence opt2 from SPINK5__Homo_sapiens__NP_001121170
augaagaucgccaccgucuccguccuccucccccucgcccucugccucauccaggacgccgccuccaagaacgaggaccaggagaugugccacgaguuccaggccuucaugaagaacggcaagcucuucugcccccaggacaagaaguucuuccagucccucgacggcaucauguucaucaacaagugcgccaccugcaagaugauccucgagaaggaggccaagucccagaagcgcgcccgccaccucgcccgcgcccccaaggccaccgcccccaccgagcucaacugcgacgacuucaagaagggcgagcgcgacggcgacuucaucugccccgacuacuacgaggccgucugcggcaccgacggcaagaccuacgacaaccgcugcgcccucugcgccgagaacgccaagaccggcucccagaucggcgucaaguccgagggcgagugcaaguccuccaaccccgagcaggacgucugcuccgccuuccgccccuucguccgcgacggccgccucggcugcacccgcgagaacgaccccguccucggccccgacggcaagacccacggcaacaagugcgccaugugcgccgagcucuuccucaaggaggccgagaacgccaagcgcgagggcgagacccgcauccgccgcaacgccgagaaggacuucugcaaggaguacgagaagcagguccgcaacggccgccucuucugcacccgcgaguccgaccccguccgcggccccgacggccgcaugcacggcaacaagugcgcccucugcgccgagaucuucaagcagcgcuucuccgaggagaacuccaagaccgaccagaaccucggcaaggccgaggagaagaccaaggucaagcgcgagaucgucaagcucugcucccaguaccagaaccaggccaagaacggcauccucuucugcacccgcgagaacgaccccauccgcggccccgacggcaagaugcacggcaaccucugcuccaugugccaggccuacuuccaggccgagaacgaggagaagaagaaggccgaggcccgcgcccgcaacaagcgcgaguccggcaaggccaccuccuacgccgagcucugcuccgaguaccgcaagcucguccgcaacggcaagcucgccugcacccgcgagaacgaccccauccagggccccgacggcaagguccacggcaacaccugcuccaugugcgaggucuucuuccaggccgaggaggaggagaagaagaagaaggagggcaagucccgcaacaagcgccaguccaaguccaccgccuccuucgaggagcucugcuccgaguaccgcaagucccgcaagaacggccgccucuucugcacccgcgagaacgaccccauccagggccccgacggcaagaugcacggcaacaccugcuccaugugcgaggccuucuuccagcaggaggagcgcgcccgcgccaaggccaagcgcgaggccgccaaggagaucugcuccgaguuccgcgaccagguccgcaacggcacccucaucugcacccgcgagcacaaccccguccgcggccccgacggcaagaugcacggcaacaagugcgccaugugcgccuccgucuucaagcucgaggaggaggagaagaagaacgacaaggaggagaagggcaaggucgaggccgagaaggucaagcgcgaggccguccaggagcucugcuccgaguaccgccacuacguccgcaacggccgccuccccugcacccgcgagaacgaccccaucgagggccucgacggcaagauccacggcaacaccugcuccaugugcgaggccuucuuccagcaggaggccaaggagaaggagcgcgccgagccccgcgccaaggucaagcgcgaggccgagaaggagaccugcgacgaguuccgccgccuccuccagaacggcaagcucuucugcacccgcgagaacgaccccguccgcggccccgacggcaagacccacggcaacaagugcgccaugugcaaggccgucuuccagaaggagaacgaggagcgcaagcgcaaggaggaggaggaccagcgcaacgccgccggccacggcuccuccggcggcggcggcggcaacacccaggacgagugcgccgaguaccgcgagcagaugaagaacggccgccucuccugcacccgcgaguccgaccccguccgcgacgccgacggcaaguccuacaacaaccagugcaccaugugcaaggccaagcucgagcgcgaggccgagcgcaagaacgaguacucccgcucccgcuccaacggcaccggcuccgaguccggcaaggacaccugcgacgaguuccgcucccagaugaagaacggcaagcucaucugcacccgcgaguccgaccccguccgcggccccgacggcaagacccacggcaacaagugcaccaugugcaaggagaagcucgagcgcgaggccgccgagaagaagaagaaggaggacgaggaccgcuccaacaccggcgagcgcuccaacaccggcgagcgcuccaacgacaaggaggaccucugccgcgaguuccgcuccaugcagcgcaacggcaagcucaucugcacccgcgagaacaaccccguccgcggccccuacggcaagaugcacaucaacaagugcgccaugugccaguccaucuucgaccgcgaggccaacgagcgcaagaagaaggacgaggagaaguccuccuccaagcccuccaacaacgccaaggaccagugccgccagguccagaacgaggccgaggacgccaaguuccgccagcccggccgcucccucgccuccgucgcccgcauguccaccgacgagugcuccgaguuccgcaacuacauccgcaacaacgagcucaucugcccccgcgagaacgaccccguccacggcgccgacggcaaguucuacaccaacaagugcuacaugugccgcgccgucuuccucaccgaggcccucgagcgcgccaagcuccaggagaagcccucccacguccgcgccucccaggaggaggacucccccgacuccuucuccucccucgacuccgagaugugcaaggacuaccgcguccucccccgcaucggcuaccucugccccaaggaccucaagcccgucugcggcgacgacggccagaccuacaacaaccccugcaugcucugccacgagaaccucauccgccagaccaacacccacauccgcuccaccggcaagugcgaggaguccuccacccccggcaccaccgccgccuccaugccccccuccgacgaguga

SEQ ID NO: 50070 - RNA, 243 nt, Artificial Sequence
  derived and/or modified sequence opt2 from SPINK6__Homo_sapiens__NP_001182219
augaagcucuccggcauguuccuccuccucucccucgcccucuucugcuuccucaccggcgucuucucccagggcggccaggucgacugcggcgaguuccaggaccccaaggucuacugcacccgcgaguccaacccccacugcggcuccgacggccagaccuacggcaacaagugcgccuucugcaaggccaucgucaaguccggcggcaagaucucccucaagcaccccggcaagugcuga

SEQ ID NO: 50071 - RNA, 258 nt, Artificial Sequence
  derived and/or modified sequence opt2 from SPINK7__Homo_sapiens__NP_115955
augaagaucaccggcggccuccuccuccucugcaccgucgucuacuucugcuccuccuccgaggccgccucccucucccccaagaaggucgacugcuccaucuacaagaaguaccccgucgucgccauccccugccccaucaccuaccuccccgucugcggcuccgacuacaucaccuacggcaacgagugccaccucugcaccgagucccucaaguccaacggccgcguccaguuccuccacgacggcuccugcuga

SEQ ID NO: 50072 - RNA, 1542 nt, Artificial Sequence
  derived and/or modified sequence opt2 from SPINT1__Homo_sapiens__NP_001027539
auggcccccgcccgcaccauggcccgcgcccgccucgcccccgccggcauccccgccgucgcccucuggcuccucugcacccucggccuccagggcacccaggccggccccccccccgccccccccggccuccccgccggcgccgacugccucaacuccuucaccgccggcguccccggcuucguccucgacaccaacgccuccgucuccaacggcgccaccuuccucgagucccccaccguccgccgcggcugggacugcguccgcgccugcugcaccacccagaacugcaaccucgcccucgucgagcuccagcccgaccgcggcgaggacgccaucgccgccugcuuccucaucaacugccucuacgagcagaacuucgucugcaaguucgccccccgcgagggcuucaucaacuaccucacccgcgaggucuaccgcuccuaccgccagcuccgcacccagggcuucggcggcuccggcauccccaaggccugggccggcaucgaccucaagguccagccccaggagccccucguccucaaggacgucgagaacaccgacuggcgccuccuccgcggcgacaccgacguccgcgucgagcgcaaggaccccaaccaggucgagcucuggggccucaaggagggcaccuaccucuuccagcucaccgucaccuccuccgaccaccccgaggacaccgccaacgucaccgucaccguccucuccaccaagcagaccgaggacuacugccucgccuccaacaaggucggccgcugccgcggcuccuucccccgcugguacuacgaccccaccgagcagaucugcaaguccuucgucuacggcggcugccucggcaacaagaacaacuaccuccgcgaggaggagugcauccucgccugccgcggcguccagggccccuccauggagcgccgccaccccgucugcuccggcaccugccagcccacccaguuccgcugcuccaacggcugcugcaucgacuccuuccucgagugcgacgacacccccaacugccccgacgccuccgacgaggccgccugcgagaaguacaccuccggcuucgacgagcuccagcgcauccacuuccccuccgacaagggccacugcgucgaccuccccgacaccggccucugcaaggaguccaucccccgcugguacuacaaccccuucuccgagcacugcgcccgcuucaccuacggcggcugcuacggcaacaagaacaacuucgaggaggagcagcagugccucgaguccugccgcggcaucuccaagaaggacgucuucggccuccgccgcgagauccccauccccuccaccggcuccgucgagauggccgucgccgucuuccucgucaucugcaucgucgucgucgucgccauccucggcuacugcuucuucaagaaccagcgcaaggacuuccacggccaccaccaccaccccccccccacccccgccuccuccaccgucuccaccaccgaggacaccgagcaccucgucuacaaccacaccacccgcccccucuga

SEQ ID NO: 50073 - RNA, 588 nt, Artificial Sequence
  derived and/or modified sequence opt2 from SPINT2__Homo_sapiens__NP_001159575
auggcccagcucugcggccuccgccgcucccgcgccuuccucgcccuccucggcucccuccuccucuccggcguccucgccgccgaccgcgagcgcuccauccacgagaacgccaccggcgaccucgccaccucccgcaacgccgccgacuccuccguccccuccgccccccgccgccaggacuccgaggaccacuccuccgacauguucaacuacgaggaguacugcaccgccaacgccgucaccggccccugccgcgccuccuucccccgcugguacuucgacgucgagcgcaacuccugcaacaacuucaucuacggcggcugccgcggcaacaagaacuccuaccgcuccgaggaggccugcaugcuccgcugcuuccgccagcaggagaaccccccccucccccucggcuccaaggucgucguccucgccggccucuucgucaugguccucauccucuuccucggcgccuccauggucuaccucauccgcgucgcccgccgcaaccaggagcgcgcccuccgcaccgucugguccuccggcgacgacaaggagcagcucgucaagaacaccuacguccucuga

SEQ ID NO: 50074 - RNA, 1365 nt, Artificial Sequence
  derived and/or modified sequence opt2 from SPNS1__Homo_sapiens__NP_001135921
auggccggcuccgacaccgcccccuuccucucccaggccgacgaccccgacgacggccccguccccggcacccccggccuccccggcuccaccggcaaccccaaguccgaggagcccgagguccccgaccaggagggccuccagcgcaucaccggccucucccccggccgcuccgcccucaucgucgccguccucugcuacaucaaccuccucaacuacauggaccgcuucaccgucgccgucuucaucuccuccuacaugguccucgcccccgucuucggcuaccucggcgaccgcuacaaccgcaaguaccucaugugcggcggcaucgccuucuggucccucgucacccucggcuccuccuucauccccggcgagcacuucuggcuccuccuccucacccgcggccucgucggcgucggcgaggccuccuacuccaccaucgcccccacccucaucgccgaccucuucgucgccgaccagcgcucccgcaugcucuccaucuucuacuucgccauccccgucggcuccggccucggcuacaucgccggcuccaaggucaaggacauggccggcgacuggcacugggcccuccgcgucacccccggccucggcgucgucgccguccuccuccucuuccucgucguccgcgagcccccccgcggcgccgucgagcgccacuccgaccuccccccccucaaccccaccuccuggugggccgaccuccgcgcccucgcccgcaaccucaucuucggccucaucaccugccucaccggcguccucggcgucggccucggcgucgagaucucccgccgccuccgccacuccaacccccgcgccgacccccucgucugcgccaccggccuccucggcuccgcccccuuccucuuccucucccucgccugcgcccgcggcuccaucgucgccaccuacaucuucaucuucaucggcgagacccuccucuccaugaacugggccaucgucgccgacauccuccucuacgucgucauccccacccgccgcuccaccgccgaggccuuccagaucguccucucccaccuccucggcgacgccggcucccccuaccucaucggccucaucuccgaccgccuccgccgcaacuggccccccuccuuccucuccgaguuccgcgcccuccaguucucccucaugcucugcgccuucgucggcgcccucggcggcgccgccuuccucggcaccgccaucuucaucgaggccgaccgccgccgcgcccagcuccacguccagggccuccuccacgaggccggcuccaccgacgaccgcaucgucgucccccagcgcggccgcuccacccgcguccccgucgccuccguccucaucuga

SEQ ID NO: 50075 - RNA, 1650 nt, Artificial Sequence
  derived and/or modified sequence opt2 from SPNS2__Homo_sapiens__NP_001118230
augaugugccucgagugcgccuccgccgccgccggcggcgccgaggaggaggaggccgacgccgagcgccgccgccgccgccgcggcgcccagcgcggcgccggcggcuccggcugcugcggcgcccgcggcgccggcggcgccggcgucuccgccgccggcgacgagguccagacccucuccggcuccguccgccgcgcccccaccggcccccccggcacccccggcacccccggcugcgccgccaccgccaagggccccggcgcccagcagcccaagcccgccucccucggccgcggccgcggcgccgccgccgccauccucucccucggcaacguccucaacuaccucgaccgcuacaccgucgccggcguccuccucgacauccagcagcacuucggcgucaaggaccgcggcgccggccuccuccaguccgucuucaucugcuccuucauggucgccgcccccaucuucggcuaccucggcgaccgcuucaaccgcaaggucauccucuccugcggcaucuucuucugguccgccgucaccuucuccuccuccuucaucccccagcaguacuucuggcuccucguccucucccgcggccucgucggcaucggcgaggccuccuacuccaccaucgcccccaccaucaucggcgaccucuucaccaagaacacccgcacccucaugcucuccgucuucuacuucgccaucccccucggcuccggccucggcuacaucaccggcuccuccgucaagcaggccgccggcgacuggcacugggcccuccgcgucucccccguccucggcaugaucaccggcacccucauccucauccucguccccgccaccaagcgcggccacgccgaccagcucggcgaccagcucaaggcccgcaccuccuggcuccgcgacaugaaggcccucauccgcaaccgcuccuacgucuucuccucccucgccaccuccgccgucuccuucgccaccggcgcccucggcauguggaucccccucuaccuccaccgcgcccaggucguccagaagaccgccgagaccugcaacuccccccccugcggcgccaaggacucccucaucuucggcgccaucaccugcuucaccggcuuccucggcgucgucaccggcgccggcgccacccgcuggugccgccucaagacccagcgcgccgacccccucgucugcgccgucggcaugcucggcuccgccaucuucaucugccucaucuucgucgccgccaaguccuccaucgucggcgccuacaucugcaucuucgucggcgagacccuccucuucuccaacugggccaucaccgccgacauccucauguacgucgucauccccacccgccgcgccaccgccgucgcccuccaguccuucaccucccaccuccucggcgacgccggcucccccuaccucaucggcuucaucuccgaccucauccgccaguccaccaaggacuccccccucugggaguuccucucccucggcuacgcccucaugcucugccccuucgucgucguccucggcggcauguucuuccucgccaccgcccucuucuucgucuccgaccgcgcccgcgccgagcagcaggucaaccagcucgccaugccccccgccuccgucaaggucuga

SEQ ID NO: 50076 - RNA, 1191 nt, Artificial Sequence
  derived and/or modified sequence opt2 from SPO11__Homo_sapiens__NP_036576
auggccuucgcccccaugggccccgaggccuccuucuucgacguccucgaccgccaccgcgagucccuccucgccgcccuccgccgcggcggccgcgagccccccaccggcggcucccgccucgccuccuccuccgagguccucgccuccaucgagaacaucauccaggacaucaucaccucccucgcccgcaacgaggcccccgccuucaccaucgacaaccgcuccuccugggagaacaucaaguucgaggacuccgucggccuccagauggucucccacugcaccacccgcaagaucaaguccgacucccccaaguccgcccagaaguucucccucauccucaagauccucuccaugaucuacaagcucguccaguccaacaccuacgccaccaagcgcgacaucuacuacaccgacucccagcucuucggcaaccagaccgucgucgacaacaucaucaacgacaucuccugcaugcucaaggucucccgccgcucccuccacauccucuccaccuccaagggccucaucgccggcaaccuccgcuacaucgaggaggacggcaccaaggucaacugcaccugcggcgccaccgccgucgccguccccuccaacauccagggcauccgcaaccucgucaccgacgccaaguucguccucaucgucgagaaggacgccaccuuccagcgccuccucgacgacaacuucugcaacaagcucucccccugcaucaugaucaccggcaagggcguccccgaccucaacacccgccuccucgucaagaagcucugggacaccuuccacguccccgucuucacccucgucgacgccgacccccacggcaucgagaucaugugcaucuacaaguacggcuccauguccauguccuucgaggcccaccaccucaccguccccgccauccgcuggcucggccuccuccccuccgaccucaagcgccucaacguccccaaggacucccucaucccccucaccaagcgcgaccagaugaagcucgacuccauccuccgccgccccuacgucaccugccagcccuucuggcgcaaggagauggagaucauggccgacuccaagaugaaggccgagauccaggcccucaccuuccucuccuccgacuaccucucccgcgucuaccuccccaacaagcucaaguucggcggcuggaucuga

SEQ ID NO: 50077 - RNA, 1320 nt, Artificial Sequence
  derived and/or modified sequence opt2 from SPOCK1__Homo_sapiens__NP_004589
augcccgccaucgccguccucgccgccgccgccgccgccuggugcuuccuccaggucgagucccgccaccucgacgcccucgccggcggcgccggccccaaccacggcaacuuccucgacaacgaccaguggcucuccaccgucucccaguacgaccgcgacaaguacuggaaccgcuuccgcgacgacgacuacuuccgcaacuggaaccccaacaagcccuucgaccaggcccucgaccccuccaaggaccccugccucaaggucaagugcuccccccacaaggucugcgucacccaggacuaccagaccgcccucugcgucucccgcaagcaccuccucccccgccagaagaagggcaacgucgcccagaagcacugggucggccccuccaaccucgucaagugcaagcccugccccgucgcccaguccgccauggucugcggcuccgacggccacuccuacaccuccaagugcaagcucgaguuccacgccugcuccaccggcaagucccucgccacccucugcgacggccccugccccugccuccccgagcccgagccccccaagcacaaggccgagcgcuccgccugcaccgacaaggagcuccgcaaccucgccucccgccucaaggacugguucggcgcccuccacgaggacgccaaccgcgucaucaagcccaccuccuccaacaccgcccagggccgcuucgacaccuccauccuccccaucugcaaggacucccucggcuggauguucaacaagcucgacaugaacuacgaccuccuccucgaccccuccgagaucaacgccaucuaccucgacaaguacgagcccugcaucaagccccucuucaacuccugcgacuccuucaaggacggcaagcucuccaacaacgaguggugcuacugcuuccagaagcccggcggccuccccugccagaacgagaugaaccgcauccagaagcucuccaagggcaagucccuccucggcgccuucaucccccgcugcaacgaggagggcuacuacaaggccacccagugccacggcuccaccggccagugcuggugcgucgacaaguacggcaacgagcucgccggcucccgcaagcagggcgccgucuccugcgaggaggagcaggagaccuccggcgacuucggcuccggcggcuccgucguccuccucgacgaccucgaguacgagcgcgagcucggccccaaggacaaggagggcaagcuccgcguccacacccgcgccgucaccgaggacgacgaggacgaggacgacgacaaggaggacgaggucggcuacaucugguga

SEQ ID NO: 50078 - RNA, 234 nt, Artificial Sequence
  derived and/or modified sequence opt2 from SPOCK2__Homo_sapiens__NP_001127906
augcgcgcccccggcugcggccgccucguccucccccuccuccuccucgccgccgccgcccucgccgagggcgacgccaagggccucaaggagggcgagacccccggcaacuucauggaggacgagcaguggcucuccuccaucucccaguacuccggcaagaucaagcacuggaaccgcuuccgcgacguccccuccuccgacccccccuccaccacccaggccacccccuga

SEQ ID NO: 50079 - RNA, 1302 nt, Artificial Sequence
  derived and/or modified sequence opt2 from SPOCK3__Homo_sapiens__NP_001035249
augcucaaggucuccgccguccucugcgucugcgccgccgccuggugcucccagucccucgccgccgccgccgccgucgccgccgccggcggccgcuccgacggcggcaacuuccucgacgacaagcaguggcucaccaccaucucccaguacgacaaggaggucggccaguggaacaaguuccgcgacgacgacuacuuccgcaccuggucccccggcaagcccuucgaccaggcccucgaccccgccaaggaccccugccucaagaugaagugcucccgccacaaggucugcaucgcccaggacucccagaccgccgucugcaucucccaccgccgccucacccaccgcaugaaggaggccggcgucgaccaccgccaguggcgcggccccauccucuccaccugcaagcagugccccgucgucuaccccucccccgucugcggcuccgacggccacaccuacuccuuccagugcaagcucgaguaccaggccugcguccucggcaagcagaucuccgucaagugcgagggccacugccccugccccuccgacaagcccaccuccaccucccgcaacgucaagcgcgccugcuccgaccucgaguuccgcgaggucgccaaccgccuccgcgacugguucaaggcccuccacgaguccggcucccagaacaagaagaccaagacccuccuccgccccgagcgcucccgcuucgacaccuccauccuccccaucugcaaggacucccucggcuggauguucaaccgccucgacaccaacuacgaccuccuccucgaccaguccgagcuccgcuccaucuaccucgacaagaacgagcagugcaccaaggccuucuucaacuccugcgacaccuacaaggacucccucaucuccaacaacgaguggugcuacugcuuccagcgccagcaggacccccccugccagaccgagcucuccaacauccagaagcgccagggcgucaagaagcuccucggccaguacaucccccucugcgacgaggacggcuacuacaagcccacccagugccacggcuccgucggccagugcuggugcgucgaccgcuacggcaacgaggucaugggcucccgcaucaacggcgucgccgacugcgccaucgacuucgagaucuccggcgacuucgccuccggcgacuuccacgaguggaccgacgacgaggacgacgaggacgacaucaugaacgacgaggacgagaucgaggacgacgacgaggacgagggcgacgacgacgacggcggcgacgaccacgacgucuacaucuga

SEQ ID NO: 50080 - RNA, 2424 nt, Artificial Sequence
  derived and/or modified sequence opt2 from SPON1__Homo_sapiens__NP_006099
augcgccucucccccgccccccucaagcucucccgcacccccgcccuccucgcccucgcccucccccucgccgccgcccucgccuucuccgacgagacccucgacaagguccccaaguccgagggcuacugcucccgcauccuccgcgcccagggcacccgccgcgagggcuacaccgaguucucccuccgcgucgagggcgaccccgacuucuacaagcccggcaccuccuaccgcgucacccucuccgccgccccccccuccuacuuccgcggcuucacccucaucgcccuccgcgagaaccgcgagggcgacaaggaggaggaccacgccggcaccuuccagaucaucgacgaggaggagacccaguucauguccaacugccccgucgccgucaccgaguccaccccccgccgccgcacccgcauccaggucuucuggaucgccccccccgccggcaccggcugcgucauccucaaggccuccaucguccagaagcgcaucaucuacuuccaggacgagggcucccucaccaagaagcucugcgagcaggacuccaccuucgacggcgucaccgacaagcccauccucgacugcugcgccugcggcaccgccaaguaccgccucaccuucuacggcaacugguccgagaagacccaccccaaggacuacccccgccgcgccaaccacugguccgccaucaucggcggcucccacuccaagaacuacguccucugggaguacggcggcuacgccuccgagggcgucaagcaggucgccgagcucggcucccccgucaagauggaggaggagauccgccagcaguccgacgagguccucaccgucaucaaggccaaggcccaguggcccgccuggcagccccucaacguccgcgccgcccccuccgccgaguucuccgucgaccgcacccgccaccucauguccuuccucaccaugaugggccccucccccgacuggaacgucggccucuccgccgaggaccucugcaccaaggagugcggcuggguccagaaggucguccaggaccucauccccugggacgccggcaccgacuccggcgucaccuacgagucccccaacaagcccaccaucccccaggagaagauccgcccccucaccucccucgaccacccccagucccccuucuacgaccccgagggcggcuccaucacccaggucgcccgcgucgucaucgagcgcaucgcccgcaagggcgagcagugcaacaucguccccgacaacgucgacgacaucgucgccgaccucgcccccgaggagaaggacgaggacgacacccccgagaccugcaucuacuccaacuggucccccugguccgccugcuccuccuccaccugcgacaagggcaagcgcaugcgccagcgcaugcucaaggcccagcucgaccucuccguccccugccccgacacccaggacuuccagcccugcaugggccccggcugcuccgacgaggacggcuccaccugcaccauguccgaguggaucaccuggucccccugcuccaucuccugcggcaugggcaugcgcucccgcgagcgcuacgucaagcaguuccccgaggacggcuccgucugcacccuccccaccgaggagaccgagaagugcaccgucaacgaggagugcucccccuccuccugccucaugaccgaguggggcgagugggacgagugcuccgccaccugcggcaugggcaugaagaagcgccaccgcaugaucaagaugaaccccgccgacggcuccaugugcaaggccgagaccucccaggccgagaagugcaugaugcccgagugccacaccauccccugccuccucucccccugguccgagugguccgacugcuccgucaccugcggcaagggcaugcgcacccgccagcgcaugcucaagucccucgccgagcucggcgacugcaacgaggaccucgagcaggucgagaagugcaugcuccccgagugccccaucgacugcgagcucaccgaguggucccagugguccgagugcaacaaguccugcggcaagggccacgucauccgcacccgcaugauccagauggagccccaguucggcggcgcccccugccccgagaccguccagcgcaagaagugccgcauccgcaagugccuccgcaaccccuccauccagaagcuccgcuggcgcgaggcccgcgagucccgccgcuccgagcagcucaaggaggaguccgagggcgagcaguuccccggcugccgcaugcgccccuggaccgccugguccgagugcaccaagcucugcggcggcggcauccaggagcgcuacaugaccgucaagaagcgcuucaaguccucccaguucaccuccugcaaggacaagaaggagauccgcgccugcaacguccaccccugcuga

SEQ ID NO: 50081 - RNA, 996 nt, Artificial Sequence
  derived and/or modified sequence opt2 from SPON2__Homo_sapiens__NP_001185950
auggagaaccccucccccgccgccgcccucggcaaggcccucugcgcccuccuccucgccacccucggcgccgccggccagccccucggcggcgaguccaucugcuccgcccgcgcccccgccaaguacuccaucaccuucaccggcaaguggucccagaccgccuuccccaagcaguacccccucuuccgcccccccgcccagugguccucccuccucggcgccgcccacuccuccgacuacuccauguggcgcaagaaccaguacgucuccaacggccuccgcgacuucgccgagcgcggcgaggccugggcccucaugaaggagaucgaggccgccggcgaggcccuccaguccguccacgccgucuucuccgcccccgccguccccuccggcaccggccagaccuccgccgagcucgagguccagcgccgccacucccucgucuccuucgucguccgcaucguccccucccccgacugguucgucggcgucgacucccucgaccucugcgacggcgaccgcuggcgcgagcaggccgcccucgaccucuaccccuacgacgccggcaccgacuccggcuucaccuucuccucccccaacuucgccaccaucccccaggacaccgucaccgagaucaccuccuccucccccucccaccccgccaacuccuucuacuacccccgccucaaggcccucccccccaucgcccgcgucacccucguccgccuccgccaguccccccgcgccuucaucccccccgcccccguccuccccucccgcgacaacgagaucgucgacuccgccuccguccccgagaccccccucgacugcgaggucucccucugguccuccuggggccucugcggcggccacugcggccgccucggcaccaagucccgcacccgcuacguccgcguccagcccgccaacaacggcucccccugccccgagcucgaggaggaggccgagugcguccccgacaacugcgucuga

SEQ ID NO: 50082 - RNA, 1125 nt, Artificial Sequence
  derived and/or modified sequence opt2 from SPOP__Homo_sapiens__NP_003554
augucccgcguccccuccccccccccccccgccgagauguccuccggccccgucgccgaguccuggugcuacacccagaucaaggucgucaaguucuccuacauguggaccaucaacaacuucuccuucugccgcgaggagaugggcgaggucaucaaguccuccaccuucuccuccggcgccaacgacaagcucaaguggugccuccgcgucaaccccaagggccucgacgaggaguccaaggacuaccucucccucuaccuccuccucgucuccugccccaaguccgagguccgcgccaaguucaaguucuccauccucaacgccaagggcgaggagaccaaggccauggagucccagcgcgccuaccgcuucguccagggcaaggacuggggcuucaagaaguucauccgccgcgacuuccuccucgacgaggccaacggccuccuccccgacgacaagcucacccucuucugcgaggucuccgucguccaggacuccgucaacaucuccggccagaacaccaugaacauggucaagguccccgagugccgccucgccgacgagcucggcggccucugggagaacucccgcuucaccgacugcugccucugcgucgccggccaggaguuccaggcccacaaggccauccucgccgcccgcucccccgucuucuccgccauguucgagcacgagauggaggaguccaagaagaaccgcgucgagaucaacgacgucgagcccgaggucuucaaggagaugaugugcuucaucuacaccggcaaggcccccaaccucgacaagauggccgacgaccuccucgccgccgccgacaaguacgcccucgagcgccucaaggucaugugcgaggacgcccucugcuccaaccucuccgucgagaacgccgccgagauccucauccucgccgaccuccacuccgccgaccagcucaagacccaggccgucgacuucaucaacuaccacgccuccgacguccucgagaccuccggcuggaaguccauggucgucucccacccccaccucgucgccgaggccuaccgcucccucgccuccgcccagugccccuuccucggccccccccgcaagcgccucaagcaguccuga

SEQ ID NO: 50083 - RNA, 903 nt, Artificial Sequence
  derived and/or modified sequence opt2 from SPP1__Homo_sapiens__NP_000573
augcgcaucgccgucaucugcuucugccuccucggcaucaccugcgccauccccgucaagcaggccgacuccggcuccuccgaggagaagcagcucuacaacaaguaccccgacgccgucgccaccuggcucaaccccgaccccucccagaagcagaaccuccucgccccccagacccuccccuccaaguccaacgagucccacgaccacauggacgacauggacgacgaggacgacgacgaccacgucgacucccaggacuccaucgacuccaacgacuccgacgacgucgacgacaccgacgacucccaccaguccgacgagucccaccacuccgacgaguccgacgagcucgucaccgacuuccccaccgaccuccccgccaccgaggucuucacccccgucguccccaccgucgacaccuacgacggccgcggcgacuccgucgucuacggccuccgcuccaaguccaagaaguuccgccgccccgacauccaguaccccgacgccaccgacgaggacaucaccucccacauggaguccgaggagcucaacggcgccuacaaggccauccccgucgcccaggaccucaacgcccccuccgacugggacucccgcggcaaggacuccuacgagaccucccagcucgacgaccaguccgccgagacccacucccacaagcagucccgccucuacaagcgcaaggccaacgacgaguccaacgagcacuccgacgucaucgacucccaggagcucuccaaggucucccgcgaguuccacucccacgaguuccacucccacgaggacaugcucgucgucgaccccaaguccaaggaggaggacaagcaccucaaguuccgcaucucccacgagcucgacuccgccuccuccgaggucaacuga

SEQ ID NO: 50084 - RNA, 636 nt, Artificial Sequence
  derived and/or modified sequence opt2 from SPP2__Homo_sapiens__NP_008875
augaucucccgcauggagaagaugaccaugaugaugaagauccucaucauguucgcccucggcaugaacuacugguccugcuccggcuuccccgucuacgacuacgaccccuccucccuccgcgacgcccucuccgccuccgucgucaaggucaacucccagucccucucccccuaccucuuccgcgccuuccgcuccucccucaagcgcgucgagguccucgacgagaacaaccucgucaugaaccucgaguucuccauccgcgagaccaccugccgcaaggacuccggcgaggaccccgccaccugcgccuuccagcgcgacuacuacgucuccaccgccgucugccgcuccaccgucaaggucuccgcccagcagguccagggcguccacgcccgcugcuccugguccuccuccaccuccgaguccuacuccuccgaggagaugaucuucggcgacaugcucggcucccacaaguggcgcaacaacuaccucuucggccucaucuccgacgaguccaucuccgagcaguucuacgaccgcucccucggcaucaugcgccgcguccucccccccggcaaccgccgcuaccccaaccaccgccaccgcgcccgcaucaacaccgacuucgaguga

SEQ ID NO: 50085 - RNA, 1563 nt, Artificial Sequence
  derived and/or modified sequence opt2 from SPPL2A__Homo_sapiens__NP_116191
augggcccccagcgccgccucucccccgccggcgccgcccuccucuggggcuuccuccuccagcucaccgccgcccaggaggccauccuccacgccuccggcaacggcaccaccaaggacuacugcaugcucuacaaccccuacuggaccgcccuccccuccacccucgagaacgccaccuccaucucccucaugaaccucaccuccaccccccucugcaaccucuccgacaucccccccgucggcaucaaguccaaggccgucgucguccccuggggcuccugccacuuccucgagaaggcccgcaucgcccagaagggcggcgccgaggccaugcucgucgucaacaacuccguccucuucccccccuccggcaaccgcuccgaguuccccgacgucaagauccucaucgccuucaucuccuacaaggacuuccgcgacaugaaccagacccucggcgacaacaucaccgucaagauguacucccccuccuggcccaacuucgacuacaccauggucgucaucuucgucaucgccgucuucaccgucgcccucggcggcuacugguccggccucgucgagcucgagaaccucaaggccgucaccaccgaggaccgcgagaugcgcaagaagaaggaggaguaccucaccuucuccccccucaccgucgucaucuucgucgucaucugcugcgucaugaugguccuccucuacuucuucuacaaguggcucgucuacgucaugaucgccaucuucugcaucgccuccgccaugucccucuacaacugccucgccgcccucauccacaagauccccuacggccagugcaccaucgccugccgcggcaagaacauggagguccgccucaucuuccucuccggccucugcaucgccgucgccgucgucugggccgucuuccgcaacgaggaccgcugggccuggauccuccaggacauccucggcaucgccuucugccucaaccucaucaagacccucaagcuccccaacuucaaguccugcgucauccuccucggccuccuccuccucuacgacgucuucuucgucuucaucacccccuucaucaccaagaacggcgaguccaucauggucgagcucgccgccggccccuucggcaacaacgagaagcuccccgucgucauccgcguccccaagcucaucuacuucuccgucauguccgucugccucaugcccgucuccauccucggcuucggcgacaucaucguccccggccuccucaucgccuacugccgccgcuucgacguccagaccggcuccuccuacaucuacuacgucuccuccaccgucgccuacgccaucggcaugauccucaccuucgucguccucguccucaugaagaagggccagcccgcccuccucuaccucguccccugcacccucaucaccgccuccgucgucgccuggcgccgcaaggagaugaagaaguucuggaagggcaacuccuaccagaugauggaccaccucgacugcgccaccaacgaggagaaccccgucaucuccggcgagcagaucguccagcaguga

SEQ ID NO: 50086 - RNA, 1536 nt, Artificial Sequence
  derived and/or modified sequence opt2 from SPPL2B__Homo_sapiens__NP_001070706
auggccgccgccgucgccgccgcccucgcccgccuccucgccgccuuccuccuccucgccgcccaggucgccugcgaguacggcaugguccacgucgucucccaggccggcggccccgagggcaaggacuacugcauccucuacaacccccagugggcccaccucccccacgaccucuccaaggccuccuuccuccagcuccgcaacuggaccgccucccuccucugcuccgccgccgaccuccccgcccgcggcuucuccaaccagaucccccucgucgcccgcggcaacugcaccuucuacgagaagguccgccucgcccagggcuccggcgcccgcggccuccucaucgucucccgcgagcgccucgucccccccggcggcaacaagacccaguacgacgagaucggcauccccgucgcccuccucuccuacaaggacaugcucgacaucuucacccgcuucggccgcaccguccgcgccgcccucuacgcccccaaggagcccguccucgacuacaacauggucaucaucuucaucauggccgucggcaccgucgccaucggcggcuacugggccggcucccgcgacgucaagaagcgcuacaugaagcacaagcgcgacgacggccccgagaagcaggaggacgaggccgucgacgucacccccgucaugaccugcgucuucgucgucaugugcugcuccaugcucguccuccucuacuacuucuacgaccuccucgucuacgucgucaucggcaucuucugccucgccuccgccaccggccucuacuccugccucgcccccugcguccgccgccuccccuucggcaagugccgcauccccaacaacucccuccccuacuuccacaagcgcccccaggcccgcaugcuccuccucgcccucuucugcgucgccgucuccgucgucuggggcgucuuccgcaacgaggaccagugggccuggguccuccaggacgcccucggcaucgccuucugccucuacaugcucaagaccauccgccuccccaccuucaaggccugcacccuccuccuccucguccucuuccucuacgacaucuucuucgucuucaucacccccuuccucaccaaguccggcuccuccaucauggucgaggucgccaccggccccuccgacuccgccacccgcgagaagcuccccaugguccucaaggucccccgccucaacuccuccccccucgcccucugcgaccgccccuucucccuccucggcuucggcgacauccucguccccggccuccucgucgccuacugccaccgcuucgacauccagguccaguccucccgcgucuacuucgucgccugcaccaucgccuacggcgucggccuccucgucaccuucgucgcccucgcccucaugcagcgcggccagcccgcccuccucuaccucguccccugcacccucgucaccuccugcgccgucgcccucuggcgccgcgagcucggcgucuucuggaccggcuccggcuucgccgucaacaccucccuccucuga

SEQ ID NO: 50087 - RNA, 2055 nt, Artificial Sequence
  derived and/or modified sequence opt2 from SPPL2C__Homo_sapiens__NP_787078
auggccugccucggcuuccuccuccccgucggcuuccuccuccucaucuccaccgucgccggcggcaaguacggcgucgcccacgucgucuccgagaacugguccaaggacuacugcauccucuucuccuccgacuacaucacccucccccgcgaccuccaccacgccccccuccucccccucuacgacggcaccaaggcccccuggugccccggcgaggacuccccccaccaggcccagcuccgcucccccucccagcgcccccuccgccagaccaccgccauggucaugcgcggcaacugcuccuuccacaccaagggcuggcucgcccagggccagggcgcccacggccuccucaucgucucccgcgucuccgaccagcagugcuccgacaccacccucgccccccaggacccccgccagccccucgccgaccucaccauccccgucgccaugcuccacuacgccgacaugcucgacauccucucccacacccgcggcgaggccgucguccgcgucgccauguacgccccccccgagcccaucaucgacuacaacaugcucgucaucuucauccucgccgucggcaccgucgccgccggcggcuacugggccggccucaccgaggccaaccgccuccagcgccgccgcgcccgccgcggcggcggcuccggcggccaccaccagcuccaggaggccgccgccgccgagggcgcccagaaggaggacaacgaggacauccccgucgacuucacccccgccaugaccggcgucgucgucacccucuccugcucccucaugcuccuccucuacuucuucuacgaccacuucgucuacgucaccaucggcaucuucggccucggcgccggcaucggccucuacuccugccucuccccccucgucugccgccucucccuccgccaguaccagcgccccccccacucccucugggccucccucccccucccccuccuccuccucgccucccucugcgccaccgucaucaucuucugggucgccuaccgcaacgaggaccgcugggccuggcuccuccaggacacccucggcaucuccuacugccucuucguccuccaccgcguccgccuccccacccucaagaacugcuccuccuuccuccucgcccuccucgccuucgacgucuucuucgucuucgucacccccuucuucaccaagaccggcgaguccaucauggcccaggucgcccucggccccgccgaguccuccucccacgagcgccuccccaugguccucaaggucccccgccuccgcgucuccgcccucacccucugcucccagcccuucuccauccucggcuucggcgacaucgucguccccggcuuccucgucgccuacugcugccgcuucgacguccaggucugcucccgccagaucuacuucgucgccugcaccgucgccuacgccgucggccuccucgucaccuucauggccaugguccucaugcagaugggccagcccgcccuccucuaccucgucuccuccacccuccucaccucccucgccgucgccgccugccgccaggagcucucccucuucuggaccggccagggccgcgccaagaugugcggccucggcugcgcccccuccgccggcucccgccagaagcaggagggcgccgccgacgcccacaccgccuccacccucgagcgcggcaccucccgcggcgccggcgaccucgacuccaaccccggcgaggacaccaccgagaucgucaccaucuccgagaacgaggccaccaaccccgaggaccgcuccgacuccuccgagggcugguccgacgcccaccucgaccccaacgagcuccccuucaucccccccggcgccuccgaggagcucaugccccucaugcccauggccaugcucaucccccucaugccccucaugcccccccccuccgagcucggccacguccacgcccaggcccaggcccacgagaccggccuccccugggccggccuccacaagcgcaagggccucaagguccgcaaguccauguccacccaggccccccucuga

SEQ ID NO: 50088 - RNA, 1155 nt, Artificial Sequence
  derived and/or modified sequence opt2 from SPPL3__Homo_sapiens__NP_620584
auggccgagcagaccuacuccugggccuacucccucgucgacuccucccaggucuccaccuuccucaucuccauccuccucaucgucuacggcuccuuccgcucccucaacauggacuucgagaaccaggacaaggagaaggacuccaacuccuccuccggcuccuucaacggcaacuccaccaacaacuccauccagaccaucgacuccacccaggcccucuuccuccccaucggcgccuccgucucccuccucgucauguucuucuucuucgacuccguccaggucgucuucaccaucugcaccgccguccucgccaccaucgccuucgccuuccuccuccuccccaugugccaguaccucacccgccccugcuccccccagaacaagaucuccuucggcugcugcggccgcuucaccgccgccgagcuccucuccuucucccucuccgucaugcucguccucaucuggguccucaccggccacuggcuccucauggacgcccucgccaugggccucugcgucgccaugaucgccuucguccgccuccccucccucaaggucuccugccuccuccucuccggccuccucaucuacgacgucuucugggucuucuucuccgccuacaucuucaacuccaacgucauggucaaggucgccacccagcccgccgacaacccccucgacguccucucccgcaagcuccaccucggccccaacgucggccgcgacgucccccgccucucccuccccggcaagcucgucuuccccuccuccaccggcucccacuucuccaugcucggcaucggcgacaucgucaugcccggccuccuccucugcuucguccuccgcuacgacaacuacaagaagcaggccuccggcgacuccugcggcgcccccggccccgccaacaucuccggccgcaugcagaaggucuccuacuuccacugcacccucaucggcuacuucgucggccuccucaccgccaccgucgccucccgcauccaccgcgccgcccagcccgcccuccucuaccucguccccuucacccuccucccccuccucaccauggccuaccucaagggcgaccuccgccgcaugugguccgagcccuuccacuccaaguccuccuccucccgcuuccucgaggucuga

SEQ ID NO: 50089 - RNA, 1335 nt, Artificial Sequence
  derived and/or modified sequence opt2 from SPRED1__Homo_sapiens__NP_689807
auguccgaggagaccgccaccuccgacaacgacaacuccuacgcccgcguccgcgccgucgucaugacccgcgacgacuccuccggcggcuggcucccccucggcggcuccggccucuccuccgucaccgucuucaaggucccccaccaggaggagaacggcugcgccgacuucuucauccgcggcgagcgccuccgcgacaagauggucguccucgagugcaugcucaagaaggaccucaucuacaacaaggucacccccaccuuccaccacuggaagaucgacgacaagaaguucggccucaccuuccagucccccgccgacgcccgcgccuucgaccgcggcauccgccgcgccaucgaggacaucucccagggcugccccgaguccaagaacgaggccgagggcgccgacgaccuccaggccaacgaggaggacuccuccuccucccucgucaaggaccaccucuuccagcaggagaccgucgucaccuccgagcccuaccgcuccuccaacauccgccccucccccuucgaggaccucaacgcccgccgcgucuacaugcagucccaggccaaccagaucaccuucggccagcccggccucgacauccagucccgcuccauggaguacguccagcgccagaucuccaaggagugcggcucccucaagucccagaaccgcgucccccucaaguccauccgccacgucuccuuccaggacgaggacgagaucguccgcaucaacccccgcgacauccucauccgccgcuacgccgacuaccgccaccccgacauguggaagaacgaccucgagcgcgacgacgccgacuccuccauccaguucuccaagcccgacuccaagaaguccgacuaccucuacuccugcggcgacgagaccaagcucuccucccccaaggacuccgucgucuucaagacccagcccuccucccucaagaucaagaaguccaagcgccgcaaggaggacggcgagcgcucccgcugcgucuacugccaggagcgcuucaaccacgaggagaacguccgcggcaagugccaggacgcccccgaccccaucaagcgcugcaucuaccaggucuccugcaugcucugcgccgaguccaugcucuaccacugcauguccgacuccgagggcgacuucuccgaccccugcuccugcgacaccuccgacgacaaguucugccuccgcuggcucgcccucgucgcccucuccuucaucguccccugcaugugcugcuacgucccccuccgcaugugccaccgcugcggcgaggccugcggcugcugcggcggcaagcacaaggccgccggcuga

SEQ ID NO: 50090 - RNA, 1248 nt, Artificial Sequence
  derived and/or modified sequence opt2 from SPRED2__Homo_sapiens__NP_001121682
auggccucccccggcuccgacuccuacaucguccgcgucaaggccgucgucaugacccgcgacgacuccuccggcggcugguucccccaggagggcggcggcaucucccgcgucggcgucugcaaggucaugcaccccgagggcaacggccgcuccggcuuccucauccacggcgagcgccagaaggacaagcucgucguccucgagugcuacguccgcaaggaccucgucuacaccaaggccaaccccaccuuccaccacuggaaggucgacaaccgcaaguucggccucaccuuccagucccccgccgacgcccgcgccuucgaccgcggcguccgcaaggccaucgaggaccucaucgagggcuccaccaccuccuccuccaccauccacaacgaggccgagcucggcgacgacgacgucuucaccaccgccaccgacuccuccuccaacuccucccagaagcgcgagcagcccacccgcaccaucuccucccccaccuccugcgagcaccgccgcaucuacacccucggccaccuccacgacuccuaccccaccgaccacuaccaccucgaccagcccaugccccgccccuaccgccaggucuccuuccccgacgacgacgaggagaucguccgcaucaacccccgcgagaagaucuggaugaccggcuacgaggacuaccgccacgcccccguccgcggcaaguaccccgaccccuccgaggacgccgacuccuccuacguccgcuucgccaagggcgagguccccaagcacgacuacaacuaccccuacgucgacuccuccgacuucggccucggcgaggaccccaagggccgcggcggcuccgucaucaagacccagcccucccgcggcaagucccgccgccgcaaggaggacggcgagcgcucccgcugcgucuacugccgcgacauguucaaccacgaggagaaccgccgcggccacugccaggacgcccccgacuccguccgcaccugcauccgccgcgucuccugcauguggugcgccgacuccaugcucuaccacugcauguccgaccccgagggcgacuacaccgaccccugcuccugcgacaccuccgacgagaaguucugccuccgcuggauggcccucaucgcccucuccuuccucgcccccugcaugugcugcuaccucccccuccgcgccugcuaccacugcggcgucaugugccgcugcugcggcggcaagcacaaggccgccgccuga

SEQ ID NO: 50091 - RNA, 1233 nt, Artificial Sequence
  derived and/or modified sequence opt2 from SPRED3__Homo_sapiens__XP_011525279
augguccgcguccgcgccgucgucauggcccgcgacgacuccuccggcggcuggcuccccgucggcggcggcggccucucccaggucuccgucugccgcguccgcggcgcccgccccgagggcggcgcccgccagggccacuacgucauccacggcgagcgccuccgcgaccagaagaccacccucgagugcacccucaagcccggccucgucuacaacaaggucaaccccaucuuccaccacuggucccucggcgacugcaaguucggccucaccuuccagucccccgccgaggccgacgaguuccagaagucccuccucgccgcccucgccgcccucggccgcggcucccucacccccuccuccuccuccuccuccuccucccccucccaggacaccgccgagacccccugcccccucaccucccacgucgacuccgacuccuccuccucccacucccgccaggagaccccccccuccgccgccgccgcccccaucaucaccauggaguccgccuccggcuucggccccaccacccccccccagcgccgccgcuccuccgcccaguccuaccccccccuccuccccuucaccggcauccccgagcccuccgagccccucgccggcgccggcggccucggcuggggcggccgcggcuacgaggacuaccgccgcuccggcccccccgccccccucgcccucuccaccugcgucguccgcuucgccaagaccggcgcccuccgcggcgccgcccucggcccccccgccgcccuccccgccccccucaccgaggccgccccccccgccccccccgcccgccccccccccggccccggccccuccuccgcccccgccaaggccucccccgaggccgaggaggccgcccgcugcguccacugccgcgcccucuuccgccgccgcgccgacggccgcggcggccgcugcgccgaggcccccgaccccggccgccuccucguccgccgccucuccugccucuggugcgccgagucccuccucuaccacugccucuccgacgccgagggcgacuucuccgaccccugcgccugcgagcccggccacccccgccccgccgcccgcugggccgcccucgccgcccucucccucgccguccccugccucugcugcuacgccccccuccgcgccugccacugggucgccgcccgcugcggcugcgccggcugcggcggccgccacgaggaggccgcccgcuga

SEQ ID NO: 50092 - RNA, 786 nt, Artificial Sequence
  derived and/or modified sequence opt2 from SPR__Homo_sapiens__NP_003115
auggagggcggccucggccgcgccgucugccuccucaccggcgccucccgcggcuucggccgcacccucgccccccuccucgccucccuccucucccccggcuccguccucguccucuccgcccgcaacgacgaggcccuccgccagcucgaggccgagcucggcgccgagcgcuccggccuccgcgucguccgcguccccgccgaccucggcgccgaggccggccuccagcagcuccucggcgcccuccgcgagcucccccgccccaagggccuccagcgccuccuccucaucaacaacgccggcucccucggcgacgucuccaagggcuucgucgaccucuccgacuccacccaggucaacaacuacugggcccucaaccucaccuccaugcucugccucaccuccuccguccucaaggccuuccccgacucccccggccucaaccgcaccgucgucaacaucuccucccucugcgcccuccagcccuucaagggcugggcccucuacugcgccggcaaggccgcccgcgacaugcucuuccagguccucgcccucgaggagcccaacguccgcguccucaacuacgcccccggcccccucgacaccgacaugcagcagcucgcccgcgagaccuccgucgaccccgacaugcgcaagggccuccaggagcucaaggccaagggcaagcucgucgacugcaaggucuccgcccagaagcuccucucccuccucgagaaggacgaguucaaguccggcgcccacgucgacuucuacgacaaguga

SEQ ID NO: 50093 - RNA, 456 nt, Artificial Sequence
  derived and/or modified sequence opt2 from SPRN__Homo_sapiens__NP_001012526
augaacugggcccccgccaccugcugggcccuccuccucgccgccgccuuccucugcgacuccggcgccgccaagggcggccgcggcggcgcccgcggcuccgcccgcggcggcguccgcggcggcgcccgcggcgccucccgcguccgcguccgccccgcccagcgcuacggcgcccccggcuccucccuccgcgucgccgccgccggcgccgccgccggcgccgccgccggcgccgccgccggccucgccgccggcuccggcuggcgccgcgccgccggccccggcgagcgcggccucgaggacgaggaggacggcguccccggcggcaacggcaccggccccggcaucuacuccuaccgcgccuggaccuccggcgccggccccacccgcggcccccgccucugccucguccucggcggcgcccucggcgcccucggccuccuccgccccuga

SEQ ID NO: 50094 - RNA, 270 nt, Artificial Sequence
  derived and/or modified sequence opt2 from SPRR1A__Homo_sapiens__NP_001186757
augaacucccagcagcagaagcagcccugcaccccccccccccagccccagcagcagcaggucaagcagcccugccagccccccccccaggagcccugcauccccaagaccaaggagcccugccaccccaagguccccgagcccugccaccccaagguccccgagcccugccagcccaagguccccgagcccugccagcccaagguccccgagcccugccccuccaccgucacccccgcccccgcccagcagaagaccaagcagaaguga

SEQ ID NO: 50095 - RNA, 270 nt, Artificial Sequence
  derived and/or modified sequence opt2 from SPRR1B__Homo_sapiens__NP_003116
auguccucccagcagcagaagcagcccugcaccccccccccccagcuccagcagcagcaggucaagcagcccugccagccccccccccaggagcccugcauccccaagaccaaggagcccugccaccccaagguccccgagcccugccaccccaagguccccgagcccugccagcccaagguccccgagcccugccaccccaagguccccgagcccugccccuccaucgucacccccgcccccgcccagcagaagaccaagcagaaguga

SEQ ID NO: 50096 - RNA, 219 nt, Artificial Sequence
  derived and/or modified sequence opt2 from SPRR2A__Homo_sapiens__NP_005979
auguccuaccagcagcagcagugcaagcagcccugccagcccccccccgucugccccacccccaagugccccgagcccugccccccccccaagugccccgagcccugccccccccccaagugcccccagcccugccccccccagcagugccagcagaaguacccccccgucacccccuccccccccugccaguccaaguacccccccaaguccaaguga

SEQ ID NO: 50097 - RNA, 219 nt, Artificial Sequence
  derived and/or modified sequence opt2 from SPRR2B__Homo_sapiens__NP_001017418
auguccuaccagcagcagcagugcaagcagcccugccagcccccccccgucugccccacccccaagugccccgagcccugccccccccccaagugccccgagcccugccccccccccaagugcccccagcccugccccccccagcagugccagcagaaguacccccccgucacccccuccccccccugccagcccaaguacccccccaaguccaaguga

SEQ ID NO: 50098 - RNA, 510 nt, Artificial Sequence
  derived and/or modified sequence opt2 from SPRR3__Homo_sapiens__NP_001091058
auguccuccuaccagcagaagcagaccuucaccccccccccccagcuccagcagcagcaggucaagcagcccucccagccccccccccaggagaucuucguccccaccaccaaggagcccugccacuccaaggucccccagcccggcaacaccaagauccccgagcccggcugcaccaagguccccgagcccggcugcaccaagguccccgagcccggcugcaccaagguccccgagcccggcugcaccaagguccccgagcccggcugcaccaagguccccgagcccggcugcaccaagguccccgagcccggcuacaccaagguccccgagcccggcuccaucaagguccccgaccagggcuucaucaaguuccccgagcccggcgccaucaagguccccgagcagggcuacaccaagguccccguccccggcuacaccaagcuccccgagcccugccccuccaccgucacccccggccccgcccagcagaagaccaagcagaaguga

SEQ ID NO: 50099 - RNA, 753 nt, Artificial Sequence
  derived and/or modified sequence opt2 from SPRTN__Homo_sapiens__NP_001010984
auggacgacgaccucaugcucgcccuccgccuccaggaggaguggaaccuccaggaggccgagcgcgaccacgcccaggagucccucucccucgucgacgccuccugggagcucgucgaccccacccccgaccuccaggcccucuucguccaguucaacgaccaguucuucuggggccagcucgaggccgucgaggucaagugguccguccgcaugacccucugcgccggcaucugcuccuacgagggcaagggcggcaugugcuccauccgccucuccgagccccuccucaagcuccgcccccgcaaggaccucgucgagacccuccuccacgagaugauccacgccuaccucuucgucaccaacaacgacaaggaccgcgagggccacggccccgaguucugcaagcacaugcaccgcaucaacucccucaccggcgccaacaucaccgucuaccacaccuuccacgacgaggucgacgaguaccgccgccacugguggcgcugcaacggccccugccagcaccgcccccccuacuacggcuacgucaagcgcgccaccaaccgcgagcccuccgcccacgacuacuggugggccgagcaccagaagaccugcggcggcaccuacaucaagaucaaggagcccgagaacuacuccaagaagggcaagggcaaggccaagcucggcaaggagcccguccucgccgccgagaacaagggcaccuucgucuacauccuccucaucuucauguga

SEQ ID NO: 50100 - RNA, 960 nt, Artificial Sequence
  derived and/or modified sequence opt2 from SPRY1__Homo_sapiens__NP_001244968
auggacccccagaaccagcacggcuccggcuccucccucgucgucauccagcagcccucccucgacucccgccagcgccucgacuacgagcgcgagauccagcccaccgccauccucucccucgaccagaucaaggccauccgcggcuccaacgaguacaccgagggccccuccgucgucaagcgccccgccccccgcaccgccccccgccaggagaagcacgagcgcacccacgagaucauccccaucaacgucaacaacaacuacgagcaccgccacaccucccaccucggccacgccguccuccccuccaacgcccgcggccccauccucucccgcuccaccuccaccggcuccgccgccuccuccggcuccaacuccuccgccuccuccgagcagggccuccucggccgcuccccccccacccgccccguccccggccaccgcuccgagcgcgccauccgcacccagcccaagcagcucaucgucgacgaccucaagggcucccucaaggaggaccucacccagcacaaguucaucugcgagcagugcggcaagugcaagugcggcgagugcaccgccccccgcacccuccccuccugccucgccugcaaccgccagugccucugcuccgccgaguccauggucgaguacggcaccugcaugugccucgucaagggcaucuucuaccacugcuccaacgacgacgagggcgacuccuacuccgacaaccccugcuccugcucccagucccacugcugcucccgcuaccucugcaugggcgccaugucccucuuccuccccugccuccucugcuacccccccgccaagggcugccucaagcucugccgccgcugcuacgacuggauccaccgccccggcugccgcugcaagaacuccaacaccgucuacugcaagcucgaguccugccccucccgcggccagggcaagcccuccuga

SEQ ID NO: 50101 - RNA, 948 nt, Artificial Sequence
  derived and/or modified sequence opt2 from SPRY2__Homo_sapiens__NP_005833
auggaggcccgcgcccaguccggcaacggcucccagccccuccuccagaccccccgcgacggcggccgccagcgcggcgagcccgacccccgcgacgcccucacccagcagguccacguccucucccucgaccagauccgcgccauccgcaacaccaacgaguacaccgagggccccaccgucgucccccgccccggccucaagcccgccccccgccccuccacccagcacaagcacgagcgccuccacggccuccccgagcaccgccagcccccccgccuccagcacucccagguccacuccuccgcccgcgccccccucucccgcuccaucuccaccgucuccuccggcucccgcuccuccacccgcaccuccaccuccuccuccuccuccgagcagcgccuccucggcuccuccuucuccuccggccccgucgccgacggcaucauccgcguccagcccaaguccgagcucaagcccggcgagcucaagccccucuccaaggaggaccucggccuccacgccuaccgcugcgaggacugcggcaagugcaagugcaaggagugcaccuacccccgcccccuccccuccgacuggaucugcgacaagcagugccucugcuccgcccagaacgucaucgacuacggcaccugcgucugcugcgucaagggccucuucuaccacugcuccaacgacgacgaggacaacugcgccgacaaccccugcuccugcucccagucccacugcugcacccgcugguccgccaugggcgucaugucccucuuccuccccugccucuggugcuaccuccccgccaagggcugccucaagcucugccagggcugcuacgaccgcgucaaccgccccggcugccgcugcaagaacuccaacaccgucugcugcaagguccccaccguccccccccgcaacuucgagaagcccaccuga

SEQ ID NO: 50102 - RNA, 867 nt, Artificial Sequence
  derived and/or modified sequence opt2 from SPRY3__Homo_sapiens__NP_005831
auggacgccgccgucaccgacgacuuccagcagauccuccccaucgagcagcuccgcuccacccacgccuccaacgacuacgucgagcgcccccccgcccccugcaagcaggcccucuccucccccucccucaucguccagacccacaaguccgacuggucccucgccaccaugcccaccucccucccccgcucccucucccagugccaccagcuccagccccucccccagcaccucucccaguccuccaucgccuccuccaugucccacuccaccaccgccuccgaccagcgccuccucgccuccaucacccccucccccuccggccaguccaucauccgcacccagcccggcgccggcguccaccccaaggccgacggcgcccucaagggcgaggccgagcaguccgccggccaccccuccgagcaccucuucaucugcgaggagugcggccgcugcaagugcguccccugcaccgccgcccgcccccuccccuccugcuggcucugcaaccagcgcugccucugcuccgccgagucccuccucgacuacggcaccugccucugcugcgucaagggccucuucuaccacugcuccaccgacgacgaggacaacugcgccgacgagcccugcuccugcggccccuccuccugcuucguccgcugggccgccaugucccucaucucccucuuccuccccugccucugcugcuaccuccccacccgcggcugccuccaccucugccagcagggcuacgacucccuccgccgccccggcugccgcugcaagcgccacaccaacaccgucugccgcaagaucuccuccggcuccgcccccuuccccaaggcccaggagaaguccgucuga

SEQ ID NO: 50103 - RNA, 900 nt, Artificial Sequence
  derived and/or modified sequence opt2 from SPRY4__Homo_sapiens__NP_001280218
auggagccccccaucccccaguccgccccccucacccccaacuccgucaugguccagccccuccucgacucccgcaugucccacucccgccuccagcacccccucaccauccuccccaucgaccaggucaagaccucccacgucgagaacgacuacaucgacaaccccucccucgcccucaccaccggccccaagcgcacccgcggcggcgcccccgagcucgcccccacccccgcccgcugcgaccaggacgucacccaccacuggaucuccuucuccggccgccccuccuccgucuccuccuccuccuccaccuccuccgaccagcgccuccucgaccacauggcccccccccccgucgccgaccaggccuccccccgcgccguccgcauccagcccaaggucguccacugccagccccucgaccucaagggccccgccgucccccccgagcucgacaagcacuuccuccucugcgaggccugcggcaagugcaagugcaaggagugcgccuccccccgcacccuccccuccugcugggucugcaaccaggagugccucugcuccgcccagacccucgucaacuacggcaccugcaugugccucguccagggcaucuucuaccacugcaccaacgaggacgacgagggcuccugcgccgaccaccccugcuccugcucccgcuccaacugcugcgcccgcugguccuucaugggcgcccucuccgucguccuccccugccuccucugcuaccuccccgccaccggcugcgucaagcucgcccagcgcggcuacgaccgccuccgccgccccggcugccgcugcaagcacaccaacuccgucaucugcaaggccgccuccggcgacgccaagaccucccgccccgacaagcccuucuga

SEQ ID NO: 50104 - RNA, 474 nt, Artificial Sequence
  derived and/or modified sequence opt2 from SPRYD7__Homo_sapiens__NP_001120954
auggccaccuccguccucugcugccuccgcugcugccgcgacggcggcaccggccacaucccccucaaggagaugcccgccguccagcucgacacccagcacaugggcaucuggggcaucggcgucgccacccagaaggucaaccucaaccagaucccccucggccgcgacaugcacucccucgucaugcgcaacgacggcgcccucuaccacaacaacgaggagaagaaccgccuccccgccaacucccucccccaggagggcgacgucgucggcaucaccuacgaccacgucgagcucaacgucuaccucaacggcaagaacaugcacugccccgccuccggcauccgcggcaccgucuaccccgucgucuacgucgacgacuccgccauccucgacugccaguucuccgaguucuaccacacccccccccccggcuucgagaagauccucuucgagcagcagaucuucuga

SEQ ID NO: 50105 - RNA, 1068 nt, Artificial Sequence
  derived and/or modified sequence opt2 from SPSB3__Homo_sapiens__NP_543137
auggcccgccgcccccgcaacucccgcgccuggcacuucguccucuccgccgcccgccgcgacgccgacgcccgcgccgucgcccucgccggcuccaccaacuggggcuacgacuccgacggccagcacuccgacuccgacuccgaccccgaguacuccacccucccccccuccauccccuccgccguccccgucaccggcgaguccuucugcgacugcgccggccaguccgaggccuccuucugcuccucccuccacuccgcccaccgcggccgcgacugccgcugcggcgaggaggacgaguacuucgacugggucugggacgaccucaacaaguccuccgccacccuccucuccugcgacaaccgcaaggucuccuuccacauggaguacuccugcggcaccgccgccauccgcggcaccaaggagcucggcgagggccagcacuucugggagaucaagaugaccucccccgucuacggcaccgacaugauggucggcaucggcaccuccgacgucgaccucgacaaguaccgccacaccuucugcucccuccucggccgcgacgaggacuccuggggccucuccuacaccggccuccuccaccacaagggcgacaagaccuccuucuccucccgcuucggccagggcuccaucaucggcguccaccucgacaccuggcacggcacccucaccuucuucaagaaccgcaagugcaucggcgucgccgccaccaagcuccagaacaagcgcuucuaccccauggucugcuccaccgccgcccgcuccuccaugaaggucacccgcuccugcgccuccgccaccucccuccaguaccucugcugccaccgccuccgccagcuccgccccgacuccggcgacacccucgagggccucccccucccccccggccucaagcagguccuccacaacaagcucggcuggguccucuccauguccugcucccgccgcaaggcccccgucuccgacccccaggccgccaccuccgcccaccccuccucccgcgagccccgccccugccagcgcaagcgcugccgccgcaccuga

SEQ ID NO: 50106 - RNA, 822 nt, Artificial Sequence
  derived and/or modified sequence opt2 from SPSB4__Homo_sapiens__NP_543138
augggccagaagcucuccggcucccucaaguccgucgagguccgcgagcccgcccuccgccccgccaagcgcgagcuccgcggcgccgagcccggccgccccgcccgccucgaccagcuccucgacaugcccgccgccggccucgccguccagcuccgccacgccuggaaccccgaggaccgcucccucaacgucuucgucaaggacgacgaccgccucaccuuccaccgccaccccgucgcccaguccaccgacggcauccgcggcaaggucggccacgcccgcggccuccacgccuggcagaucaacuggcccgcccgccagcgcggcacccacgccgucgucggcgucgccaccgcccgcgccccccuccacuccgucggcuacaccgcccucgucggcuccgacgccgaguccuggggcugggaccucggccgcucccgccucuaccacgacggcaagaaccagcccggcgucgccuaccccgccuuccucggccccgacgaggccuucgcccuccccgacucccuccucgucguccucgacauggacgagggcacccucuccuucaucgucgacggccaguaccucggcgucgccuuccgcggccucaagggcaagaagcucuaccccgucgucuccgccgucuggggccacugcgaggucaccaugcgcuacaucaacggccucgaccccgagccccucccccucauggaccucugccgccgcuccauccgcuccgcccucggccgccagcgccuccaggacaucuccucccucccccucccccagucccucaagaacuaccuccaguaccaguga

SEQ ID NO: 50107 - RNA, 7260 nt, Artificial Sequence
  derived and/or modified sequence opt2 from SPTA1__Homo_sapiens__XP_011508218
auggagcaguuccccaaggagaccgucgucgaguccuccggccccaagguccucgagaccgccgaggagauccaggagcgccgccaggagguccucacccgcuaccaguccuucaaggagcgcgucgccgagcgcggccagaagcucgaggacuccuaccaccuccaggucuucaagcgcgacgccgacgaccucggcaaguggaucauggagaaggucaacauccucaccgacaaguccuacgaggaccccaccaacauccagggcaaguaccagaagcaccagucccucgaggccgagguccagaccaagucccgccucauguccgagcucgagaagacccgcgaggagcgcuucaccaugggccacuccgcccacgaggagaccaaggcccacaucgaggagcuccgccaccucugggaccuccuccucgagcucacccucgagaagggcgaccagcuccuccgcgcccucaaguuccagcaguacguccaggagugcgccgacauccucgaguggaucggcgacaaggaggccaucgccaccuccgucgagcucggcgaggacugggagcgcaccgagguccuccacaagaaguucgaggacuuccaggucgagcucgucgccaaggagggccgcgucgucgaggucaaccaguacgccaacgagugcgccgaggagaaccaccccgaccucccccucauccaguccaagcagaacgaggucaacgccgccugggagcgccuccgcggccucgcccuccagcgccagaaggcccucuccaacgccgccaaccuccagcgcuucaagcgcgacgucaccgaggccauccaguggaucaaggagaaggagcccguccucaccuccgaggacuacggcaaggaccucgucgccuccgagggccucuuccacucccacaagggccucgagcgcaaccucgccgucauguccgacaaggucaaggagcucugcgccaaggccgagaagcucacccucucccaccccuccgacgccccccagauccaggagaugaaggaggaccucgucuccuccugggagcacauccgcgcccucgccaccucccgcuacgagaagcuccaggccaccuacugguaccaccgcuucuccuccgacuucgacgagcucuccggcuggaugaacgagaagaccgccgccaucaacgccgacgagcuccccaccgacgucgccggcggcgagguccuccucgaccgccaccagcagcacaagcacgagaucgacuccuacgacgaccgcuuccaguccgccgacgagaccggccaggaccucgucaacgccaaccacgaggccuccgacgagguccgcgagaagauggagauccucgacaacaacuggaccgcccuccucgagcucugggacgagcgccaccgccaguacgagcagugccucgacuuccaccucuucuaccgcgacuccgagcaggucgacuccuggaugucccgccaggaggccuuccucgagaacgaggaccucggcaacucccucggcuccgccgaggcccuccuccagaagcacgaggacuucgaggaggccuucaccgcccaggaggagaagaucaucaccgucgacaagaccgccaccaagcucaucggcgacgaccacuacgacuccgagaacaucaaggccauccgcgacggccuccucgcccgccgcgacgcccuccgcgagaaggccgccacccgccgccgccuccucaaggagucccuccuccuccagaagcucuacgaggacuccgacgaccucaagaacuggaucaacaagaagaagaagcucgccgacgacgaggacuacaaggacauccagaaccucaagucccgcguccagaagcagcaggucuucgagaaggagcucgccgucaacaagacccagcucgagaacauccagaagaccggccaggagaugaucgagggcggccacuacgccuccgacaacgucaccacccgccucuccgaggucgccucccucugggaggagcuccucgaggccaccaagcagaagggcacccagcuccacgaggccaaccagcagcuccaguucgagaacaacgccgaggaccuccagcgcuggcucgaggacgucgaguggcaggucaccuccgaggacuacggcaagggccucgccgagguccagaaccgccuccgcaagcacggccuccucgaguccgccgucgccgcccgccaggaccaggucgacauccucaccgaccucgccgccuacuucgaggagaucggccaccccgacuccaaggacauccgcgcccgccaggagucccucgucugccgcuucgaggcccucaaggagccccucgccacccgcaagaagaagcuccucgaccuccuccaccuccagcucaucugccgcgacaccgaggacgaggaggccuggauccaggagaccgagcccuccgccaccuccaccuaccucggcaaggaccucaucgccuccaagaagcuccucaaccgccaccgcgucauccucgagaacaucgccucccacgagccccgcauccaggagaucaccgagcgcggcaacaagauggucgaggagggccacuucgccgccgaggacgucgccucccgcgucaagucccucaaccagaacauggagucccuccgcgcccgcgccgcccgccgccagaacgaccucgaggccaacguccaguuccagcaguaccucgccgaccuccacgaggccgagaccuggauccgcgagaaggagcccaucgucgacaacaccaacuacggcgccgacgaggaggccgccggcgcccuccucaagaagcacgaggccuuccuccucgaccucaacuccuucggcgacuccaugaaggcccuccgcaaccaggccaacgccugccagcagcagcaggccgcccccgucgagggcgucgccggcgagcagcgcgucauggcccucuacgacuuccaggcccgcuccccccgcgaggucaccaugaagaagggcgacguccucacccuccucuccuccaucaacaaggacugguggaaggucgaggccgccgaccaccagggcaucguccccgccgucuacguccgccgccucgcccacgacgaguuccccaugcucccccagcgccgccgcgaggagcccggcaacaucacccagcgccaggagcagaucgagaaccaguaccgcucccuccucgaccgcgccgaggagcgccgccgccgccuccuccagcgcuacaacgaguuccuccucgccuacgaggccggcgacaugcucgaguggauccaggagaagaaggccgagaacaccggcgucgagcucgacgacgucugggagcuccagaagaaguucgacgaguuccagaaggaccucaacaccaacgagccccgccuccgcgacaucaacaaggucgccgacgaccuccucuucgagggccuccucacccccgagggcgcccagauccgccaggagcucaacucccgcuggggcucccuccagcgccucgccgacgagcagcgccagcuccucggcuccgcccacgccgucgaggucuuccaccgcgaggccgacgacaccaaggagcagaucgagaagaagugccaggcccucuccgccgccgaccccggcuccgaccucuucuccguccaggcccuccagcgccgccacgagggcuucgagcgcgaccucgucccccucggcgacaaggucaccauccucggcgagaccgccgagcgccucuccgagucccaccccgacgccaccgaggaccuccagcgccagaagauggagcucaacgaggccugggaggaccuccagggccgcaccaaggaccgcaaggagucccucaacgaggcccagaaguucuaccucuuccucuccaaggcccgcgaccuccagaacuggaucuccuccaucggcggcauggucuccucccaggagcucgccgaggaccucaccggcaucgagauccuccucgagcgccaccaggagcaccgcgccgacauggaggccgaggcccccaccuuccaggcccucgaggacuucuccgccgagcucaucgacuccggccaccacgccucccccgagaucgagaagaagcuccaggccgucaagcucgagcgcgacgaccucgagaaggccugggagaagcgcaagaagauccucgaccagugccucgagcuccagauguuccagggcaacugcgaccaggucgaguccuggauggucgcccgcgagaacucccuccgcuccgacgacaaguccucccucgacucccucgaggcccucaugaagaagcgcgacgaccucgacaaggccaucaccgcccaggagggcaagaucaccgaccucgagcacuucgccgagucccucaucgccgacgagcacuacgccaaggaggagaucgccacccgccuccagcgcguccucgaccgcuggaaggcccucaaggcccagcucaucgacgagcgcaccaagcucggcgacuacgccaaccucaagcaguucuaccgcgaccucgaggagcucgaggaguggaucuccgagaugcuccccaccgccugcgacgaguccuacaaggacgccaccaacauccagcgcaaguaccucaagcaccagaccuucgcccacgaggucgacggccgcuccgagcagguccacggcgucaucaaccucggcaacucccucaucgagugcuccgccugcgacggcaacgaggaggccaugaaggagcagcucgagcagcucaaggagcacugggaccaccuccucgagcgcaccaacgacaagggcaagaagcucaacgaggccucccgccagcagcgcuucaacaccuccauccgcgacuucgaguucuggcucuccgaggccgagacccuccucgccaugaaggaccaggcccgcgaccucgccuccgccggcaaccuccucaagaagcaccagcuccucgagcgcgagaugcucgcccgcgaggacgcccucaaggaccucaacacccucgccgaggaccuccucuccuccggcaccuucaacgucgaccagaucgucaagaagaaggacaacgucaacaagcgcuuccucaacguccaggagcucgccgccgcccaccacgagaagcucaaggaggccuacgcccucuuccaguucuuccaggaccucgacgacgaggaguccuggaucgaggagaagcucauccgcgucuccucccaggacuacggccgcgaccuccagggcguccagaaccuccucaagaagcacaagcgccucgagggcgagcucgucgcccacgagcccgccauccagaacguccucgacauggccgagaagcucaaggacaaggccgccgucggccaggaggagauccagcuccgccucgcccaguucgucgagcacugggagaagcucaaggagcucgccaaggcccgcggccucaagcucgaggagucccucgaguaccuccaguucaugcagaacgccgaggaggaggaggccuggaucaacgagaagaacgcccucgccguccgcggcgacugcggcgacacccucgccgccacccagucccuccucaugaagcacgaggcccucgagaacgacuucgccguccacgagacccgcguccagaacgucugcgcccagggcgaggacauccucaacaagguccuccaggaggagucccagaacaaggagaucuccuccaagaucgaggcccucaacgagaagacccccucccucgccaaggccaucgccgccuggaagcuccagcucgaggacgacuacgccuuccaggaguucaacuggaaggccgacgucgucgaggccuggaucgccgacaaggagaccucccucaagaccaacggcaacggcgccgaccucggcgacuuccucacccuccucgccaagcaggacacccucgacgccucccuccaguccuuccagcaggagcgccuccccgagaucaccgaccucaaggacaagcucaucuccgcccagcacaaccaguccaaggccaucgaggagcgcuacgccgcccuccucaagcgcugggagcagcuccucgaggccuccgccguccaccgccagaagcuccucgagaagcagcucccccuccagaaggccgaggaccucuucgucgaguucgcccacaaggccuccgcccucaacaacuggugcgagaagauggaggagaaccucuccgagcccguccacugcgucucccucaacgagauccgccagcuccagaaggaccacgaggacuuccucgccucccucgcccgcgcccaggccgacuucaagugccuccucgagcucgaccagcagaucaaggcccucggcguccccuccucccccuacaccuggcucaccgucgagguccucgagcgcaccuggaagcaccucuccgacaucaucgaggagcgcgagcaggagcuccagaaggaggaggcccgccaggucaagaacuucgagaugugccaggaguucgagcagaacgccuccaccuuccuccaguggauccucgagacccgcgccuacuuccucgacggcucccuccucaaggagaccggcacccucgagucccagcucgaggccaacaagcgcaagcagaaggagauccaggccaugaagcgccagcucaccaagaucgucgaccucggcgacaaccucgaggacgcccucauccucgacaucaaguacuccaccaucggccucgcccagcagugggaccagcucuaccagcucggccuccgcaugcagcacaaccucgagcagcagauccaggccaaggacaucaagggcgucuccgaggagacccucaaggaguucuccaccaucuacaagcacuucgacgagaaccucaccggccgccucacccacaaggaguuccgcuccugccuccgcggccucaacuacuaccuccccauggucgaggaggacgagcacgagcccaaguucgagaaguuccucgacgccgucgaccccggccgcaagggcuacgucucccucgaggacuacaccgccuuccucaucgacaaggaguccgagaacaucaaguccuccgacgagaucgagaacgccuuccaggcccucgccgagggcaaguccuacaucaccaaggaggacaugaagcaggcccucacccccgagcaggucuccuucugcgccacccacaugcagcaguacauggacccccgcggccgcucccaccucuccggcuacgacuacgucggcuucaccaacuccuacuucggcaacuga

SEQ ID NO: 50108 - RNA, 7434 nt, Artificial Sequence
  derived and/or modified sequence opt2 from SPTAN1__Homo_sapiens__NP_001123910
auggaccccuccggcgucaagguccucgagaccgccgaggacauccaggagcgccgccagcagguccucgaccgcuaccaccgcuucaaggagcucuccacccuccgccgccagaagcucgaggacuccuaccgcuuccaguucuuccagcgcgacgccgaggagcucgagaaguggauccaggagaagcuccagaucgccuccgacgagaacuacaaggaccccaccaaccuccagggcaagcuccagaagcaccaggccuucgaggccgagguccaggccaacuccggcgccaucgucaagcucgacgagaccggcaaccucaugaucuccgagggccacuucgccuccgagaccauccgcacccgccucauggagcuccaccgccagugggagcuccuccucgagaagaugcgcgagaagggcaucaagcuccuccaggcccagaagcucguccaguaccuccgcgagugcgaggacgucauggacuggaucaacgacaaggaggccaucgucaccuccgaggagcucggccaggaccucgagcacgucgagguccuccagaagaaguucgaggaguuccagaccgacauggccgcccacgaggagcgcgucaacgaggucaaccaguucgccgccaagcucauccaggagcagcaccccgaggaggagcucaucaagaccaagcaggacgaggucaacgccgccuggcagcgccucaagggccucgcccuccagcgccagggcaagcucuucggcgccgccgagguccagcgcuucaaccgcgacgucgacgagaccaucuccuggaucaaggagaaggagcagcucauggccuccgacgacuucggccgcgaccucgccuccguccaggcccuccuccgcaagcacgagggccucgagcgcgaccucgccgcccucgaggacaaggucaaggcccucugcgccgaggccgaccgccuccagcagucccacccccucuccgccacccagauccaggucaagcgcgaggagcucaucaccaacugggagcagauccgcacccucgccgccgagcgccacgcccgccucaacgacuccuaccgccuccagcgcuuccucgccgacuuccgcgaccucaccuccugggucaccgagaugaaggcccucaucaacgccgacgagcucgccuccgacgucgccggcgccgaggcccuccucgaccgccaccaggagcacaagggcgagaucgacgcccacgaggacuccuucaaguccgccgacgaguccggccaggcccuccucgccgccggccacuacgccuccgacgagguccgcgagaagcucaccguccucuccgaggagcgcgccgcccuccucgagcucugggagcuccgccgccagcaguacgagcagugcauggaccuccagcucuucuaccgcgacaccgagcaggucgacaacuggauguccaagcaggaggccuuccuccucaacgaggaccucggcgacucccucgacuccgucgaggcccuccucaagaagcacgaggacuucgagaagucccucuccgcccaggaggagaagaucaccgcccucgacgaguucgccaccaagcucauccagaacaaccacuacgccauggaggacgucgccacccgccgcgacgcccuccucucccgccgcaacgcccuccacgagcgcgccaugcgccgccgcgcccagcucgccgacuccuuccaccuccagcaguucuuccgcgacuccgacgagcucaaguccugggucaacgagaagaugaagaccgccaccgacgaggccuacaaggaccccuccaaccuccagggcaagguccagaagcaccaggccuucgaggccgagcucuccgccaaccagucccgcaucgacgcccucgagaaggccggccagaagcucaucgacgucaaccacuacgccaaggacgaggucgccgcccgcaugaacgaggucaucucccucuggaagaagcuccucgaggccaccgagcucaagggcaucaagcuccgcgaggccaaccagcagcagcaguucaaccgcaacgucgaggacaucgagcucuggcucuacgaggucgagggccaccucgccuccgacgacuacggcaaggaccucaccaacguccagaaccuccagaagaagcacgcccuccucgaggccgacgucgccgcccaccaggaccgcaucgacggcaucaccauccaggcccgccaguuccaggacgccggccacuucgacgccgagaacaucaagaagaagcaggaggcccucgucgcccgcuacgaggcccucaaggagcccauggucgcccgcaagcagaagcucgccgacucccuccgccuccagcagcucuuccgcgacgucgaggacgaggagaccuggauccgcgagaaggagcccaucgccgccuccaccaaccgcggcaaggaccucaucggcguccagaaccuccucaagaagcaccaggcccuccaggccgagaucgccggccacgagccccgcaucaaggccgucacccagaagggcaacgccauggucgaggagggccacuucgccgccgaggacgucaaggccaagcuccacgagcucaaccagaagugggaggcccucaaggccaaggccucccagcgccgccaggaccucgaggacucccuccaggcccagcaguacuucgccgacgccaacgaggccgaguccuggaugcgcgagaaggagcccaucgucggcuccaccgacuacggcaaggacgaggacuccgccgaggcccuccucaagaagcacgaggcccucauguccgaccucuccgccuacggcuccuccauccaggcccuccgcgagcaggcccaguccugccgccagcaggucgcccccaccgacgacgagaccggcaaggagcucguccucgcccucuacgacuaccaggagaaguccccccgcgaggucaccaugaagaagggcgacauccucacccuccucaacuccaccaacaaggacugguggaaggucgaggucaacgaccgccagggcuucguccccgccgccuacgucaagaagcucgaccccgcccaguccgccucccgcgagaaccuccucgaggagcagggcuccaucgcccuccgccaggagcagaucgacaaccagacccgcaucaccaaggaggccggcuccgucucccuccgcaugaagcaggucgaggagcucuaccacucccuccucgagcucggcgagaagcgcaagggcaugcucgagaaguccugcaagaaguucaugcucuuccgcgaggccaacgagcuccagcaguggaucaacgagaaggaggccgcccucaccuccgaggaggucggcgccgaccucgagcaggucgagguccuccagaagaaguucgacgacuuccagaaggaccucaaggccaacgagucccgccucaaggacaucaacaaggucgccgaggaccucgaguccgagggccucauggccgaggagguccaggccguccagcagcaggaggucuacggcaugaugccccgcgacgagaccgacuccaagaccgccucccccuggaaguccgcccgccucaugguccacaccgucgccaccuucaacuccaucaaggagcucaacgagcgcuggcgcucccuccagcagcucgccgaggagcgcucccagcuccucggcuccgcccacgagguccagcgcuuccaccgcgacgccgacgagaccaaggaguggaucgaggagaagaaccaggcccucaacaccgacaacuacggccacgaccucgccuccguccaggcccuccagcgcaagcacgagggcuucgagcgcgaccucgccgcccucggcgacaaggucaacucccucggcgagaccgccgagcgccucauccagucccaccccgaguccgccgaggaccuccaggagaagugcaccgagcucaaccaggccugguccucccucggcaagcgcgccgaccagcgcaaggccaagcucggcgacucccacgaccuccagcgcuuccucuccgacuuccgcgaccucauguccuggaucaacggcauccgcggccucgucuccuccgacgagcucgccaaggacgucaccggcgccgaggcccuccucgagcgccaccaggagcaccgcaccgagaucgacgcccgcgccggcaccuuccaggccuucgagcaguucggccagcagcuccucgcccacggccacuacgccucccccgagaucaagcagaagcucgacauccucgaccaggagcgcgccgaccucgagaaggccuggguccagcgccgcaugaugcucgaccagugccucgagcuccagcucuuccaccgcgacugcgagcaggccgagaacuggauggccgcccgcgaggccuuccucaacaccgaggacaagggcgacucccucgacuccgucgaggcccucaucaagaagcacgaggacuucgacaaggccaucaacguccaggaggagaagaucgccgcccuccaggccuucgccgaccagcucaucgccgccggccacuacgccaagggcgacaucuccucccgccgcaacgagguccucgaccgcuggcgccgccucaaggcccagaugaucgagaagcgcuccaagcucggcgagucccagacccuccagcaguucucccgcgacgucgacgagaucgaggccuggaucuccgagaagcuccagaccgccuccgacgaguccuacaaggaccccaccaacauccagcucuccaagcuccucuccaagcaccagaagcaccaggccuucgaggccgagcuccacgccaacgccgaccgcauccgcggcgucaucgacaugggcaacucccucaucgagcgcggcgccugcgccggcuccgaggacgccgucaaggcccgccucgccgcccucgccgaccaguggcaguuccucguccagaaguccgccgagaagucccagaagcucaaggaggccaacaagcagcagaacuucaacaccggcaucaaggacuucgacuucuggcucuccgaggucgaggcccuccucgccuccgaggacuacggcaaggaccucgccuccgucaacaaccuccucaagaagcaccagcuccucgaggccgacaucuccgcccacgaggaccgccucaaggaccucaacucccaggccgacucccucaugaccuccuccgccuucgacaccucccaggucaaggacaagcgcgacaccaucaacggccgcuuccagaagaucaaguccauggccgccucccgccgcgccaagcucaacgagucccaccgccuccaccaguucuuccgcgacauggacgacgaggaguccuggaucaaggagaagaagcuccucgucggcuccgaggacuacggccgcgaccucaccggcguccagaaccuccgcaagaagcacaagcgccucgaggccgagcucgccgcccacgagcccgccauccagggcguccucgacaccggcaagaagcucuccgacgacaacaccaucggcaaggaggagauccagcagcgccucgcccaguucgucgagcacuggaaggagcucaagcagcucgccgccgcccgcggccagcgccucgaggagucccucgaguaccagcaguucgucgccaacgucgaggaggaggaggccuggaucaacgagaagaugacccucgucgccuccgaggacuacggcgacacccucgccgccauccagggccuccucaagaagcacgaggccuucgagaccgacuucaccguccacaaggaccgcgucaacgacgucugcaccaacggccaggaccucaucaagaagaacaaccaccacgaggagaacaucuccuccaagaugaagggccucaacggcaaggucuccgaccucgagaaggccgccgcccagcgcaaggccaagcucgacgagaacuccgccuuccuccaguucaacuggaaggccgacgucgucgaguccuggaucggcgagaaggagaacucccucaagaccgacgacuacggccgcgaccucuccuccguccagacccuccucaccaagcaggagaccuucgacgccggccuccaggccuuccagcaggagggcaucgccaacaucaccgcccucaaggaccagcuccucgccgccaagcacguccaguccaaggccaucgaggcccgccacgccucccucaugaagcgcuggucccagcuccucgccaacuccgccgcccgcaagaagaagcuccucgaggcccagucccacuuccgcaaggucgaggaccucuuccucaccuucgccaagaaggccuccgccuucaacuccugguucgagaacgccgaggaggaccucaccgaccccguccgcugcaacucccucgaggagaucaaggcccuccgcgaggcccacgacgccuuccgcuccucccucuccuccgcccaggccgacuucaaccagcucgccgagcucgaccgccagaucaaguccuuccgcgucgccuccaaccccuacaccugguucaccauggaggcccucgaggagaccuggcgcaaccuccagaagaucaucaaggagcgcgagcucgagcuccagaaggagcagcgccgccaggaggagaacgacaagcuccgccaggaguucgcccagcacgccaacgccuuccaccaguggauccaggagacccgcaccuaccuccucgacggcuccugcauggucgaggaguccggcacccucgagucccagcucgaggccaccaagcgcaagcaccaggagauccgcgccaugcgcucccagcucaagaagaucgaggaccucggcgccgccauggaggaggcccucauccucgacaacaaguacaccgagcacuccaccgucggccucgcccagcagugggaccagcucgaccagcucggcaugcgcaugcagcacaaccucgagcagcagauccaggcccgcaacaccaccggcgucaccgaggaggcccucaaggaguucuccaugauguucaagcacuucgacaaggacaaguccggccgccucaaccaccaggaguucaaguccugccuccgcucccucggcuacgaccuccccauggucgaggagggcgagcccgaccccgaguucgaggccauccucgacaccgucgaccccaaccgcgacggccacgucucccuccaggaguacauggccuucaugaucucccgcgagaccgagaacgucaaguccuccgaggagaucgaguccgccuuccgcgcccucuccuccgagggcaagcccuacgucaccaaggaggagcucuaccagaaccucacccgcgagcaggccgacuacugcgucucccacaugaagcccuacgucgacggcaagggccgcgagcuccccaccgccuucgacuacgucgaguucacccgcucccucuucgucaacuga

SEQ ID NO: 50109 - RNA, 6414 nt, Artificial Sequence
  derived and/or modified sequence opt2 from SPTB__Homo_sapiens__NP_000338
augaccuccgccaccgaguucgagaacgucggcaaccagccccccuacucccgcaucaacgcccgcugggacgcccccgacgacgagcucgacaacgacaacuccuccgcccgccucuucgagcgcucccgcaucaaggcccucgccgacgagcgcgaggucguccagaagaagaccuucaccaagugggucaacucccaccucgcccgcgucuccugccgcaucaccgaccucuacaaggaccuccgcgacggccgcaugcucaucaagcuccucgagguccucuccggcgagaugcuccccaagcccaccaagggcaagaugcgcauccacugccucgagaacgucgacaaggcccuccaguuccucaaggagcagcgcguccaccucgagaacaugggcucccacgacaucgucgacggcaaccaccgccucguccucggccucaucuggaccaucauccuccgcuuccagauccaggacaucgucguccagacccaggagggccgcgagacccgcuccgccaaggacgcccuccuccucuggugccagaugaagaccgccggcuacccccacgucaacgucaccaacuucaccuccuccuggaaggacggccucgccuucaacgcccucauccacaagcaccgccccgaccucaucgacuucgacaagcucaaggacuccaacgcccgccacaaccucgagcacgccuucaacgucgccgagcgccagcucggcaucaucccccuccucgaccccgaggacgucuucaccgagaaccccgacgagaaguccaucaucaccuacgucgucgccuucuaccacuacuucuccaagaugaagguccucgccgucgagggcaagcgcgucggcaaggucaucgaccacgccaucgagaccgagaagaugaucgagaaguacuccggccucgccuccgaccuccucaccuggaucgagcagaccaucaccguccucaacucccgcaaguucgccaacucccucaccggcguccagcagcagcuccaggccuucuccaccuaccgcaccgucgagaagccccccaaguuccaggagaagggcaaccucgagguccuccucuucaccauccagucccgcaugcgcgccaacaaccagaaggucuacaccccccacgacggcaagcucgucuccgacaucaaccgcgccugggagucccucgaggaggccgaguaccgccgcgagcucgcccuccgcaacgagcucauccgccaggagaagcucgagcagcucgcccgccgcuucgaccgcaaggccgccaugcgcgagaccuggcucuccgagaaccagcgccucgucgcccaggacaacuucggcuacgaccucgccgccgucgaggccgccaagaagaagcacgaggccaucgagaccgacaccgccgccuacgaggagcgcguccgcgcccucgaggaccucgcccaggagcucgagaaggagaacuaccacgaccagaagcgcaucaccgcccgcaaggacaacauccuccgccucugguccuaccuccaggagcuccuccagucccgccgccagcgccucgagaccacccucgcccuccagaagcucuuccaggacaugcuccacuccaucgacuggauggacgagaucaaggcccaccuccucuccgccgaguucggcaagcaccuccucgaggucgaggaccuccuccagaagcacaagcucauggaggccgacaucgccauccagggcgacaaggucaaggccaucaccgccgccacccucaaguucaccgagggcaagggcuaccagcccugcgacccccaggucauccaggaccgcaucucccaccucgagcagugcuucgaggagcucuccaacauggccgccggccgcaaggcccagcucgagcaguccaagcgccucuggaaguucuucugggagauggacgaggccgaguccuggaucaaggagaaggagcagaucuacuccucccucgacuacggcaaggaccucaccuccguccucauccuccagcgcaagcacaaggccuucgaggacgagcuccgcggccucgacgcccaccucgagcagaucuuccaggaggcccacggcauggucgcccgcaagcaguucggccacccccagaucgaggcccgcaucaaggaggucuccgcccagugggaccagcucaaggaccucgccgccuucugcaagaagaaccuccaggacgccgagaacuucuuccaguuccagggcgacgccgacgaccucaaggccuggcuccaggacgcccaccgccuccucuccggcgaggacgucggccaggacgagggcgccacccgcgcccucggcaagaagcacaaggacuuccucgaggagcucgaggagucccgcggcgucauggagcaccucgagcagcaggcccagggcuuccccgaggaguuccgcgacucccccgacgucacccaccgccuccaggcccuccgcgagcucuaccagcaggucgucgcccaggccgaccuccgccagcagcgccuccaggaggcccucgaccucuacaccgucuucggcgagaccgacgccugcgagcucuggaugggcgagaaggagaaguggcucgccgagauggagaugcccgacacccucgaggaccucgaggucguccagcaccgcuucgacauccucgaccaggagaugaagacccucaugacccagaucgacggcgucaaccucgccgccaacucccucgucgaguccggccacccccgcucccgcgaggucaagcaguaccaggaccaccucaacacccgcuggcaggccuuccagacccucgucuccgagcgccgcgaggccgucgacuccgcccuccgcguccacaacuacugcgucgacugcgaggagaccuccaaguggaucaccgacaagaccaaggucgucgaguccaccaaggaccucggccgcgaccucgccggcaucaucgccauccagcgcaagcucuccggccucgagcgcgacgucgccgccauccaggcccgcgucgacgcccucgagcgcgagucccagcagcucauggacucccaccccgagcagaaggaggacaucggccagcgccagaagcaccucgaggagcucuggcagggccuccagcagucccuccagggccaggaggaccuccucggcgaggucucccagcuccaggccuuccuccaggaccucgacgacuuccaggccuggcucuccaucacccagaaggccgucgccuccgaggacaugcccgagucccuccccgaggccgagcagcuccuccagcagcacgccggcaucaaggacgagaucgacggccaccaggacuccuaccagcgcgucaaggaguccggcgagaaggucauccagggccagaccgaccccgaguaccuccuccucggccagcgccucgagggccucgacaccggcuggaacgcccucggccgcaugugggagucccgcucccacacccucgcccagugccucggcuuccaggaguuccagaaggacgccaagcaggccgaggccauccucuccaaccaggaguacacccucgcccaccucgagccccccgacucccucgaggccgccgaggccggcauccgcaaguucgaggacuuccucggcuccauggagaacaaccgcgacaagguccucucccccgucgacuccggcaacaagcucgucgccgagggcaaccucuacuccgacaagaucaaggagaagguccagcucaucgaggaccgccaccgcaagaacaacgagaaggcccaggaggccuccguccuccuccgcgacaaccucgagcuccagaacuuccuccagaacugccaggagcucacccucuggaucaacgacaagcuccucaccucccaggacgucuccuacgacgaggcccgcaaccuccacaacaaguggcucaagcaccaggccuucgucgccgagcucgccucccacgagggcuggcucgagaacaucgacgccgagggcaagcagcucauggacgagaagccccaguucaccgcccucgucucccagaagcucgaggcccuccaccgccucugggacgagcuccaggccaccaccaaggagaagacccagcaccucuccgccgcccgcuccuccgaccuccgccuccagacccacgccgaccucaacaaguggaucuccgccauggaggaccagcuccgcuccgacgaccccggcaaggaccucaccuccgucaaccgcaugcucgccaagcucaagcgcgucgaggaccaggucaacguccgcaaggaggagcucggcgagcucuucgcccagguccccuccaugggcgaggagggcggcgacgccgaccucuccaucgagaagcgcuuccucgaccuccucgagccccucggccgccgcaagaagcagcucgaguccucccgcgccaagcuccagaucucccgcgaccucgaggacgagacccucugggucgaggagcgccucccccucgcccaguccgccgacuacggcaccaaccuccagaccguccagcucuucaugaagaagaaccagacccuccagaacgagauccucggccacaccccccgcgucgaggacguccuccagcgcggccagcagcucgucgaggccgccgagaucgacugccaggaccucgaggagcgccucggccaccuccaguccuccugggaccgccuccgcgaggccgccgccggccgccuccagcgccuccgcgacgccaacgaggcccagcaguacuaccucgacgccgacgaggccgaggccuggaucggcgagcaggagcucuacgucaucuccgacgagauccccaaggacgaggagggcgccaucgucaugcucaagcgccaccuccgccagcagcgcgccgucgaggacuacggccgcaacaucaagcagcucgccucccgcgcccagggccuccucuccgccggccaccccgagggcgagcagaucauccgccuccagggccaggucgacaagcacuacgccggccucaaggacgucgccgaggagcgcaagcgcaagcucgagaacauguaccaccucuuccagcucaagcgcgagaccgacgaccucgagcaguggaucuccgagaaggagcucgucgccuccucccccgagaugggccaggacuucgaccacgucacccuccuccgcgacaaguuccgcgacuucgcccgcgagaccggcgccaucggccaggagcgcgucgacaacgucaacgccuucaucgagcgccucaucgacgccggccacuccgaggccgccaccaucgccgaguggaaggacggccucaacgagaugugggccgaccuccucgagcucaucgacacccgcaugcagcuccucgccgccuccuacgaccuccaccgcuacuucuacaccggcgccgagauccucggccucaucgacgagaagcaccgcgagcuccccgaggacgucggccucgacgccuccaccgccgaguccuuccaccgcguccacaccgccuucgagcgcgagcuccaccuccucggcguccagguccagcaguuccaggacgucgccacccgccuccagaccgccuacgccggcgagaaggccgaggccauccagaacaaggagcaggaggucuccgccgccuggcaggcccuccucgacgccugcgccggccgccgcacccagcucgucgacaccgccgacaaguuccgcuucuucuccauggcccgcgaccuccucuccuggauggaguccaucauccgccagaucgagacccaggagcgcccccgcgacgucuccuccgucgagcuccucaugaaguaccaccagggcaucaacgccgagaucgagacccgcuccaagaacuucuccgccugccucgagcucggcgagucccuccuccagcgccagcaccaggccuccgaggagauccgcgagaagcuccagcaggucaugucccgccgcaaggagaugaacgagaagugggaggcccgcugggagcgccuccgcaugcuccucgaggucugccaguucucccgcgacgccuccgucgccgaggccuggcucaucgcccaggagcccuaccucgccuccggcgacuucggccacaccgucgacuccgucgagaagcucaucaagcgccacgaggccuucgagaaguccaccgccuccugggccgagcgcuucgccgcccucgagaagcccaccacccucgagcucaaggagcgccagaucgccgagcgccccgccgaggagaccggcccccaggaggaggagggcgagaccgccggcgaggcccccgucucccaccacgccgccaccgagcgcaccucccccgucucccucuggucccgccucuccuccuccugggagucccuccagcccgagcccucccaccccuacuga

SEQ ID NO: 50110 - RNA, 6468 nt, Artificial Sequence
  derived and/or modified sequence opt2 from SPTBN1__Homo_sapiens__NP_842565
auggagcuccagcgcaccuccuccaucuccggcccccucucccccgccuacaccggccagguccccuacaacuacaaccagcucgagggccgcuucaagcagcuccaggacgagcgcgaggccguccagaagaagaccuucaccaagugggucaacucccaccucgcccgcgucuccugccgcaucaccgaccucuacaccgaccuccgcgacggccgcaugcucaucaagcuccucgagguccucuccggcgagcgccuccccaagcccaccaagggccgcaugcgcauccacugccucgagaacgucgacaaggcccuccaguuccucaaggagcagcgcguccaccucgagaacaugggcucccacgacaucgucgacggcaaccaccgccucacccucggccucaucuggaccaucauccuccgcuuccagauccaggacaucuccgucgagaccgaggacaacaaggagaagaaguccgccaaggacgcccuccuccucuggugccagaugaagaccgccggcuaccccaacgucaacauccacaacuucaccaccuccuggcgcgacggcauggccuucaacgcccucauccacaagcaccgccccgaccucaucgacuucgacaagcucaagaaguccaacgcccacuacaaccuccagaacgccuucaaccucgccgagcagcaccucggccucaccaagcuccucgaccccgaggacaucuccgucgaccaccccgacgagaaguccaucaucaccuacgucgucaccuacuaccacuacuucuccaagaugaaggcccucgccgucgagggcaagcgcaucggcaagguccucgacaacgccaucgagaccgagaagaugaucgagaaguacgagucccucgccuccgaccuccucgaguggaucgagcagaccaucaucauccucaacaaccgcaaguucgccaacucccucgucggcguccagcagcagcuccaggccuucaacaccuaccgcaccgucgagaagccccccaaguucaccgagaagggcaaccucgagguccuccucuucaccauccaguccaagaugcgcgccaacaaccagaaggucuacaugccccgcgagggcaagcucaucuccgacaucaacaaggccugggagcgccucgagaaggccgagcacgagcgcgagcucgcccuccgcaacgagcucauccgccaggagaagcucgagcagcucgcccgccgcuucgaccgcaaggccgccaugcgcgagaccuggcucuccgagaaccagcgccucgucucccaggacaacuucggcuucgaccuccccgccgucgaggccgccaccaagaagcacgaggccaucgagaccgacaucgccgccuacgaggagcgcguccaggccgucgucgccgucgcccgcgagcucgaggccgagaacuaccacgacaucaagcgcaucaccgcccgcaaggacaacgucauccgccucugggaguaccuccucgagcuccuccgcgcccgccgccagcgccucgagaugaaccucggccuccagaagaucuuccaggagaugcucuacaucauggacuggauggacgagaugaagguccucguccucucccaggacuacggcaagcaccuccucggcgucgaggaccuccuccagaagcacacccucgucgaggccgacaucggcauccaggccgagcgcguccgcggcgucaacgccuccgcccagaaguucgccaccgacggcgagggcuacaagcccugcgacccccaggucauccgcgaccgcgucgcccacauggaguucugcuaccaggagcucugccagcucgccgccgagcgccgcgcccgccucgaggagucccgccgccucuggaaguucuucugggagauggccgaggaggagggcuggauccgcgagaaggagaagauccucuccuccgacgacuacggcaaggaccucaccuccgucaugcgccuccucuccaagcaccgcgccuucgaggacgagauguccggccgcuccggccacuucgagcaggccaucaaggagggcgaggacaugaucgccgaggagcacuucggcuccgagaagauccgcgagcgcaucaucuacauccgcgagcagugggccaaccucgagcagcucuccgccauccgcaagaagcgccucgaggaggccucccuccuccaccaguuccaggccgacgccgacgacaucgacgccuggaugcucgacauccucaagaucgucuccuccuccgacgucggccacgacgaguacuccacccagucccucgucaagaagcacaaggacgucgccgaggagaucgccaacuaccgccccacccucgacacccuccacgagcaggccuccgcccucccccaggagcacgccgagucccccgacguccgcggccgccucuccggcaucgaggagcgcuacaaggaggucgccgagcucacccgccuccgcaagcaggcccuccaggacacccucgcccucuacaagauguucuccgaggccgacgccugcgagcucuggaucgacgagaaggagcaguggcucaacaacaugcagauccccgagaagcucgaggaccucgaggucauccagcaccgcuucgagucccucgagcccgagaugaacaaccaggccucccgcgucgccgucgucaaccagaucgcccgccagcucaugcacuccggccaccccuccgagaaggagaucaaggcccagcaggacaagcucaacacccgcuggucccaguuccgcgagcucgucgaccgcaagaaggacgcccuccucuccgcccucuccauccagaacuaccaccucgagugcaacgagaccaaguccuggauccgcgagaagaccaaggucaucgaguccacccaggaccucggcaacgaccucgccggcgucauggcccuccagcgcaagcucaccggcauggagcgcgaccucgucgccaucgaggccaagcucuccgaccuccagaaggaggccgagaagcucgaguccgagcaccccgaccaggcccaggccauccucucccgccucgccgagaucuccgacgucugggaggagaugaagaccacccucaagaaccgcgaggccucccucggcgaggccuccaagcuccagcaguuccuccgcgaccucgacgacuuccaguccuggcucucccgcacccagaccgccaucgccuccgaggacaugcccaacacccucaccgaggccgagaagcuccucacccagcacgagaacaucaagaacgagaucgacaacuacgaggaggacuaccagaagaugcgcgacaugggcgagauggucacccagggccagaccgacgcccaguacauguuccuccgccagcgccuccaggcccucgacaccggcuggaacgagcuccacaagaugugggagaaccgccagaaccuccucucccagucccacgccuaccagcaguuccuccgcgacaccaagcaggccgaggccuuccucaacaaccaggaguacguccucgcccacaccgagaugcccaccacccucgagggcgccgaggccgccaucaagaagcaggaggacuucaugaccaccauggacgccaacgaggagaagaucaacgccgucgucgagaccggccgccgccucgucuccgacggcaacaucaacuccgaccgcauccaggagaaggucgacuccaucgacgaccgccaccgcaagaaccgcgagaccgccuccgagcuccucaugcgccucaaggacaaccgcgaccuccagaaguuccuccaggacugccaggagcucucccucuggaucaacgagaagaugcucaccgcccaggacauguccuacgacgaggcccgcaaccuccacuccaaguggcucaagcaccaggccuucauggccgagcucgccuccaacaaggaguggcucgacaagaucgagaaggagggcaugcagcucaucuccgagaagcccgagaccgaggccgucgucaaggagaagcucaccggccuccacaagaugugggagguccucgaguccaccacccagaccaaggcccagcgccucuucgacgccaacaaggccgagcucuucacccaguccugcgccgaccucgacaaguggcuccacggccucgagucccagauccaguccgacgacuacggcaaggaccucaccuccgucaacauccuccucaagaagcagcagaugcucgagaaccagauggagguccgcaagaaggagaucgaggagcuccagucccaggcccaggcccucucccaggagggcaaguccaccgacgaggucgacuccaagcgccucaccguccagaccaaguucauggagcuccucgagccccucaacgagcgcaagcacaaccuccucgccuccaaggagauccaccaguucaaccgcgacgucgaggacgagauccucugggucggcgagcgcaugccccucgccaccuccaccgaccacggccacaaccuccagaccguccagcuccucaucaagaagaaccagacccuccagaaggagauccagggccaccagccccgcaucgacgacaucuucgagcgcucccagaacaucgucaccgacuccuccucccucuccgccgaggccauccgccagcgccucgccgaccucaagcagcucuggggccuccucaucgaggagaccgagaagcgccaccgccgccucgaggaggcccaccgcgcccagcaguacuacuucgacgccgccgaggccgaggccuggauguccgagcaggagcucuacaugauguccgaggagaaggccaaggacgagcaguccgccgucuccaugcucaagaagcaccagauccucgagcaggccgucgaggacuacgccgagaccguccaccagcucuccaagaccucccgcgcccucgucgccgacucccaccccgaguccgagcgcaucuccaugcgccaguccaaggucgacaagcucuacgccggccucaaggaccucgccgaggagcgccgcggcaagcucgacgagcgccaccgccucuuccagcucaaccgcgaggucgacgaccucgagcaguggaucgccgagcgcgaggucgucgccggcucccacgagcucggccaggacuacgagcacgucaccaugcuccaggagcgcuuccgcgaguucgcccgcgacaccggcaacaucggccaggagcgcgucgacaccgucaaccaccucgccgacgagcucaucaacuccggccacuccgacgccgccaccaucgccgaguggaaggacggccucaacgaggccugggccgaccuccucgagcucaucgacacccgcacccagauccucgccgccuccuacgagcuccacaaguucuaccacgacgccaaggagaucuucggccgcauccaggacaagcacaagaagcuccccgaggagcucggccgcgaccagaacaccgucgagacccuccagcgcaugcacaccaccuucgagcacgacauccaggcccucggcacccagguccgccagcuccaggaggacgccgcccgccuccaggccgccuacgccggcgacaaggccgacgacauccagaagcgcgagaacgagguccucgaggccuggaagucccuccucgacgccugcgagucccgccgcguccgccucgucgacaccggcgacaaguuccgcuucuucuccaugguccgcgaccucaugcucuggauggaggacgucauccgccagaucgaggcccaggagaagccccgcgacgucuccuccgucgagcuccucaugaacaaccaccagggcaucaaggccgagaucgacgcccgcaacgacuccuucaccaccugcaucgagcucggcaagucccuccucgcccgcaagcacuacgccuccgaggagaucaaggagaagcuccuccagcucaccgagaagcgcaaggagaugaucgacaagugggaggaccgcugggaguggcuccgccucauccucgagguccaccaguucucccgcgacgccuccgucgccgaggccuggcuccucggccaggagcccuaccucuccucccgcgagaucggccaguccgucgacgaggucgagaagcucaucaagcgccacgaggccuucgagaaguccgccgccaccugggacgagcgcuucuccgcccucgagcgccucaccacccucgagcuccucgagguccgccgccagcaggaggaggaggagcgcaagcgccgcccccccucccccgagcccuccaccaaggucuccgaggaggccgagucccagcagcagugggacaccuccaagggcgagcaggucucccagaacggccuccccgccgagcagggcuccccccgcgucuccuaccgcucccagaccuaccagaacuacaagaacuucaacucccgccgcaccgccuccgaccagcccugguccggccucuga

SEQ ID NO: 50111 - RNA, 7173 nt, Artificial Sequence
  derived and/or modified sequence opt2 from SPTBN2__Homo_sapiens__NP_008877
auguccuccacccucucccccaccgacuucgacucccucgagauccagggccaguacuccgacaucaacaaccgcugggaccuccccgacuccgacugggacaacgacuccuccuccgcccgccucuucgagcgcucccgcaucaaggcccucgccgacgagcgcgaggccguccagaagaagaccuucaccaagugggucaacucccaccucgcccgcgucaccugccgcgucggcgaccucuacuccgaccuccgcgacggccgcaaccuccuccgccuccucgagguccucuccggcgagauccuccccaagcccaccaagggccgcaugcgcauccacugccucgagaacgucgacaaggcccuccaguuccucaaggagcagaagguccaccucgagaacaugggcucccacgacaucgucgacggcaaccaccgccucacccucggccucgucuggaccaucauccuccgcuuccagauccaggacaucuccgucgagaccgaggacaacaaggagaagaaguccgccaaggacgcccuccuccucuggugccagaugaagaccgccggcuaccccaacgucaacguccacaacuucaccaccuccuggcgcgacggccucgccuucaacgccaucguccacaagcaccgccccgaccuccucgacuucgagucccucaagaagugcaacgcccacuacaaccuccagaacgccuucaaccucgccgagaaggagcucggccucaccaagcuccucgaccccgaggacgucaacgucgaccagcccgacgagaaguccaucaucaccuacgucgccaccuacuaccacuacuucuccaagaugaaggcccucgccgucgagggcaagcgcaucggcaagguccucgaccacgccauggaggccgagcgccucgucgagaaguacgagucccucgccuccgagcuccuccaguggaucgagcagaccaucgucacccucaacgaccgccagcucgccaacucccucuccggcguccagaaccagcuccaguccuucaacuccuaccgcaccgucgagaagccccccaaguucaccgagaagggcaaccucgagguccuccucuucaccauccaguccaagcuccgcgccaacaaccagaaggucuacaccccccgcgagggccgccucaucuccgacaucaacaaggccugggagcgccucgagaaggccgagcacgagcgcgagcucgcccuccgcaccgagcucauccgccaggagaagcucgagcagcucgccgcccgcuucgaccgcaaggccgccaugcgcgagaccuggcucuccgagaaccagcgccucgucucccaggacaacuucggccucgagcucgccgccgucgaggccgccguccgcaagcacgaggccaucgagaccgacaucgucgccuacuccggccgcguccaggccgucgacgccgucgccgccgagcucgccgccgagcgcuaccacgacaucaagcgcaucgccgcccgccagcacaacgucgcccgccucugggacuuccuccgccagauggucgccgcccgccgcgagcgccuccuccucaaccucgagcuccagaaggucuuccaggaccuccucuaccucauggacuggauggaggagaugaagggccgccuccagucccaggaccucggccgccaccucgccggcgucgaggaccuccuccagcuccacgagcucgucgaggccgacaucgccguccaggccgagcgcguccgcgccgucuccgccuccgcccuccgcuucugcaaccccggcaaggaguaccgccccugcgacccccagcucgucuccgagcgcgucgccaagcucgagcaguccuacgaggcccucugcgagcucgccgccgcccgccgcgcccgccucgaggagucccgccgccucuggcgcuuccucugggaggucggcgaggccgaggccuggguccgcgagcagcagcaccuccucgccuccgccgacaccggccgcgaccucaccggcgcccuccgccuccucaacaagcacaccgcccuccgcggcgagauguccggccgccucggcccccucaagcucacccucgagcagggccagcagcucgucgccgagggccaccccggcgccucccaggccuccgcccgcgccgccgagcuccaggcccagugggagcgccucgaggcccucgccgaggagcgcgcccagcgccucgcccaggccgccucccucuaccaguuccaggccgacgccaacgacauggaggccuggcucgucgacgcccuccgccucgucuccucccccgagcucggccacgacgaguucuccacccaggcccucgcccgccagcaccgcgcccucgaggaggagauccgcucccaccgccccacccucgacgcccuccgcgagcaggccgccgcccucccccccacccucucccgcacccccgagguccagggccgcguccccacccucgagcgccacuacgaggagcuccaggcccgcgccggcgagcgcgcccgcgcccucgaggccgcccucgcccucuacaccaugcucuccgaggccggcgccugcggccucugggucgaggagaaggagcaguggcucaacggccucgcccuccccgagcgccucgaggaccucgaggucguccagcagcgcuucgagacccucgagcccgagaugaacacccucgccgcccagaucaccgccgucaacgacaucgccgagcagcuccucaaggccaacccccccggcaaggaccgcaucgucaacacccaggagcagcucaaccaccgcuggcagcaguuccgccgccucgccgacggcaagaaggccgcccucaccuccgcccucuccauccagaacuaccaccucgagugcaccgagacccaggccuggaugcgcgagaagaccaaggucaucgaguccacccagggccucggcaacgaccucgccggcguccucgcccuccagcgcaagcucgccggcaccgagcgcgaccucgaggccaucgccgcccgcgucggcgagcucacccgcgaggccaacgcccucgccgccggccaccccgcccaggccgucgccaucaacgcccgccuccgcgagguccagaccggcugggaggaccuccgcgccaccaugcgccgccgcgaggagucccucggcgaggcccgccgccuccaggacuuccuccgcucccucgacgacuuccaggccuggcucggccgcacccagaccgccgucgccuccgaggagggccccgccacccuccccgaggccgaggcccuccucgcccagcacgccgcccuccgcggcgaggucgagcgcgcccaguccgaguacucccgccuccgcgcccucggcgaggaggucacccgcgaccaggccgacccccagugccucuuccuccgccagcgccucgaggcccucggcaccggcugggaggagcucggccgcaugugggagucccgccagggccgccucgcccaggcccacggcuuccagggcuuccuccgcgacgcccgccaggccgagggcguccucuccucccaggaguacguccucucccacaccgagaugcccggcacccuccaggccgccgacgccgccaucaagaagcucgaggacuucauguccaccauggacgccaacggcgagcgcauccacggccuccucgaggccggccgccagcucgucuccgagggcaacauccacgccgacaagauccgcgagaaggccgacuccaucgagcgccgccacaagaagaaccaggacgccgcccagcaguuccucggccgccuccgcgacaaccgcgagcagcagcacuuccuccaggacugccacgagcucaagcucuggaucgacgagaagaugcucaccgcccaggacgucuccuacgacgaggcccgcaaccuccacaccaaguggcagaagcaccaggccuucauggccgagcucgccgccaacaaggacuggcucgacaaggucgacaaggagggccgcgagcucacccucgagaagcccgagcucaaggcccucgucuccgagaagcuccgcgaccuccaccgccgcugggacgagcucgagaccaccacccaggccaaggcccgcucccucuucgacgccaaccgcgccgagcucuucgcccaguccugcugcgcccucgaguccuggcucgagucccuccaggcccagcuccacuccgacgacuacggcaaggaccucaccuccgucaacauccuccucaagaagcagcagaugcucgagugggagauggccguccgcgagaaggaggucgaggccauccaggcccaggccaaggcccucgcccaggaggaccagggcgccggcgaggucgagcgcaccucccgcgccgucgaggagaaguuccgcgcccucugccagcccaugcgcgagcgcugccgccgccuccaggccucccgcgagcagcaccaguuccaccgcgacgucgaggacgagauccucugggucaccgagcgccuccccauggccuccuccauggagcacggcaaggaccuccccuccguccagcuccucaugaagaagaaccagacccuccagaaggagauccagggccacgagccccgcaucgccgaccuccgcgagcgccagcgcgcccucggcgccgccgccgccggccccgagcucgccgagcuccaggagauguggaagcgccucggccacgagcucgagcuccgcggcaagcgccucgaggacgcccuccgcgcccagcaguucuaccgcgacgccgccgaggccgaggccuggaugggcgagcaggagcuccacaugaugggccaggagaaggccaaggacgagcucuccgcccaggccgaggucaagaagcaccagguccucgagcaggcccucgccgacuacgcccagaccauccaccagcucgccgccuccucccaggacaugaucgaccacgagcaccccgaguccacccgcaucuccauccgccaggcccaggucgacaagcucuacgccggccucaaggagcucgccggcgagcgccgcgagcgccuccaggagcaccuccgccucugccagcuccgccgcgagcucgacgaccucgagcaguggauccaggagcgcgaggucgucgccgccucccacgagcucggccaggacuacgagcacgucaccaugcuccgcgacaaguuccgcgaguucucccgcgacaccuccaccaucggccaggagcgcgucgacuccgccaacgcccucgccaacggccucaucgccggcggccacgccgcccgcgccaccgucgccgaguggaaggacucccucaacgaggccugggccgaccuccucgagcuccucgacacccgcggccagguccucgccgccgccuacgagcuccagcgcuuccuccacggcgcccgccaggcccucgcccgcguccagcacaagcagcagcagcuccccgacggcaccggccgcgaccucaacgccgccgaggcccuccagcgccgccacugcgccuacgagcacgacauccaggcccucuccccccagguccagcagguccaggacgacggccaccgccuccagaaggccuacgccggcgacaaggccgaggagaucggccgccacaugcaggccgucgccgaggccugggcccagcuccagggcuccuccgccgcccgccgccagcuccuccucgacaccaccgacaaguuccgcuucuucaaggccguccgcgagcucaugcucuggauggacgaggucaaccuccagauggacgcccaggagcgcccccgcgacgucuccuccgccgaccucgucaucaagaaccagcagggcaucaaggccgagaucgaggcccgcgccgaccgcuucuccuccugcaucgacaugggcaaggagcuccucgcccgcucccacuacgccgccgaggagaucuccgagaagcucucccagcuccaggcccgccgccaggagaccgccgagaaguggcaggagaagauggacuggcuccagcucguccucgagguccucgucuucggccgcgacgccggcauggccgaggccuggcucugcucccaggagccccucguccgcuccgccgagcucggcugcaccgucgacgaggucgagucccucaucaagcgccacgaggccuuccagaaguccgccgucgccugggaggagcgcuucugcgcccucgagaagcucaccgcccucgaggagcgcgagaaggagcgcaagcgcaagcgcgaggaggaggagcgccgcaagcagccccccgcccccgagcccaccgccuccgucccccccggcgaccucgucggcggccagaccgccuccgacaccaccugggacggcacccagccccgccccccccccuccacccaggcccccuccgucaacggcgucugcaccgacggcgagcccucccagccccuccucggccagcagcgccucgagcacuccuccuuccccgagggccccggccccggcuccggcgacgaggccaacggcccccgcggcgagcgccagacccgcacccgcggccccgcccccuccgccaugccccagucccgcuccaccgaguccgcccacgccgccacccuccccccccgcggccccgagcccuccgcccaggagcagauggagggcaugcucugccgcaagcaggagauggaggccuucggcaagaaggccgccaaccgcuccuggcagaacgucuacugcguccuccgccgcggcucccucggcuucuacaaggacgccaaggccgccuccgccggcguccccuaccacggcgagguccccgucucccucgcccgcgcccagggcuccgucgccuucgacuaccgcaagcgcaagcacgucuucaagcucggccuccaggacggcaaggaguaccucuuccaggccaaggacgaggccgagauguccuccuggcuccgcgucgucaacgccgccaucgccaccgccuccuccgccuccggcgagcccgaggagcccgucguccccuccaccacccgcggcaugacccgcgccaugaccaugccccccgucucccccgucggcgccgagggccccgucguccuccgcuccaaggacggccgcgagcgcgagcgcgagaagcgcuucuccuucuucaagaagaacaaguga

SEQ ID NO: 50112 - RNA, 7695 nt, Artificial Sequence
  derived and/or modified sequence opt2 from SPTBN4__Homo_sapiens__NP_066022
auggcccagguccccggcgaggucgacaacauggagggccuccccgcccccaacaacaaccccgccgcccgcugggagucccccgaccgcggcugggagcgcgagcagcccgccgccuccaccgccgccgccucccucuucgagugcucccgcaucaaggcccucgccgacgagcgcgaggccguccagaagaagaccuucaccaagugggucaacucccaccucgcccgcgucggcugccacaucggcgaccucuacgucgaccuccgcgacggcuucguccucacccgccuccucgagguccucuccggcgagcagcucccccgccccacccgcggccgcaugcgcauccacucccucgagaacgucgacaaggcccuccaguuccucaaggagcagcgcguccaccucgagaacgucggcucccacgacaucgucgacggcaaccaccgccucacccucggccucgucuggaccaucauccuccgcuuccagauccaggucaucaagaucgagaccgaggacaaccgcgagacccgcuccgccaaggacgcccuccuccucuggugccagaugaagaccgccggcuaccccgaggucaacauccagaacuucaccaccuccuggcgcgacggccucgccuucaacgcccucauccaccgccaccgccccgaccucgucgacuucuccaagcucaccaaguccaacgccaacuacaaccuccagcgcgccuuccgcaccgccgagcagcaccucggccucgcccgccuccucgaccccgaggacgucaacauggaggcccccgacgagaaguccaucaucaccuacgucgucuccuucuaccacuacuucuccaagaugaaggcccucgccgucgagggcaagcgcaucggcaagguccucgaccagguccucgaggucggcaagaucaucgagcgcuacgaggagcucgccgccgagcuccucgccuggauccaccgcaccgucggccucaucuccaaccagaaguucgccaacucccucuccggcguccagcagcagcuccaggccuucaccgccuacugcacccucgagaagcccgucaaguuccaggagaagggcaaccucgagguccuccucuucuccauccaguccaagcuccgcgccugcaaccgccgccucuucgucccccgcgagggcugcggcaucugggacaucgacaaggccuggggcgagcucgagaaggccgagcacgagcgcgaggccgcccuccgcgccgagcucauccgccaggagaagcucgagcuccucgcccagcgcuucgaccacaaggucgccaugcgcgaguccuggcucaacgagaaccagcgccucgucucccaggacaacuucggcuacgagcuccccgccgucgaggccgccaugaagaagcacgaggccaucgaggccgacaucgccgccuacgaggagcgcguccagggcgucgccgagcucgcccaggcccucgccgccgagggcuacuacgacauccgccgcgucgccgcccagcgcgacuccguccuccgccagugggcccuccucaccggccucgucggcgcccgccgcacccgccucgagcagaaccucgcccuccagaaggucuuccaggagauggucuacauggucgacuggauggaggagaugcaggcccagcuccucucccgcgagugcggccagcaccucgucgaggccgacgaccuccuccagaagcacggccuccucgagggcgacaucgccgcccaguccgagcgcgucgaggcccucaacgccgccgcccuccgcuucucccagcuccagggcuaccagcccugcgacccccaggucaucugcaaccgcgucaaccacguccacggcugccucgccgagcuccaggagcaggccgcccgccgccgcgccgagcucgaggccucccgcucccucugggcccuccuccaggagcucgaggaggccgaguccugggcccgcgacaaggagcgccuccucgaggccgccggcggcggcggcgccgccggcgccgccggcgccgccggcaccgccggcggcgcccacgaccucuccuccaccgcccgccuccucgcccagcacaagauccuccagggcgagcucggcggccgccgcgcccuccuccagcaggcccuccgcugcggcgaggagcucgucgccgccggcggcgccgucggccccggcgccgacaccguccaccucgucggccucgccgagcgcgccgccuccgcccgccgccgcuggcagcgccucgaggaggccgccgcccgccgcgagcgccgccuccaggaggcccgcgcccuccaccaguucggcgccgaccucgacggccuccucgacuggcuccgcgacgccuaccgccucgccgccgccggcgacuucggccacgacgaggccuccucccgccgccucgcccgccagcaccgcgcccucaccggcgaggucgaggcccaccgcggccccgucuccggccuccgccgccagcucgccacccucggcggcgccuccggcgccggcccccucgucgucgcccuccagguccgcgucgucgaggccgagcagcucuucgccgaggucaccgaggucgccgcccuccgccgccaguggcuccgcgacgcccucgccgucuaccgcauguucggcgagguccacgccugcgagcucuggaucggcgagaaggagcaguggcuccucuccaugcgcguccccgacucccucgacgacgucgaggucguccagcaccgcuucgagucccucgaccaggagaugaacucccucaugggccgcguccucgacgucaaccacaccguccaggagcucgucgagggcggccaccccuccuccgacgagguccgcuccugccaggaccaccucaacucccgcuggaaccgcaucgucgagcucgucgagcagcgcaaggaggagauguccgccguccuccucgucgagaaccacguccucgaggucgccgagguccgcgcccagguccgcgagaagcgccgcgccgucgaguccgccccccgcgccggcggcgcccuccaguggcgccucuccggccucgaggccgcccuccaggcccucgagccccgccaggccgcccuccucgaggaggccgcccuccucgccgagcgcuuccccgcccaggccgcccgccuccaccagggcgccgaggagcucggcgccgaguggggcgcccucgccuccgccgcccaggccugcggcgaggccgucgccgccgccggccgccuccagcgcuuccuccacgaccucgacgccuuccucgacuggcucguccgcgcccaggaggccgccggcggcuccgagggcccccuccccaacucccucgaggaggccgacgcccuccucgcccgccacgccgcccucaaggaggaggucgaccagcgcgaggaggacuacgcccgcaucgucgccgccuccgaggcccuccucgccgccgacggcgccgagcucggccccggccucgcccucgacgaguggcucccccaccucgagcucggcuggcacaagcuccucggccucugggaggcccgccgcgaggcccucguccaggcccacaucuaccagcucuuccuccgcgaccuccgccaggcccucgucguccuccgcaaccaggagauggcccucuccggcgccgagcuccccggcaccgucgaguccgucgaggaggcccucaagcagcaccgcgacuuccucaccaccauggagcucucccagcagaagaugcaggucgccguccaggccgccgagggccuccuccgccagggcaacaucuacggcgagcaggcccaggaggccgucacccgccuccucgagaagaaccaggagaaccagcuccgcgcccagcaguggaugcagaagcuccacgaccagcucgagcuccagcacuuccuccgcgacugccacgagcucgacggcuggauccacgagaagaugcucauggcccgcgacggcacccgcgaggacaaccacaagcuccacaagcgcuggcuccgccaccaggccuucauggccgagcucgcccagaacaaggaguggcucgagaagaucgagcgcgagggccagcagcucaugcaggagaagcccgagcucgccgccuccguccgcaagaagcucggcgagauccgccagugcugggccgagcucgaguccaccacccaggccaaggcccgccagcucuucgaggccuccaaggccgaccagcucguccaguccuucgccgagcucgacaagaagcuccuccacauggagucccagcuccaggacgucgaccccggcggcgaccucgccaccgucaacucccagcucaagaagcuccaguccauggagucccaggucgaggagugguaccgcgaggucggcgagcuccaggcccagaccgccgcccucccccucgagcccgccuccaaggagcucgucggcgagcgccagaacgccgucggcgagcgccucguccgccuccucgagccccuccaggagcgccgccgccuccuccucgccuccaaggagcuccaccaggucgcccacgaccucgacgacgagcucgccuggguccaggagcgccucccccucgccaugcagaccgagcgcggcaacggccuccaggccguccagcagcacaucaagaagaaccagggccuccgccgcgagauccaggcccacggcccccgccucgaggagguccucgagcgcgccggcgcccucgccucccuccgcucccccgaggccgaggccguccgccgcggccucgagcagcuccaguccgccugggccggccuccgcgaggccgccgagcgccgccagcagguccucgacgccgccuuccaggucgagcaguacuacuucgacgucgccgaggucgaggccuggcucggcgagcaggagcuccucaugauguccgaggacaagggcaaggacgagcaguccacccuccagcuccucaagaagcaccuccagcucgagcagggcgucgagaacuacgaggaguccaucgcccagcucucccgccagugccgcgcccuccucgagaugggccaccccgacuccgagcagaucucccgccgccagucccaggucgaccgccucuacgucgcccucaaggagcucggcgaggagcgccgcgucgcccucgagcagcaguacuggcucuaccagcucucccgccaggucuccgagcucgagcacuggaucgccgagaaggaggucgucgccggcucccccgagcucggccaggacuucgagcacgucuccguccuccaggagaaguucuccgaguucgccuccgagaccggcauggccggccgcgagcgccucgccgccgucaaccagauggucgacgagcucaucgagugcggccacaccgccgccgccaccauggccgaguggaaggacggccucaacgaggccugggccgagcuccucgagcucaugggcacccgcgcccagcuccucgccgccucccgcgagcuccacaaguucuucuccgacgcccgcgagcuccagggccagaucgaggagaagcgccgccgccucccccgccucaccaccccccccgagccccgccccuccgccuccuccaugcagcgcacccuccgcgccuucgagcacgaccuccagcuccucgucucccagguccgccagcuccaggagggcgccgcccagcuccgcaccgucuacgccggcgagcacgccgaggccaucgccucccgcgagcaggagguccuccagggcuggaaggagcuccucuccgccugcgaggacgcccgccuccacgucuccuccaccgccgacgcccuccgcuuccacucccagguccgcgaccuccucuccuggauggacggcaucgccucccagaucggcgccgccgacaagccccgcgacgucuccuccgucgagguccucaugaacuaccaccagggccucaagaccgagcucgaggcccgcguccccgagcucaccaccugccaggagcucggccgcucccuccuccucaacaaguccgccauggccgacgagauccaggcccagcucgacaagcucggcacccgcaaggaggaggucuccgagaagugggaccgccacugggaguggcuccagcagaugcucgagguccaccaguucgcccaggaggccgucgucgccgacgccuggcucaccgcccaggagccccuccuccagucccgcgagcucggcuccuccgucgacgaggucgagcagcucauccgccgccacgaggccuuccgcaaggccgccgccgccugggaggagcgcuucuccucccuccgccgccucaccaccaucgagaagaucaaggccgagcaguccaagcagccccccaccccccuccucggccgcaaguucuucggcgaccccaccgagcucgccgccaaggccgccccccuccuccgccccggcggcuacgagcgcggccucgagccccucgcccgccgcgccuccgacacccucuccgccgagguccgcacccgcgucggcuacguccgccaggagcucaagcccgagcgccuccagccccgcaucgaccgccuccccgagauccccggccgcgucgagcccgccgcccuccccgccgcccccgaggacgccgccgagacccccgccacccccgccgccgccgagcagguccgcccccgccccgagcgccaggaguccgccgaccgcgccgaggagcucccccgccgccgccgccccgagcgccaggaguccgucgaccaguccgaggaggccgcccgccgccgccgccccgagcgccaggaguccgccgagcacgaggccgcccacucccucacccucggccgcuacgagcagauggagcgccgccgcgagcgccgcgagcgccgccucgagcgccaggaguccuccgagcaggagaugcccauccgcggcgaccucgucaagggcaaggccacccucgccgacaucgucgagcagcuccaggagaaggaggccggccccggccuccccgccggccccucccucccccagccccgcgagcucccccccggccgccuccccaacggccucgagcuccccgagcgcaccccccgccccgaccgcccccgcgcccgcgaccgccccaagccccgccgccgcccccgcccccgcgagggcggcgagggcggcggcucccgccgcucccgcuccgcccccgcccagggcggcuccgcccccgcccccccccccccccccacccacaccguccagcacgagggcuuccuccuccgcaagcgcgagcucgacgccaaccgcaaguccuccaaccgcuccugggucucccucuacugcguccucuccaagggcgagcucggcuucuacaaggacuccaagggccccgccuccggcuccacccacggcggcgagccccuccucucccuccacaaggccaccuccgaggucgccuccgacuacaagaagaagaagcacgucuucaagcuccagacccaggacggcuccgaguuccuccuccaggccaaggacgaggaggagaugaacggcuggcucgaggccgucgccuccuccgucgccgagcacgccgagaucgcccgcuggggccagacccuccccaccaccuccuccaccgacgagggcaaccccaagcgcgagggcggcgaccgccgcgccuccggccgccgcaaguga

SEQ ID NO: 50113 - RNA, 11025 nt, Artificial Sequence
  derived and/or modified sequence opt2 from SPTBN5__Homo_sapiens__NP_057726
auggccggccagccccacuccccccgcgagcuccucggcgccgccggccaccgcucccgccgccccuccaccgagcuccgcgucccccccucccccucccucaccauggacucccaguacgagaccggccacauccgcaagcuccaggcccgccacaugcagaugcaggagaagaccuucaccaaguggaucaacaacgucuuccagugcggccaggccggcaucaagauccgcaaccucuacaccgagcucgccgacggcauccaccuccuccgccuccucgagcucaucuccggcgaggcccuccccccccccucccgcggccgccuccgcguccacuuccucgagaacuccucccgcgcccucgccuuccuccgcgccaagguccccgucccccucaucggccccgagaacaucgucgacggcgaccagacccucauccucggccucaucugggucaucauccuccgcuuccagaucucccacaucucccucgacaaggaggaguucggcgccuccgccgcccuccucuccaccaaggaggcccuccucgucuggugccagcgcaagaccgccuccuacaccaacgucaacaucaccgacuucucccgcuccugguccgacggccucggcuucaacgcccucauccacgcccaccgccccgaccuccucgacuacggcucccuccgccccgaccgcccccuccacaaccucgccuucgccuuccucgucgccgagcaggagcucggcaucgcccagcuccucgaccccgaggacgucgccgccgcccagcccgacgagcgcuccaucaugaccuacgucucccucuacuaccacuacugcucccgccuccaccagggccagaccguccagcgccgccucaccaagauccuccuccagcuccaggagaccgagcuccuccagacccaguacgagcagcucgucgccgaccuccuccgcuggaucgccgagaagcagaugcagcucgaggcccgcgacuuccccgacucccuccccgccaugcgccagcuccucgccgccuucaccaucuuccgcacccaggagaagcccccccgccuccagcagcgcggcgccgccgaggcccuccucuuccgccuccagaccgcccuccaggcccagaaccgccgccccuuccucccccacgagggccucggccucgccgagcucucccagugcugggccggccucgagugggccgaggccgcccgcucccaggcccuccagcagcgccuccuccagcuccagcgccucgagacccucgcccgccgcuuccagcacaaggccgcccuccgcgaguccuuccucaaggacgccgagcagguccucgaccaggcccgcgccccccccgccucccucgccaccgucgaggccgccguccagcgccucggcaugcucgaggccggcauccucccccaggagggccgcuuccaggcccucgccgagaucgccgacauccuccgccaggagcaguaccacuccugggccgacgucgcccgccgccaggaggaggucaccguccgcuggcagcgccuccuccagcaccuccagggccagcgcaagcaggucgccgacaugcaggccguccucucccuccuccaggaggucgaggccgccucccaccagcucgaggagcuccaggagcccgcccgcuccaccgccugcggccagcagcucgccgaggucgucgagcuccuccagcgccacgaccuccucgaggcccaggucuccgcccacggcgcccacgucucccaccucgcccagcagaccgccgagcucgacuccucccucggcaccuccgucgagguccuccaggccaaggcccgcacccucgcccagcuccagcagucccucgucgcccucguccgcgcccgccgcgcccuccucgagcagacccuccagcgcgccgaguuccuccgcaacugcgaggaggaggaggccuggcucaaggagugcggccagcgcgucggcaacgccgcccucggccgcgaccucucccagaucgccggcgcccuccagaagcacaaggcccucgaggccgagguccaccgccaccaggccgucugcgucgaccucguccgccgcggccgcgaccucuccgcccgccgcccccccacccagcccgaccccggcgagcgcgccgaggccguccagggcggcuggcagcuccuccagacccgcgucgucggccgcggcgcccgccuccagaccgcccuccucguccuccaguacuucgccgacgccgccgaggccgccuccuggcuccgcgagcgccgcuccucccucgagcgcgccuccugcggccaggaccaggccgccgccgagacccuccuccgccgccacguccgccucgagcgcguccuccgcgccuucgccgccgagcuccgccgccucgaggagcagggccgcgccgccuccgcccgcgccucccucuucaccgucaacuccgcccucuccccccccggcgagucccuccgcaaccccggccccugguccgaggccuccugccaccccggccccggcgacgccuggaagauggcccuccccgccgagcccgaccccgacuucgaccccaacaccauccuccagacccaggaccaccucucccaggacuacgagucccuccgcgcccucgcccagcuccgccgcgcccgccucgaggaggccauggcccucuucggcuucugcuccuccugcggcgagcuccagcucuggcucgagaagcagaccguccuccuccagcgcguccagccccaggccgacacccucgaggucaugcagcucaaguacgagaacuuccucaccgcccucgccgucggcaagggccucugggccgaggucuccuccuccgccgagcagcuccgccagcgcuaccccggcaacuccacccagauccagcgccagcaggaggagcucucccagcgcuggggccagcucgaggcccucaagcgcgagaaggccguccagcucgcccacuccgucgaggucugcuccuuccuccaggagugcggccccacccagguccagcuccgcgacguccuccuccagcucgaggcccuccagcccggcuccuccgaggacaccugccacgcccuccagcucgcccagaagaagacccucguccucgagcgccgcguccacuuccuccaguccgucgucgucaaggucgaggagcccggcuacgccgagucccagccccuccagggccaggucgagacccuccagggccuccucaagcagguccaggagcaggucgcccagcgcgcccgccgccaggccgagacccaggcccgccaguccuuccuccaggagucccagcagcuccuccucugggccgaguccguccaggcccagcuccgcuccaaggaggucuccgucgacgucgccuccgcccagcgccuccuccgcgagcaccaggaccuccucgaggagauccaccucuggcaggagcgccuccagcagcucgacgcccagucccagcccauggccgcccucgacugccccgacucccaggagguccccaacacccuccgcguccucggccagcagggccaggagcucaagguccucugggagcagcgccagcaguggcuccaggagggccucgagcuccagaaguucggccgcgaggucgacggcuucaccgccaccugcgccaaccaccaggccuggcuccaccucgacaaccucggcgaggacguccgcgaggcccucucccuccuccagcagcaccgcgaguucggccgccuccucuccacccucggcccccgcgccgaggcccuccgcgcccacggcgagaagcucguccagucccagcaccccgccgcccacaccguccgcgagcagcuccaguccauccaggcccaguggacccgccuccagggccgcuccgagcagcgccgccgccagcuccucgccucccuccagcuccaggaguggaagcaggacgucgccgagcucaugcaguggauggaggagaagggccucauggccgcccacgagcccuccggcgcccgccgcaacauccuccagacccucaagcgccacgaggccgccgaguccgagcuccucgccacccgccgccacgucgaggcccuccagcaggucggccgcgagcuccucucccgccgccccugcggccaggaggacauccagacccgccuccagggccuccgcuccaagugggaggcccucaaccgcaagaugaccgagcgcggcgacgagcuccagcaggccggccagcaggagcagcuccuccgccagcuccaggacgccaaggagcagcucgagcagcucgagggcgcccuccaguccuccgagaccggccaggaccuccgcuccucccagcgccuccagaagcgccaccagcagcucgaguccgagucccgcacccucgccgccaagauggccgcccucgccuccauggcccacggcauggccgccucccccgccauccucgaggagacccagaagcaccuccgccgccucgagcuccuccagggccaccucgccauccgcggccuccagcuccaggccuccgucgagcuccaccaguucugccaccucuccaacauggagcucuccugggucgccgagcacaugccccacggcucccccaccuccuacaccgagugccucaacggcgcccagucccuccaccgcaagcacaaggagcuccaggucgaggucaaggcccaccagggccagguccagcgcguccucuccuccggccgcucccucgccgccuccggccacccccaggcccagcacaucgucgagcagugccaggagcucgagggccacugggccgagcucgagcgcgccugcgaggcccgcgcccagugccuccagcaggccgucaccuuccagcaguacuuccucgacgucuccgagcucgagggcugggucgaggagaagcgcccccucgucuccucccgcgacuacggccgcgacgaggccgccacccuccgccucaucaacaagcaccaggcccuccaggaggagcucgccaucuacugguccuccauggaggagcucgaccagaccgcccagacccucaccggccccgagguccccgagcagcagcgcgucguccaggagcgccuccgcgagcagcuccgcgcccuccaggagcucgccgccacccgcgaccgcgagcucgagggcacccuccgccuccacgaguuccuccgcgaggccgaggaccuccagggcuggcucgccucccagaagcaggccgccaagggcggcgagucccucggcgaggaccccgagcacgcccuccaccucugcaccaaguucgccaaguuccagcaccaggucgagaugggcucccagcgcgucgccgccugccgccuccucgccgagucccuccucgagcgcggccacuccgccggccccaugguccgccagcgccagcaggaccuccagaccgccugguccgagcucugggagcucacccaggcccgcggccacgcccuccgcgacaccgagaccacccuccgcguccaccgcgaccuccucgagguccucacccagguccaggagaaggccaccucccuccccaacaacgucgcccgcgaccucugcggccucgaggcccagcuccgcucccaccagggccucgagcgcgagcucgucggcaccgagcgccagcuccaggagcuccucgagaccgccggccgcguccagaagcucugccccggcccccaggcccacgccguccagcagcgccagcaggccgucacccaggccugggccguccuccagcgccgcauggagcagcgccgcgcccagcucgagcgcgcccgccuccucgcccgcuuccgcaccgccguccgcgacuacgccuccugggccgcccgcguccgccaggaccuccaggucgaggaguccucccaggagcccuccuccggcccccucaagcucuccgcccaccaguggcuccgcgccgagcucgaggcccgcgagaagcucuggcagcaggccacccagcucggccagcaggcccuccucgccgccggcacccccaccaaggagguccaggaggagcuccgcgcccuccaggaccagcgcgaccaggucuaccagaccugggcccgcaagcaggagcgccuccaggccgagcagcaggagcagcucuuccuccgcgagugcggccgccucgaggagauccucgccgcccaggaggucucccucaagaccuccgcccucggcuccuccgucgaggaggucgagcagcucauccgcaagcacgaggucuuccucaagguccucaccgcccaggacaagaaggaggccgcccuccgcgagcgccucaagacccuccgccgcccccgcguccgcgaccgccuccccauccuccuccagcgccgcaugcgcgucaaggagcucgccgagucccgcggccacgcccuccacgccucccuccucauggccuccuucacccaggccgccacccaggccgaggacuggauccaggccugggcccagcagcucaaggagcccgucccccccggcgaccuccgcgacaagcucaagccccuccucaagcaccaggccuucgaggccgagguccaggcccacgaggaggucaugaccuccgucgccaagaagggcgaggcccuccucgcccagucccacccccgcgccggcgaggucucccagcgccuccagggccuccgcaagcacugggaggaccuccgccaggccauggcccuccgcggccaggagcucgaggaccgccgcaacuuccucgaguuccuccagcgcgucgaccucgccgaggccuggauccaggagaaggaggucaagaugaacgucggcgaccucggccaggaccucgagcacugccuccagcuccgccgccgccuccgcgaguuccgcggcaacuccgccggcgacaccgucggcgacgccugcauccgcuccaucuccgaccucucccuccagcucaagaaccgcgaccccgaggaggucaagaucaucugccagcgccgcucccagcucaacaaccgcugggccuccuuccacggcaaccuccuccgcuaccagcagcagcucgagggcgcccucgagauccacguccucucccgcgagcucgacaacgucaccaagcgcauccaggagaaggaggcccucauccaggcccucgacugcggcaaggaccucgaguccguccagcgccuccuccgcaagcacgaggagcucgagcgcgagguccaccccauccaggcccaggucgagucccucgagcgcgaggucggccgccucugccagcgcucccccgaggccgcccacggccuccgccaccgccagcaggaggucgccgaguccugguggcagcuccgcucccgcgcccagaagcgccgcgaggcccucgacgcccuccaccaggcccagaagcuccaggccaugcuccaggagcuccucgucuccgcccagcgccuccgcgcccagauggacaccucccccgccccccgcucccccgucgaggcccgccgcaugcucgaggagcaccaggagugcaaggccgagcucgacuccuggaccgacuccaucucccucgcccgcuccaccggccagcagcuccucaccgccggccaccccuucuccuccgacauccgccagguccucgccggccucgagcaggagcucuccucccucgagggcgccuggcaggagcaccagcuccagcuccagcaggcccucgagcuccagcucuuccucuccuccgucgagaagauggagcgcuggcucugcuccaaggaggacucccucgccuccgagggccucugggacccccucgcccccauggagccccuccucuggaagcacaagaugcucgagugggaccucgagguccaggccggcaagaucuccgcccucgaggccaccgcccgcggccuccaccagggcggccaccccgaggcccaguccgcccucggccgcugccaggccaugcuccuccgcaaggaggcccucuuccgccaggccggcacccgccgccaccgccucgaggagcuccgccagcuccaggccuuccuccaggacucccaggaggucgccgccuggcuccgcgagaagaaccucgucgcccucgaggagggccuccucgacaccgccaugcuccccgcccagcuccagaagcagcagaacuuccaggccgagcucgacgccuccaugcaccagcagcaggagcuccagcgcgagggccagcgccuccuccagggcggccaccccgccuccgaggccauccaggagcgccucgaggagcucggcgcccucuggggcgagcuccaggacaacucccagaagaaggucgccaagcuccagaaggccugcgaggcccuccgccuccgccgcuccauggaggagcucgagaacuggcucgagcccaucgaggucgagcuccgcgcccccaccgucggccaggcccuccccggcgucggcgagcuccucggcacccagcgcgagcucgaggccgccgucgacaagaaggcccgccaggccgaggcccuccucggccaggcccaggccuucguccgcgagggccacugccucgcccaggacgucgaggagcaggcccgccgccuccuccagcgcuucaagucccuccgcgagccccuccaggagcgccgcaccgcccucgaggcccgcucccuccuccucaaguucuuccgcgacgccgacgaggagauggccuggguccaggagaagcucccccucgccgccgcccaggacuacggccagucccucuccgccguccgccaccuccaggagcagcaccagaaccucgaguccgagauguccucccacgaggcccucacccgcgucguccucggcaccggcuacaagcucguccaggccggccacuucgccgcccacgaggucgccgcccgcguccagcagcucgagaaggccauggcccaccuccgcgccgaggccgcccgccgccgccuccuccuccagcaggcccaggaggcccagcaguuccucaccgagcuccucgaggccggcuccuggcucgccgagcgcggccacguccucgacuccgaggacaugggccacuccgccgaggccacccaggcccuccuccgccgccucgaggccaccaagcgcgaccucgaggccuucuccccccgcaucgagcgccuccagcagaccgccgcccuccucgagucccgcaagaaccccgagucccccaagguccucgcccagcuccaggccguccgcgaggcccacgccgagcuccuccgccgcgccgaggcccgcggccacggccuccaggagcagcuccagcuccaccagcucgagcgcgagacccuccuccucgacgccuggcucaccaccaaggccgccaccgccgagucccaggacuacggccaggaccucgagggcgucaagguccucgaggagaaguucgacgccuuccgcaaggagguccagucccucggccaggccaaggucuacgcccuccgcaagcucgccggcacccucgagcgcggcgccccccgccgcuacccccacauccaggcccagcgcucccgcaucgaggccgccugggagcgccucgaccaggccaucaaggcccgcaccgagaaccucgccgccgcccacgagguccacuccuuccagcaggccgccgccgagcuccagggccgcaugcaggagaagaccgcccucaugaagggcgaggacggcggccacucccucuccuccguccgcacccuccagcagcagcaccgccgccucgagcgcgagcucgaggccauggagaaggaggucgcccgccuccagaccgaggccugccgccucggccagcuccaccccgccgcccccggcggccucgccaagguccaggaggccugggccacccuccaggccaaggcccaggagcgcggccaguggcucgcccaggccgcccagggccacgccuuccucggccgcugccaggagcuccucgccugggcccaggagcgccaggagcucgccuccuccgaggagcucgccgaggacgucgccggcgccgagcagcuccucggccagcacgaggagcucggccaggagauccgcgagugccgccuccaggcccaggaccuccgccaggagggccagcagcucgucgacaacucccacuucauguccgccgaggucaccgagugccuccaggagcucgagggccgccuccaggagcucgaggaggccugggcccuccgcuggcagcgcugcgccgaguccuggggccuccagaagcuccgccagcgccucgagcaggccgaggccuggcucgccugcugggagggccuccuccucaagcccgacuacggccacuccgucuccgacgucgagcuccuccuccaccgccaccaggaccucgagaagcuccucgccgcccaggaggagaaguucgcccagaugcagaagaccgagauggagcaggagcuccuccuccagccccaggagcucaagcccggccgcgccggcuccucccucaccuccuuccaguggcgccccuccggccaccagggccucggcgcccagcucgccgagacccgcgacccccaggacgccaagggcacccccaccauggagggcucccucgaguucaagcagcaccuccuccccggcggccgccagcccuccuccuccuccugggacuccugccgcggcaaccuccagggcuccucccucucccucuuccucgacgagcgcauggccgccgagaaggucgccuccaucgcccuccucgaccucaccggcgcccgcugcgagcgccuccgcggccgccacggccgcaagcacaccuucucccuccgccucaccuccggcgccgagauccucuucgccgcccccuccgaggagcaggccgaguccugguggcgcgcccucggcuccaccgccgcccagucccucucccccaagcucaaggccaagcccgucuccucccucaacgagugcaccaccaaggacgcccgccccggcugccuccuccgcuccgaccccuga

SEQ ID NO: 50114 - RNA, 1422 nt, Artificial Sequence
  derived and/or modified sequence opt2 from SPTLC1__Homo_sapiens__NP_006406
auggccaccgccaccgagcaguggguccucgucgagaugguccaggcccucuacgaggcccccgccuaccaccucauccucgagggcauccucauccucuggaucauccgccuccucuucuccaagaccuacaagcuccaggagcgcuccgaccucaccgucaaggagaaggaggagcucaucgaggaguggcagcccgagccccucgucccccccguccccaaggaccaccccgcccucaacuacaacaucgucuccggcccccccucccacaagaccgucgucaacggcaaggagugcaucaacuucgccuccuucaacuuccucggccuccucgacaacccccgcgucaaggccgccgcccucgccucccucaagaaguacggcgucggcaccugcggcccccgcggcuucuacggcaccuucgacguccaccucgaccucgaggaccgccucgccaaguucaugaagaccgaggaggccaucaucuacuccuacggcuucgccaccaucgccuccgccauccccgccuacuccaagcgcggcgacaucgucuucgucgaccgcgccgccugcuucgccauccagaagggccuccaggccucccgcuccgacaucaagcucuucaagcacaacgacauggccgaccucgagcgccuccucaaggagcaggagaucgaggaccagaagaacccccgcaaggcccgcgucacccgccgcuucaucgucgucgagggccucuacaugaacaccggcaccaucugcccccuccccgagcucgucaagcucaaguacaaguacaaggcccgcaucuuccucgaggagucccucuccuucggcguccucggcgagcacggccgcggcgucaccgagcacuacggcaucaacaucgacgacaucgaccucaucuccgccaacauggagaacgcccucgccuccaucggcggcuucugcugcggccgcuccuucgucaucgaccaccagcgccucuccggccagggcuacugcuucuccgccucccuccccccccuccucgccgccgccgccaucgaggcccucaacaucauggaggagaaccccggcaucuucgccguccucaaggagaagugcggccagauccacaaggcccuccagggcaucuccggccucaaggucgucggcgagucccucucccccgccuuccaccuccagcucgaggaguccaccggcucccgcgagcaggacguccgccuccuccaggagaucgucgaccagugcaugaaccgcuccaucgcccucacccaggcccgcuaccucgagaaggaggagaagugccuccccccccccuccauccgcgucgucgucaccgucgagcagaccgaggaggagcucgagcgcgccgccuccaccaucaaggaggucgcccaggccguccuccucuga

SEQ ID NO: 50115 - RNA, 1689 nt, Artificial Sequence
  derived and/or modified sequence opt2 from SPTLC2__Homo_sapiens__NP_004854
augcgccccgagcccggcggcugcugcugccgccgcaccguccgcgccaacggcugcgucgccaacggcgagguccgcaacggcuacguccgcuccuccgccgccgccgccgccgccgccgccgccggccagauccaccacgucacccagaacggcggccucuacaagcgccccuucaacgaggccuucgaggagacccccaugcucgucgccguccucaccuacgucggcuacggcguccucacccucuucggcuaccuccgcgacuuccuccgcuacuggcgcaucgagaagugccaccacgccaccgagcgcgaggagcagaaggacuucgucucccucuaccaggacuucgagaacuucuacacccgcaaccucuacaugcgcauccgcgacaacuggaaccgccccaucugcuccguccccggcgcccgcgucgacaucauggagcgccagucccacgacuacaacugguccuucaaguacaccggcaacaucaucaagggcgucaucaacaugggcuccuacaacuaccucggcuucgcccgcaacaccggcuccugccaggaggccgccgccaagguccucgaggaguacggcgccggcgucugcuccacccgccaggagaucggcaaccucgacaagcacgaggagcucgaggagcucgucgcccgcuuccucggcgucgaggccgccauggccuacggcaugggcuucgccaccaacuccaugaacauccccgcccucgucggcaagggcugccucauccucuccgacgagcucaaccacgccucccucguccucggcgcccgccucuccggcgccaccauccgcaucuucaagcacaacaacaugcagucccucgagaagcuccucaaggacgccaucgucuacggccagccccgcacccgccgccccuggaagaagauccucauccucgucgagggcaucuacuccauggagggcuccaucguccgccuccccgaggucaucgcccucaagaagaaguacaaggccuaccucuaccucgacgaggcccacuccaucggcgcccucggccccaccggccgcggcgucgucgaguacuucggccucgaccccgaggacgucgacgucaugaugggcaccuucaccaaguccuucggcgccuccggcggcuacaucggcggcaagaaggagcucaucgacuaccuccgcacccacucccacuccgccgucuacgccaccucccucuccccccccgucgucgagcagaucaucaccuccaugaagugcaucaugggccaggacggcaccucccucggcaaggagugcguccagcagcucgccgagaacacccgcuacuuccgccgccgccucaaggagaugggcuucaucaucuacggcaacgaggacucccccgucgucccccucaugcucuacaugcccgccaagaucggcgccuucggccgcgagaugcucaagcgcaacaucggcgucgucgucgucggcuuccccgccacccccaucaucgagucccgcgcccgcuucugccucuccgccgcccacaccaaggagauccucgacaccgcccucaaggagaucgacgaggucggcgaccuccuccagcucaaguacucccgccaccgccucgucccccuccucgaccgccccuucgacgagaccaccuacgaggagaccgaggacuga

SEQ ID NO: 50116 - RNA, 1659 nt, Artificial Sequence
  derived and/or modified sequence opt2 from SPTLC3__Homo_sapiens__NP_060797
auggccaaccccggcggcggcgccgucugcaacggcaagcuccacaaccacaagaagcaguccaacggcucccagucccgcaacugcaccaagaacggcaucgucaaggaggcccagcagaacggcaagccccacuucuacgacaagcucaucgucgaguccuucgaggaggccccccuccacgucauggucuucaccuacaugggcuacggcaucggcacccucuucggcuaccuccgcgacuuccuccgcaacuggggcaucgagaagugcaacgccgccgucgagcgcaaggagcagaaggacuucgucccccucuaccaggacuucgagaacuucuacacccgcaaccucuacaugcgcauccgcgacaacuggaaccgccccaucugcuccgcccccggcccccucuucgaccucauggagcgcgucuccgacgacuacaacuggaccuuccgcuucaccggccgcgucaucaaggacgucaucaacaugggcuccuacaacuuccucggccucgccgccaaguacgacgaguccaugcgcaccaucaaggacguccucgaggucuacggcaccggcgucgccuccacccgccacgagaugggcacccucgacaagcacaaggagcucgaggaccucgucgccaaguuccucaacgucgaggccgccauggucuucggcaugggcuucgccaccaacuccaugaacauccccgcccucgucggcaagggcugccucauccucuccgacgagcucaaccacaccucccucguccucggcgcccgccucuccggcgccaccauccgcaucuucaagcacaacaacacccagucccucgagaagcuccuccgcgacgccgucaucuacggccagccccgcacccgccgcgccuggaagaagauccucauccucgucgagggcgucuacuccauggagggcuccaucguccaccucccccagaucaucgcccucaagaagaaguacaaggccuaccucuacaucgacgaggcccacuccaucggcgccgucggccccaccggccgcggcgucaccgaguucuucggccucgacccccacgaggucgacguccucaugggcaccuucaccaaguccuucggcgccuccggcggcuacaucgccggccgcaaggaccucgucgacuaccuccgcguccacucccacuccgccgucuacgccuccuccauguccccccccaucgccgagcagaucauccgcucccucaagcucaucaugggccucgacggcaccacccagggccuccagcgcguccagcagcucgccaagaacacccgcuacuuccgccagcgccuccaggagaugggcuucaucaucuacggcaacgagaacgccuccgucgucccccuccuccucuacaugcccggcaaggucgccgccuucgcccgccacaugcucgagaagaagaucggcgucgucgucgucggcuuccccgccaccccccucgccgaggcccgcgcccgcuucugcgucuccgccgcccacacccgcgagaugcucgacaccguccucgaggcccucgacgagaugggcgaccuccuccagcucaaguacucccgccacaagaaguccgcccgccccgagcucuacgacgagaccuccuucgagcucgaggacuga

SEQ ID NO: 50117 - RNA, 231 nt, Artificial Sequence
  derived and/or modified sequence opt2 from SPTSSB__Homo_sapiens__NP_001035189
auggaccuccgccgcgucaaggaguacuucuccuggcucuacuaccaguaccagaucaucuccugcugcgccguccucgagcccugggagcgcuccauguucaacaccauccuccucaccaucaucgccauggucgucuacaccgccuacgucuucauccccauccacauccgccucgccugggaguucuucuccaagaucugcggcuaccacuccaccaucuccaacuga

SEQ ID NO: 50118 - RNA, 2058 nt, Artificial Sequence
  derived and/or modified sequence opt2 from SPTY2D1__Homo_sapiens__NP_919261
auggacuuccgcgagauccucaugaucgccuccaagggccagggcgucaacaacguccccaagcgcuacucccucgccgucggcccccccaagaaggaccccaaggucaagggcguccaguccgccgccguccaggccuuccucaagcgcaaggaggaggagcuccgccgcaaggcccucgaggagaagcgccgcaaggaggagcucgucaagaagcgcaucgagcucaagcacgacaagaaggcccgcgccauggccaagcgcaccaaggacaacuuccacggcuacaacggcauccccaucgaggagaaguccaagaagcgccaggccaccgagucccacaccucccagggcaccgaccgcgaguacgagauggaggaggagaacgaguuccucgaguacaaccacgccgaguccgagcaggaguacgaggaggagcaggagccccccaaggucgaguccaagcccaaggucccccucaaguccgcccccccccccaugaacuucaccgaccuccuccgccucgccgagaagaagcaguucgagcccgucgagaucaaggucgucaagaaguccgaggagcgccccaugaccgccgaggagcuccgcgagcgcgaguuccucgagcgcaagcaccgccgcaagaagcucgagaccgacggcaagcucccccccaccgucuccaagaaggcccccucccagaaggaguccgucggcaccaagcucuccaagggcuccggcgaccgccaccccuccuccaagggcaugccccucccccacgccgagaagaagucccgccccuccauggccaacgagaagcaccucgcccucuccuccuccaaguccaugcccggcgagcgcaucaaggccggcuccggcaacuccucccagcccucccuccgcgagggccacgacaagcccgucuucaacggcgccggcaagccccacuccuccaccuccucccccuccguccccaagaccuccgccucccgcacccagaaguccgccgucgagcacaaggccaagaagucccucucccaccccucccacucccgccccggccccauggucaccccccacaacaaggccaagucccccggcguccgccagcccggcuccuccuccuccuccgcccccggccagcccuccaccggcgucgcccgccccaccgucuccuccggccccgucccccgccgccagaacggcuccuccuccuccggccccgagcgcuccaucuccggcuccaagaagcccaccaacgacuccaaccccucccgccgcaccgucuccggcaccugcggccccggccagcccgccuccuccuccggcggccccggccgccccaucuccggcuccgucuccuccgcccgcccccucggcuccucccgcggccccggccgccccgucuccuccccccacgagcuccgccgccccgucuccggccucggcccccccggccgcuccgucuccggccccggccgcuccaucuccggcuccauccccgccggccgcaccgucuccaacuccguccccggccgccccgucuccucccucggccccggccagaccgucuccuccuccggccccaccaucaagcccaagugcaccgucgucuccgagaccaucuccuccaagaacaucaucucccgcuccuccaacggccagaugaacggcaugaagcccccccucuccggcuaccgcgccgcccagggcccccagcgccuccccuuccccaccggcuacaagcgccagcgcgaguacgaggaggaggacgacgacgacgacgaguacgacuccgagauggaggacuucaucgaggacgagggcgagccccaggaggagaucuccaagcacauccgcgagaucuucggcuacgaccgcaagaaguacaaggacgaguccgacuacgcccuccgcuacauggaguccuccuggaaggagcagcagaaggaggaggccaagucccuccgccucggcaugcaggaggaccucgaggagaugcgccgcgaggaggaggagaugcagcgccgccgcgccaagaagcucaagcgccgcuga

SEQ ID NO: 50119 - RNA, 1293 nt, Artificial Sequence
  derived and/or modified sequence opt2 from SPZ1__Homo_sapiens__NP_115956
auggccuccuccgccaaguccgccgagaugcccaccaucuccaagaccgucaaccccacccccgacccccaccaggaguaccucgacccccgcaucaccaucgcccucuucgagaucggcucccacucccccuccuccuggggcucccuccccuuccucaagaacuccucccaccaggucaccgagcagcagaccgcccagaaguucaacaaccuccucaaggagaucaaggacauccucaagaacauggccggcuucgaggagaagaucaccgaggccaaggagcucuucgaggagaccaacaucaccgaggacgucuccgcccacaaggagaacauccgcggccucgacaagaucaacgagaugcucuccaccaaccuccccgucucccucgcccccgagaaggaggacaacgagaagaagcaggagaugauccucgagaccaacaucaccgaggacgucuccgcccacaaggagaacauccgcggccucgacaagaucaacgagaugcucuccaccaaccuccccgucucccucgcccccgagaaggaggacaacgagaagaagcagcagaugaucauggagaaccagaacuccgagaacaccgcccaggucuucgcccgcgaccucgucaaccgccucgaggagaagaagguccucaacgagacccagcagucccaggagaaggccaagaaccgccucaacguccaggaggagaccaugaagauccgcaacaacauggagcagcuccuccaggaggccgagcacugguccaagcagcacaccgagcucuccaagcucaucaaguccuaccagaagucccagaaggacaucuccgagacccucggcaacaacggcgucggcuuccagacccagcccaacaacgaggucuccgccaagcacgagcucgaggagcaggucaagaagcucucccacgacaccuacucccuccagcucauggccgcccuccucgagaacgagugccagauccuccagcagcgcgucgagauccucaaggagcuccaccaccagaagcagggcacccuccaggagaagcccauccagaucaacuacaagcaggacaagaagaaccagaagcccuccgaggccaagaaggucgagauguacaagcagaacaagcaggccaugaagggcaccuucuggaagaaggaccgcuccugccgcucccucgacgucugccucaacaagaaggccugcaacacccaguucaacauccacgucgcccgcaaggcccuccgcggcaagaugcgcuccgccuccucccuccgcuga

SEQ ID NO: 50120 - RNA, 1725 nt, Artificial Sequence
  derived and/or modified sequence opt2 from SQLE__Homo_sapiens__NP_003120
auguggaccuuccucggcaucgccaccuucaccuacuucuacaagaaguucggcgacuucaucacccucgccaaccgcgagguccuccucugcguccucgucuuccucucccucggccucguccucuccuaccgcugccgccaccgcaacggcggccuccucggccgccagcaguccggcucccaguucgcccucuucuccgacauccucuccggccuccccuucaucggcuucuucugggccaaguccccccccgaguccgagaacaaggagcagcucgaggcccgccgccgccgcaagggcaccaacaucuccgagaccucccucaucggcaccgccgccugcaccuccaccuccucccagaacgaccccgaggucaucaucgucggcgccggcguccucggcuccgcccucgccgccguccucucccgcgacggccgcaaggucaccgucaucgagcgcgaccucaaggagcccgaccgcaucgucggcgaguuccuccagcccggcggcuaccacguccucaaggaccucggccucggcgacaccgucgagggccucgacgcccaggucgucaacggcuacaugauccacgaccaggaguccaaguccgagguccagauccccuacccccucuccgagaacaaccagguccaguccggccgcgccuuccaccacggccgcuucaucaugucccuccgcaaggccgccauggccgagcccaacgccaaguucaucgagggcgucguccuccagcuccucgaggaggacgacgucgucaugggcguccaguacaaggacaaggagaccggcgacaucaaggagcuccacgccccccucaccgucgucgccgacggccucuucuccaaguuccgcaagucccucgucuccaacaaggucuccgucuccucccacuucgucggcuuccucaugaagaacgccccccaguucaaggccaaccacgccgagcucauccucgccaaccccucccccguccucaucuaccagaucuccuccuccgagacccgcguccucgucgacauccgcggcgagaugccccgcaaccuccgcgaguacauggucgagaagaucuacccccagauccccgaccaccucaaggagcccuuccucgaggccaccgacaacucccaccuccgcuccaugcccgccuccuuccucccccccuccuccgucaagaagcgcggcguccuccuccucggcgacgccuacaacaugcgccacccccucaccggcggcggcaugaccgucgccuucaaggacaucaagcucuggcgcaagcuccucaagggcauccccgaccucuacgacgacgccgccaucuucgaggccaagaaguccuucuacugggcccgcaagaccucccacuccuucgucgucaacauccucgcccaggcccucuacgagcucuucuccgccaccgacgacucccuccaccagcuccgcaaggccugcuuccucuacuucaagcucggcggcgagugcgucgccggccccgucggccuccucuccguccucucccccaacccccucguccucaucggccacuucuucgccgucgccaucuacgccgucuacuucugcuucaaguccgagcccuggaucaccaagccccgcgcccuccucuccuccggcgccguccucuacaaggccugcuccgucaucuucccccucaucuacuccgagaugaaguacaugguccacuga

SEQ ID NO: 50121 - RNA, 1353 nt, Artificial Sequence
  derived and/or modified sequence opt2 from SQRDL__Homo_sapiens__NP_067022
auggucccccucgucgccgucgucuccggcccccgcgcccagcucuucgccugccuccuccgccucggcacccagcaggucggcccccuccagcuccacaccggcgccucccacgccgcccgcaaccacuacgagguccucguccucggcggcggcuccggcggcaucaccauggccgcccgcaugaagcgcaaggucggcgccgagaacgucgccaucgucgagcccuccgagcgccacuucuaccagcccaucuggacccucgucggcgccggcgccaagcagcucuccuccuccggccgccccaccgccuccgucauccccuccggcgucgaguggaucaaggcccgcgucaccgagcucaaccccgacaagaacugcauccacaccgacgacgacgagaagaucuccuaccgcuaccucaucaucgcccucggcauccagcucgacuacgagaagaucaagggccuccccgagggcuucgcccaccccaagaucggcuccaacuacuccgucaagaccgucgagaagaccuggaaggcccuccaggacuucaaggagggcaacgccaucuucaccuuccccaacacccccgucaagugcgccggcgccccccagaagaucauguaccucuccgaggccuacuuccgcaagaccggcaagcgcuccaaggccaacaucaucuucaacaccucccucggcgccaucuucggcgucaagaaguacgccgacgcccuccaggagaucauccaggagcgcaaccucaccgucaacuacaagaagaaccucaucgagguccgcgccgacaagcaggaggccgucuucgagaaccucgacaagcccggcgagacccaggucaucuccuacgagaugcuccacgucaccccccccauguccccccccgacguccucaagaccucccccgucgccgacgccgccggcugggucgacgucgacaaggagacccuccagcaccgccgcuaccccaacgucuucggcaucggcgacugcaccaaccuccccaccuccaagaccgccgccgccgucgccgcccaguccggcauccucgaccgcaccaucuccgucaucaugaagaaccagacccccaccaagaaguacgacggcuacaccuccugcccccucgucaccggcuacaaccgcgucauccucgccgaguucgacuacaaggccgagccccucgagaccuuccccuucgaccaguccaaggagcgccucuccauguaccucaugaaggccgaccucaugcccuuccucuacuggaacaugaugcuccgcggcuacuggggcggccccgccuuccuccgcaagcucuuccaccucggcauguccuga

SEQ ID NO: 50122 - RNA, 1071 nt, Artificial Sequence
  derived and/or modified sequence opt2 from SQSTM1__Homo_sapiens__NP_001135771
auggccauguccuacgucaaggacgacaucuuccgcaucuacaucaaggagaagaaggagugccgccgcgaccaccgcccccccugcgcccaggaggccccccgcaacaugguccaccccaacgucaucugcgacggcugcaacggccccgucgucggcacccgcuacaagugcuccgucugccccgacuacgaccucugcuccgucugcgagggcaagggccuccaccgcggccacaccaagcucgccuuccccucccccuucggccaccucuccgagggcuucucccacucccgcuggcuccgcaaggucaagcacggccacuucggcuggcccggcugggagaugggcccccccggcaacugguccccccgccccccccgcgccggcgaggcccgccccggccccaccgccgaguccgccuccggccccuccgaggaccccuccgucaacuuccucaagaacgucggcgaguccgucgccgccgcccucuccccccucggcaucgaggucgacaucgacgucgagcacggcggcaagcgcucccgccucacccccgucucccccgaguccuccuccaccgaggagaaguccuccucccagcccuccuccugcugcuccgaccccuccaagcccggcggcaacgucgagggcgccacccagucccucgccgagcagaugcgcaagaucgcccucgaguccgagggccgccccgaggagcagauggaguccgacaacugcuccggcggcgacgacgacuggacccaccucuccuccaaggaggucgaccccuccaccggcgagcuccagucccuccagaugcccgaguccgagggccccuccucccucgaccccucccaggagggccccaccggccucaaggaggccgcccucuacccccaccucccccccgaggccgacccccgccucaucgagucccucucccagaugcucuccaugggcuucuccgacgagggcggcuggcucacccgccuccuccagaccaagaacuacgacaucggcgccgcccucgacaccauccaguacuccaagcacccccccccccucuga

SEQ ID NO: 50123 - RNA, 711 nt, Artificial Sequence
  derived and/or modified sequence opt2 from SRA1__Homo_sapiens__NP_001030312
augacccgcugccccgccggccaggccgaggucgagauggccgagcucuacgucaagcccggcaacaaggagcgcggcuggaacgaccccccccaguucuccuacggccuccagacccaggccggcggcccccgccgcucccuccucaccaagcgcgucgccgccccccaggacggcuccccccgcguccccgccuccgagaccucccccggccccccccccaugggcccccccccccccuccuccaaggccccccgcuccccccccgucggcuccggccccgccuccggcgucgagcccaccuccuuccccgucgaguccgaggccgucauggaggacguccuccgcccccucgagcaggcccucgaggacugccgcggccacacccgcaagcaggucugcgacgacaucucccgccgccucgcccuccuccaggagcagugggccggcggcaagcucuccauccccgucaagaagcgcauggcccuccucguccaggagcucuccucccaccgcugggacgccgccgacgacauccaccgcucccucauggucgaccacgucaccgaggucucccaguggauggucggcgucaagcgccucaucgccgagaagcgcucccucuucuccgaggaggccgccaacgaggagaaguccgccgccaccgccgagaagaaccacaccauccccggcuuccagcaggccuccuga

SEQ ID NO: 50124 - RNA, 2988 nt, Artificial Sequence
  derived and/or modified sequence opt2 from SRBD1__Homo_sapiens__NP_060549
auguccucccucccccgccgcgccaagguccagguccaggacgucguccucaaggacgaguucuccuccuucuccgagcucuccuccgccuccgaggaggacgacaaggaggacuccgccugggagccccagaagaaggucccccgcucccgcaagcagcccccccccaaggaguccaagcccaagcgcaugccccgcgucaagaagaacgccccccagaucuccgacggcuccgaggucgucgucgucaaggaggagcucaacuccuccgucgccaucgccgacaccgcccucgaggaccgcaagaacaagcucgacaccguccagacccucaagaccgccaagaccaagcagaagugcgccgcccagccccacaccguccgccgcaccaagaagcucaaggucgaggaggagaccuccaaggccuccaaccucgagggcgaguccaacuccuccgagacccccuccaccuccaccgucuggggcggcaccugcaagaaggaggagaacgacgacgacuucaccuucggccaguccgcccucaagaagaucaagaccgagaccuacccccagggccagcccgucaaguuccccgccaacgccaacuccaccaaggaggaggucgagaugaacugggacaugguccagguccucuccgagcgcaccaacaucgagcccugggucugcgccaacaucauccgccucuucaacgacgacaacaccauccccuucaucauccgcuaccgcaaggagcucaucaacaaccucgacgccgacucccuccgcgagguccagcagacccucgaggagcuccgcgccgucgccaagaagguccacuccaccauccagaagaucaagaaggagggcaagauguccgagugccuccucaaggccaugcucaacugcaagaccuucgaggagcucgagcacgucuccgcccccuacaagaccggcuccaagggcaccaaggcccagcgcgcccgccagcucggccucgagggcgccgcccgcgcccuccucgagaagcccggcgagcucucccuccucuccuacauccgccccgacgucaagggccucuccacccuccaggacaucgagaucggcguccagcacauccucgccgacaugaucgccaaggacaaggacacccucgacuucauccgcaaccucugccagaagcgccacgucugcauccaguccucccucgccaaggucuccuccaagaaggucaacgagaaggacgucgacaaguuccuccucuaccagcacuucuccugcaacauccgcaacauccaccaccaccagauccucgccaucaaccgcggcgagaaccucaagguccucaccgucaaggucaacaucuccgacggcgucaaggacgaguucugccgcuggugcauccagaaccgcuggcgcccccgcuccuucgcccgccccgagcucaugaagauccucuacaacucccucaacgacuccuucaagcgccucaucuacccccuccucugccgcgaguuccgcgccaagcucaccuccgacgccgagaaggaguccgucaugauguucggccgcaaccuccgccagcuccuccucaccucccccguccccggccgcacccucaugggcgucgaccccggcuacaagcacggcugcaagcucgccaucaucucccccaccucccagauccuccacaccgacgucgucuaccuccacugcggccagggcuuccgcgaggccgagaagaucaagacccuccuccucaacuucaacugcuccaccgucgucaucggcaacggcaccgccugccgcgagaccgaggccuacuucgccgaccucaucaugaagaacuacuucgccccccucgacgucgucuacugcaucgucuccgaggccggcgccuccaucuacuccgucucccccgaggccaacaaggagaugcccggccucgaccccaaccuccgcuccgccgucuccaucgcccgccgcguccaggacccccucgccgagcucgucaagaucgagcccaagcacaucggcgucggcauguaccagcacgacgucucccagacccuccucaaggccacccucgacuccgucgucgaggagugcgucuccuucgucggcgucgacaucaacaucugcuccgagguccuccuccgccacaucgccggccucaacgccaaccgcgccaagaacaucaucgaguggcgcgagaagaacggccccuucaucaaccgcgagcagcucaagaaggucaagggccucggccccaaguccuuccagcagugcgccggcuucauccgcaucaaccaggacuacauccgcaccuucugcucccagcagaccgagaccuccggccagauccagggcgucgccgucaccuccuccgccgacgucgaggucaccaacgagaagcagggcaagaagaaguccaagaccgccgucaacguccuccucaagcccaacccccucgaccagaccugcauccaccccgaguccuacgacaucgccaugcgcuuccucuccuccaucggcggcacccucuacgaggucggcaagcccgagaugcagcagaagaucaacuccuuccucgagaaggagggcauggagaagaucgccgagcgccuccagaccaccguccacacccuccaggucaucaucgacggccucucccagcccgaguccuucgacuuccgcaccgacuucgacaagcccgacuucaagcgcuccaucgucugccucgaggaccuccagaucggcaccguccucaccggcaaggucgagaacgccacccucuucggcaucuucgucgacaucggcgucggcaaguccggccucauccccauccgcaacgucaccgaggccaagcucuccaagaccaagaagcgccgcucccucggccucggccccggcgagcgcgucgagguccagguccucaacaucgacaucccccgcucccgcaucacccucgaccucauccgcguccucuga

SEQ ID NO: 50125 - RNA, 9693 nt, Artificial Sequence
  derived and/or modified sequence opt2 from SRCAP__Homo_sapiens__NP_006653
augcaguccucccccucccccgcccacccccagcuccccguccuccagacccagauggucuccgacggcaugaccggcuccaaccccgucucccccgccuccuccuccucccccgccuccuccggcgccggcggcaucuccccccagcacaucgcccaggacuccucccucgacggcccccccggcccccccgacggcgccaccgucccccucgagggcuucucccucucccaggccgccgaccucgccaacaagggccccaagugggagaagucccacgccgagaucgccgagcaggccaagcacgaggccgagaucgagacccgcaucgccgagcuccgcaaggagggcuucuggucccucaagcgccuccccaagguccccgagcccccccgccccaagggccacugggacuaccucugcgaggagaugcaguggcucuccgccgacuucgcccaggagcgccgcuggaagcgcggcgucgcccgcaaggucguccgcauggucauccgccaccacgaggagcagcgccagaaggaggagcgcgcccgccgcgaggagcaggccaagcuccgccgcaucgccuccaccauggccaaggacguccgccaguucugguccaacgucgagaaggucguccaguucaagcagcagucccgccucgaggagaagcgcaagaaggcccucgaccuccaccucgacuucaucgucggccagaccgagaaguacuccgaccuccucucccagucccucaaccagccccucaccuccuccaaggccggcuccucccccugccucggcuccuccuccgccgccuccuccccccccccccccgccucccgccucgacgacgaggacggcgacuuccagccccaggaggacgaggaggaggacgacgaggagaccaucgaggucgaggagcagcaggagggcaacgacgccgaggcccagcgccgcgagaucgagcuccuccgccgcgagggcgagcucccccucgaggagcuccuccgcucccuccccccccagcuccucgagggccccuccucccccucccagacccccuccucccacgacuccgacacccgcgacggccccgaggagggcgccgaggaggagcccccccagguccucgagaucaagcccccccccuccgccgucacccagcgcaacaagcagcccuggcaccccgacgaggacgacgaggaguucaccgccaacgaggaggaggccgaggacgaggaggacaccaucgccgccgaggagcagcucgagggcgaggucgaccacgccauggagcucuccgagcucgcccgcgagggcgagcucuccauggaggagcuccuccagcaguacgccggcgccuacgcccccggcuccggcuccuccgaggacgaggacgaggacgaggucgacgccaacuccuccgacugcgagcccgagggccccgucgaggccgaggagcccccccaggaggacuccuccucccaguccgacuccgucgaggaccgcuccgaggacgaggaggacgagcacuccgaggaggaggagaccuccggcuccuccgccuccgaggaguccgaguccgaggaguccgaggacgcccagucccagucccaggccgacgaggaggaggaggacgacgacuucggcgucgaguaccuccucgcccgcgacgaggagcaguccgaggccgacgccggcuccggcccccccacccccggccccaccacccucggccccaagaaggagaucaccgacaucgccgccgccgccgagucccuccagcccaagggcuacacccucgccaccacccaggucaagacccccaucccccuccuccuccgcggccagcuccgcgaguaccagcacaucggccucgacuggcucgucaccauguacgagaagaagcucaacggcauccucgccgacgagaugggccucggcaagaccauccagaccaucucccuccucgcccaccucgccugcgagaagggcaacuggggcccccaccucaucaucguccccaccuccgucaugcucaacugggagauggagcucaagcgcuggugccccuccuucaagauccucaccuacuacggcgcccagaaggagcgcaagcucaagcgccagggcuggaccaagcccaacgccuuccacgucugcaucaccuccuacaagcucguccuccaggaccaccaggccuuccgccgcaagaacuggcgcuaccucauccucgacgaggcccagaacaucaagaacuucaagucccagcgcuggcagucccuccucaacuucaacucccagcgccgccuccuccucaccggcaccccccuccagaacucccucauggagcucuggucccucaugcacuuccucaugccccacgucuuccagucccaccgcgaguucaaggagugguucuccaacccccucaccggcaugaucgagggcucccaggaguacaacgagggccucgucaagcgccuccacaagguccuccgccccuuccuccuccgccgcgucaaggucgacgucgagaagcagaugcccaagaaguacgagcacgucauccgcugccgccucuccaagcgccagcgcugccucuacgacgacuucauggcccagaccaccaccaaggagacccucgccaccggccacuucauguccgucaucaacauccucaugcagcuccgcaaggucugcaaccaccccaaccucuucgacccccgccccgucaccucccccuucaucacccccggcaucugcuucuccaccgccucccucguccuccgcgccaccgacguccacccccuccagcgcaucgacaugggccgcuucgaccucaucggccucgagggccgcgucucccgcuacgaggccgacaccuuccucccccgccaccgccucucccgccgcguccuccucgaggucgccaccgcccccgacccccccccccgccccaagcccgucaagaugaaggucaaccgcaugcuccagcccguccccaagcaggagggccgcaccgucgucgucgucaacaacccccgcgccccccucggccccguccccguccgccccccccccggccccgagcucuccgcccagcccacccccggccccgucccccagguccuccccgccucccucauggucuccgccucccccgccggccccccccucauccccgccucccgcccccccggccccguccuccuccccccccuccagcccaacuccggcucccucccccagguccuccccuccccccucggcguccucuccggcaccucccgcccccccacccccacccucucccucaagcccaccccccccgcccccguccgccucucccccgcccccccccccggcuccuccucccuccucaagccccucaccgucccccccggcuacaccuucccccccgccgccgccaccaccaccuccaccaccaccgccaccgccaccaccaccgccguccccgcccccacccccgccccccagcgccucauccucucccccgacaugcaggcccgccuccccuccggcgaggucgucuccaucggccagcucgccucccucgcccagcgccccgucgccaacgccggcggcuccaagccccucaccuuccagauccagggcaacaagcucacccucaccggcgcccagguccgccagcucgccgucggccagccccgcccccuccagcgcaacgucguccaccucgucuccgccggcggccagcaccaccucaucucccagcccgcccacgucgcccucauccaggccgucgcccccacccccggccccacccccgucuccguccuccccuccuccacccccuccaccacccccgcccccaccggccucucccucccccucgccgccaaccaggucccccccaccauggucaacaacaccggcgucgucaagaucgucguccgccaggccccccgcgacggccucacccccguccccccccucgcccccgccccccgcccccccuccuccggccuccccgccguccucaacccccgccccacccucacccccggccgccuccccacccccacccucggcaccgcccgcgcccccaugcccacccccacccucguccgcccccuccucaagcucguccacucccccucccccgaggucuccgccuccgcccccggcgccgccccccucaccaucuccuccccccuccacguccccuccucccuccccggccccgccuccucccccaugcccauccccaacuccuccccccucgccucccccgucuccuccaccgucuccgucccccucuccuccucccuccccaucuccguccccaccacccuccccgcccccgccuccgccccccucaccauccccaucuccgccccccucaccgucuccgccuccggccccgcccuccucaccuccgucacccccccccucgcccccgucguccccgccgcccccggcccccccucccucgcccccuccggcgccucccccuccgccuccgcccucacccucggccucgccaccgcccccucccucuccuccucccagacccccggccacccccuccuccucgcccccaccuccucccacguccccggccucaacuccaccgucgcccccgccugcucccccguccucguccccgccuccgcccucgccucccccuuccccuccgcccccaaccccgcccccgcccaggccucccuccucgcccccgccuccuccgccucccaggcccucgccaccccccucgcccccauggccgccccccagaccgccauccucgcccccucccccgcccccccccucgccccccuccccguccucgcccccucccccggcgccgcccccguccucgccuccucccagacccccguccccgucauggcccccuccuccacccccggcaccucccucgccuccgccucccccguccccgcccccacccccguccucgcccccuccuccacccagaccaugcuccccgcccccguccccuccccccuccccucccccgccuccacccagacccucgcccucgcccccgcccucgcccccacccucggcggcuccucccccucccagacccucucccucggcaccggcaacccccagggccccuuccccacccagacccucucccucacccccgccuccucccucguccccacccccgcccagacccucucccucgcccccggccccccccucggccccacccagacccucucccucgcccccgcccccccccucgcccccgccucccccgucggccccgcccccgcccacacccucacccucgcccccgccuccuccuccgccucccuccucgcccccgccuccguccagacccucacccucucccccgcccccguccccacccucggccccgccgccgcccagacccucgcccucgcccccgccuccacccagucccccgccucccaggccuccucccucgucgucuccgccuccggcgccgccccccuccccgucaccauggucucccgccuccccgucuccaaggacgagcccgacacccucacccuccgcuccggcccccccuccccccccuccaccgccaccuccuucggcggcccccgcccccgccgccagccccccccccccccccgcucccccuucuaccucgacucccucgaggagaagcgcaagcgccagcgcuccgagcgccucgagcgcaucuuccagcucuccgaggcccacggcgcccucgcccccgucuacggcaccgagguccucgacuucugcacccucccccagcccgucgccucccccaucggcccccgcucccccggccccucccaccccaccuucuggaccuacaccgaggccgcccaccgcgccguccucuucccccagcagcgccucgaccagcucuccgagaucaucgagcgcuucaucuucgucaugccccccgucgaggcccccccccccucccuccacgccugccaccccccccccuggcucgccccccgccaggccgccuuccaggagcagcucgccuccgagcucuggccccgcgcccgcccccuccaccgcaucgucugcaacaugcgcacccaguuccccgaccuccgccucauccaguacgacugcggcaagcuccagacccucgccguccuccuccgccagcucaaggccgagggccaccgcguccucaucuucacccagaugacccgcaugcucgacguccucgagcaguuccucaccuaccacggccaccucuaccuccgccucgacggcuccacccgcgucgagcagcgccaggcccucauggagcgcuucaacgccgacaagcgcaucuucugcuucauccucuccacccgcuccggcggcgucggcgucaaccucaccggcgccgacaccgucgucuucuacgacuccgacuggaaccccaccauggacgcccaggcccaggaccgcugccaccgcaucggccagacccgcgacguccacaucuaccgccucaucuccgagcgcaccgucgaggagaacauccucaagaaggccaaccagaagcgcaugcucggcgacauggccaucgagggcggcaacuucaccaccgccuacuucaagcagcagaccauccgcgagcucuucgacaugccccucgaggagcccuccuccuccuccguccccuccgcccccgaggaggaggaggagaccgucgccuccaagcagacccacauccucgagcaggcccucugccgcgccgaggacgaggaggacauccgcgccgccacccaggccaaggccgagcaggucgccgagcucgccgaguucaacgagaacgacggcuuccccgccggcgagggcgaggaggccggccgccccggcgccgaggacgaggagaugucccgcgccgagcaggagaucgccgcccucgucgagcagcucacccccaucgagcgcuacgccaugaaguuccucgaggccucccucgaggaggucucccgcgaggagcucaagcaggccgaggagcaggucgaggccgcccgcaaggaccucgaccaggccaaggaggaggucuuccgccucccccaggaggaggaggagggccccggcgccggcgacgaguccuccugcggcaccggcggcggcacccaccgccgcuccaagaaggccaaggcccccgagcgccccggcacccgcgucuccgagcgccuccgcggcgcccgcgccgagacccagggcgccaaccacacccccgucaucuccgcccaccagacccgcuccaccaccacccccccccgcugcucccccgcccgcgagcgcgucccccgccccgccccccgcccccgccccacccccgccuccgcccccgccgccauccccgcccucguccccguccccgucuccgcccccguccccaucuccgcccccaaccccaucaccauccuccccguccacauccuccccuccccccccccccccucccagaucccccccugcuccucccccgccugcacccccccccccgccugcacccccccccccgcccacacccccccccccgcccagaccugccucgucacccccuccuccccccuccuccucggcccccccuccguccccaucuccgccuccgucaccaaccucccccucggccuccgccccgaggccgagcucugcgcccaggcccucgccucccccgagucccucgagcucgccuccgucgccuccuccgagaccuccucccucucccucgucccccccaaggaccuccuccccgucgccgucgagauccuccccgucuccgagaagaaccucucccucacccccuccgcccccucccucacccucgaggccggcuccauccccaacggccaggagcaggaggcccccgacuccgccgagggcaccacccucaccguccuccccgagggcgaggagcucccccucugcgucuccgaguccaacggccucgagcucccccccuccgccgccuccgacgagccccuccaggagccccucgaggccgaccgcaccuccgaggagcucaccgaggccaagacccccaccuccucccccgagaagccccaggagcucgucaccgccgaggucgccgcccccuccaccuccuccuccgccaccuccucccccgagggccccucccccgcccgccccccccgccgccgcaccuccgccgacgucgagauccgcggccagggcaccggccgccccggccagccccccggccccaagguccuccgcaagcuccccggccgccucgucaccgucgucgaggagaaggagcucguccgccgccgccgccagcagcgcggcgccgccuccacccucguccccggcgucuccgagaccuccgccucccccggcucccccuccguccgcuccauguccggccccgaguccuccccccccaucggcggccccugcgaggccgcccccuccuccucccuccccacccccccccagcagcccuucaucgcccgccgccacaucgagcucggcgucaccggcggcggcucccccgagaacggcgacggcgcccuccucgccaucaccccccccgccgucaagcgccgccgcggccgcccccccaagaagaaccgcucccccgccgacgccggccgcggcgucgacgaggcccccuccuccacccucaagggcaagaccaacggcgccgaccccguccccggccccgagacccucaucgucgccgaccccguccucgagccccagcucauccccggcccccagccccucggcccccagcccguccaccgccccaacccccuccucucccccgucgagaagcgccgccgcggccgcccccccaaggcccgcgaccuccccauccccggcaccaucuccuccgccggcgacggcaacuccgagucccgcacccagccccccccccaccccuccccccucaccccccuccccccccuccucgucugccccaccgccaccgucgccaacaccgucaccaccgucaccaucuccaccuccccccccaagcgcaagcgcggccgcccccccaagaacccccccuccccccgccccucccagcuccccguccucgaccgcgacuccaccuccguccucgaguccugcggccucggccgccgccgccagccccagggccagggcgaguccgagggcuccuccuccgacgaggacggcucccgcccccucacccgccucgcccgccuccgccucgaggccgagggcaugcgcggccgcaaguccggcggcuccauggucgucgccgucauccaggacgaccucgaccucgccgacuccggccccggcggccucgagcucaccccccccgucgucucccucacccccaagcuccgcuccacccgccuccgccccggcucccucguccccccccucgagaccgagaagcucccccgcaagcgcgccggcgcccccgucggcggcucccccggccucgccaagcgcggccgccuccagccccccuccccccucggccccgagggcuccgucgaggaguccgaggccgaggccuccggcgaggaggaggagggcgacggcaccccccgccgccgccccggcccccgccgccucgucggcaccaccaaccagggcgaccagcgcauccuccgcuccuccgccccccccucccucgccggccccgccgucucccaccgcggccgcaaggccaagaccuga

SEQ ID NO: 50126 - RNA, 1611 nt, Artificial Sequence
  derived and/or modified sequence opt2 from SRC__Homo_sapiens__NP_005408
augggcuccaacaaguccaagcccaaggacgccucccagcgccgccgcucccucgagcccgccgagaacguccacggcgccggcggcggcgccuuccccgccucccagacccccuccaagcccgccuccgccgacggccaccgcggccccuccgccgccuucgcccccgccgccgccgagcccaagcucuucggcggcuucaacuccuccgacaccgucaccuccccccagcgcgccggcccccucgccggcggcgucaccaccuucgucgcccucuacgacuacgagucccgcaccgagaccgaccucuccuucaagaagggcgagcgccuccagaucgucaacaacaccgagggcgacugguggcucgcccacucccucuccaccggccagaccggcuacauccccuccaacuacgucgcccccuccgacuccauccaggccgaggagugguacuucggcaagaucacccgccgcgaguccgagcgccuccuccucaacgccgagaacccccgcggcaccuuccucguccgcgaguccgagaccaccaagggcgccuacugccucuccgucuccgacuucgacaacgccaagggccucaacgucaagcacuacaagauccgcaagcucgacuccggcggcuucuacaucaccucccgcacccaguucaacucccuccagcagcucgucgccuacuacuccaagcacgccgacggccucugccaccgccucaccaccgucugccccaccuccaagccccagacccagggccucgccaaggacgccugggagaucccccgcgagucccuccgccucgaggucaagcucggccagggcugcuucggcgaggucuggaugggcaccuggaacggcaccacccgcgucgccaucaagacccucaagcccggcaccaugucccccgaggccuuccuccaggaggcccaggucaugaagaagcuccgccacgagaagcucguccagcucuacgccgucgucuccgaggagcccaucuacaucgucaccgaguacauguccaagggcucccuccucgacuuccucaagggcgagaccggcaaguaccuccgccucccccagcucgucgacauggccgcccagaucgccuccggcauggccuacgucgagcgcaugaacuacguccaccgcgaccuccgcgccgccaacauccucgucggcgagaaccucgucugcaaggucgccgacuucggccucgcccgccucaucgaggacaacgaguacaccgcccgccagggcgccaaguuccccaucaaguggaccgcccccgaggccgcccucuacggccgcuucaccaucaaguccgacgucugguccuucggcauccuccucaccgagcucaccaccaagggccgcguccccuaccccggcauggucaaccgcgagguccucgaccaggucgagcgcggcuaccgcaugcccugcccccccgagugccccgagucccuccacgaccucaugugccagugcuggcgcaaggagcccgaggagcgccccaccuucgaguaccuccaggccuuccucgaggacuacuucaccuccaccgagccccaguaccagcccggcgagaaccucuga

SEQ ID NO: 50127 - RNA, 3552 nt, Artificial Sequence
  derived and/or modified sequence opt2 from SRCIN1__Homo_sapiens__NP_079524
augggcaacgcccccucccaggaccccgagcgcuccuccccccccaugcucuccgccgacgacgccgaguacccccgcgaguaccgcacccucggcggcggcggcggcggcggcuccggcggccgccgcuucuccaacgucggccucguccacaccuccgagcgccgccacaccgucaucgccgcccagucccucgaggcccucuccggccuccagaaggccgacgccgaccgcaagcgcgacgccuucauggaccaccucaaguccaaguacccccagcacgcccucgcccuccgcggccagcaggaccgcaugcgcgagcagcccaacuacugguccuucaagacccgcuccucccgccacacccagggcgcccagcccggccucgccgaccaggccgccaagcucuccuacgccuccgccgagucccucgagaccauguccgaggccgagcucccccucggcuucucccgcaugaaccgcuuccgccagucccucccccucucccgcuccgccucccagaccaagcuccgcucccccggcguccucuuccuccaguucggcgaggagacccgccgcguccacaucacccacgaggucuccucccucgacacccuccacgcccucaucgcccacauguucccccagaagcucaccaugggcaugcucaagucccccaacaccgccauccucaucaaggacgaggcccgcaacgucuucuacgagcucgaggacguccgcgacauccaggaccgcuccaucaucaagaucuaccgcaaggagccccucuacgccgccuuccccggcucccaccucaccaacggcgaccuccgccgcgagauggucuacgccucccgcgaguccucccccacccgccgccucaacaaccucucccccgccccccaccucgccuccggcucccccccccccggccuccccuccggccuccccuccggccuccaguccggcucccccucccgcucccgccucuccuacgccggcggccgcccccccuccuacgccggcucccccguccaccacgccgccgagcgccucggcggcgcccccgccgcccagggcgucucccccucccccuccgccauccucgagcgccgcgacgucaagcccgacgaggaccucgccuccaaggccggcggcaugguccucgucaagggcgagggccucuacgccgaccccuacggccuccuccacgagggccgccucucccucgccgccgccgccggcgaccccuucgccuaccccggcgccggcggccucuacaagcgcggcuccguccgcucccucuccaccuacuccgccgccgcccuccaguccgaccucgaggacucccucuacaaggccgccggcggcggcggcccccucuacggcgacggcuacggcuuccgccucccccccuccuccccccagaagcucgccgacgucgccgccccccccggcggccccccccccccccacucccccuacuccggcccccccucccgcggcucccccguccgccaguccuuccgcaaggacuccggcuccuccuccgucuucgccgagucccccggcggcaagacccgcuccgccggcuccgccuccaccgccggcgccccccccuccgagcucuuccccggccccggcgagcgcucccucgucggcuucggcccccccguccccgccaaggacaccgagacccgcgagcgcauggaggccauggagaagcagaucgccucccucaccggccucguccaguccgcccuccuccgcggcuccgagcccgagacccccuccgagaagaucgagggcuccaacggcgccgccacccccuccgcccccugcggcuccggcggccgcuccuccggcgccacccccgucuccggcccccccccccccuccgccuccuccacccccgccggccagcccaccgccgucucccgccuccagaugcagcuccaccuccgcggccuccagaacuccgccuccgaccuccgcggccagcuccagcagcuccgcaagcuccagcuccagaaccaggaguccguccgcgcccuccucaagcgcaccgaggccgagcucuccaugcgcgucuccgaggccgcccgccgccaggaggacccccuccagcgccagcgcacccucgucgaggaggagcgccuccgcuaccucaacgacgaggagcucaucacccagcagcucaacgaccucgagaaguccgucgagaagauccagcgcgacgucucccacaaccaccgccucguccccggccccgagcucgaggagaaggcccucguccucaagcagcucggcgagacccucaccgagcucaaggcccacuuccccggccuccaguccaagaugcgcgucguccuccgcgucgaggucgaggccgucaaguuccucaaggaggagccccagcgccucgacggccuccucaagcgcugccgcggcgucaccgacacccucgcccagauccgccgccaggucgacgagggcgucuggcccccccccaacaaccuccucucccagucccccaagaaggucaccgccgagaccgacuucaacaaguccgucgacuucgagaugcccccccccucccccccccucaaccuccacgagcucuccggccccgccgagggcgccucccucacccccaagggcggcaaccccaccaagggccucgacacccccggcaagcgcuccgucgacaaggccgucuccgucgaggccgccgagcgcgacugggaggagaagcgcgccgcccucacccaguacuccgccaaggacaucaaccgccuccucgaggagacccaggccgagcuccucaaggccauccccgaccucgacugcgccuccaaggcccaccccggccccgcccccacccccgaccacaagccccccaaggccccccacggccagaaggccgccccccgcaccgagcccuccggccgccgcggcuccgacgagcucaccgucccccgcuaccgcaccgagaagcccuccaagucccccccccccccccccccccgccgcuccuuccccuccucccacggccucaccaccacccgcaccggcgaggucgucgucaccuccaagaaggacuccgccuucaucaagaaggccgaguccgaggagcucgagguccagaagccccaggucaagcuccgccgcgccgucuccgaggucgcccgccccgccuccaccccccccaucauggccuccgccaucaaggacgaggacgacgaggaccgcaucaucgccgagcucgaguccggcggcggcuccgucccccccaugaaggucgucacccccggcgccucccgccucaaggccgcccagggccaggccggcucccccgacaaguccaagcacggcaagcagcgcgccgaguacaugcgcauccaggcccagcagcaggccaccaagcccuccaaggagauguccggcuccaacgagaccuccucccccgucuccgagaagcccuccgccucccgcaccuccauccccguccucaccuccuucggcgcccgcaacuccuccaucuccuucuga

SEQ ID NO: 50128 - RNA, 639 nt, Artificial Sequence
  derived and/or modified sequence opt2 from SRD5A1__Homo_sapiens__XP_011512405
auggagcacgccgcccagcccuggcgcuggcagcgccgccgcggcuggcgccgcuccgccugcuggccccgcucccccaccugcuccgcccccugggccgcccgcuccucccgcgccaucguccgccgcacccagugcaccgccgccacccgcugccccgccaccggcuccgagugccgccgcggcccccccggcuggugccgcuccugcccccgcuggcccugccgcuccaccuccacccccgccucccccccccgcgucuccgccgcccgccccaccgccuccuccuggcccugcuccuccuccaccaccggcaucggcuucggccucuggcucaccggcaugcucaucaacauccacuccgaccacauccuccgcaaccuccgcaagcccggcgacaccggcuacaagaucccccgcggcggccucuucgaguacgucaccgccgccaacuacuucggcgagaucauggaguggugcggcuacgcccucgccuccugguccguccagggcgccgccuucgccuucuucaccuucugcuuccucuccggccgcgccaaggagcaccacgagugguaccuccgcaaguucgaggaguaccccaaguuccgcaagaucaucauccccuuccucuucuga

SEQ ID NO: 50129 - RNA, 747 nt, Artificial Sequence
  derived and/or modified sequence opt2 from SRD5A2__Homo_sapiens__XP_011531370
augcagguccagugccagcagucccccguccucgccggcuccgccacccucgucgcccucggcgcccucgcccucuacgucgccaagcccuccggcuacggcaagcacaccgagucccucaagcccgccgccacccgccuccccgcccgcgccgccugguuccuccaggagcuccccuccuucgccguccccgccggcauccucgcccgccagccccucucccucuucggcccccccggcaccguccuccucggccucuucugccuccacuacuuccaccgcaccuucgucuacucccuccucaaccgcggccgccccuaccccgccauccucauccuccgcggcaccgccuucugcaccggcaacggcguccuccagggcuacuaccucaucuacugcgccgaguaccccgacggcugguacaccgacauccgcuucucccucgccugccuccccgucguccuccucuucaucaccuccuggcuccaggacgucgacugcuccucccgccacuacaucuggcagucccgccaggaggagcgccgcucccgcggcaccggccucgccugcaccuucuaccagaaguccaagcgcuucccccgcaagucccccaaccaggacuucacccuccaccucaucggcggcaccuccuccugcgacccccucucccagugcaaccucugcuccggcggcuggcagaagaagcgcggcuggaaccagcuccuccgcuacgagaccuccaucuga

SEQ ID NO: 50130 - RNA, 957 nt, Artificial Sequence
  derived and/or modified sequence opt2 from SRD5A3__Homo_sapiens__NP_078868
auggcccccugggccgaggccgagcacuccgcccucaacccccuccgcgccgucuggcucacccucaccgccgccuuccuccucacccuccuccuccagcuccucccccccggccuccuccccggcugcgccaucuuccaggaccucauccgcuacggcaagaccaagugcggcgagcccucccgccccgccgccugccgcgccuucgacguccccaagcgcuacuucucccacuucuacaucaucuccguccucuggaacggcuuccuccucuggugccucacccagucccucuuccucggcgcccccuuccccuccuggcuccacggccuccuccgcauccucggcgccgcccaguuccagggcggcgagcucgcccucuccgccuuccucguccucgucuuccucuggcuccacucccuccgccgccucuucgagugccucuacgucuccgucuucuccaacgucaugauccacgucguccaguacugcuucggccucgucuacuacguccucgucggccucaccguccucucccagguccccauggacggccgcaacgccuacaucaccggcaagaaccuccucaugcaggcccgcugguuccacauccucggcaugaugauguucaucugguccuccgcccaccaguacaagugccacgucauccucggcaaccuccgcaagaacaaggccggcgucgucauccacugcaaccaccgcauccccuucggcgacugguucgaguacgucuccucccccaacuaccucgccgagcucaugaucuacgucuccauggccgucaccuucggcuuccacaaccucaccugguggcucgucgucaccaacgucuucuucaaccaggcccucuccgccuuccucucccaccaguucuacaaguccaaguucgucuccuaccccaagcaccgcaaggccuuccuccccuuccucuucuga

SEQ ID NO: 50131 - RNA, 3534 nt, Artificial Sequence
  derived and/or modified sequence opt2 from SREBF1__Homo_sapiens__NP_001005291
auggacgagccccccuucuccgaggccgcccucgagcaggcccucggcgagcccugcgaccucgacgccgcccuccucaccgacaucgagggcgaggucggcgccggccgcggccgcgccaacggccucgacgccccccgcgccggcgccgaccgcggcgccauggacugcaccuucgaggacaugcuccagcucaucaacaaccaggacuccgacuuccccggccucuucgacccccccuacgccggcuccggcgccggcggcaccgaccccgccucccccgacaccuccucccccggcucccucucccccccccccgccacccucuccuccucccucgaggccuuccucuccggcccccaggccgcccccuccccccucucccccccccagcccgcccccaccccccucaagauguaccccuccaugcccgccuucucccccggccccggcaucaaggaggaguccgucccccucuccauccuccagacccccaccccccagccccuccccggcgcccuccucccccaguccuuccccgcccccgcccccccccaguucuccuccacccccguccucggcuaccccuccccccccggcggcuucuccaccggcuccccccccggcaacacccagcagccccuccccggccucccccucgccuccccccccggcgucccccccgucucccuccacacccagguccaguccgucgucccccagcagcuccucaccgucaccgccgcccccaccgccgcccccgucaccaccaccgucaccucccagauccagcagguccccguccuccuccagccccacuucaucaaggccgacucccuccuccucaccgccaugaagaccgacggcgccaccgucaaggccgccggccucuccccccucgucuccggcaccaccguccagaccggcccccuccccacccucgucuccggcggcaccauccucgccaccgucccccucgucgucgacgccgagaagcuccccaucaaccgccucgccgccggcuccaaggcccccgccuccgcccagucccgcggcgagaagcgcaccgcccacaacgccaucgagaagcgcuaccgcuccuccaucaacgacaagaucaucgagcucaaggaccucgucgucggcaccgaggccaagcucaacaaguccgccguccuccgcaaggccaucgacuacauccgcuuccuccagcacuccaaccagaagcucaagcaggagaaccucucccuccgcaccgccguccacaaguccaagucccucaaggaccucgucuccgccugcggcuccggcggcaacaccgacguccucauggagggcgucaagaccgaggucgaggacacccucacccccccccccuccgacgccggcucccccuuccaguccuccccccucucccucggcucccgcggcuccggcuccggcggcuccggcuccgacuccgagcccgacucccccgucuucgaggacuccaaggccaagcccgagcagcgccccucccuccacucccgcggcaugcucgaccgcucccgccucgcccucugcacccucgucuuccucugccucuccugcaacccccucgccucccuccucggcgcccgcggccuccccucccccuccgacaccaccuccgucuaccacucccccggccgcaacguccucggcaccgagucccgcgacggccccggcugggcccaguggcuccucccccccgucgucuggcuccucaacggccuccucguccucgucucccucguccuccucuucgucuacggcgagcccgucacccgcccccacuccggccccgccgucuacuucuggcgccaccgcaagcaggccgaccucgaccucgcccgcggcgacuucgcccaggccgcccagcagcucuggcucgcccuccgcgcccucggccgcccccuccccaccucccaccucgaccucgccugcucccuccucuggaaccucauccgccaccuccuccagcgccucugggucggccgcuggcucgccggccgcgccggcggccuccagcaggacugcgcccuccgcgucgacgccuccgccuccgcccgcgacgccgcccucgucuaccacaagcuccaccagcuccacaccaugggcaagcacaccggcggccaccucaccgccaccaaccucgcccucuccgcccucaaccucgccgagugcgccggcgacgccgucuccgucgccacccucgccgagaucuacgucgccgccgcccuccgcgucaagaccucccucccccgcgcccuccacuuccucacccgcuucuuccucuccuccgcccgccaggccugccucgcccaguccggcuccgucccccccgccaugcaguggcucugccaccccgucggccaccgcuucuucgucgacggcgacugguccguccucuccacccccugggagucccucuacucccucgccggcaaccccgucgacccccucgcccaggucacccagcucuuccgcgagcaccuccucgagcgcgcccucaacugcgucacccagcccaaccccucccccggcuccgccgacggcgacaaggaguucuccgacgcccucggcuaccuccagcuccucaacuccugcuccgacgccgccggcgcccccgccuacuccuucuccaucuccuccuccauggccaccaccaccggcgucgaccccgucgccaaguggugggccucccucaccgccgucgucauccacuggcuccgccgcgacgaggaggccgccgagcgccucugcccccucgucgagcaccucccccgcguccuccaggaguccgagcgcccccucccccgcgccgcccuccacuccuucaaggccgcccgcgcccuccucggcugcgccaaggccgaguccggccccgccucccucaccaucugcgagaaggccuccggcuaccuccaggacucccucgccaccacccccgccuccuccuccaucgacaaggccguccagcucuuccucugcgaccuccuccucgucguccgcaccucccucuggcgccagcagcagccccccgcccccgcccccgccgcccagggcaccuccucccgcccccaggccuccgcccucgagcuccgcggcuuccagcgcgaccucuccucccuccgccgccucgcccaguccuuccgccccgccaugcgccgcgucuuccuccacgaggccaccgcccgccucauggccggcgccucccccacccgcacccaccagcuccucgaccgcucccuccgccgccgcgccggccccggcggcaagggcggcgccgucgccgagcucgagccccgccccacccgccgcgagcacgccgaggcccuccuccucgccuccugcuaccucccccccggcuuccucuccgcccccggccagcgcgucggcaugcucgccgaggccgcccgcacccucgagaagcucggcgaccgccgccuccuccacgacugccagcagaugcucaugcgccucggcggcggcaccaccgucaccuccuccuga

SEQ ID NO: 50132 - RNA, 3426 nt, Artificial Sequence
  derived and/or modified sequence opt2 from SREBF2__Homo_sapiens__NP_004590
auggacgacuccggcgagcucggcggccucgagaccauggagacccucaccgagcucggcgacgagcucacccucggcgacaucgacgagaugcuccaguucgucuccaaccaggucggcgaguuccccgaccucuucuccgagcagcucugcuccuccuuccccggcuccggcggcuccggcuccuccuccggcuccuccggcuccuccuccuccuccuccaacggccgcggcuccuccuccggcgccgucgaccccuccguccagcgcuccuucacccaggucacccuccccuccuucucccccuccgccgccuccccccaggcccccacccuccaggucaaggucucccccaccuccguccccaccaccccccgcgccacccccauccuccagccccgcccccagccccagccccagccccagacccagcuccagcagcagaccgucaugaucacccccaccuucuccaccaccccccagacccgcaucauccagcagccccucaucuaccagaacgccgccaccuccuuccagguccuccagccccagguccagucccucgucaccuccucccagguccagcccgucaccauccagcagcagguccagaccguccaggcccagcgcguccucacccagaccgccaacggcacccuccagacccucgcccccgccaccguccagaccgucgccgccccccagguccagcagguccccguccucguccagccccagaucaucaagaccgacucccucguccucaccacccucaagaccgacggcucccccgucauggccgccguccagaaccccgcccucaccgcccucaccacccccauccagaccgccgcccuccagguccccacccucgucggcuccuccggcaccauccucaccaccaugcccgucaugaugggccaggagaagguccccaucaagcagguccccggcggcgucaagcagcucgagccccccaaggagggcgagcgccgcaccacccacaacaucaucgagaagcgcuaccgcuccuccaucaacgacaagaucaucgagcucaaggaccucgucaugggcaccgacgccaagaugcacaaguccggcguccuccgcaaggccaucgacuacaucaaguaccuccagcaggucaaccacaagcuccgccaggagaacaugguccucaagcucgccaaccagaagaacaagcuccucaagggcaucgaccucggcucccucgucgacaacgaggucgaccucaagaucgaggacuucaaccagaacguccuccucauguccccccccgccuccgacuccggcucccaggccggcuucucccccuacuccaucgacuccgagcccggcuccccccuccucgacgacgccaaggucaaggacgagcccgacuccccccccgucgcccucggcauggucgaccgcucccgcauccuccucugcguccucaccuuccucugccucuccuucaacccccucaccucccuccuccaguggggcggcgcccacgacuccgaccagcacccccacuccggcuccggccgcuccguccucuccuucgaguccggcuccggcggcugguucgacuggaugaugcccacccuccuccucuggcucgucaacggcgucaucguccucuccgucuucgucaagcuccucguccacggcgagcccgucauccgcccccacucccgcuccuccgucaccuucuggcgccaccgcaagcaggccgaccucgaccucgcccgcggcgacuucgccgccgccgccggcaaccuccagaccugccucgccguccucggccgcgcccuccccaccucccgccucgaccucgccugcucccucuccuggaacgucauccgcuacucccuccagaagcuccgccucguccgcuggcuccucaagaaggucuuccagugccgccgcgccacccccgccaccgaggccggcuucgaggacgaggccaagaccuccgcccgcgacgccgcccucgccuaccaccgccuccaccagcuccacaucaccggcaagcuccccgccggcuccgccugcuccgacguccacauggcccucugcgccgucaaccucgccgagugcgccgaggagaagaucccccccuccacccucgucgagauccaccucaccgccgccaugggccucaagacccgcugcggcggcaagcucggcuuccucgccuccuacuuccucucccgcgcccagucccucugcggccccgagcacuccgccguccccgacucccuccgcuggcucugccacccccucggccagaaguucuucauggagcgcuccugguccgucaaguccgccgccaaggagucccucuacugcgcccagcgcaaccccgccgaccccaucgcccagguccaccaggccuucugcaagaaccuccucgagcgcgccaucgagucccucgucaagccccaggccaagaagaaggccggcgaccaggaggaggaguccugcgaguucuccuccgcccucgaguaccucaagcuccuccacuccuucgucgacuccgucggcgucaugucccccccccucucccgcuccuccguccucaaguccgcccucggccccgacaucaucugccgcugguggaccuccgccaucaccgucgccaucuccuggcuccagggcgacgacgccgccguccgcucccacuucaccaaggucgagcgcauccccaaggcccucgaggucaccgaguccccccucgucaaggccaucuuccacgccugccgcgccaugcacgccucccuccccggcaaggccgacggccagcaguccuccuucugccacugcgagcgcgccuccggccaccucugguccucccucaacgucuccggcgccaccuccgaccccgcccucaaccacgucguccagcuccucaccugcgaccuccuccucucccuccgcaccgcccucuggcagaagcaggccuccgccucccaggccgucggcgagaccuaccacgccuccggcgccgagcucgccggcuuccagcgcgaccucggcucccuccgccgccucgcccacuccuuccgccccgccuaccgcaaggucuuccuccacgaggccaccguccgccucauggccggcgccucccccacccgcacccaccagcuccucgagcacucccuccgccgccgcaccacccaguccaccaagcacggcgaggucgacgccuggcccggccagcgcgagcgcgccaccgccauccuccucgccugccgccaccucccccucuccuuccucuccucccccggccagcgcgccguccuccucgccgaggccgcccgcacccucgagaaggucggcgaccgccgcuccugcaacgacugccagcagaugaucgucaagcucggcggcggcaccgccaucgccgccuccuga

SEQ ID NO: 50133 - RNA, 1875 nt, Artificial Sequence
  derived and/or modified sequence opt2 from SREK1__Homo_sapiens__NP_001070667
augaacuccggcggcggcuucggccucggccucggcuucggccucacccccaccuccgucauccaggucaccaaccucuccuccgccgucaccuccgagcagaugcgcacccucuucuccuuccucggcgagaucgaggagcuccgccucuacccccccgacaacgccccccucgccuucuccuccaaggucugcuacgucaaguuccgcgaccccuccuccgucggcgucgcccagcaccucaccaacaccgucuucaucgaccgcgcccucaucgucguccccugcgccgagggcaagauccccgaggaguccaaggcccucucccuccucgcccccgcccccaccaugaccucccucaugcccggcgccggccuccuccccauccccacccccaacccccucaccacccucggcgucucccucuccucccucggcgccauccccgccgccgcccucgaccccaacaucgccacccucggcgagaucccccagcccccccucaugggcaacgucgaccccuccaagaucgacgagauccgccgcaccgucuacgucggcaaccucaacucccagaccaccaccgccgaccagcuccucgaguucuucaagcaggucggcgaggucaaguucguccgcauggccggcgacgagacccagcccacccgcuucgccuucgucgaguucgccgaccagaacuccgucccccgcgcccucgccuucaacggcgucauguucggcgaccgcccccucaagaucaaccacuccaacaacgccaucgucaagccccccgagaugaccccccaggccgccgccaaggagcucgaggaggucaugaagcgcguccgcgaggcccaguccuucaucuccgccgccaucgagcccgaguccggcaaguccaacgagcgcaagggcggccgcucccgcucccacacccgcuccaagucccgcuccuccuccaagucccacucccgccgcaagcgcucccaguccaagcaccgcucccgcucccacaaccgcucccgcucccgccagaaggaccgccgccgcuccaaguccccccacaagaagcgcuccaagucccgcgagcgccgcaagucccgcucccgcucccacucccgcgacaagcgcaaggacacccgcgagaagaucaaggagaaggagcgcgucaaggagaaggaccgcgagaaggagcgcgagcgcgagaaggagcgcgagaaggagaaggagcgcggcaagaacaaggaccgcgacaaggagcgcgagaaggaccgcgagaaggacaaggagaaggaccgcgagcgcgagcgcgagaaggagcacgagaaggaccgcgacaaggagaaggagaaggagcaggacaaggagaaggagcgcgagaaggaccgcuccaaggagaucgacgagaagcgcaagaaggacaagaagucccgcacccccccccgcuccuacaacgccucccgccgcucccgcuccuccucccgcgagcgccgccgccgccgcucccgcuccuccucccgcuccccccgcaccuccaagaccaucaagcgcaaguccucccgcucccccuccccccgcucccgcaacaagaaggacaagaagcgcgagaaggagcgcgaccacaucuccgagcgccgcgagcgcgagcgcuccaccuccaugcgcaaguccuccaacgaccgcgacggcaaggagaagcucgagaagaacuccaccucccucaaggagaaggagcacaacaaggagcccgacuccuccgucuccaaggaggucgacgacaaggacgccccccgcaccgaggagaacaagauccagcacaacggcaacugccagcucaacgaggagaaccucuccaccaagaccgaggccgucuga

SEQ ID NO: 50134 - RNA, 468 nt, Artificial Sequence
  derived and/or modified sequence opt2 from SREK1IP1__Homo_sapiens__NP_776190
auggccguccccggcugcaacaaggacuccguccgcgccggcugcaagaagugcggcuaccccggccaccucaccuucgagugccgcaacuuccuccgcgucgaccccaagcgcgacaucguccucgacgucuccuccaccuccuccgaggacuccgacgaggagaacgaggagcucaacaagcuccaggcccuccaggagaagcgcaucaacgaggaggaggagaagaagaaggagaaguccaaggagaagaucaagcucaagaagaagcgcaagcgcuccuacuccuccuccuccaccgaggaggacaccuccaagcagaagaagcagaaguaccagaagaaggagaagaagaaggagaagaaguccaaguccaagaagggcaagcaccacaagaaggagaagaagaagcgcaagaaggagaagcacuccuccacccccaacuccuccgaguucucccgcaaguga

SEQ ID NO: 50135 - RNA, 1290 nt, Artificial Sequence
  derived and/or modified sequence opt2 from SRFBP1__Homo_sapiens__NP_689759
auggcccagcccggcacccucaaccucaacaacgaggucgucaagaugcgcaaggaggucaagcgcauccgcguccucgucauccgcaagcucguccgcuccgucggccgccucaaguccaagaagggcaccgaggacgcccuccucaagaaccagcgccgcgcccagcgccuccucgaggagauccacgccaugaaggagcucaagcccgacaucgucaccaaguccgcccucggcgacgacaucaacuucgagaagaucuucaagaagcccgacuccaccgccaccgagcgcgccaucgcccgccucgccguccacccccuccucaagaagaagaucgacguccucaaggccgccguccaggccuucaaggaggcccgccagaacgucgccgaggucgaguccuccaagaacgccuccgaggacaaccacuccgagaacacccucuacuccaacgacaacggcuccaaccuccagcgcgaggccaccgucaucuccgagcagaaggucaaggagaccaagauccucgccaagaagcccauccacaacuccaaggagaagaucgccaagauggagcacggccccaaggccgucaccaucgccaacucccccuccaagcccuccgagaaggacuccgucgucucccucgagucccagaagacccccgccgaccccaagcucaagacccucucccagaccaagaagaacaagggcuccgacuccucccucuccggcaacuccgacggcggcgaggaguucugcgaggaggagaaggaguacuucgacgacuccaccgaggagcgcuucuacaagcaguccuccauguccgaggacuccgacuccggcgacgacuucuucaucggcaagguccgccgcacccgcaagaaggaguccuccugccacuccuccgucaaggagcagaagccccucgagaaggucuuccucaaggaggacaccggcgagacccacggcgacacccgcaacgacaagaucaagcccuccaccgagacccgcaagcucgaguccgucuucuuccacucccucuccggcuccaaguccucccgccgcaacuucaaggagcaggcccccaagacccgcucccucgacuucccccagaacgagccccagaucaagaaccaguucaacaagaagcucuccggccgccucgagaacaccaagcagcagcuccagcucccccuccaccccuccugggaggccucccgccgccgcaaggagcagcaguccaacaucgccgucuuccagggcaagaagaucaccuucgacgacuga

SEQ ID NO: 50136 - RNA, 915 nt, Artificial Sequence
  derived and/or modified sequence opt2 from SRF__Homo_sapiens__NP_001278930
augaucaccuccgagaccggcaaggcccucauccagaccugccucaacucccccgacucccccccccgcuccgaccccaccaccgaccagcgcauguccgccaccggcuucgaggagaccgaccucaccuaccaggucuccgaguccgacuccuccggcgagaccaaggacacccucaagcccgccuucaccgucaccaaccuccccggcaccaccuccaccauccagaccgcccccuccaccuccaccaccaugcaggucuccuccggccccuccuuccccaucaccaacuaccucgcccccgucuccgccuccgucucccccuccgccgucuccuccgccaacggcaccguccucaaguccaccggcuccggccccgucuccuccggcggccucaugcagcuccccaccuccuucacccucaugcccggcggcgccgucgcccagcagguccccguccaggccauccagguccaccaggccccccagcaggccucccccucccgcgacuccuccaccgaccucacccagaccuccuccuccggcaccgucacccuccccgccaccaucaugaccuccuccguccccaccaccgucggcggccacaugauguaccccuccccccacgccgucauguacgcccccaccuccggccucggcgacggcucccucaccguccucaacgccuucucccaggcccccuccaccaugcaggucucccacucccagguccaggagcccggcggcgucccccaggucuuccucaccgccuccuccggcaccguccagauccccgucuccgccguccagcuccaccagauggccgucaucggccagcaggccggcuccuccuccaaccucaccgagcuccaggucgucaaccucgacaccgcccacuccaccaaguccgaguga

SEQ ID NO: 50137 - RNA, 3258 nt, Artificial Sequence
  derived and/or modified sequence opt2 from SRGAP1__Homo_sapiens__NP_065813
auguccacccccucccgcuucaagaaggacaaggagaucaucgccgaguacgagucccaggucaaggagauccgcgcccagcucgucgagcagcagaagugccucgagcagcagaccgagaugcgcguccagcuccuccaggaccuccaggacuucuuccgcaagaaggccgagaucgagaccgaguacucccgcaaccucgagaagcucgccgagcgcuucauggccaagacccgcuccaccaaggaccaccagcaguacaagaaggaccagaaccuccucucccccgucaacugcugguaccuccuccucaaccagguccgccgcgaguccaaggaccacgccacccucuccgacaucuaccucaacaacgucaucaugcgcuucaugcagaucuccgaggacuccacccgcauguucaagaaguccaaggagaucgccuuccagcuccacgaggaccucaugaagguccucaacgagcucuacaccgucaugaagaccuaccacauguaccacgccgaguccaucuccgccgaguccaagcucaaggaggccgagaagcaggaggagaagcagaucggccgcuccggcgaccccgucuuccacauccgccucgaggagcgccaccagcgccgcuccuccgucaagaagaucgagaagaugaaggagaagcgccaggccaaguacuccgagaacaagcucaaguccaucaaggcccgcaacgaguaccuccucacccucgaggccaccaacgccuccgucuucaaguacuacauccacgaccucuccgaccucaucgacugcugcgaccucggcuaccacgccucccucaaccgcgcccuccgcaccuaccucuccgccgaguacaaccucgagaccucccgccacgagggccucgacaucaucgagaacgccgucgacaaccucgagccccgcuccgacaagcagcgcuucauggagauguaccccgccgccuucugcccccccaugaaguucgaguuccagucccacaugggcgacgaggucugccaggucuccgcccagcagcccguccaggccgagcucaugcuccgcuaccagcagcuccagucccgccucgccacccucaagaucgagaacgaggaggucaagaagaccaccgaggccacccuccagaccauccaggacauggucaccaucgaggacuacgacgucuccgagugcuuccagcacucccgcuccaccgaguccgucaaguccaccgucuccgagaccuaccucuccaagcccuccaucgccaagcgccgcgccaaccagcaggagaccgagcaguucuacuucaugaagcuccgcgaguaccucgagggcuccaaccucaucaccaagcuccaggccaagcacgaccuccuccagcgcacccucggcgagggccaccgcgccgaguacaugaccacccgcccccccaacgucccccccaagccccagaagcaccgcaagucccgcccccgcucccaguacaacaccaagcucuucaacggcgaccucgagaccuucgucaaggacuccggccaggucaucccccucaucgucgaguccugcauccgcuucaucaaccucuacggccuccagcaccagggcaucuuccgcgucuccggcucccaggucgaggucaacgacaucaagaacuccuucgagcgcggcgagaacccccucgccgacgaccaguccaaccacgacaucaacuccgucgccggcguccucaagcucuacuuccgcggccucgagaacccccucuuccccaaggagcgcuucaacgaccucaucuccugcauccgcaucgacaaccucuacgagcgcgcccuccacauccgcaagcuccuccucacccucccccgcuccguccucaucgucaugcgcuaccucuucgccuuccucaaccaccucucccaguacuccgacgagaacaugauggaccccuacaaccucgccaucugcuucggccccacccucaugcccguccccgagauccaggaccaggucuccugccaggcccacgucaacgagaucaucaagaccaucaucauccaccacgagaccaucuuccccgacgccaaggagcucgacggccccgucuacgagaagugcauggccggcgacgacuacugcgacucccccuacuccgagcacggcacccucgaggaggucgaccaggacgccggcaccgagccccacaccuccgaggacgagugcgagcccaucgaggccaucgccaaguucgacuacgucggccgcuccgcccgcgagcucuccuucaagaagggcgccucccuccuccucuaccaccgcgccuccgaggacuggugggagggccgccacaacggcaucgacggccucgucccccaccaguacaucgucguccaggacauggacgacaccuucuccgacacccucucccagaaggccgacuccgaggccuccuccggccccgucaccgaggacaaguccuccuccaaggacaugaacucccccaccgaccgccaccccgacggcuaccucgcccgccagcgcaagcgcggcgagccccccccccccguccgccgccccggccgcaccuccgacggccacugcccccuccaccccccccacgcccucuccaacuccuccgucgaccucggcucccccucccucgccucccacccccgcggccuccuccagaaccgcggccucaacaacgacucccccgagcgccgccgccgccccggccacggcucccucaccaacaucucccgccacgacucccucaagaagaucgacuccccccccauccgccgcuccaccuccuccggccaguacaccggcuucaacgaccacaagccccucgaccccgagaccaucgcccaggacaucgaggagaccaugaacaccgcccucaacgagcuccgcgagcucgagcgccaguccaccgccaagcacgcccccgacgucguccucgacacccucgagcaggucaagaacucccccacccccgccaccuccaccgagucccucuccccccuccacaacgucgcccuccgcuccuccgagccccagauccgccgcuccaccuccuccuccuccgacaccauguccaccuucaagcccauggucgccccccgcaugggcguccagcucaagccccccgcccuccgccccaagcccgccguccuccccaagaccaaccccaccaucggccccgccccccccccccagggccccaccgacaaguccugcaccauguga

SEQ ID NO: 50138 - RNA, 2370 nt, Artificial Sequence
  derived and/or modified sequence opt2 from SRGAP2__Homo_sapiens__NP_001287881
augaccucccccgccaaguucaagaaggacaaggagaucaucgccgaguacgacacccaggucaaggagauccgcgcccagcucaccgagcagaugaagugccucgaccagcagugcgagcuccgcguccagcuccuccaggaccuccaggacuucuuccgcaagaaggccgagaucgagauggacuacucccgcaaccucgagaagcucgccgagcgcuuccucgccaagacccgcuccaccaaggaccagcaguucaagaaggaccagaacguccucucccccgucaacugcuggaaccuccuccucaaccaggucaagcgcgagucccgcgaccacaccacccucuccgacaucuaccucaacaacaucaucccccgcuucguccaggucuccgaggacuccggccgccucuucaagaaguccaaggaggucggccagcagcuccaggacgaccucaugaagguccucaacgagcucuacuccgucaugaagaccuaccacauguacaacgccgacuccaucuccgcccaguccaagcucaaggaggccgagaagcaggaggagaagcagaucggcaaguccgucaagcaggaggaccgccagaccccccgcucccccgacuccaccgccaacguccgcaucgaggagaagcacguccgccgcuccuccgucaagaagaucgagaagaugaaggagaagcgccaggccaaguacaccgagaacaagcucaaggccaucaaggcccgcaacgaguaccuccucgcccucgaggccaccaacgccuccgucuucaaguacuacauccacgaccucuccgaccucaucgacugcugcgaccucggcuaccacgccucccucaaccgcgcccuccgcaccuuccucuccgccgagcucaaccucgagcaguccaagcacgagggccucgacgccaucgagaacgccgucgagaaccucgacgccaccuccgacaagcagcgccucauggagauguacaacaacgucuucugcccccccaugaaguucgaguuccagccccacaugggcgacauggccucccagcucugcgcccagcagcccguccaguccgagcucguccagcgcugccagcagcuccagucccgccucuccacccucaagaucgagaacgaggaggucaagaagaccauggaggccacccuccagaccauccaggacaucgucaccgucgaggacuucgacgucuccgacugcuuccaguacuccaacuccauggaguccgucaaguccaccgucuccgagaccuucauguccaagcccuccaucgccaagcgccgcgccaaccagcaggagaccgagcaguucuacuucaccaagaugaaggaguaccucgagggccgcaaccucaucaccaagcuccaggccaagcacgaccuccuccagaagacccucggcgagucccagcgcaccgacugcucccucgcccgccgcuccuccaccguccgcaagcaggacuccucccaggccaucccccucgucgucgaguccugcauccgcuucaucucccgccacggccuccagcacgagggcaucuuccgcgucuccggcucccaggucgaggucaacgacaucaagaacgccuucgagcgcggcgaggacccccucgccggcgaccagaacgaccacgacauggacuccaucgccggcguccucaagcucuacuuccgcggccucgagcacccccucuuccccaaggacaucuuccacgaccucauggccugcgucaccauggacaaccuccaggagcgcgcccuccacauccgcaagguccuccucguccuccccaagaccacccucaucaucaugcgcuaccucuucgccuuccucaaccaccucucccaguucuccgaggagaacaugauggaccccuacaaccucgccaucugcuucggccccucccucauguccguccccgagggccacgaccaggucuccugccaggcccacgucaacgagcucaucaagaccaucaucauccagcacgagaacaucuuccccuccccccgcgagcucgagggccccgucuacucccgcggcggcuccauggaggacuacugcgacuccccccacggcgagaccaccuccgucgaggacuccacccaggacgucaccgccgagcaccacaccuccgacgacgagugcgagcccaucgaggccaucgccaaguucgacuacgucggccgcaccgcccgcgagcucuccuucaagaagggcgccucccuccuccucuaccagcgcgccuccgacgacuggugggagggccgccacaacggcaucgacggccucaucccccaccaguacaucgucguccaggacacccucaucuccuga

SEQ ID NO: 50139 - RNA, 3228 nt, Artificial Sequence
  derived and/or modified sequence opt2 from SRGAP3__Homo_sapiens__NP_001028289
auguccucccagaccaaguucaagaaggacaaggagaucaucgccgaguacgaggcccagaucaaggagauccgcacccagcucgucgagcaguucaagugccucgagcagcaguccgagucccgccuccagcuccuccaggaccuccaggaguucuuccgccgcaaggccgagaucgagcucgaguacucccgcucccucgagaagcucgccgagcgcuucuccuccaagauccgcuccucccgcgagcaccaguucaagaaggaccaguaccuccucucccccgucaacugcugguaccucguccuccaccagacccgccgcgagucccgcgaccacgccacccucaacgacaucuucaugaacaacgucaucguccgccucucccagaucuccgaggacgucauccgccucuucaagaaguccaaggagaucggccuccagaugcacgaggagcuccucaaggucaccaacgagcucuacaccgucaugaagaccuaccacauguaccacgccgaguccaucuccgccgaguccaagcucaaggaggccgagaagcaggaggagaagcaguucaacaaguccggcgaccucuccaugaaccuccuccgccacgaggaccgcccccagcgccgcuccuccgucaagaagaucgagaagaugaaggagaagcgccaggccaaguacuccgagaacaagcucaagugcaccaaggcccgcaacgacuaccuccucaaccucgccgccaccaacgccgccaucuccaaguacuacauccacgacgucuccgaccucaucgacugcugcgaccucggcuuccacgccucccucgcccgcaccuuccgcaccuaccucuccgccgaguacaaccucgagaccucccgccacgagggccucgacgucaucgagaacgccgucgacaaccucgacucccgcuccgacaagcacaccgucauggacaugugcaaccaggucuucugccccccccucaaguucgaguuccagccccacaugggcgacgaggucugccaggucuccgcccagcagcccguccagaccgagcuccucaugcgcuaccaccagcuccagucccgccucgccacccucaagaucgagaacgaggagguccgcaagacccucgacgccaccaugcagacccuccaggacaugcucaccgucgaggacuucgacgucuccgacgccuuccagcacucccgcuccaccgaguccgucaaguccgccgccuccgagaccuacauguccaagaucaacaucgccaagcgccgcgccaaccagcaggagaccgagauguucuacuucaccaaguucaaggaguacgucaacggcuccaaccucaucaccaagcuccaggccaagcacgaccuccucaagcagacccucggcgagggcgagcgcgccgagugcggcaccacccgcggccgccgcaacgcccgcacccgcaaccaggacuccggccaggccaucccccucgucgucgaguccugcauccgcuacaucaaccucuacggccuccagcagcagggcaucuuccgcguccccggcucccaggucgaggucaacgacaucaagaacuccuucgagcgcggcgaggacccccucgucgacgaccagaacgagcgcgacaucaacuccgucgccggcguccucaagcucuacuuccgcggccucgagaacccccucuuccccaaggagcgcuuccaggaccucaucuccaccaucaagcucgagaaccccgccgagcgcguccaccagauccagcagauccucgucacccucccccgcgucgucaucgucgucaugcgcuaccucuucgccuuccucaaccaccucucccaguacuccgacgagaacaugauggaccccuacaaccucgccaucugcuucggccccacccucaugcacauccccgacggccaggaccccgucuccugccaggcccacaucaacgaggucaucaagaccaucaucauccaccacgaggccaucuuccccuccccccgcgagcucgagggccccgucuacgagaagugcauggccggcggcgaggaguacugcgacuccccccacuccgagcccggcgccaucgacgaggucgaccacgacaacggcaccgagccccacaccuccgacgaggaggucgagcagaucgaggccaucgccaaguucgacuacaugggccgcuccccccgcgagcucuccuucaagaagggcgccucccuccuccucuaccaccgcgccuccgaggacuggugggagggccgccacaacggcgucgacggccucaucccccaccaguacaucgucguccaggacauggacgacgccuucuccgacucccucucccagaaggccgacuccgaggccuccuccggcccccuccucgacgacaaggccuccuccaagaacgaccuccagucccccaccgagcacaucuccgacuacggcuucggcggcgucaugggccgcguccgccuccgcuccgacggcgccgccaucccccgccgccgcuccggcggcgacacccacucccccccccgcggccucggccccuccaucgacacccccccccgcgccgccgccugccccuccuccccccacaagaucccccucacccgcggccgcaucgagucccccgagaagcgccgcauggccaccuucggcuccgccggcuccaucaacuaccccgacaagaaggcccucuccgagggccacuccaugcgcuccaccugcggcuccacccgccacuccucccucggcgaccacaagucccucgaggccgaggcccucgccgaggacaucgagaagaccauguccaccgcccuccacgagcuccgcgagcucgagcgccagaacaccgucaagcaggcccccgacgucguccucgacacccucgagccccucaagaacccccccggccccgucuccuccgagcccgccuccccccuccacaccaucgucauccgcgaccccgacgccgccaugcgccgcuccuccuccuccuccaccgagaugaugaccaccuucaagcccgcccucuccgcccgccucgccggcgcccagcuccgccccccccccaugcgccccguccgccccgucguccagcaccgcuccuccuccuccuccuccuccggcgucggcucccccgccgucacccccaccgagaagauguuccccaacuccuccgccgacaaguccggcaccauguga

SEQ ID NO: 50140 - RNA, 477 nt, Artificial Sequence
  derived and/or modified sequence opt2 from SRGN__Homo_sapiens__NP_002718
augaugcagaagcuccucaagugcucccgccucguccucgcccucgcccucauccucguccucgaguccuccguccagggcuaccccacccgccgcgcccgcuaccaguggguccgcugcaaccccgacuccaacuccgccaacugccucgaggagaagggccccauguucgagcuccuccccggcgaguccaacaagaucccccgccuccgcaccgaccucuuccccaagacccgcauccaggaccucaaccgcaucuucccccucuccgaggacuacuccggcuccggcuucggcuccggcuccggcuccggcuccggcuccggcuccggcuuccucaccgagauggagcaggacuaccagcucgucgacgaguccgacgccuuccacgacaaccuccgcucccucgaccgcaaccuccccuccgacucccaggaccucggccagcacggccucgaggaggacuucaugcucuga

SEQ ID NO: 50141 - RNA, 543 nt, Artificial Sequence
  derived and/or modified sequence opt2 from SRI__Homo_sapiens__NP_001243821
augcaguacggcggcgcccccggcggccccgccuuccccggccagacccaggacccccucuacggcuacuucgccgccgucgccggccaggacggccagaucgacgccgacgagcuccagcgcugccucacccaguccggcaucgccggcggcuacaagcccuucaaccucgagaccugccgccucauggucuccaugcucgaccgcgacauguccggcaccaugggcuucaacgaguucaaggagcucugggccguccucaacggcuggcgccagcacuucaucuccuucgacaccgaccgcuccggcaccgucgacccccaggagcuccagaaggcccucaccaccaugggcuuccgccucuccccccaggccgucaacuccaucgccaagcgcuacuccaccaacggcaagaucaccuucgacgacuacaucgccugcugcgucaagcuccgcgcccucaccgacuccuuccgccgccgcgacaccgcccagcagggcgucgucaacuuccccuacgacgacgucucccuccgcaacuga

SEQ ID NO: 50142 - RNA, 1422 nt, Artificial Sequence
  derived and/or modified sequence opt2 from SRL__Homo_sapiens__NP_001092284
augcgcgcccucguccuccucggcugccuccucgccucccuccucuucuccggccaggccgaggagaccgaggacgccaacgaggaggccccccuccgcgaccgcucccacaucgagaagacccucaugcucaacgaggacaagcccuccgacgacuacuccgccguccuccagcgccuccgcaagaucuaccacuccuccaucaagccccucgagcaguccuacaaguacaacgagcuccgccagcacgagaucaccgacggcgagaucaccuccaagcccaugguccucuuccucggccccugguccgucggcaaguccaccaugaucaacuaccuccucggccucgagaacacccgcuaccagcucuacaccggcgccgagcccaccaccuccgaguucaccguccucaugcacggccccaagcucaagaccaucgagggcaucgucauggccgccgacuccgcccgcuccuucuccccccucgagaaguucggccagaacuuccucgagaagcucaucggcaucgaggucccccacaagcuccucgagcgcgucaccuucgucgacacccccggcaucaucgagaaccgcaagcagcaggagcgcggcuaccccuucaacgacgucugccagugguucaucgaccgcgccgaccucaucuucgucgucuucgaccccaccaagcucgacgucggccucgagcucgagaugcucuuccgccagcucaagggccgcgagucccagauccgcaucauccucaacaaggccgacaaccucgccacccagaugcucaugcgcgucuacggcgcccucuucuggucccucgccccccucaucaacgucaccgagcccccccgcgucuacgucuccuccuucuggccccaggaguacaagcccgacacccaccaggagcucuuccuccaggaggagaucucccuccucgaggaccucaaccaggucaucgagaaccgccucgagaacaagaucgccuucauccgccagcacgccauccgcguccgcauccacgcccuccucgucgaccgcuaccuccagaccuacaaggacaagaugaccuucuucuccgacggcgagcucgucuucaaggacaucgucgaggaccccgacaaguucuacaucuucaagaccauccucgccaagaccaacgucuccaaguucgaccuccccaaccgcgaggccuacaaggacuucuucggcaucaaccccaucuccuccuucaagcuccucucccagcagugcuccuacaugggcggcugcuuccucgagaagaucgagcgcgccaucacccaggagcuccccggccuccucggcucccucggccucggcaagaaccccggcgcccucaacugcgacaagaccggcugcuccgagacccccaagaaccgcuaccgcaagcacuga

SEQ ID NO: 50143 - RNA, 1467 nt, Artificial Sequence
  derived and/or modified sequence opt2 from SRMS__Homo_sapiens__NP_543013
auggagcccuuccuccgccgccgccucgccuuccucuccuucuucugggacaagaucuggcccgccggcggcgagcccgaccacggcacccccggcucccucgaccccaacaccgaccccguccccacccuccccgccgagcccugcucccccuucccccagcucuuccucgcccucuacgacuucaccgcccgcugcggcggcgagcucuccguccgccgcggcgaccgccucugcgcccucgaggagggcggcggcuacaucuucgcccgccgccucuccggccagcccuccgccggccucguccccaucacccacgucgccaaggccucccccgagacccucuccgaccagcccugguacuucuccggcgucucccgcacccaggcccagcagcuccuccucuccccccccaacgagcccggcgccuuccucauccgccccuccgaguccucccucggcggcuacucccucuccguccgcgcccaggccaaggucugccacuaccgcgucuccauggccgccgacggcucccucuaccuccagaagggccgccucuuccccggccucgaggagcuccucaccuacuacaaggccaacuggaagcucauccagaacccccuccuccagcccugcaugccccagaaggccccccgccaggacgucugggagcgcccccacuccgaguucgcccucggccgcaagcucggcgagggcuacuucggcgaggucugggagggccucuggcucggcucccuccccgucgccaucaaggucaucaaguccgccaacaugaagcucaccgaccucgccaaggagauccagacccucaagggccuccgccacgagcgccucauccgccuccacgccgucugcuccggcggcgagcccgucuacaucgucaccgagcucaugcgcaagggcaaccuccaggccuuccucggcacccccgagggccgcgcccuccgccuccccccccuccucggcuucgccugccaggucgccgagggcauguccuaccucgaggagcagcgcgucguccaccgcgaccucgccgcccgcaacguccucgucgacgacggccucgccugcaaggucgccgacuucggccucgcccgccuccucaaggacgacaucuacucccccuccuccuccuccaagauccccgucaaguggaccgcccccgaggccgccaacuaccgcgucuucucccagaaguccgacgucugguccuucggcguccuccuccacgaggucuucaccuacggccagugccccuacgagggcaugaccaaccacgagacccuccagcagaucaugcgcggcuaccgccucccccgccccgccgccugccccgccgaggucuacguccucaugcucgagugcuggcgcuccucccccgaggagcgccccuccuucgccacccuccgcgagaagcuccacgccauccaccgcugccaccccuga

SEQ ID NO: 50144 - RNA, 411 nt, Artificial Sequence
  derived and/or modified sequence opt2 from SRP14__Homo_sapiens__NP_003125
augguccuccucgaguccgagcaguuccucaccgagcucacccgccucuuccagaagugccgcaccuccggcuccgucuacaucacccucaagaaguacgacggccgcaccaagcccauccccaagaagggcaccgucgagggcuucgagcccgccgacaacaagugccuccuccgcgccaccgacggcaagaagaagaucuccaccgucgucuccuccaaggaggucaacaaguuccagauggccuacuccaaccuccuccgcgccaacauggacggccucaagaagcgcgacaagaagaacaagaccaagaagaccaaggccgccgccgccgccgccgccgccgcccccgccgccgccgccaccgcccccaccaccgccgccaccaccgccgccaccgccgcccaguga

SEQ ID NO: 50145 - RNA, 333 nt, Artificial Sequence
  derived and/or modified sequence opt2 from SRP19__Homo_sapiens__NP_001191122
auggccugcgccgccgcccgcucccccgccgaccaggaccgcuucaucugcaucuaccccgccuaccucaacaacaagaagaccaucgccgagggccgccgcauccccaucuccaaggccgucgagaaccccaccgccaccgagauccaggacgucugcuccgccgucggccucaacgucuuccucgagaagaacaagauguacucccgcgaguggaaccgcgacguccaguaccgcggccgcguccgcguccagcucaagcaggaggacggcucccucugccucguccaguuccccucccacuacacccucucccucaccuccggcuccuga

SEQ ID NO: 50146 - RNA, 1770 nt, Artificial Sequence
  derived and/or modified sequence opt2 from SRP68__Homo_sapiens__NP_001247431
auggccgccgagaagcagguccccggcggcggcggcggcggcggcuccggcggcggcggcggcuccggcggcggcggcuccggcggcggccgcggcgccggcggcgaggagaacaaggagaacgagcgccccuccgccggcuccaaggccaacaaggaguucggcgacucccucucccucgagauccuccagaucaucaaggagucccagcagcagcacggccuccgccacggcgacuuccagcgcuaccgcuaccuccuccucguccucauggacgccgagcgcgccugguccuacgccaugcagcucaagcaggaggccaacaccgagccccgcaagcgcuuccaccuccucucccgccuccgcaaggccgucaagcacgccgaggagcucgagcgccucugcgaguccaaccgcgucgacgccaagaccaagcucgaggcccaggccuacaccgccuaccucuccggcaugcuccgcuucgagcaccaggaguggaaggccgccaucgaggccuucaacaagugcaagaccaucuacgagaagcucgccuccgccuucaccgaggagcaggccguccucuacaaccagcgcgucgaggagaucucccccaacauccgcuacugcgccuacaacaucggcgaccaguccgccaucaacgagcucaugcagaugcgccuccgcuccggcggcaccgagggccuccucgccgagaagcucgaggcccucaucacccagacccgcgccaagcaggccgccaccauguccgaggucgaguggcgcggccgcaccguccccgucaagaucgacaagguccgcaucuuccuccucggccucgccgacaacgaggccgccaucguccaggccgaguccgaggagaccaaggagcgccucuucgaguccaugcucuccgagugccgcgacgccauccaggucguccgcgaggagcucaagcccgaccagaagcagcgcgacuacauccucgagggcgagcccggcaaggucuccaaccuccaguaccuccacuccuaccucaccuacaucaagcucuccaccgccaucaagcgcaacgagaacauggccaagggccuccagcgcgcccuccuccagcagcagcccgaggacgacuccaagcgcuccccccgcccccaggaccucauccgccucuacgacaucauccuccagaaccucgucgagcuccuccagcuccccggccucgaggaggacaaggccuuccagaaggagaucggccucaagacccucgucuucaaggccuaccgcugcuucuucaucgcccaguccuacguccucgucaagaagugguccgaggcccucguccucuacgaccgcguccucaaguacgccaacgaggucaacuccgacgccggcgccuucaagaacucccucaaggaccuccccgacguccaggagcucaucacccagguccgcuccgagaagugcucccuccaggccgccgccauccucgacgccaacgacgcccaccagaccgagaccuccuccucccaggucaaggacaacaagccccucgucgagcgcuucgagaccuucugccucgaccccucccucgucaccaagcaggccaaccucguccacuucccccccggcuuccagcccauccccugcaagccccucuucuucgaccucgcccucaaccacgucgccuuccccccccucgaggacaagcucgagcagaagaccaaguccggccucaccggcuacaucaagggcaucuucggcuuccgcuccuga

SEQ ID NO: 50147 - RNA, 1833 nt, Artificial Sequence
  derived and/or modified sequence opt2 from SRP72__Homo_sapiens__NP_001254651
auggccuccggcggcuccggcggcgucuccguccccgcccucugguccgaggucaaccgcuacggccagaacggcgacuucacccgcgcccucaagaccgucaacaagauccuccagaucaacaaggacgacgucaccgcccuccacugcaaggucgucugccucauccagaacggcuccuucaaggaggcccucaacgucaucaacacccacaccaagguccucgccaacaacucccucuccuucgagaaggccuacugcgaguaccgccucaaccgcaucgagaacgcccucaagaccaucgaguccgccaaccagcagaccgacaagcucaaggagcucuacggccagguccucuaccgccucgagcgcuacgacgagugccucgccgucuaccgcgaccucguccgcaacucccaggacgacuacgacgaggagcgcaagaccaaccucuccgccgucgucgccgcccaguccaacugggagaaggucguccccgagaaccucggccuccaggagggcacccacgagcucugcuacaacaccgccugcgcccucaucggccagggccagcucaaccaggccaugaagauccuccagaaggccgaggaccucugccgccgcucccucuccgaggacaccgaccagaacgucuucgacuccaagaagaaggucaagcucaccaacgccgagggcgucgaguucaagcucuccaagaagcagcuccaggccaucgaguucaacaaggcccuccucgccauguacaccaaccaggccgagcagugccgcaagaucuccgccucccuccagucccagucccccgagcaccuccuccccguccucauccaggccgcccagcucugccgcgagaagcagcacaccaaggccaucgagcuccuccaggaguucuccgaccagcaccccgagaacgccgccgagaucaagcucaccauggcccagcucaagaucucccagggcaacaucuccaaggccugccucauccuccgcuccaucgaggagcucaagcacaagcccggcauggucuccgcccucgucaccauguacucccacgaggaggacaucgacuccgccaucgaggucuucacccaggccauccagugguaccagaaccaccagcccaagucccccgcccaccucucccucauccgcgaggccgccaacuucaagcucaaguacggccgcaagaaggaggccaucuccgaccuccagcagcucuggaagcagaaccccaaggacauccacacccucgcccagcucaucuccgccuacucccucgucgaccccgagaaggccaaggcccucuccaagcaccuccccuccuccgacuccaugucccucaaggucgacgucgaggcccucgagaacuccgccggcgccaccuacauccgcaagaagggcggcaaggucaccggcgacucccagcccaaggagcagggccagggcgaccucaagaagaagaagaagaagaagaagggcaagcuccccaagaacuacgaccccaaggucacccccgaccccgagcgcuggcuccccaugcgcgagcgcuccuacuaccgcggccgcaagaagggcaagaagaaggaccagaucggcaagggcacccagggcgccaccgccggcgccuccuccgagcucgacgccuccaagaccgucuccuccccccccaccuccccccgccccggcuccgccgccaccgucuccgccuccaccuccaacaucauccccccccgccaccagaagcccgccggcgcccccgccaccaagaagaagcagcagcagaagaagaagaagggcggcaagggcggcugguga

SEQ ID NO: 50148 - RNA, 249 nt, Artificial Sequence
  derived and/or modified sequence opt2 from SRP9__Homo_sapiens__NP_001123912
augccccaguaccagaccugggaggaguucucccgcgccgccgagaagcucuaccucgccgaccccaugaaggcccgcgucguccucaaguaccgccacuccgacggcaaccucugcgucaaggucaccgacgaccucguccgccagugccucgcccuccuccuccgccuccagugcuccggcaugaucaucgcccacugcauccucgaccuccucggcuccuccggcccccucgccuccgccuccuga

SEQ ID NO: 50149 - RNA, 1968 nt, Artificial Sequence
  derived and/or modified sequence opt2 from SRPK1__Homo_sapiens__NP_003128
auggagcgcaagguccucgcccuccaggcccgcaagaagcgcaccaaggccaagaaggacaaggcccagcgcaaguccgagacccagcaccgcggcuccgccccccacuccgaguccgaccuccccgagcaggaggaggagauccucggcuccgacgacgacgagcaggaggaccccaacgacuacugcaagggcggcuaccaccucgucaagaucggcgaccucuucaacggccgcuaccacgucauccgcaagcucggcuggggccacuucuccaccgucuggcucuccugggacauccagggcaagaaguucgucgccaugaaggucgucaaguccgccgagcacuacaccgagaccgcccucgacgagauccgccuccucaaguccguccgcaacuccgaccccaacgaccccaaccgcgagauggucguccagcuccucgacgacuucaagaucuccggcgucaacggcacccacaucugcauggucuucgagguccucggccaccaccuccucaaguggaucaucaaguccaacuaccagggccucccccuccccugcgucaagaagaucauccagcagguccuccagggccucgacuaccuccacaccaagugccgcaucauccacaccgacaucaagcccgagaacauccuccucuccgucaacgagcaguacauccgccgccucgccgccgaggccaccgaguggcagcgcuccggcgcccccccccccuccggcuccgccgucuccaccgccccccagcccaagcccgccgacaagauguccaagaacaagaagaagaagcucaagaagaagcagaagcgccaggccgagcuccucgagaagcgcaugcaggagaucgaggagauggagaaggaguccggccccggccagaagcgccccaacaagcaggaggaguccgagucccccgucgagcgcccccucaaggagaacccccccaacaagaugacccaggagaagcucgaggaguccuccaccaucggccaggaccagacccucauggagcgcgacaccgagggcggcgccgccgagaucaacugcaacggcgucaucgaggucaucaacuacacccagaacuccaacaacgagacccuccgccacaaggaggaccuccacaacgccaacgacugcgacguccagaaccucaaccaggaguccuccuuccucuccucccagaacggcgacuccuccaccucccaggagaccgacuccugcacccccaucaccuccgaggucuccgacaccauggucugccaguccuccuccaccgucggccaguccuucuccgagcagcacaucucccagcuccaggaguccauccgcgccgagauccccugcgaggacgagcaggagcaggagcacaacggcccccucgacaacaagggcaaguccaccgccggcaacuuccucgucaacccccucgagcccaagaacgccgagaagcucaaggucaagaucgccgaccucggcaacgccugcuggguccacaagcacuucaccgaggacauccagacccgccaguaccgcucccucgagguccucaucggcuccggcuacaacacccccgccgacaucugguccaccgccugcauggccuucgagcucgccaccggcgacuaccucuucgagccccacuccggcgaggaguacacccgcgacgaggaccacaucgcccucaucaucgagcuccucggcaaggucccccgcaagcucaucgucgccggcaaguacuccaaggaguucuucaccaagaagggcgaccucaagcacaucaccaagcucaagcccuggggccucuucgagguccucgucgagaaguacgaguggucccaggaggaggccgccggcuucaccgacuuccuccuccccaugcucgagcucauccccgagaagcgcgccaccgccgccgagugccuccgccaccccuggcucaacuccuga

SEQ ID NO: 50150 - RNA, 2067 nt, Artificial Sequence
  derived and/or modified sequence opt2 from SRPK2__Homo_sapiens__NP_872633
auguccgucaacuccgagaaguccuccuccuccgagcgccccgagccccagcagaaggccccccucgucccccccccccccccccccccccccccccccccccccccccuccccgaccccaccccccccgagcccgaggaggagauccucggcuccgacgacgaggagcaggaggaccccgccgacuacugcaagggcggcuaccaccccgucaagaucggcgaccucuucaacggccgcuaccacgucauccgcaagcucggcuggggccacuucuccaccgucuggcucugcugggacaugcagggcaagcgcuucgucgccaugaaggucgucaaguccgcccagcacuacaccgagaccgcccucgacgagaucaagcuccucaagugcguccgcgaguccgaccccuccgaccccaacaaggacauggucguccagcucaucgacgacuucaagaucuccggcaugaacggcauccacgucugcauggucuucgagguccucggccaccaccuccucaaguggaucaucaaguccaacuaccagggccuccccguccgcugcgucaaguccaucauccgccagguccuccagggccucgacuaccuccacuccaagugcaagaucauccacaccgacaucaagcccgagaacauccucaugugcgucgacgacgccuacguccgccgcauggccgccgaggccaccgaguggcagaaggccggcgcccccccccccuccggcuccgccgucuccaccgccccccagcagaagcccaucggcaagaucuccaagaacaagaagaagaagcucaagaagaagcagaagcgccaggccgagcuccucgagaagcgccuccaggagaucgaggagcucgagcgcgaggccgagcgcaagaucaucgaggagaacaucaccuccgccgcccccuccaacgaccaggacggcgaguacugccccgaggucaagcucaagaccaccggccucgaggaggccgccgaggccgagaccgccaaggacaacggcgaggccgaggaccaggaggagaaggaggacgccgagaaggagaacaucgagaaggacgaggacgacgucgaccaggagcucgccaacaucgaccccaccuggaucgagucccccaagaccaacggccacaucgagaacggccccuucucccucgagcagcagcucgacgacgaggacgacgacgaggaggacugccccaaccccgaggaguacaaccucgacgagcccaacgccgaguccgacuacaccuacuccuccuccuacgagcaguucaacggcgagcuccccaacggccgccacaagauccccgagucccaguuccccgaguucuccaccucccucuucuccggcucccucgagcccgucgccugcggcuccguccucuccgagggcuccccccucaccgagcaggaggaguccucccccucccacgaccgcucccgcaccgucuccgccuccuccaccggcgaccuccccaaggccaagacccgcgccgccgaccuccucgucaacccccucgacccccgcaacgccgacaagauccgcgucaagaucgccgaccucggcaacgccugcuggguccacaagcacuucaccgaggacauccagacccgccaguaccgcuccaucgagguccucaucggcgccggcuacuccacccccgccgacaucugguccaccgccugcauggccuucgagcucgccaccggcgacuaccucuucgagccccacuccggcgaggacuacucccgcgacgaggaccacaucgcccacaucaucgagcuccucggcuccaucccccgccacuucgcccucuccggcaaguacucccgcgaguucuucaaccgccgcggcgagcuccgccacaucaccaagcucaagcccuggucccucuucgacguccucgucgagaaguacggcuggccccacgaggacgccgcccaguucaccgacuuccucauccccaugcucgagaugguccccgagaagcgcgccuccgccggcgagugccuccgccaccccuggcucaacuccuga

SEQ ID NO: 50151 - RNA, 816 nt, Artificial Sequence
  derived and/or modified sequence opt2 from SRPRB__Homo_sapiens__NP_067026
auggccuccgccgacucccgccgcgucgccgacggcggcggcgccggcggcaccuuccagcccuaccucgacacccuccgccaggagcuccagcagaccgaccccacccuccucuccgucgucgucgccguccucgccguccuccucacccucgucuucuggaagcucauccgcucccgccgcuccucccagcgcgccguccuccucgucggccucugcgacuccggcaagacccuccucuucguccgccuccucaccggccucuaccgcgacacccagaccuccaucaccgacuccugcgccgucuaccgcgucaacaacaaccgcggcaacucccucacccucaucgaccuccccggccacgagucccuccgccuccaguuccucgagcgcuucaaguccuccgcccgcgccaucgucuucgucgucgacuccgccgccuuccagcgcgaggucaaggacgucgccgaguuccucuaccagguccucaucgacuccaugggccucaagaacacccccuccuuccucaucgccugcaacaagcaggacaucgccauggccaaguccgccaagcucauccagcagcagcucgagaaggagcucaacacccuccgcgucacccgcuccgccgcccccuccacccucgacuccuccuccaccgcccccgcccagcucggcaagaagggcaaggaguucgaguucucccagcucccccucaaggucgaguuccucgagugcuccgccaagggcggccgcggcgacgucggcuccgccgacauccaggaccucgagaaguggcucgccaagaucgccuga

SEQ ID NO: 50152 - RNA, 1833 nt, Artificial Sequence
  derived and/or modified sequence opt2 from SRPR__Homo_sapiens__NP_001171313
augcucgacuucuucaccaucuucuccaagggcggccucguccucuggugcuuccagggcgucuccgacuccugcaccggccccgucaacgcccucauccgcuccguccuccuccaggucggcuuccagaagauccucacccucaccuacgucgacaagcucaucgacgacguccaccgccucuuccgcgacaaguaccgcaccgagauccagcagcaguccgcccucucccuccucaacggcaccuucgacuuccagaacgacuuccuccgccuccuccgcgaggccgaggaguccuccaagauccgcgcccccaccaccaugaagaaguucgaggacuccgagaaggccaagaagcccguccgcuccaugaucgagacccgcggcgagaagcccaaggagaaggccaagaacuccaagaagaagggcgccaagaaggagggcuccgacggcccccucgccaccuccaagcccguccccgccgagaaguccggccuccccgucggccccgagaacggcgucgagcucuccaaggaggagcucauccgccgcaagcgcgaggaguucauccagaagcacggccgcggcauggagaaguccaacaaguccaccaaguccgacgcccccaaggagaagggcaagaaggccccccgcgucugggagcucggcggcugcgccaacaaggagguccucgacuacuccacccccaccaccaacggcacccccgaggccgcccucuccgaggacaucaaccucauccgcggcaccggcuccggcggccagcuccaggaccucgacugcuccuccuccgacgacgagggcgccgcccagaacuccaccaagcccuccgccaccaagggcacccucggcggcauguucggcaugcucaagggccucgucggcuccaagucccucucccgcgaggacauggaguccguccucgacaagaugcgcgaccaccucaucgccaagaacgucgccgccgacaucgccguccagcucugcgaguccgucgccaacaagcucgagggcaaggucaugggcaccuucuccaccgucaccuccaccgucaagcaggcccuccaggagucccucguccagauccuccagccccagcgccgcgucgacaugcuccgcgacaucauggacgcccagcgccgccagcgccccuacgucgucaccuucugcggcgucaacggcgucggcaaguccaccaaccucgccaagaucuccuucuggcuccucgagaacggcuucuccguccucaucgccgccugcgacaccuuccgcgccggcgccgucgagcagcuccgcacccacacccgccgccucuccgcccuccacccccccgagaagcacggcggccgcaccaugguccagcucuucgagaagggcuacggcaaggacgccgccggcaucgccauggaggccaucgccuucgcccgcaaccagggcuucgacgucguccucgucgacaccgccggccgcaugcaggacaacgccccccucaugaccgcccucgccaagcucaucaccgucaacacccccgaccucguccucuucgucggcgaggcccucgucggcaacgaggccgucgaccagcucgucaaguucaaccgcgcccucgccgaccacuccauggcccagaccccccgccucaucgacggcaucguccucaccaaguucgacaccaucgacgacaaggucggcgccgccaucuccaugaccuacaucaccuccaagcccaucgucuucgucggcaccggccagaccuacugcgaccuccgcucccucaacgccaaggccgucgucgccgcccucaugaaggccuga

SEQ ID NO: 50153 - RNA, 1398 nt, Artificial Sequence
  derived and/or modified sequence opt2 from SRPX2__Homo_sapiens__XP_005262178
auggccucccagcucacccagcgcggcgcccucuuccuccucuucuuccucacccccgccgucacccccaccugguacgccggcuccggcuacuaccccgacgaguccuacaacgaggucuacgccgaggaggucccccaggcccccgcccucgacuaccgcgucccccgcuggugcuacacccucaacauccaggacggcgaggccaccugcuacucccccaagggcggcaacuaccacuccucccucggcacccgcugcgagcucuccugcgaccgcggcuuccgccucaucggccgccgcuccguccagugccuccccucccgccgcugguccggcaccgccuacugccgccagaugcgcugccacgcccuccccuucaucaccuccggcaccuacaccugcaccaacggcguccuccucgacucccgcugcgacuacuccugcuccuccggcuaccaccucgagggcgaccgcucccgcaucugcauggaggacggccgcugguccggcggcgagcccgucugcgucgacaucgacccccccaagauccgcugcccccacucccgcgagaagauggccgagcccgagaagcucaccgcccgcgucuacugggaccccccccucgucaaggacuccgccgacggcaccaucacccgcgucacccuccgcggccccgagcccggcucccacuuccccgagggcgagcacgucauccgcuacaccgccuacgaccgcgccuacaaccgcgccuccugcaaguucaucgucaagguccagguccgccgcugccccacccucaagcccccccagcacggcuaccucaccugcaccuccgccggcgacaacuacggcgccaccugcgaguaccacugcgacggcggcuacgaccgccagggcacccccucccgcgucugccaguccucccgccagugguccggcuccccccccaucugcgcccccaugaagaucaacgucaacgucaacuccgccgccggccuccucgaccaguucuacgagaagcagcgccuccucaucaucuccgcccccgaccccuccaaccgcuacuacaagaugcagaucuccaugcuccagcaguccaccugcggccucgaccuccgccacgucaccaucaucgagcucgucggccagcccccccaggaggucggccgcauccgcgagcagcagcucuccgccaacaucaucgaggagcuccgccaguuccagcgccucacccgcuccuacuucaacaugguccucaucgacaagcagggcaucgaccgcgaccgcuacauggagcccgucacccccgaggagaucuucaccuucaucgacgacuaccuccucuccaaccaggagcucacccagcgccgcgagcagcgcgacaucugcgaguga

SEQ ID NO: 50154 - RNA, 1335 nt, Artificial Sequence
  derived and/or modified sequence opt2 from SRPX__Homo_sapiens__NP_001164221
augggcucccccgcccaccgccccgcccuccuccuccuccuccccccccuccuccuccuccuccuccuccgcgucccccccucccgcuccuuccccgacacccccuggugcucccccaucaaggucaaguacggcgacgucuacugccgcgccccccagggcggcuacuacaagaccgcccucggcacccgcugcgacauccgcugccagaagggcuacgagcuccacggcuccucccuccucaucugccaguccaacaagcgcugguccgacaaggucaucugcaagcagaagcgcugccccacccucgccaugcccgccaacggcggcuucaagugcgucgacggcgccuacuucaacucccgcugcgaguacuacugcucccccggcuacacccucaagggcgagcgcaccgucaccugcauggacaacaaggccugguccggccgccccgccuccugcgucgacauggagcccccccgcaucaagugccccuccgucaaggagcgcaucgccgagcccaacaagcucaccguccgcgucuccugggagacccccgagggccgcgacaccgccgacggcauccucaccgacgucauccucaagggccucccccccggcuccaacuuccccgagggcgaccacaagauccaguacaccgucuacgaccgcgccgagaacaagggcaccugcaaguuccgcgucaagguccgcgucaagcgcugcggcaagcucaacgcccccgagaacggcuacaugaagugcuccuccgacggcgacaacuacggcgccaccugcgaguucuccugcaucggcggcuacgagcuccagggcucccccgcccgcgucugccaguccaaccucgccugguccggcaccgagcccaccugcgccgccaugaacgucaacgucggcguccgcaccgccgccgcccuccucgaccaguucuacgagaagcgccgccuccucaucgucuccacccccaccgcccgcaaccuccucuaccgccuccagcucggcaugcuccagcaggcccagugcggccucgaccuccgccacaucaccgucgucgagcucgucggcgucuuccccacccucaucggccgcaucggcgccaagaucaugccccccgcccucgcccuccagcuccgccuccuccuccgcaucccccucuacuccuucuccaugguccucgucgacaagcacggcauggacaaggagcgcuacgucucccucgucaugcccgucgcccucuucaaccucaucgacaccuucccccuccgcaaggaggagaugguccuccaggccgagaugucccagaccugcaacaccuga

SEQ ID NO: 50155 - RNA, 1023 nt, Artificial Sequence
  derived and/or modified sequence opt2 from SRR__Homo_sapiens__XP_011522276
augugcgcccaguacugcaucuccuucgccgacgucgagaaggcccacaucaacauccgcgacuccauccaccucacccccguccucaccuccuccauccucaaccagcucaccggccgcaaccucuucuucaagugcgagcucuuccagaagaccggcuccuucaagauccgcggcgcccucaacgccguccgcucccucguccccgacgcccucgagcgcaagcccaaggccgucgucacccacuccuccggcaaccacggccaggcccucaccuacgccgccaagcucgagggcauccccgccuacaucgucgucccccagaccgcccccgacugcaagaagcucgccauccaggccuacggcgccuccaucgucuacugcgagcccuccgacgagucccgcgagaacgucgccaagcgcgucaccgaggagaccgagggcaucaugguccaccccaaccaggagcccgccgucaucgccggccagggcaccaucgcccucgagguccucaaccaggucccccucgucgacgcccucgucguccccgucggcggcggcggcaugcucgccggcaucgccaucaccgucaaggcccucaagcccuccgucaaggucuacgccgccgagcccuccaacgccgacgacugcuaccaguccaagcucaagggcaagcucaugcccaaccucuacccccccgagaccaucgccgacggcgucaaguccuccaucggccucaacaccuggcccaucauccgcgaccucgucgacgacaucuucaccgucaccgaggacgagaucaagugcgccacccagcucgucugggagcgcaugaagcuccucaucgagcccaccgccggcgucggcgucgccgccguccucucccagcacuuccagaccgucucccccgaggucaagaacaucugcaucguccucuccggcggcaacgucgaccucaccuccuccaucaccugggucaagcaggccgagcgccccgccuccuaccaguccgucuccgucuga

SEQ ID NO: 50156 - RNA, 2751 nt, Artificial Sequence
  derived and/or modified sequence opt2 from SRRM1__Homo_sapiens__NP_001290377
auggacgccggcuucuuccgcggcaccuccgccgagcaggacaaccgcuucuccaacaagcagaagaagcuccucaagcagcucaaguucgccgagugccucgagaagaaggucgacauguccaaggucaaccucgaggucaucaagcccuggaucaccaagcgcgucaccgagauccucggcuucgaggacgacgucgucaucgaguucaucuucaaccagcucgaggucaagaaccccgacuccaagaugaugcagaucaaccucaccggcuuccucaacggcaagaacgcccgcgaguucaugggcgagcucuggccccuccuccucuccgcccaggagaacaucgccggcauccccuccgccuuccucgagcucaagaaggaggagaucaagcagcgccagaucgagcaggagaagcucgccuccaugaagaagcaggacgaggacaaggacaagcgcgacaaggaggagaaggaguccucccgcgagaagcgcgagcgcucccgcuccccccgccgccgcaagucccgcucccccuccccccgccgccgcuccucccccguccgccgcgagcgcaagcgcucccacucccgcuccccccgccaccgcaccaagucccgcucccccucccccgcccccgagaagaaggagaagacccccgagcuccccgagcccuccgucaaggucaaggagcccuccguccaggaggccaccuccaccuccgacauccucaagguccccaagcccgagcccauccccgagcccaaggagcccucccccgagaagaacuccaagaaggagaaggagaaggagaagacccgcccccgcucccgcucccgcuccaagucccgcucccgcacccgcucccgcucccccucccacacccgcccccgccgccgccaccgcucccgcucccgcuccuacuccccccgccgccgccccuccccccgccgccgccccuccccccgccgccgcacccccccccgccgcaugcccccccccccccgccaccgccgcucccgcucccccguccgccgccgccgccgcuccuccgccucccucuccggcuccuccuccuccuccuccuccucccgcucccgcuccccccccaagaagccccccaagcgcaccuccucccccccccgcaagacccgccgccucucccccuccgccucccccccccgccgccgccaccgccccuccccccccgccacccccccccccaagacccgccacucccccaccccccagcaguccaaccgcacccgcaagucccgcgucuccgucucccccggccgcaccuccgucaccaagcacaagggcaccgagaagcgcgagucccccucccccgcccccaagccccgcaaggucgagcucuccgaguccgaggaggacaagggcggcaagauggccgccgccgacuccguccagcagcgccgccaguaccgccgccagaaccagcaguccuccuccgacuccggcuccuccuccuccuccgaggacgagcgccccaagcgcucccacgucaagaacggcgaggucggccgccgccgccgccacucccccucccgcuccgccucccccuccccccgcaagcgccagaaggagaccuccccccgcaugcagaugggcaagcgcuggcagucccccgucaccaaguccggccgccgccgccgcucccccucccccccccccacccgccgccgccgcucccccucccccgccccccccccccgccgccgccgcacccccaccccccccccccgccgccgcacccccuccccccccccccgccgccgcucccccuccccccgccgcuacuccccccccauccagcgccgcuacucccccucccccccccccaagcgccgcaccgccucccccccccccccccccaagcgccgcgccucccccucccccccccccaagcgccgcgucucccacucccccccccccaagcagcgcuccucccccgucaccaagcgccgcucccccucccucuccuccaagcaccgcaagggcuccucccccucccgcuccacccgcgaggcccgcuccccccagcccaacaagcgccacucccccuccccccgcccccgcgccccccagaccuccuccucccccccccccguccgccgcggcgccuccuccuccccccagcgccgccagucccccucccccuccacccgccccauccgccgcgucucccgcacccccgagcccaagaagaucaagaaggccgccucccccuccccccaguccguccgccgcgucuccuccucccgcuccgucuccggcucccccgagcccgccgccaagaagccccccgccccccccucccccguccagucccagucccccuccaccaacuggucccccgccguccccgucaagaaggccaagucccccacccccucccccucccccccccgcaacuccgaccaggagggcggcggcaagaagaagaagaagaagaaggacaagaagcacaagaaggacaagaagcacaagaagcacaagaagcacaagaaggagaaggccgucgccgccgccgccgccgccgccgucacccccgccgccaucgccgccgccaccaccacccucgcccaggaggagcccgucgccgcccccgagcccaagaaggagaccgaguccgaggccgaggacaaccucgacgaccucgagaagcaccuccgcgagaaggcccuccgcuccaugcgcaaggcccaggucuccccccaguccuga

SEQ ID NO: 50157 - RNA, 8259 nt, Artificial Sequence
  derived and/or modified sequence opt2 from SRRM2__Homo_sapiens__NP_057417
auguacaacggcaucggccuccccaccccccgcggcuccggcaccaacggcuacguccagcgcaaccucucccucguccgcggccgccgcggcgagcgccccgacuacaagggcgaggaggagcuccgccgccucgaggccgcccucgucaagcgccccaaccccgacauccucgaccacgagcgcaagcgccgcgucgagcuccgcugccucgagcucgaggagaugauggaggagcagggcuacgaggagcagcagauccaggagaaggucgccaccuuccgccucaugcuccucgagaaggacgucaaccccggcggcaaggaggagacccccggccagcgccccgccgucaccgagacccaccagcucgccgagcucaacgagaagaagaacgagcgccuccgcgccgccuucggcaucuccgacuccuacgucgacggcuccuccuucgacccccagcgccgcgcccgcgaggccaagcagcccgcccccgagccccccaagcccuacucccucguccgcgaguccuccuccucccgcucccccacccccaagcagaagaagaagaagaagaagaaggaccgcggccgccgcuccgaguccuccuccccccgccgcgagcgcaagaaguccuccaagaagaagaagcaccgcuccgaguccgaguccaagaagcgcaagcaccgcucccccacccccaaguccaagcgcaaguccaaggacaagaagcgcaagcgcucccgcuccaccacccccgcccccaagucccgccgcgcccaccgcuccaccuccgccgacuccgccuccuccuccgacaccucccgcucccgcucccgcuccgccgccgccaagacccacaccaccgcccucgccggccgcucccccucccccgccuccggccgccgcggcgagggcgacgcccccuucuccgagcccggcaccaccuccacccagcgccccuccucccccgagaccgccaccaagcagcccuccucccccuacgaggacaaggacaaggacaagaaggagaaguccgccacccgccccucccccucccccgagcgcuccuccaccggccccgagccccccgcccccaccccccuccucgccgagcgccacggcggcuccccccagccccucgccaccaccccccucucccaggagcccgucaacccccccuccgaggccucccccacccgcgaccgcuccccccccaagucccccgagaagcucccccaguccuccuccuccgaguccuccccccccuccccccagcccaccaaggucucccgccacgccuccuccucccccgagucccccaagcccgcccccgcccccggcucccaccgcgagaucuccuccucccccaccuccaagaaccgcucccacggccgcgccaagcgcgacaagucccacucccacacccccucccgccgcaugggccgcucccgcucccccgccaccgccaagcgcggccgcucccgcucccgcacccccaccaagcgcggccacucccgcucccgcuccccccaguggcgccgcucccgcuccgcccagcgcuggggccgcucccgcuccccccagcgccgcggccgcucccgcuccccccagcgccccggcuggucccgcucccgcaacacccagcgccgcggccgcucccgcuccgcccgccgcggccgcucccacucccgcucccccgccacccgcggccgcucccgcucccgcacccccgcccgccgcggccgcucccgcucccgcacccccgcccgccgccgcucccgcucccgcacccccacccgccgccgcucccgcucccgcacccccgcccgccgcggccgcucccgcucccgcacccccgcccgccgccgcucccgcacccgcucccccguccgccgccgcucccgcucccgcucccccgcccgccgcuccggccgcucccgcucccgcacccccgcccgccgcggccgcucccgcucccgcacccccgcccgccgcggccgcucccgcucccgcacccccgcccgccgcuccggccgcucccgcucccgcacccccgcccgccgcggccgcucccgcucccgcaccccccgccgcggccgcucccgcucccgcucccucguccgccgcggccgcucccacucccgcaccccccagcgccgcggccgcuccggcuccuccuccgagcgcaagaacaagucccgcaccucccagcgccgcucccgcuccaacuccucccccgagaugaagaagucccgcaucuccucccgccgcucccgcucccucuccuccccccgcuccaaggccaagucccgccucucccuccgccgcucccucuccggcuccucccccugccccaagcagaagucccagacccccccccgccgcucccgcuccggcuccucccagcccaaggccaagucccgcacccccccccgccgcucccgcuccuccuccucccccccccccaagcagaaguccaagacccccucccgccagucccacuccuccuccuccccccaccccaaggucaaguccggcacccccccccgccagggcuccaucaccuccccccaggccaacgagcaguccgucaccccccagcgccgcuccugcuucgaguccucccccgaccccgagcucaagucccgcacccccucccgccacuccugcuccggcuccucccccccccgcgucaaguccuccacccccccccgccagucccccucccgcuccuccuccccccagcccaaggucaaggccaucaucuccccccgccagcgcucccacuccggcuccuccucccccucccccucccgcgucaccucccgcaccaccccccgccgcucccgcuccgucucccccugcuccaacgucgagucccgccuccucccccgcuacucccacuccggcuccuccucccccgacaccaaggucaagcccgagacccccccccgccagucccacuccggcuccaucucccccuaccccaaggucaaggcccagaccccccccggccccucccucuccggcuccaagucccccugcccccaggagaaguccaaggacucccucguccaguccugccccggcucccucucccucugcgccggcgucaaguccuccaccccccccggcgaguccuacuucggcgucuccucccuccagcucaagggccagucccagaccucccccgaccaccgcuccgacaccuccucccccgagguccgccagucccacuccgagucccccucccuccaguccaagucccagaccucccccaagggcggccgcucccgcuccuccucccccgucaccgagcucgccucccgcucccccauccgccaggaccgcggcgaguucuccgccucccccaugcucaaguccggcaugucccccgagcagucccgcuuccaguccgacuccuccuccuaccccaccgucgacuccaacucccuccucggccagucccgccucgagaccgccgaguccaaggagaagauggcccuccccccccaggaggacgccaccgccucccccccccgccagaaggacaaguucucccccuuccccguccaggaccgccccgaguccucccucgucuucaaggacacccuccgcacccccccccgcgagcgcuccggcgccggcuccucccccgagaccaaggagcagaacuccgcccuccccaccuccucccaggacgaggagcucauggaggucgucgagaaguccgaggagcccgccggccagauccucucccaccucuccuccgagcucaaggagauguccaccuccaacuucgaguccucccccgaggucgaggagcgccccgccgucucccucacccucgaccagucccagucccaggccucccucgaggccgucgagguccccuccauggccuccuccuggggcggcccccacuucucccccgagcacaaggagcucuccaacuccccccuccgcgagaacuccuucggcuccccccucgaguuccgcaacuccggcccccucggcaccgagaugaacaccggcuucuccuccgaggucaaggaggaccucaacggccccuuccucaaccagcucgagaccgaccccucccucgacaugaaggagcaguccacccgcuccuccggccacuccuccuccgagcucucccccgacgccgucgagaaggccggcauguccuccaaccaguccaucuccucccccguccucgacgccgucccccgcacccccucccgcgagcgcuccuccuccgccuccucccccgagaugaaggacggccucccccgcacccccucccgccgcucccgcuccggcuccucccccggccuccgcgacggcuccggcacccccucccgccacucccucuccggcuccucccccggcaugaaggacaucccccgcacccccucccgcggccgcuccgagugcgacuccucccccgagcccaaggcccucccccagaccccccgcccccgcucccgcucccccuccucccccgagcucaacaacaagugccucaccccccagcgcgagcgcuccggcuccgaguccuccgucgaccagaagaccgucgcccgcaccccccucggccagcgcucccgcuccggcuccucccaggagcucgacgucaagcccuccgccuccccccaggagcgcuccgaguccgacuccucccccgacuccaaggccaagacccgcaccccccuccgccagcgcucccgcuccggcuccucccccgaggucgacuccaagucccgccucuccccccgccgcucccgcuccggcuccucccccgaggucaaggacaagccccgcgccgccccccgcgcccaguccggcuccgacuccucccccgagcccaaggcccccgccccccgcgcccucccccgccgcucccgcuccggcuccuccuccaagggccgcggccccucccccgagggcuccuccuccaccgaguccucccccgagcacccccccaagucccgcaccgcccgccgcggcucccgcuccucccccgagcccaagaccaagucccgcacccccccccgccgccgcuccucccgcuccucccccgagcucacccgcaaggcccgccucucccgccgcucccgcuccgccuccuccucccccgagacccgcucccgcacccccccccgccaccgccgcucccccuccgucuccucccccgagcccgccgagaagucccgcuccucccgccgccgccgcuccgccuccuccccccgcaccaagaccaccucccgccgcggccgcucccccucccccaagccccgcggccuccagcgcucccgcucccgcucccgccgcgagaagacccgcaccacccgccgccgcgaccgcuccggcuccucccaguccaccucccgccgccgccagcgcucccgcucccgcucccgcgucacccgccgccgccgcggcggcuccggcuaccacucccgcucccccgcccgccaggaguccucccgcaccuccucccgccgccgccgcggccgcucccgcaccccccccaccucccgcaagcgcucccgcucccgcaccucccccgcccccuggaagcgcucccgcucccgcgccucccccgccacccaccgccgcucccgcucccgcaccccccucaucucccgccgccgcucccgcucccgcaccucccccgucucccgccgccgcucccgcucccgcaccuccgucacccgccgccgcucccgcucccgcgccucccccgucucccgccgccgcucccgcucccgcaccccccccgucacccgccgccgcucccgcucccgcacccccaccacccgccgccgcucccgcucccgcaccccccccgucacccgccgccgcucccgcucccgcaccccccccgucacccgccgccgcucccgcucccgcaccucccccaucacccgccgccgcucccgcucccgcaccucccccgucacccgccgccgcucccgcucccgcaccucccccgucacccgccgccgcucccgcucccgcaccucccccgucacccgccgccgcucccgcucccgcaccccccccgccauccgccgccgcucccgcucccgcaccccccuccucccccgcaagcgcucccgcucccgcuccccccucgccauccgccgccgcucccgcucccgcaccccccgcaccgcccgcggcaagcgcucccucacccgcuccccccccgccauccgccgccgcuccgccuccggcuccuccuccgaccgcucccgcuccgccaccccccccgccacccgcaaccacuccggcucccgcaccccccccgucgcccucaacuccucccgcauguccugcuucucccgccccuccaugucccccaccccccucgaccgcugccgcucccccggcaugcucgagccccucggcuccucccgcacccccauguccguccuccagcaggccggcggcuccaugauggacggccccggcccccgcauccccgaccaccagcgcaccuccguccccgagaaccacgcccagucccgcaucgcccucgcccucaccgccaucucccucggcaccgcccgccccccccccuccauguccgccgccggccucgccgcccgcaugucccagguccccgcccccgucccccucaugucccuccgcaccgcccccgccgccaaccucgccucccgcauccccgccgccuccgccgccgccaugaaccucgccuccgcccgcacccccgccauccccaccgccgucaaccucgccgacucccgcacccccgccgccgccgccgccaugaaccucgccuccccccgcaccgccgucgcccccuccgccgucaaccucgccgacccccgcacccccaccgcccccgccgucaaccucgccggcgcccgcacccccgccgcccucgccgcccucucccucaccggcuccggcaccccccccaccgccgccaacuaccccuccuccucccgcaccccccaggcccccgccuccgccaaccucgucggcccccgcuccgcccacgccaccgcccccgucaacaucgccggcucccgcaccgccgccgcccucgcccccgccucccucaccuccgcccgcauggcccccgcccucuccggcgccaaccucaccuccccccgcgucccccucuccgccuacgagcgcgucuccggccgcaccucccccccccuccucgaccgcgcccgcucccgcaccccccccuccgcccccucccagucccgcaugaccuccgagcgcgcccccucccccuccucccgcaugggccaggcccccucccagucccuccucccccccgcccaggaccagccccgcucccccguccccuccgccuucuccgaccagucccgcugccucaucgcccagaccacccccgucgccggcucccagucccucuccuccggcgccgucgccaccaccaccuccuccgccggcgaccacaacggcaugcucuccguccccgcccccggcgucccccacuccgacgucggcgagccccccgccuccaccggcgcccagcagcccuccgcccucgccgcccuccagcccgccaaggagcgccgcuccuccuccuccuccuccuccuccuccuccuccuccuccuccuccuccuccuccuccuccuccuccuccuccuccggcuccuccuccuccgacuccgagggcuccucccuccccguccagcccgaggucgcccucaagcgcguccccucccccacccccgcccccaaggaggccguccgcgagggccgcccccccgagcccacccccgccaagcgcaagcgccgcuccuccuccuccuccuccuccuccuccuccuccuccuccuccuccuccuccuccuccuccuccuccuccuccuccuccuccuccuccuccuccuccuccuccuccuccuccuccuccuccuccucccccucccccgccaagcccggcccccaggcccuccccaagcccgccucccccaagaagcccccccccggcgagcgccgcucccgcuccccccgcaagcccaucgacucccuccgcgacucccgcucccucuccuacucccccgucgagcgccgccgccccuccccccagcccuccccccgcgaccagcaguccuccuccuccgagcgcggcucccgccgcggccagcgcggcgacucccgcucccccucccacaagcgccgccgcgagacccccuccccccgccccaugcgccaccgcuccucccgcucccccuga

SEQ ID NO: 50158 - RNA, 1836 nt, Artificial Sequence
  derived and/or modified sequence opt2 from SRRM4__Homo_sapiens__NP_919262
auggccuccguccagcagggcgagaagcagcucuucgagaaguucuggcgcggcaccuucaaggccgucgccaccccccgccccgaguccaucaucgucgccuccaucaccgcccgcaagccccucccccgcaccgagccccagaacaaccccgucguccccgcccaggacggccccuccgagaagcucggccagcaccucgccaccgagccccucggcaccaacuccugggagcgcgacaagaccugccgcgagcucggcgccacccgcggccacuccgccucccacgacaaggaccucacccccccccccuccucccgcggcaagaagaagaagaagaaguccacccgcaagaagcgccgccgcuccuccuccuacucccccucccccgucaagaagaagaagaagaaguccuccaagaagcacaagcgccgccgcuccuucuccaagaagcgccgccacuccuccuccucccccaaguccaagcgccgcgacgagaagcgccacaagaagcagucccgcucccgcccccgcaagucccaccgccaccgccaccaccgcugccccucccgcucccaguccuccgagucccgccccuccuccugcgagucccgccaccgcggccgcucccccgaggagggccagaagucccgccgccgccacucccgccgcugcuccaagacccucugcaaggacucccccgaggcccaguccucccgcccccccucccagccccuccagaugcucggcuaccucuccgcccgcggcgucaucaccggcuccggcuccgccgccgaccucuucaccaagaccgccuccccccucaccaccucccgcggccgcucccaggaguacgacuccggcaacgacaccuccuccccccccuccacccagaccuccuccgcccgcucccgcggccaggagaagggcucccccuccggcggccucuccaagucccgcgagcucaacuccggcaacaccuccgacuccggcaacuccuucaccaccuccuccccccagaacaagggcgccaugcucgagaaccucucccccaccucccgcggccgcgagucccgcggcuuccagucccccugccucgagugcgccgaggucaagaaguccucccucguccccuccaccgcccgcuccucccccaugaagggcugcucccgcuccuccuccuacgccuccacccgcuccuccucccacuccucccgcucccccaacccccgcgccuccccccgcuacacccagucccgcuccaccuccuccgagaagcgcuccuacucccgcucccccuccuacuccuccaaguccggcaagcgcuccccccccucccgcuccucccgcucccgccgcucccccuccuacucccgcuacucccccucccgcgagcgcgaccccaaguacuccgagaaggacucccagcagcgcgagcgcgagcgcgcccgccgccgccgccgcuccuacucccccaugcgcaagcgccgccgcgacucccccucccaccucgaggcccgccgcaucaccuccgcccgcaagcgccccauccccuacuaccgccccucccccuccuccuccggcucccucuccuccaccuccuccugguacuccuccuccuccucccgcuccgccucccgcuccuacucccgcucccgcucccgcucccgcucccgccgccgcucccgcacccgcaccuccuccuccuccuccucccgcucccccucccccggcucccgcucccgcucccgcucccgcucccgcucccgcucccgcucccgcucccagucccgcuccuacuccuccgccgacuccuacuccuccacccgccgcuga

SEQ ID NO: 50159 - RNA, 2652 nt, Artificial Sequence
  derived and/or modified sequence opt2 from SRRT__Homo_sapiens__XP_005250462
auggcccccuccgaccgcgccaugggcgacuccgacgacgaguacgaccgccgccgccgcgacaaguuccgccgcgagcgcuccgacuacgaccgcucccgcgagcgcgacgagcgccgccgcggcgacgacuggaacgaccgcgagugggaccgcggccgcgagcgccgcucccgcggcgaguaccgcgacuacgaccgcaaccgccgcgagcgcuucucccccccccgccacgagcucucccccccccagaagcgcaugcgccgcgacugggacgagcacuccuccgaccccuaccacuccggcuacgagaugcccuacgccggcggcggcggcggccccaccuacggccccccccagcccuggggccaccccgacguccacaucaugcagcaccacguccuccccauccaggcccgccucggcuccaucgccgagaucgaccucggcguccccccccccgucaugaagaccuucaaggaguuccuccucucccucgacgacuccgucgacgagaccgaggccgucaagcgcuacaacgacuacaagcucgacuuccgccgccagcagaugcaggacuucuuccucgcccacaaggacgaggagugguuccgcuccaaguaccaccccgacgaggucggcaagcgccgccaggaggcccgcggcgcccuccagaaccgccuccgcgucuuccucucccucauggagaccggcugguucgacaaccuccuccucgacaucgacaaggccgacgccaucgucaagaugcucgacgccgccgucaucaagauggagggcggcaccgagaacgaccuccgcauccucgagcaggaggaggaggaggagcaggccggcaagcccggcgagcccuccaagaaggaggagggccgcgccggcgccggccucggcgacggcgagcgcaagaccaacgacaaggacgagaagaaggaggacggcaagcaggccgagaacgacuccuccaacgacgacaagaccaagaaguccgagggcgacggcgacaaggaggagaagaaggaggacuccgagaaggaggccaagaaguccuccaagaagcgcaaccgcaagcacuccggcgacgacuccuucgacgagggcuccgucuccgaguccgaguccgaguccgaguccggccaggccgaggaggagaaggaggaggccgaggaggcccucaaggagaaggagaagcccaaggaggaggagugggagaagcccaaggacgccgccggccucgagugcaagccccgcccccuccacaagaccugcucccucuucaugcgcaacaucgcccccaacaucucccgcgccgagaucaucucccucugcaagcgcuaccccggcuucaugcgcgucgcccucuccgagccccagcccgagcgccgcuucuuccgccgcggcugggucaccuucgaccgcuccgucaacaucaaggagaucugcuggaaccuccagaacauccgccuccgcgagugcgagcucucccccggcgucaaccgcgaccucacccgccgcguccgcaacaucaacggcaucacccagcacaagcagaucguccgcaacgacaucaagcucgccgccaagcucauccacacccucgacgaccgcacccagcucugggccuccgagcccggcacccccccccuccccaccucccuccccucccagaaccccauccucaagaacaucaccgacuaccucaucgaggaggucuccgccgaggaggaggagcuccucggcuccuccggcggcgccccccccgaggagccccccaaggagggcaaccccgccgagaucaacgucgagcgcgacgagaagcucaucaagguccucgacaagcuccuccucuaccuccgcaucguccacucccucgacuacuacaacaccugcgaguaccccaacgaggacgagaugcccaaccgcugcggcaucauccacguccgcggccccaugccccccaaccgcaucucccacggcgagguccucgaguggcagaagaccuucgaggagaagcucaccccccuccucuccguccgcgagucccucuccgaggaggaggcccagaagaugggccgcaaggaccccgagcaggaggucgagaaguucgucaccuccaacacccaggagcucggcaaggacaaguggcucugcccccucuccggcaagaaguucaagggccccgaguucguccgcaagcacaucuucaacaagcacgccgagaagaucgaggaggucaagaaggaggucgccuucuucaacaacuuccucaccgacgccaagcgccccgcccuccccgagaucaagcccgcccagccccccggccccgcccagauccucccccccggccucacccccggccuccccuacccccaccagaccccccagggccucaugcccuacggccagccccgcccccccauccucggcuacggcgccggcgccguccgccccgccguccccaccggcggcccccccuacccccacgcccccuacggcgccggccgcggcaacuacgacgccuuccgcggccagggcggcuaccccggcaagccccgcaaccgcaugguccgcggcgacccccgcgccaucgucgaguaccgcgaccucgacgcccccgacgacgucgacuucuucuga

SEQ ID NO: 50160 - RNA, 519 nt, Artificial Sequence
  derived and/or modified sequence opt2 from SRSF10__Homo_sapiens__NP_001287865
augucccgcuaccuccgcccccccaacaccucccucuucguccgcaacgucgccgacgacacccgcuccgaggaccuccgccgcgaguucggccgcuacggccccaucgucgacgucuacgucccccucgacuucuacacccgccgcccccgcggcuucgccuacguccaguucgaggacguccgcgacgccgaggacgcccuccacaaccucgaccgcaaguggaucugcggccgccagaucgagauccaguucgcccagggcgaccgcaagacccccaaccagaugaaggccaaggagggccgcaacgucuacuccuccucccgcuacgacgacuacgaccgcuaccgccgcucccgcucccgcuccuacgagcgccgccgcucccgcucccgcuccuucgacuacaacuaccgccgcuccuacuccccccgcaaccgccccaccggccgcccccgccgcucccgcucccacuccgacaacgacucccaggucuccaagaagaagaacgagcgcuga

SEQ ID NO: 50161 - RNA, 1455 nt, Artificial Sequence
  derived and/or modified sequence opt2 from SRSF11__Homo_sapiens__XP_011540729
auguccaacaccaccgucguccccuccaccgccggccccggccccuccggcggccccggcggcggcggcggcggcggcggcggcggcggcggcaccgaggucauccaggucaccaacgucucccccuccgccuccuccgagcagaugcgcacccucuucggcuuccucggcaagaucgacgagcuccgccucuucccccccgacgacuccccccuccccgucuccucccgcgucugcuucgucaaguuccacgaccccgacuccgccgucgucgcccagcaccucaccaacaccgucuucgucgaccgcgcccucaucgucguccccuacgccgagggcgucauccccgacgaggccaaggcccucucccuccucgcccccgccaacgccgucgccggccuccuccccggcggcggccuccuccccacccccaacccccucacccagaucggcgccgucccccucgccgcccucggcgcccccacccucgaccccgcccucgccgcccucggccuccccggcgccaaccucaacucccagucccucgccgccgaccagcuccucaagcucauguccaccgucgaccccaagcucaaccacgucgccgccggccucgucucccccucccucaaguccgacaccuccuccaaggagaucgaggaggccaugaagcgcguccgcgaggcccagucccucaucuccgccgccaucgagcccgacaagaaggaggagaagcgccgccacucccgcucccgcucccgcucccgccgccgccgcacccccuccuccucccgccaccgccgcucccgcucccgcucccgccgccgcucccacuccaagucccgcucccgccgccgcuccaaguccccccgccgccgccgcucccacucccgcgagcgcggccgccgcucccgcuccaccuccaagacccgcgacaagaagaaggaggacaaggagaagaagcgcuccaagaccccccccaaguccuacuccaccgcccgccgcucccgcuccgccucccgcgagcgccgccgccgccgcucccgcuccggcacccgcucccccaagaagccccgcucccccaagcgcaagcucucccgcucccccuccccccgccgccacaagaaggagaagaagaaggacaaggacaaggagcgcucccgcgacgagcgcgagcgcuccaccuccaagaagaagaaguccaaggacaaggagaaggaccgcgagcgcaaguccgaguccgacaaggacgucaagcaggucacccgcgacuacgacgaggaggagcagggcuacgacuccgagaaggagaagaaggaggagaagaagcccaucgagaccggcucccccaagaccaaggagugcuccgucgagaagggcaccggcgacucccuccgcgaguccaaggucaacggcgacgaccaccacgaggaggacauggacauguccgacuga

SEQ ID NO: 50162 - RNA, 786 nt, Artificial Sequence
  derived and/or modified sequence opt2 from SRSF12__Homo_sapiens__NP_542781
augucccgcuacacccgcccccccaacaccucccucuucauccgcaacgucgccgacgccacccgccccgaggaccuccgccgcgaguucggccgcuacggccccaucgucgacgucuacaucccccucgacuucuacacccgccgcccccgcggcuucgccuacguccaguucgaggacguccgcgacgccgaggacgcccucuacaaccucaaccgcaagugggucugcggccgccagaucgagauccaguucgcccagggcgaccgcaagacccccggccagaugaaguccaaggagcgccaccccugcucccccuccgaccaccgccgcucccgcucccccucccagcgccgcacccgcucccgcuccuccuccuggggccgcaaccgccgccgcuccgacucccucaaggagucccgccaccgccgcuucuccuacucccaguccaagucccgcuccaagucccucccccgccgcuccaccuccgcccgccagucccgcaccccccgccgcaacuucggcucccgcggccgcucccgcuccaagucccuccagaagcgcuccaaguccaucggcaagucccaguccuccuccccccagaagcagaccuccuccggcaccaagucccgcucccacggccgccacuccgacuccaucgcccgcucccccugcaagucccccaagggcuacaccaacuccgagaccaagguccagaccgccaagcacucccacuuccgcucccacucccgcucccgcuccuaccgccacaagaacuccugguga

SEQ ID NO: 50163 - RNA, 606 nt, Artificial Sequence
  derived and/or modified sequence opt2 from SRSF1__Homo_sapiens__NP_001071634
auguccggcggcggcgucauccgcggccccgccggcaacaacgacugccgcaucuacgucggcaaccucccccccgacauccgcaccaaggacaucgaggacgucuucuacaaguacggcgccauccgcgacaucgaccucaagaaccgccgcggcggcccccccuucgccuucgucgaguucgaggacccccgcgacgccgaggacgccgucuacggccgcgacggcuacgacuacgacggcuaccgccuccgcgucgaguucccccgcuccggccgcggcaccggccgcggcggcggcggcggcggcggcggcggcgccccccgcggccgcuacggcccccccucccgccgcuccgagaaccgcgucgucgucuccggccucccccccuccggcuccuggcaggaccucaaggaccacaugcgcgaggccggcgacgucugcuacgccgacgucuaccgcgacggcaccggcgucgucgaguucguccgcaaggaggacaugaccuacgccguccgcaagcucgacaacaccaaguuccgcucccacgaggucggcuacacccgcauccucuucuucgaccagaacuggauccagugguccuga

SEQ ID NO: 50164 - RNA, 666 nt, Artificial Sequence
  derived and/or modified sequence opt2 from SRSF2__Homo_sapiens__NP_001182356
auguccuacggccgccccccccccgacgucgagggcaugaccucccucaaggucgacaaccucaccuaccgcaccucccccgacacccuccgccgcgucuucgagaaguacggccgcgucggcgacgucuacaucccccgcgaccgcuacaccaaggagucccgcggcuucgccuucguccgcuuccacgacaagcgcgacgccgaggacgccauggacgccauggacggcgccguccucgacggccgcgagcuccgcguccagauggcccgcuacggccgcccccccgacucccaccacucccgccgcggcccccccccccgccgcuacggcggcggcggcuacggccgccgcucccgcuccccccgccgccgccgccgcucccgcucccgcucccgcucccgcucccgcucccgcucccgcucccgcuacucccgcuccaagucccgcucccgcacccgcucccgcucccgcuccaccuccaagucccgcuccgcccgccgcuccaaguccaaguccuccuccgucucccgcucccgcucccgcucccgcucccgcucccgcucccgcucccccccccccgucuccaagcgcgaguccaagucccgcucccgcuccaaguccccccccaagucccccgaggaggagggcgccgucuccuccuga

SEQ ID NO: 50165 - RNA, 495 nt, Artificial Sequence
  derived and/or modified sequence opt2 from SRSF3__Homo_sapiens__NP_003008
augcaccgcgacuccugcccccucgacugcaaggucuacgucggcaaccucggcaacaacggcaacaagaccgagcucgagcgcgccuucggcuacuacggcccccuccgcuccgucugggucgcccgcaacccccccggcuucgccuucgucgaguucgaggacccccgcgacgccgccgacgccguccgcgagcucgacggccgcacccucugcggcugccgcguccgcgucgagcucuccaacggcgagaagcgcucccgcaaccgcggccccccccccuccuggggccgccgcccccgcgacgacuaccgccgccgcuccccccccccccgccgccgcuccccccgccgccgcuccuucucccgcucccgcucccgcucccucucccgcgaccgccgccgcgagcgcucccucucccgcgagcgcaaccacaagcccucccgcuccuucucccgcucccgcucccgcucccgcuccaacgagcgcaaguga

SEQ ID NO: 50166 - RNA, 1395 nt, Artificial Sequence
  derived and/or modified sequence opt2 from SRSF4__Homo_sapiens__XP_011540253
augccccgcgucuacaucggccgccucuccuaccaggcccgcgagcgcgacgucgagcgcuucuucaagggcuacggcaagauccucgaggucgaccucaagaacggcuacggcuucgucgaguucgacgaccuccgcgacgccgacgacgccgucuacgagcucaacggcaaggaccucugcggcgagcgcgucaucgucgagcacgcccgcggcccccgccgcgacggcuccuacggcuccggccgcuccggcuacggcuaccgccgcuccggccgcgacaaguacggcccccccacccgcaccgaguaccgccucaucgucgagaaccucuccucccgcugcuccuggcaggaccucaaggacuacaugcgccaggccggcgaggucaccuacgccgacgcccacaagggccgcaagaacgagggcgucaucgaguucgucuccuacuccgacaugaagcgcgcccucgagaagcucgacggcaccgaggucaacggccgcaagauccgccucgucgaggacaagcccggcucccgccgccgccgcuccuacucccgcucccgcucccacucccgcuccggcucccgcucccgcuccaagucccgcucccgcucccagucccgcucccgcuccaagaaggagaagucccgcucccccuccaaggagaagucccgcucccgcucccacuccgccggcaagucccgcuccaaguccaaggaccaggccgaggagaagauccagaacaacgacaacgucggcaagcccaagucccgcucccccucccgccacaaguccaaguccaagucccgcucccgcucccaggagcgccgcgucgaggaggagaagcgcggcuccgucucccgcggccgcucccaggagaagucccuccgccagucccgcucccgcucccgcuccaagggcggcucccgcucccgcucccgcucccgcuccaaguccaaggacaagcgcaagggccgcaagcgcucccgcgaggagucccgcucccgcucccgcucccgcuccaaguccgagcgcucccgcaagcgcggcuccaagcgcgacuccaaggccggcuccuccaagaagaagaagaaggaggacaccgaccgcucccagucccgcucccccucccgcuccgucuccaaggagcgcgagcacgccaaguccgaguccucccagcgcgagggccgcggcgaguccgagaacgccggcaccaaccaggagacccgcucccgcucccgcuccaacuccaaguccaagcccaaccuccccuccgagucccgcucccgcuccaaguccgccuccaagacccgcucccgcuccaagucccgcucccgcuccgccucccgcucccccucccgcucccgcucccgcucccacucccgcuccuga

SEQ ID NO: 50167 - RNA, 819 nt, Artificial Sequence
  derived and/or modified sequence opt2 from SRSF5__Homo_sapiens__NP_001307143
auguccggcugccgcgucuucaucggccgccucaaccccgccgcccgcgagaaggacgucgagcgcuucuucaagggcuacggccgcauccgcgacaucgaccucaagcgcggcuucggcuucgucgaguucgaggacccccgcgacgccgacgacgccgucuacgagcucgacggcaaggagcucugcuccgagcgcgucaccaucgagcacgcccgcgcccgcucccgcggcggccgcggccgcggccgcuacuccgaccgcuucuccucccgccgcccccgcaacgaccgccgcaacgccccccccguccgcaccgagaaccgccucaucgucgagaaccucuccucccgcgucuccuggcaggaccucaaggacuucaugcgccaggccggcgaggucaccuucgccgacgcccaccgccccaagcucaacgagggcgucgucgaguucgccuccuacggcgaccucaagaacgccaucgagaagcucuccggcaaggagaucaacggccgcaagaucaagcucaucgagggcuccaagcgccacucccgcucccgcucccgcucccgcucccgcacccgcuccuccucccgcucccgcucccgcucccgcucccgcucccgcaaguccuacucccgcucccgcucccgcucccgcucccgcucccgcuccaagucccgcuccgucucccgcucccccguccccgagaagucccagaagcgcggcuccuccucccgcuccaagucccccgccuccgucgaccgccagcgcucccgcucccgcucccgcucccgcuccgucgacuccggcaacuga

SEQ ID NO: 50168 - RNA, 1035 nt, Artificial Sequence
  derived and/or modified sequence opt2 from SRSF6__Homo_sapiens__NP_006266
augccccgcgucuacaucggccgccucuccuacaacguccgcgagaaggacauccagcgcuucuucuccggcuacggccgccuccucgaggucgaccucaagaacggcuacggcuucgucgaguucgaggacucccgcgacgccgacgacgccgucuacgagcucaacggcaaggagcucugcggcgagcgcgucaucgucgagcacgcccgcggcccccgccgcgaccgcgacggcuacuccuacggcucccgcuccggcggcggcggcuacuccucccgccgcaccuccggccgcgacaaguacggcccccccguccgcaccgaguaccgccucaucgucgagaaccucuccucccgcugcuccuggcaggaccucaaggacuucaugcgccaggccggcgaggucaccuacgccgacgcccacaaggagcgcaccaacgagggcgucaucgaguuccgcuccuacuccgacaugaagcgcgcccucgacaagcucgacggcaccgagaucaacggccgcaacauccgccucaucgaggacaagccccgcaccucccaccgccgcuccuacuccggcucccgcucccgcucccgcucccgccgccgcucccgcucccgcucccgccgcuccucccgcucccgcucccgcuccaucuccaagucccgcucccgcucccgcucccgcuccaagggccgcucccgcucccgcuccaagggccgcaagucccgcuccaaguccaaguccaagcccaaguccgaccgcggcucccacucccacucccgcucccgcuccaaggacgaguacgagaagucccgcucccgcucccgcucccgcucccccaaggagaacggcaagggcgacaucaaguccaagucccgcucccgcucccagucccgcuccaacuccccccuccccgucccccccuccaaggcccgcuccgucucccccccccccaagcgcgccaccucccgcucccgcucccgcucccgcuccaagucccgcucccgcucccgcuccuccucccgcgacuga

SEQ ID NO: 50169 - RNA, 717 nt, Artificial Sequence
  derived and/or modified sequence opt2 from SRSF7__Homo_sapiens__NP_001026854
augucccgcuacggccgcuacggcggcgagaccaaggucuacgucggcaaccucggcaccggcgccggcaagggcgagcucgagcgcgccuucuccuacuacggcccccuccgcaccgucuggaucgcccgcaacccccccggcuucgccuucgucgaguucgaggacccccgcgacgccgaggacgccguccgcggccucgacggcaaggucaucugcggcucccgcguccgcgucgagcucuccaccggcaugccccgccgcucccgcuucgaccgcccccccgcccgccgccccuucgaccccaacgaccgcugcuacgagugcggcgagaagggccacuacgccuacgacugccaccgcuacucccgccgccgccgcucccgcucccgcucccgcucccacucccgcucccgcggccgccgcuacucccgcucccgcucccgcucccgcggccgccgcucccgcuccgccuccccccgccgcucccgcuccaucucccuccgccgcucccgcuccgccucccuccgccgcucccgcuccggcuccaucaagggcucccgcuacuuccagucccccucccgcucccgcucccgcucccgcuccaucucccgcccccgcuccucccgcuccaagucccgcucccccucccccaagcgcucccgcucccccuccggcuccccccgccgcuccgccucccccgagcgcauggacuga

SEQ ID NO: 50170 - RNA, 666 nt, Artificial Sequence
  derived and/or modified sequence opt2 from SRSF9__Homo_sapiens__NP_003760
auguccggcugggccgacgagcgcggcggcgagggcgacggccgcaucuacgucggcaaccuccccaccgacguccgcgagaaggaccucgaggaccucuucuacaaguacggccgcauccgcgagaucgagcucaagaaccgccacggccucguccccuucgccuucguccgcuucgaggacccccgcgacgccgaggacgccaucuacggccgcaacggcuacgacuacggccagugccgccuccgcgucgaguucccccgcaccuacggcggccgcggcggcuggccccgcggcggccgcaacggcccccccacccgccgcuccgacuuccgcguccucgucuccggccucccccccuccggcuccuggcaggaccucaaggaccacaugcgcgaggccggcgacgucugcuacgccgacguccagaaggacggcgucggcauggucgaguaccuccgcaaggaggacauggaguacgcccuccgcaagcucgacgacaccaaguuccgcucccacgagggcgagaccuccuacauccgcgucuaccccgagcgcuccaccuccuacggcuacucccgcucccgcuccggcucccgcggccgcgacucccccuaccagucccgcggcuccccccacuacuucucccccuuccgccccuacuga

SEQ ID NO: 50171 - RNA, 414 nt, Artificial Sequence
  derived and/or modified sequence opt2 from SRXN1__Homo_sapiens__NP_542763
augggccuccgcgccggcggcacccucggccgcgccggcgccggccgcggcgcccccgagggccccggccccuccggcggcgcccagggcggcuccauccacuccggccgcaucgccgccguccacaacgucccccucuccguccucauccgcccccuccccuccguccucgaccccgccaagguccagucccucgucgacaccauccgcgaggaccccgacuccgucccccccaucgacguccucuggaucaagggcgcccagggcggcgacuacuucuacuccuucggcggcugccaccgcuacgccgccuaccagcagcuccagcgcgagaccauccccgccaagcucguccaguccacccucuccgaccuccgcgucuaccucggcgccuccacccccgaccuccaguga

SEQ ID NO: 50172 - RNA, 615 nt, Artificial Sequence
  derived and/or modified sequence opt2 from SRY__Homo_sapiens__NP_003131
augcaguccuacgccuccgccaugcucuccgucuucaacuccgacgacuacucccccgccguccaggagaacauccccgcccuccgccgcuccuccuccuuccucugcaccgaguccugcaacuccaaguaccagugcgagaccggcgagaacuccaagggcaacguccaggaccgcgucaagcgccccaugaacgccuucaucgucuggucccgcgaccagcgccgcaagauggcccucgagaacccccgcaugcgcaacuccgagaucuccaagcagcucggcuaccaguggaagaugcucaccgaggccgagaaguggcccuucuuccaggaggcccagaagcuccaggccaugcaccgcgagaaguaccccaacuacaaguaccgcccccgccgcaaggccaagaugcuccccaagaacugcucccuccuccccgccgaccccgccuccguccucugcuccgagguccagcucgacaaccgccucuaccgcgacgacugcaccaaggccacccacucccgcauggagcaccagcucggccaccucccccccaucaacgccgccuccuccccccagcagcgcgaccgcuacucccacuggaccaagcucuga

SEQ ID NO: 50173 - RNA, 1257 nt, Artificial Sequence
  derived and/or modified sequence opt2 from SS18__Homo_sapiens__NP_001007560
auguccgucgccuucgccgccccccgccagcgcggcaagggcgagaucacccccgccgccauccagaagaugcucgacgacaacaaccaccucauccagugcaucauggacucccagaacaagggcaagaccuccgagugcucccaguaccagcagaugcuccacaccaaccucgucuaccucgccaccaucgccgacuccaaccagaacaugcagucccuccuccccgccccccccacccagaacaugcccaugggccccggcggcaugaaccaguccggcccccccccccccccccgcucccacaacaugcccuccgacggcauggucggcggcggcccccccgccccccacaugcagaaccagaugaacggccagaugcccggccccaaccacaugcccaugcagggccccggccccaaccagcucaacaugaccaacuccuccaugaacaugcccuccuccucccacggcuccaugggcggcuacaaccacuccguccccuccucccaguccaugcccguccagaaccagaugaccaugucccagggccagcccaugggcaacuacggcccccgccccaacauguccaugcagcccaaccagggccccaugaugcaccagcagccccccucccagcaguacaacaugccccagggcggcggccagcacuaccagggccagcagccccccaugggcaugaugggccaggucaaccagggcaaccacaugaugggccagcgccagaucccccccuaccgccccccccagcagggccccccccagcaguacuccggccaggaggacuacuacggcgaccaguacucccacggcggccagggcccccccgagggcaugaaccagcaguacuaccccgacggccacaacgacuacggcuaccagcagcccuccuaccccgagcagggcuacgaccgccccuacgaggacuccucccagcacuacuacgagggcggcaacucccaguacggccagcagcaggacgccuaccagggcccccccccccagcagggcuaccccccccagcagcagcaguaccccggccagcagggcuaccccggccagcagcagggcuacggccccucccagggcggccccggcccccaguaccccaacuacccccagggccagggccagcaguacggcggcuaccgccccacccagcccggccccccccagcccccccagcagcgccccuacggcuacgaccagggccaguacggcaacuaccagcaguga

SEQ ID NO: 50174 - RNA, 1191 nt, Artificial Sequence
  derived and/or modified sequence opt2 from SS18L1__Homo_sapiens__NP_945173
auguccgucgccuucgccuccgcccgcccccgcggcaagggcgaggucacccagcagaccauccagaagaugcucgacgagaaccaccaccucauccagugcauccucgaguaccaguccaagggcaagaccgccgagugcacccaguaccagcagauccuccaccgcaaccucgucuaccucgccaccaucgccgacuccaaccagaacaugcagucccuccuccccgccccccccacccagaacaugaaccucggccccggcgcccucacccaguccggcuccucccagggccuccacucccagggcucccucuccgacgccaucuccaccggccucccccccuccucccuccuccagggccagaucggcaacggccccucccacgucuccaugcagcagaccgcccccaacacccuccccaccaccuccauguccaucuccggccccggcuacucccacgccggccccgccucccagggcguccccaugcagggccagggcaccaucggcaacuacgucucccgcaccaacaucaacaugcaguccaaccccgucuccaugaugcagcagcaggccgccaccucccacuacuccuccgcccagggcggcucccagcacuaccagggccaguccuccaucgccaugaugggccagggcucccagggcuccuccaugaugggccagcgccccauggcccccuaccgccccucccagcagggcuccucccagcaguaccucggccaggaggaguacuacggcgagcaguacucccacucccagggcgccgccgagcccaugggccagcaguacuaccccgacggccacggcgacuacgccuaccagcaguccuccuacaccgagcaguccuacgaccgcuccuucgaggaguccacccagcacuacuacgagggcggcaacucccaguacucccagcagcaggccggcuaccagcagggcgccgcccagcagcagaccuacucccagcagcaguaccccucccagcaguccuaccccggccagcagcagggcuacggcuccgcccagggcgcccccucccaguaccccggcuaccagcagggccagggccagcaguacggcuccuaccgcgccccccagaccgcccccuccgcccagcagcagcgccccuacggcuacgagcagggccaguacggcaacuaccagcaguga

SEQ ID NO: 50175 - RNA, 1227 nt, Artificial Sequence
  derived and/or modified sequence opt2 from SSB__Homo_sapiens__NP_003133
auggccgagaacggcgacaacgagaagauggccgcccucgaggccaagaucugccaccagaucgaguacuacuucggcgacuucaaccucccccgcgacaaguuccucaaggagcagaucaagcucgacgagggcugggucccccucgagaucaugaucaaguucaaccgccucaaccgccucaccaccgacuucaacgucaucgucgaggcccucuccaaguccaaggccgagcucauggagaucuccgaggacaagaccaagauccgccgcucccccuccaagccccuccccgaggucaccgacgaguacaagaacgacgucaagaaccgcuccgucuacaucaagggcuuccccaccgacgccacccucgacgacaucaaggaguggcucgaggacaagggccagguccucaacauccagaugcgccgcacccuccacaaggccuucaagggcuccaucuucgucgucuucgacuccaucgaguccgccaagaaguucgucgagacccccggccagaaguacaaggagaccgaccuccucauccucuucaaggacgacuacuucgccaagaagaacgaggagcgcaagcagaacaaggucgaggccaagcuccgcgccaagcaggagcaggaggccaagcagaagcucgaggaggacgccgagaugaagucccucgaggagaagaucggcugccuccucaaguucuccggcgaccucgacgaccagaccugccgcgaggaccuccacauccucuucuccaaccacggcgagaucaaguggaucgacuucguccgcggcgccaaggagggcaucauccucuucaaggagaaggccaaggaggcccucggcaaggccaaggacgccaacaacggcaaccuccagcuccgcaacaaggaggucaccugggagguccucgagggcgaggucgagaaggaggcccucaagaagaucaucgaggaccagcaggagucccucaacaaguggaaguccaagggccgccgcuucaagggcaagggcaagggcaacaaggccgcccagcccggcuccggcaagggcaagguccaguuccagggcaagaagaccaaguucgccuccgacgacgagcacgacgagcacgacgagaacggcgccaccggccccgucaagcgcgcccgcgaggagaccgacaaggaggagcccgccuccaagcagcagaagaccgagaacggcgccggcgaccaguga

SEQ ID NO: 50176 - RNA, 447 nt, Artificial Sequence
  derived and/or modified sequence opt2 from SSBP1__Homo_sapiens__NP_001243442
auguuccgccgccccguccuccagguccuccgccaguucguccgccacgaguccgagaccaccaccucccucguccucgagcgcucccucaaccgcguccaccuccucggccgcgucggccaggaccccguccuccgccaggucgagggcaagaaccccgucaccaucuucucccucgccaccaacgagauguggcgcuccggcgacuccgaggucuaccagcucggcgacgucucccagaagaccaccuggcaccgcaucuccgucuuccgccccggccuccgcgacgucgccuaccaguacgucaagaagggcucccgcaucuaccucgagggcaagaucgacuacggcgaguacauggacaagaacaacguccgccgccaggccaccaccaucaucgccgacaacaucaucuuccucuccgaccagaccaaggagaaggaguga

SEQ ID NO: 50177 - RNA, 1026 nt, Artificial Sequence
  derived and/or modified sequence opt2 from SSBP2__Homo_sapiens__NP_001243662
auguacggcaagggcaaguccaacuccuccgccguccccuccgacucccaggcccgcgagaagcucgcccucuacgucuacgaguaccuccuccacgucggcgcccagaaguccgcccagaccuuccucuccgagauccgcugggagaagaacaucacccucggcgagccccccggcuuccuccacuccugguggugcgucuucugggaccucuacugcgccgcccccgagcgccgcgagaccugcgagcacuccuccgaggccaaggccuuccacgacuacuccgccgccgccgcccccucccccguccucggcaacaucccccccggcgacggcaugcccgucggccccgucccccccggcuucuuccaggcccucggcggcguccccggcucccagccccuccuccccuccggcauggaccccacccgccagcagggccaccccaacaugggcggccccaugcagcgcaugacccccccccgcggcauggucccccucggcccccagaacuacggcggcgccaugcgccccccccucaacgcccucggcggccccggcaugcccggcaugaacaugggccccggcggcggccgccccuggcccaaccccaccaacgccaacuccauccccuacuccuccgccucccccggcaacuacgucggcccccccggcggcggcggcccccccggcacccccaucaugcccucccccgccgacuccaccaacuccggcgacaacauguacacccucaugaacgccgucccccccggccccaaccgccccaacuuccccaugggccccggcuccgacggccccaugggcggccucggcggcauggagucccaccacaugaacggcucccucggcuccggcgacauggacuccaucuccaagaacucccccaacaacaugucccucuccaaccagcccggcaccccccgcgacgacggcgagaugggcggcaacuuccucaaccccuuccaguccgaguccuacucccccuccaugaccauguccgucuga

SEQ ID NO: 50178 - RNA, 3780 nt, Artificial Sequence
  derived and/or modified sequence opt2 from SSFA2__Homo_sapiens__NP_001123917
auggaccgcccccucuccuccuccgccgaggccgaggaggagcucgaguggcaggucgccucccgccgccgcaaggccugggccaagugccgcuccuccuggcaggccuccgagaccgaggaccucuccaccgaggccaccacccaggacgaggaggaggacgaggaggaggaccuccccggcgcccagcuccccgccgccggcggccgcggcaacguccccaacgagaagaucgccaucuggcucaaggacugccgcaccccccucggcgccucccucgacgagcaguccuccuccacccucaagggcguccucguccgcaacggcggcuccuucgaggacgaccucucccucggcgccgaggccaaccaccuccacgaguccgacgcccagaucgagaacugcaacaacauccucgccaaggagcgccgccuccaguuccaccagaagggccgcuccaugaacuccaccggcuccggcaaguccuccggcaccgucuccuccgucuccgagcuccucgagcucuacgaggaggaccccgaggagauccucuacaaccucggcuucggccgcgacgagcccgacaucgccuccaagauccccucccgcuucuucaacuccuccuccuucgccaagggcaucgacaucaaggucuuccucuccgcccagaugcagcgcauggaggucgagaaccccaacuacgcccucaccucccgcuuccgccagaucgagguccucaccaccgucgccaacgccuucuccucccucuacucccaggucuccggcaccccccuccagcgcaucggcuccauguccuccgucaccuccaacaaggagaccgaccccccccccccccucacccgcuccaacaccgccaaccgccucaugaagacccucuccaagcucaaccucugcgucgacaagaccgagaagggcgaguccuccucccccucccccuccgccgagaagggcaagauccucaacgucuccgucaucgaggaguccggcaacaagaacgaccagaagucccagaagaucaugaagaagaaggaguccuccuccaugcucgccaccgucaaggaggaggucuccggcuccuccgccgccgucaccgagaacgccgacuccgaccgcaucuccgacgaggccaacuccaacuucaaccagggcaccgagaacgagcaguccaaggagacccagucccacgaguccaagcucggcgaggaguccggcaucgucgaguccaagcucgacuccgacuucaacaucuccucccacuccgagcucgagaacuccuccgagcucaaguccguccacaucuccacccccgagaaggagcccugcgccccccucaccauccccuccauccgcaacaucaugacccagcagaaggacuccuucgagauggaggagguccaguccaccgagggcgaggccccccacguccccgccaccuaccagcucggccucaccaaguccaagcgcgaccaccuccuccgcaccgccucccagcacuccgacuccuccggcuucgccgaggacuccaccgacugccucucccucaaccaccuccagguccaggagucccuccaggccaugggcuccuccgccgacuccugcgacuccgagaccaccgucaccucccucggcgaggaccucgccacccccaccgcccaggaccagcccuacuucaacgaguccgaggaggagucccucgucccccuccagaagggccucgagaaggccgccgccgucgccgacaagcgcaaguccggcucccaggacuucccccagugcaacaccaucgagaacaccggcaccaagcaguccaccugcucccccggcgaccacaucaucgagaucaccgaggucgaggaggaccucuuccccgccgagaccgucgagcuccuccgcgaggccuccgccgaguccgacgucggcaaguccuccgaguccgaguucacccaguacaccacccaccacauccucaagucccucgccuccaucgaggccaagugcuccgacauguccuccgagaacaccaccggcccccccuccuccauggaccgcgucaacaccgcccuccagcgcgcccagaugaaggucugcucccucuccaaccagcgcaugggccgcucccuccucaaguccaaggaccuccucaagcagcgcuaccucuucgccaaggccggcuacccccuccgccgcucccagucccuccccaccacccuccucucccccguccgcgucgucuccuccgucaacguccgccucucccccggcaaggagacccgcugcuccccccccuccuucaccuacaaguacacccccgaggaggagcaggagcucgagaagcgcgucauggagcacgacggccagucccucgucaaguccaccaucuucaucucccccuccuccgucaagaaggaggaggccccccaguccgaggccccccgcgucgaggagugccaccacggccgcacccccaccugcucccgccucgcccccccccccaugucccaguccaccugcucccuccacuccauccacuccgaguggcaggagcgcccccucugcgagcacacccgcacccucuccacccacuccguccccaacaucuccggcgccaccugcuccgccuucgccucccccuucggcugccccuacucccaccgccacgccaccuaccccuaccgcgucugcuccgucaacccccccuccgccaucgagaugcagcuccgccgcguccuccacgacauccgcaacucccuccagaaccucucccaguaccccaugaugcgcggccccgaccccgccgccgcccccuacuccacccagaaguccuccguccucccccucuacgagaacaccuuccaggagcuccaggucaugcgccgcucccucaaccucuuccgcacccagaugauggaccucgagcucgccaugcuccgccagcagaccauggucuaccaccacaugaccgaggaggagcgcuucgaggucgaccagcuccagggccuccgcaacuccguccgcauggagcuccaggaccucgagcuccagcucgaggagcgccuccucggccucgaggagcagcuccgcgccguccgcaugcccucccccuuccgcuccuccgcccucaugggcaugugcggcucccgcuccgccgacaaccucuccugccccuccccccucaacgucauggagcccgucaccgagcucaugcaggagcaguccuaccucaaguccgagcucggccucggccucggcgagaugggcuucgagaucccccccggcgaguccuccgaguccgucuucucccaggccaccuccgaguccuccuccgucugcuccggccccucccacgccaaccgccgcaccggcguccccuccaccgccuccgucggcaaguccaagaccccccucgucgcccgcaagaaggucuuccgcgccuccgucgcccucacccccaccgcccccucccgcaccggcuccguccagaccccccccgaccucgaguccuccgaggaggucgacgccgccgagggcgcccccgaggucgucggccccaaguccgaggucgaggagggccacggcaagcuccccuccaugcccgccgccgaggagaugcacaagaacgucgagcaggacgagcuccagcaggucauccgcgagaucaaggaguccaucgucggcgagauccgccgcgagaucgucuccggccuccucgccgccgucuccuccuccaaggccuccaacuccaagcaggacuaccacuga

SEQ ID NO: 50179 - RNA, 2079 nt, Artificial Sequence
  derived and/or modified sequence opt2 from SSH1__Homo_sapiens__NP_001154802
auggcccucgucacccuccagcgcucccccacccccuccgccgccuccuccuccgccuccaacuccgagcucgaggccggcuccgaggaggaccgcaagcucaaccucucccucuccgaguccuucuucauggucaagggcgccgcccucuuccuccagcagggcuccuccccccagggccagcgcucccuccagcacccccacaagcacgccggcgaccucccccagcaccuccaggucaugaucaaccuccuccgcugcgaggaccgcaucaagcucgccguccgccucgaguccgccugggccgaccgcguccgcuacauggucgucgucuacuccuccggccgccaggacaccgaggagaacauccuccucggcgucgacuucuccuccaaggaguccaaguccugcaccaucggcaugguccuccgccucugguccgacaccaagauccaccucgacggcgacggcggcuucuccgucuccaccgccggccgcaugcacaucuucaagcccgucuccguccaggccaugugguccgcccuccagguccuccacaaggccugcgaggucgcccgccgccacaacuacuuccccggcggcgucgcccucaucugggccaccuacuacgaguccugcaucuccuccgagcaguccugcaucaacgaguggaacgccaugcaggaccucgaguccacccgccccgacucccccgcccucuucgucgacaagcccaccgagggcgagcgcaccgagcgccucaucaaggccaagcuccgcuccaucaugaugucccaggaccucgagaacgucaccuccaaggagauccgcaacgagcucgagaagcagaugaacugcaaccucaaggagcucaaggaguucaucgacaacgagaugcuccucauccucggccagauggacaagcccucccucaucuucgaccaccucuaccucggcuccgaguggaacgccuccaaccucgaggagcuccagggcuccggcgucgacuacauccucaacgucacccgcgagaucgacaacuucuuccccggccucuucgccuaccacaacauccgcgucuacgacgaggagaccaccgaccuccucgcccacuggaacgaggccuaccacuucaucaacaaggccaagcgcaaccacuccaagugccucguccacugcaagaugggcgucucccgcuccgccuccaccgucaucgccuacgccaugaaggaguucggcuggccccucgagaaggccuacaacuacgucaagcagaagcgcuccaucacccgccccaacgccggcuucaugcgccagcucuccgaguacgagggcauccucgacgccuccaagcagcgccacaacaagcucuggcgccagcagaccgacuccucccuccagcagcccgucgacgaccccgccggccccggcgacuuccuccccgagacccccgacggcacccccgagucccagcuccccuuccucgacgacgccgcccagcccggccucggccccccccuccccugcugcuuccgccgccucuccgacccccuccuccccucccccgaggacgagaccggcucccucguccaccucgaggaccccgagcgcgaggcccuccucgaggaggccgccccccccgccgagguccaccgccccgcccgccagccccagcagggcuccggccucugcgagaaggacgucaagaagaagcucgaguucggcucccccaagggccgcuccggcucccuccuccaggucgaggagaccgagcgcgaggagggccucggcgccggccgcuggggccagcuccccacccagcucgaccagaaccuccucaacuccgagaaccucaacaacaacuccaagcgcuccugccccaacggcauggaggucggccgcgcccgccccgccggcuggcacacccccucccuccccucccacuccaacuggcccaccuccgccuccgucgucggcaccaccggcacccgccaccacacccagcucaucuucuucuacugccuccucugggcccccuccucccaccuccagggccccgagggcuccuucaccggcuga

SEQ ID NO: 50180 - RNA, 4353 nt, Artificial Sequence
  derived and/or modified sequence opt2 from SSH2__Homo_sapiens__NP_001269058
auggcccucgucaccguccagcgcucccccacccccuccaccaccuccucccccugcgccuccuccucccaccucgaggacuccgaguccgccgcccuccucugcugcgagugcgaggaguccgagaucuucaccgacuccaacgaggccgacuccggcgaggaggagugccgcucccagccccgcuccaucuccgaguccuuccucaccgucaagggcgccgcccucuuccucccccgcggcaacggcuccuccaccccccgcaucucccaccgccgcaacaagcacgccggcgaccuccagcagcaccuccaggccauguucauccuccuccgccccgaggacaacauccgccucgccguccgccucgaguccaccuaccagaaccgcacccgcuacauggucgucgucuccaccaacggccgccaggacaccgaggaguccaucguccucggcauggacuucuccuccaacgacuccuccaccugcaccaugggccucguccucccccucugguccgacacccucauccaccucgacggcgacggcggcuucuccgucuccaccgacaaccgcguccacaucuucaagcccgucuccguccaggccaugugguccgcccuccagucccuccacaaggccugcgaggucgcccgcgcccacaacuacuaccccggcucccucuuccucaccugggucuccuacuacgagucccacaucaacuccgaccaguccuccgucaacgaguggaacgccaugcaggacguccagucccaccgccccgacucccccgcccucuucaccgacauccccaccgagcgcgagcgcaccgagcgccucaucaagaccaagcuccgcgagaucaugaugcagaaggaccucgagaacaucaccuccaaggagauccgcaccgagcucgagaugcagauggucugcaaccuccgcgaguucaaggaguucaucgacaacgagaugaucgucauccucggccagauggacucccccacccagaucuucgagcacgucuuccucggcuccgaguggaacgccuccaaccucgaggaccuccagaaccgcggcguccgcuacauccucaacgucacccgcgagaucgacaacuucuuccccggcgucuucgaguaccacaacauccgcgucuacgacgaggaggccaccgaccuccucgccuacuggaacgacaccuacaaguucaucuccaaggccaagaagcacggcuccaagugccucguccacugcaagaugggcgucucccgcuccgccuccaccgucaucgccuacgccaugaaggaguacggcuggaaccucgaccgcgccuacgacuacgucaaggagcgccgcaccgucaccaagcccaaccccuccuucaugcgccagcucgaggaguaccagggcauccuccucgccuccaagcagcgccacaacaagcucuggcgcucccacuccgacuccgaccucuccgaccaccacgagcccaucugcaagcccggccucgagcucaacaagaaggacaucaccaccuccgccgaccagaucgccgaggucaagaccauggagucccacccccccaucccccccgucuucgucgagcacauggucccccaggacgccaaccagaagggccucugcaccaaggagcgcaugaucugccucgaguucaccucccgcgaguuccacgccggccagaucgaggacgagcucaaccucaacgacaucaacggcugcuccuccggcugcugccucaacgaguccaaguucccccucgacaacugccacgccuccaaggcccucauccagcccggccacguccccgagauggccaacaaguuccccgaccucaccgucgaggaccucgagaccgacgcccucaaggccgacaugaacguccaccuccuccccauggaggagcucaccuccccccucaaggacccccccaugucccccgaccccgagucccccuccccccagcccuccugccagaccgagaucuccgacuucuccaccgaccgcaucgacuucuucuccgcccucgagaaguucgucgagcucucccaggagacccgcucccgcuccuucucccacucccgcauggaggagcucggcggcggccgcaacgaguccugccgccucuccgucgucgaggucgcccccuccaaggucaccgccgacgaccagcgcuccuccucccucuccaacaccccccacgccuccgaggaguccuccauggacgaggagcaguccaaggccaucuccgagcucgucucccccgacaucuucaugcagucccacuccgagaacgccaucuccgucaaggagaucgucaccgagaucgaguccaucucccagggcgucggccagauccagcucaagggcgacauccuccccaaccccugccacacccccaagaagaacuccauccacgagcuccuccucgagcgcgcccagacccccgagaacaagcccggccacauggagcaggacgaggacuccugcaccgcccagcccgagcucgccaaggacuccggcaugugcaaccccgagggcugccucaccacccacuccuccaucgccgaccucgaggagggcgagcccgccgagggcgagcaggagcuccagggcuccggcaugcaccccggcgccaagugguaccccggcuccguccgccgcgccacccucgaguucgaggagcgccuccgccaggagcaggagcaccacggcgccgcccccaccugcaccucccucuccacccgcaagaacuccaagaacgacuccuccgucgccgaccucgcccccaagggcaaguccgacgaggccccccccgagcacuccuucguccucaaggagcccgagauguccaagggcaagggcaaguacuccggcuccgaggccggcucccucucccacuccgagcagaacgccaccguccccgccccccgcguccucgaguucgaccaccuccccgacccccaggagggccccggcuccgacaccggcacccagcaggagggcguccucaaggaccuccgcaccgucauccccuaccaggaguccgagacccaggccgucccccucccccuccccaagcgcgucgagaucaucgaguacacccacaucgucaccucccccaaccacaccggccccggcuccgagaucgccaccuccgagaaguccggcgagcagggccuccgcaaggucaacauggagaaguccgucaccguccucugcacccucgacgagaaccucaaccgcacccucgaccccaaccaggucucccuccacccccagguccucccccucccccacuccuccucccccgagcacaaccgccccaccgaccaccccaccuccauccucuccucccccgaggaccgcggcuccucccucuccaccgcccucgagaccgccgcccccuucgucucccacaccacccaccuccucuccgccucccucgacuaccuccacccccagaccaugguccaccucgagggcuucaccgagcaguccuccaccaccgacgagcccuccgccgagcaggucuccugggaggagucccaggaguccccccucuccuccggcuccgagguccccuacaaggacucccagcucuccuccgccgaccucucccucaucuccaagcucggcgacaacaccggcgagcuccaggagaagauggacccccuccccgucgccugccgccucccccacuccuccuccuccgagaacaucaagucccucucccacucccccggcgucgucaaggagcgcgccaaggagaucgagucccgcgucgucuuccaggccggccucaccaagcccucccagaugcgccgcuccgccucccucgccaagcucggcuaccucgaccucugcaaggacugccuccccgagcgcgagcccgccuccugcgaguccccccaccucaagcuccuccagcccuuccuccgcaccgacuccggcaugcacgccauggaggaccaggagucccucgagaaccccggcgccccccacaaccccgagcccaccaaguccuucgucgagcagcucaccaccaccgagugcaucguccaguccaagcccgucgagcgcccccucguccaguacgccaaggaguucggcuccucccagcaguaccuccucccccgcgccggccucgagcucaccuccuccgagggcggccuccccguccuccagacccagggccuccagugcgccugccccgcccccggccucgccgucgccccccgccagcagcacggccgcacccacccccuccgccgccucaagaaggccaacgacaagaagcgcaccaccaaccccuucuacaacaccauguga

SEQ ID NO: 50181 - RNA, 735 nt, Artificial Sequence
  derived and/or modified sequence opt2 from SSMEM1__Homo_sapiens__NP_660311
augggcgaccucuucucccucuucugggaggucgaccccccccccauccccgucaacugcgccauccccaaccaggacuacgagugcuggaaggacgacuccugcggcaccaucggcuccuuccuccucugguacuucgucaucgucuucguccucauguucuucucccgcgccuccgucuggauguccgaggacaagaaggacgagggcuccggcaccuccaccuccguccgcaaggccuccaaggagaccuccugcaagcgccaguccaaggacuccgccugggaccccucccagaccaugaagaagcccaagcagaaccagcucacccccgucaccaacuccgaggucgcccucgucaacgccuaccccgagcagcgccgcgcccgccgccagucccaguucaacgaggucaaccagaaccagcacgacuccgacaccaccgaguacggcuccgaggaguccaacuccgaggccuccuccuggaaggaguccgaguccgagcaccaccccucccccgacuccaucaagcgccgcaagauggcccagcgccagcgcaaccucggcuccuaccagauguccgagcgccacugccuccacugcaaggcccuccgcaccaacgaguggcucgcccaccacucccgccagaagcccuccgucaccccccccaugaagcgcgacucccaggaggaguccuccaucuccgacaucaacaagaaguucuccaaguucuga

SEQ ID NO: 50182 - RNA, 360 nt, Artificial Sequence
  derived and/or modified sequence opt2 from SSNA1__Homo_sapiens__NP_003722
augacccagcagggcgccgcccuccagaacuacaacaacgagcucgucaagugcaucgaggagcucugccagaagcgcgaggagcucugccgccagauccaggaggaggaggacgagaagcagcgccuccagaacgagguccgccagcucaccgagaagcucgcccgcgucaacgagaaccucgcccgcaagaucgccucccgcaacgaguucgaccgcaccaucgccgagaccgaggccgccuaccucaagauccucgaguccucccagacccuccucuccguccucaagcgcgaggccggcaaccucaccaaggccaccgcccccgaccagaaguccuccggcggccgcgacuccuga

SEQ ID NO: 50183 - RNA, 732 nt, Artificial Sequence
  derived and/or modified sequence opt2 from SSPN__Homo_sapiens__NP_005077
augggcaagaacaagcagccccgcggccagcagcgccagggcggcccccccgccgccgacgccgccggccccgacgacauggagcccaagaagggcaccggcgcccccaaggagugcggcgaggaggagccccgcaccugcugcggcugccgcuucccccuccuccucgcccuccuccagcucgcccucggcaucgccgucaccgucgucggcuuccucauggccuccaucuccuccucccuccucguccgcgacacccccuucugggccggcaucaucgucugccucgucgccuaccucggccucuucaugcucugcgucuccuaccaggucgacgagcgcaccugcauccaguucuccaugaagcuccucuacuuccuccucuccgcccucggccucaccgucugcguccucgccgucgccuucgccgcccaccacuacucccagcucacccaguucaccugcgagaccacccucgacuccugccagugcaagcuccccuccuccgagccccucucccgcaccuucgucuaccgcgacgucaccgacugcaccuccgucaccggcaccuucaagcucuuccuccucauccagaugauccucaaccucgucugcggccucgucugccuccucgccugcuucgucauguggaagcaccgcuaccaggucuucuacgucggcguccgcaucugcucccucaccgccuccgagggcccccagcagaagaucuga

SEQ ID NO: 50184 - RNA, 15444 nt, Artificial Sequence
  derived and/or modified sequence opt2 from SSPO__Homo_sapiens__NP_940857
augcuccuccccgcccuccucuucggcauggccugggcccucgccgacggccgcuggugcgaguggaccgagaccauccgcgucgaggaggaggucgccccccgccaggaggaccucguccccugcgccucccucgaccacuacucccgccucggcuggcgccucgaccuccccugguccggccgcuccggccucacccgcucccccgcccccggccucugccccaucuacaagccccccgagacccgccccgccaaguggaaccgcaccguccgcaccugcugccccggcuggggcggcgcccacugcaccgaggcccucgccaaggccucccccgagggccacugcuucgccauguggcagugccagcuccaggccggcuccgccaacgccuccgccggcucccucgaggagugcugcgcccgccccuggggccaguccuggugggacggcuccucccaggccugccgcuccugcuccucccgccaccuccccggcuccgccuccucccccgcccuccuccagccccucgccggcgccgucggccagcucuggucccagcaccagcgccccuccgccaccugcgccuccugguccggcuuccacuaccgcaccuucgacggccgccacuaccacuuccucggccgcugcaccuaccuccucgccggcgccgccgacuccaccugggccguccaccucacccccggcgaccgcugcccccagcccggccacugccagcgcgucaccaugggccccgaggagguccucauccaggccggcaacgucuccgucaagggccagcucguccccgagggccaguccuggcuccuccacggccucucccuccaguggcucggcgacuggcucguccucuccggcggccucggcgucgucguccgccucgaccgcaccggcuccaucuccaucuccgucgaccacgagcucuggggccagacccagggccucugcggccucuacaacggcuggcccgaggacgacuucauggagcccggcggcggccucgccaugcucgccgccaccuucggcaacuccuggcgccuccccggcuccgaguccggcugccucgacgccgucgaggucgcccagggcugcgacccccucggccucaucgacgccgacgucgagcccggccaccuccgcgccgaggcccaggacgucugccaccagcuccucgagggccccuucggccagugccacgcccaggucucccccgccgaguaccacgaggccugccucuucgccuacugcgccggcgccauggccggcuccggccaggagggccgccagcaggccgucugcgccaccuucgccuccuacguccaggccugcgcccgccgccacauccacauccgcuggcgcaagcccggcuucugcgagcgccucugccccggcggccagcucuacuccgacugcgucucccucugcccccccuccugcgaggccgucggccagggcgaggaggaguccugccgcgaggagugcgucuccggcugcgagugcccccgcggccucuucuggaacggcacccucugcguccccgccgcccacugccccugcuacuacugccgccagcgcuacguccccggcgacaccguccgccagcucugcaaccccugcgucugccgcgacggccgcuggcacugcgcccaggcccucugccccgccgagugcgccgucggcggcgacggccacuaccucaccuucgacggccgcuccuacuccuucuggggcggccagggcugccgcuacucccucguccaggacuacgucaagggccagcuccucauccuccucgagcacggcgccugcgacgccggcuccugccuccacgccaucuccgucucccucgaggacacccacauccagcuccgcgacuccggcgccguccucgucaacggccaggacgucggccuccccuggaucggcgccgagggccucuccguccgccgcgccuccuccgccuuccuccuccuccgcuggcccggcgcccagguccucuggggccucuccgaccccgucgccuacaucacccucgacccccgccacgcccaccagguccagggccucugcggcaccuucacccagaaccagcaggacgacuuccucacccccgccggcgacgucgagaccuccaucgccgccuucgccuccaaguuccaggucgccggcaagggccgcugccccuccgaggacuccgcccuccucucccccugcaccacccacucccagcgccacgccuucgccgaggccgccugcgccauccuccacuccuccgucuuccaggagugccaccgccucgucgacaaggagcccuucuaccuccgcugccucgccgccgucugcggcugcgaccccggcuccgacugccucugccccguccucuccgccuacgcccgccgcugcgcccaggagggcgccuccccccccuggcgcaaccagacccucugccccgucaugugccccggcggccaggaguaccgcgagugcgcccccgccugcggccagcacugcggcaagcccgaggacugcggcgagcucggcuccugcgucgccggcugcaacugcccccucggccuccucugggaccccgagggccagugcgucccccccucccucugccccugccagcucggcgcccgccgcuacgcccccggcuccgccaccaugaaggagugcaaccgcugcaucugccaggagcgcggccucuggaacugcaccgcccgccacugccccucccaggccuucugcccccgcgagcucgucuacgcccccggcgccugccuccucaccugcgacucccccuccgccaaccacuccugccccgccggcuccaccgacggcugcgucugcccccccggcaccguccuccucgacgagcgcugcgucccccccgaccucugccccugccgccacuccggccagugguaccuccccaacgccaccauccaggaggacugcaacgucugcgucugccgcggccgccaguggcacugcaccggccagcgccgcuccggccgcugccaggccuccggcgccccccacuacgucaccuucgacggccucgccuucaccuaccccggcgccugcgaguaccuccucguccgcgaggccuccggccucuucaccgucuccgcccagaaccuccccugcggcgccuccggccucaccugcaccaaggcccucgccguccgccucgagggcaccgucguccacaugcuccgcggccgcgccgucaccgucaacggcgucuccgucaccccccccaaggucuacaccggccccggccucucccuccgccgcgccggccucuuccuccuccucuccacccaccucggccucacccuccucugggacggcggcacccgcguccucguccagcucuccccccaguuccgcggccgcgucgccggccucugcggcgacuucgacggcgacgccuccaacgaccuccgcucccgccagggcguccucgagcccaccgccgagcucgccgcccacuccuggcgccucuccccccucugccccgagcccggcgaccucccccaccccugcaccaugaacacccaccgcgccggcugggcccgcgcccgcugcggcgcccuccuccagccccucuucacccucugccacgccgagguccccccccagcagcacuacgaguggugccucuacgacgccugcggcugcgacuccggcggcgacugcgagugccucugcuccgccaucgccaccuacgccgacgagugcgcccgccacggccaccacguccgcuggcgcucccaggagcucugcucccuccagugcgagggcggccaggucuacgaggccugcggccccaccugcccccccaccugccacgagcagcaccccgagcccggcuggcacugccaggucgucgccugcgucgagggcugcuucugccccgagggcacccuccuccacggcggcgccugccucgagcccgccuccugccccugcgaguggggccgcaacuccuucccccccggcuccguccuccagaaggacugcggcaacugcaccugccaggagggccaguggcacugcggcggcgacggcggccacugcgaggagcucguccccgccugcgccgagggcgaggcccucugccaggagaacggccacugcgucccccacggcuggcucugcgacaaccaggacgacugcggcgacggcuccgacgaggagggcugcgccgcccccggcugcggcgagggccagaugaccugcuccuccggccacugccucccccucgcccuccucugcgaccgccaggacgacugcggcgacggcaccgacgagcccuccuaccccugcccccagggccuccucgccugcgccgacggccgcugccucccccccgcccuccucugcgacggccaccccgacugccucgacgccgccgacgaggaguccugccucggccaggucaccugcguccccggcgaggucuccugcgucgacggcaccugccucggcgccauccagcucugcgacggcgucugggacugccccgacggcgccgacgagggccccggccacugcccccuccccucccuccccaccccccccgccuccacccuccccggccccucccccggcucccucgacaccgccuccuccccccucgccuccgccucccccgccccccccugcggccccuucgaguuccgcugcggcuccggcgagugcaccccccgcggcuggcgcugcgaccaggaggaggacugcgccgacggcuccgacgagcgcggcugcggcggccccugcgccccccaccacgcccccugcgcccgcggcccccacugcgucucccccgagcagcucugcgacggcguccgccagugccccgacggcuccgacgagggccccgacgccugcggcggccuccccgcccucggcggccccaaccgcaccggccuccccugccccgaguacaccugccccaacggcaccugcaucggcuuccagcucgucugcgacggccagcccgacugcggccgccccggccaggucggccccucccccgaggagcagggcugcggcgccuggggccccuggucccccuggggccccugcucccgcaccugcggccccuggggccagggccgcucccgccgcugcuccccccucggccuccucguccuccagaacugccccggccccgagcaccagucccaggccugcuucaccgccgccugccccgucgacggcgagugguccaccuggucccccugguccgucugcuccgagcccugccgcggcaccaugacccgccagcgccagugccacuccccccagaacggcggccgcaccugcgccgcccuccccggcggccuccacuccacccgccagaccaagcccugcccccaggacggcugccccaacgccaccugcuccggcgagcucauguuccagcccugcgcccccugcccccucaccugcgacgacaucuccggccaggucaccugcccccccgacuggcccugcggcucccccggcugcuggugccccgagggccagguccucggcuccgagggcuggugcgucuggccccgccagugccccugccucgucgacggcgcccgcuacuggcccggccagcgcaucaaggccgacugccagcucugcaucugccaggacggccgcccccgccgcugccgccucaaccccgacugcgccgucgacugcggcugguccuccuggucccccugggccaagugccucggccccugcggcucccaguccauccagugguccuuccgcuccuccaacaacccccgccccuccggccgcggccgccagugccgcggcauccaccgcaaggcccgccgcugccagaccgagcccugcgagggcugcgagcaccagggccagguccaccgcgucggcgagcgcuggcacggcggccccugccgcgucugccagugccuccacaaccucaccgcccacugcucccccuacugcccccucggcuccugcccccagggcuggguccucgucgagggcaccggcgaguccugcugccacugcgcccuccccggcgagaaccagaccguccagcccauggccacccccgccgccgcccccgcccccuccccccagauccgcuucccccucgccaccuacauccucccccccuccggcgaccccugcuacuccccccucggccucgccggccucgccgagggcucccuccacgccuccucccagcagcucgagcaccccacccaggccgcccuccucggcgcccccacccagggccccuccccccagggcuggcacgccggcggcgacgccuacgccaaguggcacacccgcccccacuaccuccagcucgaccuccuccagccccgcaaccucaccggcauccucguccccgagaccggcuccuccaacgccuacgccuccuccuucucccuccaguucuccuccaacggccuccacuggcacgacuaccgcgaccuccuccccggcauccucccccuccccaagcucuucccccgcaacugggacgaccucgaccccgccgucuggaccuucggccgcaugguccaggcccgcuucguccgcgucuggccccacgacguccaccacuccgacgucccccuccaggucgagcuccucggcugcgagcccggcuccccccccgccccccucugccccggcgucggccuccgcugcgccuccggcgagugcguccuccgcggcggccccugcgacggcguccucgacugcgaggacggcuccgacgaggagggcugcguccuccuccccgagggcaccggccgcuuccacuccaccgccaagacccucgcccucuccuccgcccagcccggccagcuccuccacuggccccgcgagggccucgccgagaccgagcacuggccccccggccaggagucccccaccucccccaccgagacccgccccgucucccccggccccgccuccggcgucccccaccacggcgaguccguccagauggucaccaccacccccaucccccagauggaggcccgcacccucccccccggcauggccgccgucaccgucguccccccccaccccgucacccccgccacccccgccggccaguccgucgcccccggccccuucccccccguccagugcggccccggccagacccccugcgagguccucggcugcgucgagcaggcccaggucugcgacggccgcgaggacugccucgacggcuccgacgagcgccacugcgcccgcaaccuccucauguggcuccccucccuccccgcccucugggccgccuccaccguccccuucaugaugcccaccauggcccuccccggccuccccgccucccgcgcccucugcucccccucccagcucuccugcggcuccggcgagugccucuccgccgagcgccgcugcgaccuccgccccgacugccaggacggcuccgacgaggacggcugcgucgacugcguccucgcccccugguccgucugguccuccugcucccgcuccugcggccucggccucaccuuccagcgccaggagcuccuccgccccccccuccccggcggcuccugcccccgcgaccgcuuccgcucccaguccugcuucguccaggccugccccgucgccggcgccugggccaugugggaggccuggggccccugcuccgucuccugcggcggcggccaccagucccgccagcgcuccugcgucgaccccccccccaagaacggcggcgcccccugccccggcgccucccaggagcgcgcccccugcggccuccagcccugcuccggcggcaccgacugcgagcucggccgcgucuacgucuccgccgaccucugccagaagggccucgucccccccugcccccccuccugccucgaccccaaggccaaccgcuccugcuccggccacugcgucgagggcugccgcugcccccccggccuccuccuccacgacacccgcugccucccccucuccgagugccccugccucgucggcgaggagcucaaguggcccggcgucuccuuccuccucggcaacugcucccagugcgucugcgagaagggcgagcuccucugccagcccggcggcugcccccuccccugcggcugguccgccugguccuccugggcccccugcgaccgcuccugcggcuccggcguccgcgcccgcuuccgcucccccuccaacccccccgccgccuggggcggcgcccccugcgagggcgaccgccaggagcuccagggcugccacaccgucugcggcaccgaggucuucggcuggacccccuggaccuccugguccuccugcucccaguccugccucgcccccggcggcggccccggcuggcgcucccgcucccgccucugccccucccccggcgacuccuccugccccggcgacgccacccaggaggagcccugcuccccccccgucugccccguccccuccaucuggggccucugggcccccugguccaccugcuccgcccccugcgacggcggcauccagacccgcggccgcuccugcuccucccucgcccccggcgacaccaccugccccggcccccacucccagacccgcgacugcaacacccagcccugcaccgcccagugccccgagaacaugcucuuccgcuccgccgagcagugccaccaggagggcggccccugcccccgccucugccucacccagggccccggcaucgagugcaccggcuucugcgcccccggcugcaccugcccccccggccucuuccuccacaacgccuccugccucccccgcucccagugccccugccagcuccacggccagcucuacgccuccggcgccauggcccgccucgacuccugcaacaacugcaccugcgucuccggcaagauggccugcaccuccgagcgcugccccgucgccugcggcuggucccccuggacccucuggucccucugcuccugcuccugcaacgucggcauccgccgccgcuuccgcgccggcaccgccccccccgccgccuucggcggcgccgagugccagggccccaccauggaggccgaguucugcucccuccgccccugccccggccccggcggcgaguggggccccuggucccccugcuccguccccugcggcggcggcuaccgcaaccgcacccgcggcuccucccgcucccucauggaguucuccaccugcggccuccagcccugcgccggccccguccccggcaugugcccccgcgacaagcaguggcucgacugcgcccagggccccgccuccugcgccgagcucuccgccccccgcggcaccaaccagaccugccaccccggcugccacugccccuccggcaugcuccuccucaacaacgucugcguccccacccaggacugccccugcgcccacgagggccaccucuacccccccggcuccaccgucguccgccccugcgagaacugcuccugcgucuccggccucaucgccaacugcuccuccuggcccugcgccgagggcgagcccaccuggucccccuggacccccuggucccagugcuccgccuccugcggccccgcccgcugccaccgccaccgcuucugcgcccgcucccccuccgccguccccuccaccgucgccccccucccccuccccgccacccccaccccccucugcuccggccccgaggccgaggaggagcccugccuccuccagggcugcgaccgcgccggcggcuggggccccuggggccccuggucccacugcucccgcuccugcggcggcggccuccgcucccgcacccgcgccugcgaccagccccccccccagggccucggcgacuacugcgagggcccccgcgcccagggcgaggucugccaggcccuccccugccccgucaccaacugcaccgccaucgagggcgccgaguacucccccugcggcccccccugcccccgcuccugcgacgaccucguccacugcgucuggcgcugccagcccggcugcuacugcccccccggccagguccucuccuccaacggcgccaucugcguccagcccggccacugcuccugccucgaccuccucaccggccagcgccaccaccccggcgcccgccucgcccgccccgacggcugcaaccacugcaccugccucgagggccgccucaacugcaccgaccuccccugccccguccccggcggcuggugccccugguccgaguggaccaugugcucccagcccugccgcggccagacccgcucccgcucccgcgccugcgccugccccaccccccagcacggcggcgcccccugcaccggcgaggccggcgaggccggcgcccagcaccagcgcgaggccugccccuccuacgccaccugccccgucgacggcgccuggggccccuggggccccuggucccccugcgacaugugccucggccagucccaccgcucccgcgccugcucccgcccccccacccccgagggcggccgccccugccccggcaaccacacccagucccgccccugccaggagaacuccacccagugcaccgacugcggcggcggccagucccuccaccccugcggccagcccugcccccgcuccugccaggaccucucccccggcuccgucugccagcccggcuccgucggcugccagcccaccugcggcugcccccucggccagcucucccaggacggccucugcgucccccccgcccacugccgcugccaguaccagcccggcgccaugggcauccccgagaaccagucccgcuccgccggcucccgcuucuccuccugggagucccucgagcccggcgaggucgucaccggccccugcgacaacugcaccugcgucgccggcauccuccagugccaggagguccccgacugccccgaccccggcgucugguccuccuggggccccugggaggacugcuccgucuccugcggcggcggcgagcagcuccgcucccgccgcugcgcccgcccccccugccccggccccgcccgccagucccgcaccugcuccacccaggucugccgcgaggccggcugccccgccggccgccucuaccgcgagugccagcccggcgagggcugccccuucuccugcgcccacgucacccagcaggucggcugcuucuccgagggcugcgaggagggcugccacugccccgagggcaccuuccagcaccgccucgccugcguccaggagugccccugcguccucaccgccuggcuccuccaggagcucggcgccaccaucggcgaccccggccagccccucggccccggcgacgagcucgacuccggccagacccuccgcaccuccugcggcaacugcuccugcgcccacggcaagcucuccugcucccucgacgacugcuucgaggccgacggcggcuucggccccuggucccccuggggccccugcucccgcuccugcggcggccucggcacccgcacccgcucccgccagugcguccucaccaugcccacccucuccggccagggcugccgcggcccccgccaggaccucgagugccccucccccgacugccccggcgccgagggcuccaccgucgagcccgucaccggccuccccggcggcuggggccccugguccuccuggucccccugcucccgcuccugcaccgaccccgcccgccccgccuggcgcucccgcacccgccucugccucgccaacugcaccaugggcgacccccuccaggagcgccccugcaaccuccccuccugcaccgagcuccccgucugccccggccccggcugcggcgccggcaacugcuccuggaccuccugggcccccugggagcccugcucccgcuccugcggcgucggccagcagcgccgccuccgcgccuaccgcccccccggccccggcggccacuggugccccaacauccucaccgccuaccaggagcgccgcuucugcaaccuccgcgccugccccguccccggcggcuggucccgcuggucccccugguccuggugcgaccgcuccugcggcggcggccagucccuccgcucccgcuccugcuccuccccccccuccaagaacggcggcgcccccugcgccggcgagcgccaccaggcccgccucugcaaccccaugcccugcgaggccggcugccccgccggcauggaggucgucaccugcgccaaccgcugcccccgccgcugcuccgaccuccaggagggcaucgucugccaggacgaccaggucugccagaagggcugccgcugccccaagggcucccucgagcaggacggcggcugcguccccaucggccacugcgacugcaccgacgcccagggccacuccugggcccccggcucccagcaccaggacgccugcaacaacugcuccugccaggccggccagcucuccugcaccgcccagcccugccccccccccacccacugcgccuggucccacugguccgccuggucccccugcucccacuccugcggcccccgcggccagcagucccgcuuccgcuccuccaccuccggcuccugggcccccgagugccgcgaggagcagucccagucccagcccugcccccagcccuccugccccccccucugccuccagggcacccgcucccgcacccucggcgacuccuggcuccagggcgagugccagcgcugcuccugcacccccgagggcgucaucugcgaggacaccgagugcgccguccccgaggccuggacccucugguccuccugguccgacugccccgucuccugcggcggcggcaaccagguccgcacccgcgccugccgcgccgccgccccccaccaccgcuccccccccugccucggccccgacacccagacccgccagcagcccugccccggccuccucgaggccugcuccuggggccccuggggccccugcucccgcuccugcggccccggccucgccucccgcuccggcuccugccccugccucauggccaaggccgaccccaccugcaacuccaccuuccuccaccucgacacccagggcugcuacuccggccccugccccgaggagugcgucugguccuccugguccuccuggacccgcugcuccugccgcguccucguccagcagcgcuaccgccaccagggccccgccucccgcggcgcccgcgccggcgcccccugcacccgccucgacggccacuuccgccccugccucaucuccaacugcuccgaggacuccugcaccccccccuucgaguuccacgccugcggcucccccugcgccggccucugcgccacccaccucucccaccagcucugccaggaccucccccccugccagcccggcugcuacugccccaagggccuccucgagcaggccggcggcugcaucccccccgaggagugcaacugcuggcacaccuccgccgccggcgccggcaugacccucgcccccggcgaccgccuccagcucggcugcaaggagugcgagugccgccgcggcgagcuccacugcaccucccagggcugccagggccuccucccccucuccgagugguccgaguggucccccugcggccccugccucccccccuccgcccucgcccccgccucccgcaccgcccucgaggagcacuggcuccgcgaccccaccggccucucccccacccucgccccccuccucgccuccgagcagcaccgccaccgccucugccucgaccccgccaccggccgccccuggaccggcgccccccaccucugcaccgccccccucucccagcagcgccucugccccgaccccggcgccugccccgacuccugccaguggucccucuggggccccuggucccccugccagguccccugcuccggcggcuuccgccuccgcuggcgcgaggccgaggcccucugcggcggcggcugccgcgagcccugggcccaggaguccugcaacggcggccccugccccgagugcgaggcccaggacaccgucuucacccucgacugcgccaaccagugcccccacuccugcgccgaccucugggaccgcguccagugccuccagggccccugccgccccggcugccgcugcccccccggccagcucguccaggacggccgcugcguccccaucuccuccugccgcugcggccuccccuccgccaacgccuccugggagcucgcccccgcccaggccguccagcucgacugccagaacugcaccugcgucaacgagucccucgucugcccccaccaggagugccccguccucggccccugguccgccugguccuccugcuccgcccccugcggcggcggcaccauggagcgccaccgcaccugcgagggcggccccggcgucgcccccugccaggcccaggacaccgagcagcgccaggagugcaaccuccagcccugccccgagugcccccccggccagguccucuccgccugcgccaccuccugccccugccucugcuggcaccuccagcccggcgccaucugcguccaggagcccugccagcccggcugcggcugccccggcggccagcuccuccacaacggcaccugcgucccccccaccgccugccccugcacccagcacucccuccccuggggccucacccucacccucgaggagcaggcccaggagcucccccccggcaccguccucacccgcaacugcacccgcugcgucugccacggcggcgccuucuccugcucccucgucgacugccaggucccccccggcgagaccuggcagcaggucgcccccggcgagcucggccucugcgagcagaccugccucgagaugaacgccaccaagacccaguccaacugcuccuccgcccgcgccuccggcugcgucugccagcccggccacuuccgcucccaggccggccccugcguccccgaggaccacugcgagugcuggcaccucggccgcccccaccuccccggcuccgaguggcaggaggccugcgaguccugccucugccucuccggccgccccgucugcacccagcacugcuccccccucaccugcgcccagggcgaggagaugguccucgagcccggcuccugcugccccuccugccgccgcgaggcccccgaggagcagucccccuccugccagcuccucaccgagcuccgcaacuucaccaagggcaccugcuaccucgaccaggucgaggucuccuacugcuccggcuacugccccuccuccacccacgucaugcccgaggagcccuaccuccagucccagugcgacugcugcuccuaccgccucgaccccgagucccccguccgcauccucaaccuccgcugccucggcggccacaccgagcccgucguccuccccgucauccacuccugccagugcuccuccugccagggcggcgacuucuccaagcgcuga

SEQ ID NO: 50185 - RNA, 861 nt, Artificial Sequence
  derived and/or modified sequence opt2 from SSR1__Homo_sapiens__NP_003135
augcgccuccucccccgccuccuccuccuccuccuccucgucuuccccgccaccguccucuuccgcggcggcccccgcggccuccucgccgucgcccaggaccucaccgaggacgaggagaccgucgaggacuccaucaucgaggacgaggacgacgaggccgaggucgaggaggacgagcccaccgaccucgucgaggacaaggaggaggaggacgucuccggcgagcccgaggccucccccuccgccgacaccaccauccucuucgucaagggcgaggacuuccccgccaacaacaucgucaaguuccucgucggcuucaccaacaagggcaccgaggacuucaucgucgagucccucgacgccuccuuccgcuacccccaggacuaccaguucuacauccagaacuucaccgcccucccccucaacaccgucguccccccccagcgccaggccaccuucgaguacuccuucauccccgccgagcccaugggcggccgccccuucggccucgucaucaaccucaacuacaaggaccucaacggcaacgucuuccaggacgccgucuucaaccagaccgucaccgucaucgagcgcgaggacggccucgacggcgagaccaucuucauguacauguuccucgccggccucggccuccucgucaucgucggccuccaccagcuccucgagucccgcaagcgcaagcgccccauccagaaggucgagaugggcaccuccucccagaacgacgucgacauguccuggaucccccaggagacccucaaccagaucaacaaggccuccccccgccgccucccccgcaagcgcgcccagaagcgcuccgucggcuccgacgaguga

SEQ ID NO: 50186 - RNA, 609 nt, Artificial Sequence
  derived and/or modified sequence opt2 from SSR2__Homo_sapiens__XP_011508225
augcucacccucuccuccugccucugcggcuccggcaaggccuucggcaugcccaccaugcgccuccucuccuucgucguccucgcccucuucgccgucacccaggccgaggagggcgcccgccuccucgccuccaagucccuccucaaccgcuacgccgucgagggccgcgaccucacccuccaguacaacaucuacaacgucggcuccuccgccgcccucgacgucgagcucuccgacgacuccuucccccccgaggacuucggcaucgucuccggcaugcucaacgucaagugggaccgcaucgcccccgccuccaacgucucccacaccgucguccuccgcccccucaaggccggcuacuucaacuucaccuccgccaccaucaccuaccucgcccaggaggacggccccgucgucaucggcuccaccuccgcccccggccagggcggcauccucgcccagcgcgaguucgaccgccgcuucuccccccacuuccucgacugggccgccuucggcgucaugacccuccccuccaucggcaucccccuccuccucugguacuccuccaagcgcaaguacgacacccccaagaccaagaagaacuga

SEQ ID NO: 50187 - RNA, 2130 nt, Artificial Sequence
  derived and/or modified sequence opt2 from SSRP1__Homo_sapiens__NP_003137
auggccgagacccucgaguucaacgacgucuaccaggaggucaagggcuccaugaacgacggccgccuccgccucucccgccagggcaucaucuucaagaacuccaagaccggcaaggucgacaacauccaggccggcgagcucaccgagggcaucuggcgccgcgucgcccucggccacggccucaagcuccucaccaagaacggccacgucuacaaguacgacggcuuccgcgaguccgaguucgagaagcucuccgacuucuucaagacccacuaccgccucgagcucauggagaaggaccucugcgucaagggcuggaacuggggcaccgucaaguucggcggccagcuccucuccuucgacaucggcgaccagcccgucuucgagaucccccucuccaacgucucccagugcaccaccggcaagaacgaggucacccucgaguuccaccagaacgacgacgccgaggucucccucauggagguccgcuucuacgucccccccacccaggaggacggcgucgaccccgucgaggccuucgcccagaacguccucuccaaggccgacgucauccaggccaccggcgacgccaucugcaucuuccgcgagcuccagugccucaccccccgcggccgcuacgacauccgcaucuaccccaccuuccuccaccuccacggcaagaccuucgacuacaagauccccuacaccaccguccuccgccucuuccuccucccccacaaggaccagcgccagauguucuucgucaucucccucgacccccccaucaagcagggccagacccgcuaccacuuccucauccuccucuucuccaaggacgaggacaucucccucacccucaacaugaacgaggaggaggucgagaagcgcuucgagggccgccucaccaagaacauguccggcucccucuacgagauggucucccgcgucaugaaggcccucgucaaccgcaagaucaccguccccggcaacuuccagggccacuccggcgcccagugcaucaccugcuccuacaaggccuccuccggccuccucuacccccucgagcgcggcuucaucuacguccacaagccccccguccacauccgcuucgacgagaucuccuucgucaacuucgcccgcggcaccaccaccacccgcuccuucgacuucgagaucgagaccaagcagggcacccaguacaccuucuccuccaucgagcgcgaggaguacggcaagcucuucgacuucgucaacgccaagaagcucaacaucaagaaccgcggccucaaggagggcaugaaccccuccuacgacgaguacgccgacuccgacgaggaccagcacgacgccuaccucgagcgcaugaaggaggagggcaagauccgcgaggagaacgccaacgacuccuccgacgacuccggcgaggagaccgacgaguccuucaaccccggcgaggaggaggaggacgucgccgaggaguucgacuccaacgccuccgccuccuccuccuccaacgagggcgacuccgaccgcgacgagaagaagcgcaagcagcucaagaaggccaagauggccaaggaccgcaagucccgcaagaagcccgucgaggucaagaagggcaaggaccccaacgcccccaagcgccccauguccgccuacaugcucuggcucaacgccucccgcgagaagaucaaguccgaccaccccggcaucuccaucaccgaccucuccaagaaggccggcgagaucuggaagggcauguccaaggagaagaaggaggagugggaccgcaaggccgaggacgcccgccgcgacuacgagaaggccaugaaggaguacgagggcggccgcggcgaguccuccaagcgcgacaaguccaagaagaagaagaaggucaaggucaagauggagaagaaguccacccccucccgcggcuccuccuccaaguccuccucccgccagcucuccgaguccuucaaguccaaggaguucgucuccuccgacgaguccuccuccggcgagaacaaguccaagaagaagcgccgccgcuccgaggacuccgaggaggaggagcucgccuccaccccccccuccuccgaggacuccgccuccggcuccgacgaguga

SEQ ID NO: 50188 - RNA, 600 nt, Artificial Sequence
  derived and/or modified sequence opt2 from SSSCA1__Homo_sapiens__NP_006387
auggcccucaacggcgccgaggucgacgacuucuccugggagccccccaccgaggccgagaccaagguccuccaggcccgccgcgagcgccaggaccgcaucucccgccucaugggcgacuaccuccuccgcggcuaccgcaugcucggcgagaccugcgccgacugcggcaccauccuccuccaggacaagcagcgcaagaucuacugcgucgccugccaggagcucgacuccgacgucgacaaggacaaccccgcccucaacgcccaggccgcccucucccaggcccgcgagcaccagcucgccuccgccuccgagcucccccucggcucccgccccgccccccagccccccgucccccgccccgagcacugcgagggcgccgccgccggccucaaggccgcccagggcccccccgcccccgccgucccccccaacaccgacgucauggccugcacccagaccgcccuccuccagaagcucaccugggccuccgccgagcucggcuccuccaccucccucgagaccuccauccagcucugcggccucauccgcgccugcgccgaggcccuccgcucccuccagcagcuccagcacuga

SEQ ID NO: 50189 - RNA, 351 nt, Artificial Sequence
  derived and/or modified sequence opt2 from SST__Homo_sapiens__NP_001039
augcucuccugccgccuccagugcgcccucgccgcccucuccaucguccucgcccucggcugcgucaccggcgcccccuccgacccccgccuccgccaguuccuccagaagucccucgccgccgccgccggcaagcaggagcucgccaaguacuuccucgccgagcuccucuccgagcccaaccagaccgagaacgacgcccucgagcccgaggaccucucccaggccgccgagcaggacgagaugcgccucgagcuccagcgcuccgccaacuccaaccccgccauggccccccgcgagcgcaaggccggcugcaagaacuucuucuggaagaccuucaccuccugcuga

SEQ ID NO: 50190 - RNA, 1176 nt, Artificial Sequence
  derived and/or modified sequence opt2 from SSTR1__Homo_sapiens__NP_001040
auguuccccaacggcaccgccuccucccccuccuccucccccucccccucccccggcuccugcggcgagggcggcggcucccgcggccccggcgccggcgccgccgacggcauggaggagcccggccgcaacgccucccagaacggcacccucuccgagggccagggcuccgccauccucaucuccuucaucuacuccgucgucugccucgucggccucugcggcaacuccauggucaucuacgucauccuccgcuacgccaagaugaagaccgccaccaacaucuacauccucaaccucgccaucgccgacgagcuccucaugcucuccguccccuuccucgucaccuccacccuccuccgccacuggcccuucggcgcccuccucugccgccucguccucuccgucgacgccgucaacauguucaccuccaucuacugccucaccguccucuccgucgaccgcuacgucgccgucguccaccccaucaaggccgcccgcuaccgccgccccaccgucgccaaggucgucaaccucggcgucuggguccucucccuccucgucauccuccccaucgucgucuucucccgcaccgccgccaacuccgacggcaccgucgccugcaacaugcucaugcccgagcccgcccagcgcuggcucgucggcuucguccucuacaccuuccucaugggcuuccuccuccccgucggcgccaucugccucugcuacguccucaucaucgccaagaugcgcauggucgcccucaaggccggcuggcagcagcgcaagcgcuccgagcgcaagaucacccucauggucaugauggucgucauggucuucgucaucugcuggaugcccuucuacgucguccagcucgucaacgucuucgccgagcaggacgacgccaccgucucccagcucuccgucauccucggcuacgccaacuccugcgccaaccccauccucuacggcuuccucuccgacaacuucaagcgcuccuuccagcgcauccucugccucuccuggauggacaacgccgccgaggagcccgucgacuacuacgccaccgcccucaagucccgcgccuacuccgucgaggacuuccagcccgagaaccucgaguccggcggcgucuuccgcaacggcaccugcaccucccgcaucaccacccucuga

SEQ ID NO: 50191 - RNA, 1110 nt, Artificial Sequence
  derived and/or modified sequence opt2 from SSTR2__Homo_sapiens__NP_001041
auggacauggccgacgagccccucaacggcucccacaccuggcucuccauccccuucgaccucaacggcuccgucgucuccaccaacaccuccaaccagaccgagcccuacuacgaccucaccuccaacgccguccucaccuucaucuacuucgucgucugcaucaucggccucugcggcaacacccucgucaucuacgucauccuccgcuacgccaagaugaagaccaucaccaacaucuacauccucaaccucgccaucgccgacgagcucuucaugcucggccuccccuuccucgccaugcaggucgcccucguccacuggcccuucggcaaggccaucugccgcgucgucaugaccgucgacggcaucaaccaguucaccuccaucuucugccucaccgucauguccaucgaccgcuaccucgccgucguccaccccaucaaguccgccaaguggcgccgcccccgcaccgccaagaugaucaccauggccgucuggggcgucucccuccucgucauccuccccaucaugaucuacgccggccuccgcuccaaccaguggggccgcuccuccugcaccaucaacuggcccggcgaguccggcgccugguacaccggcuucaucaucuacaccuucauccucggcuuccucgucccccucaccaucaucugccucugcuaccucuucaucaucaucaaggucaaguccuccggcauccgcgucggcuccuccaagcgcaagaaguccgagaagaaggucacccgcauggucuccaucgucgucgccgucuucaucuucugcuggcuccccuucuacaucuucaacgucuccuccgucuccauggccaucucccccacccccgcccucaagggcauguucgacuucgucgucguccucaccuacgccaacuccugcgccaaccccauccucuacgccuuccucuccgacaacuucaagaaguccuuccagaacguccucugccucgucaaggucuccggcaccgacgacggcgagcgcuccgacuccaagcaggacaagucccgccucaacgagaccaccgagacccagcgcacccuccucaacggcgaccuccagaccuccaucuga

SEQ ID NO: 50192 - RNA, 1257 nt, Artificial Sequence
  derived and/or modified sequence opt2 from SSTR3__Homo_sapiens__XP_005261778
auggacaugcuccaccccuccuccgucuccaccaccuccgagcccgagaacgccuccuccgccuggccccccgacgccacccucggcaacgucuccgccggccccucccccgccggccucgccgucuccggcguccucaucccccucgucuaccucgucgucugcgucgucggccuccucggcaacucccucgucaucuacgucguccuccgccacaccgccucccccuccgucaccaacgucuacauccucaaccucgcccucgccgacgagcucuucaugcucggccuccccuuccucgccgcccagaacgcccucuccuacuggcccuucggcucccucaugugccgccucgucauggccgucgacggcaucaaccaguucaccuccaucuucugccucaccgucauguccgucgaccgcuaccucgccgucguccaccccacccgcuccgcccgcuggcgcaccgcccccgucgcccgcaccgucuccgccgccgucugggucgccuccgccgucgucguccuccccgucgucgucuucuccggcgucccccgcggcauguccaccugccacaugcaguggcccgagcccgccgccgccuggcgcgccggcuucaucaucuacaccgccgcccucggcuucuucggcccccuccucgucaucugccucugcuaccuccucaucgucgucaagguccgcuccgccggccgccgcgucugggcccccuccugccagcgccgccgccgcuccgagcgccgcgucacccgcauggucgucgccgucgucgcccucuucguccucugcuggaugcccuucuacguccucaacaucgucaacgucgucugcccccuccccgaggagcccgccuucuucggccucuacuuccucgucgucgcccuccccuacgccaacuccugcgccaaccccauccucuacggcuuccucuccuaccgcuucaagcagggcuuccgccgcguccuccuccgccccucccgccgcguccgcucccaggagcccaccgucggcccccccgagaagaccgaggaggaggacgaggaggaggaggacggcgaggagucccgcgagggcggcaagggcaaggagaugaacggccgcgucucccagaucacccagcccggcaccuccggccaggagcgcccccccucccgcgucgccuccaaggagcagcagcuccucccccaggaggccuccaccggcgagaaguccuccaccaugcgcaucuccuaccucuga

SEQ ID NO: 50193 - RNA, 1167 nt, Artificial Sequence
  derived and/or modified sequence opt2 from SSTR4__Homo_sapiens__NP_001043
auguccgcccccuccacccucccccccggcggcgaggagggccucggcaccgccuggcccuccgccgccaacgccuccuccgcccccgccgaggccgaggaggccgucgccggccccggcgacgcccgcgccgccggcauggucgccauccagugcaucuacgcccucgucugccucgucggccucgucggcaacgcccucgucaucuucgucauccuccgcuacgccaagaugaagaccgccaccaacaucuaccuccucaaccucgccgucgccgacgagcucuucaugcucuccguccccuucgucgccuccuccgccgcccuccgccacuggcccuucggcuccguccucugccgcgccguccucuccgucgacggccucaacauguucaccuccgucuucugccucaccguccucuccgucgaccgcuacgucgccgucguccacccccuccgcgccgccaccuaccgccgccccuccgucgccaagcucaucaaccucggcgucuggcucgccucccuccucgucacccuccccaucgccaucuucgccgacacccgccccgcccgcggcggccaggccgucgccugcaaccuccaguggccccaccccgccugguccgccgucuucgucgucuacaccuuccuccucggcuuccuccuccccguccucgccaucggccucugcuaccuccucaucgucggcaagaugcgcgccgucgcccuccgcgccggcuggcagcagcgccgccgcuccgagaagaagaucacccgccucguccucauggucgucgucgucuucguccucugcuggaugcccuucuacgucguccagcuccucaaccucuucgucaccucccucgacgccaccgucaaccacgucucccucauccucuccuacgccaacuccugcgccaaccccauccucuacggcuuccucuccgacaacuuccgccgcuucuuccagcgcguccucugccuccgcugcugccuccucgagggcgccggcggcgccgaggaggagccccucgacuacuacgccaccgcccucaaguccaagggcggcgccggcugcaugugccccccccuccccugccagcaggaggcccuccagcccgagcccggccgcaagcgcaucccccucacccgcaccaccaccuucuga

SEQ ID NO: 50194 - RNA, 1095 nt, Artificial Sequence
  derived and/or modified sequence opt2 from SSTR5__Homo_sapiens__NP_001166031
auggagccccucuuccccgccuccacccccuccuggaacgccuccucccccggcgccgccuccggcggcggcgacaaccgcacccucgucggccccgcccccuccgccggcgcccgcgccguccucguccccguccucuaccuccucgucugcgccgccggccucggcggcaacacccucgucaucuacgucguccuccgcuucgccaagaugaagaccgucaccaacaucuacauccucaaccucgccgucgccgacguccucuacaugcucggccuccccuuccucgccacccagaacgccgccuccuucuggcccuucggccccguccucugccgccucgucaugacccucgacggcgucaaccaguucaccuccgucuucugccucaccgucauguccgucgaccgcuaccucgccgucguccacccccucuccuccgcccgcuggcgccgcccccgcgucgccaagcucgccuccgccgccgccuggguccucucccucugcaugucccucccccuccucgucuucgccgacguccaggagggcggcaccugcaacgccuccuggcccgagcccgucggccucuggggcgccgucuucaucaucuacaccgccguccucggcuucuucgccccccuccucgucaucugccucugcuaccuccucaucgucgucaagguccgcgccgccggcguccgcgucggcugcguccgccgccgcuccgagcgcaaggucacccgcaugguccucgucgucguccucgucuucgccggcugcuggcuccccuucuucaccgucaacaucgucaaccucgccgucgcccucccccaggagcccgccuccgccggccucuacuucuucgucgucauccucuccuacgccaacuccugcgccaaccccguccucuacggcuuccucuccgacaacuuccgccaguccuuccagaagguccucugccuccgcaagggcuccggcgccaaggacgccgacgccaccgagccccgccccgaccgcauccgccagcagcaggaggccaccccccccgcccaccgcgccgccgccaacggccucaugcagaccuccaagcucuga

SEQ ID NO: 50195 - RNA, 1128 nt, Artificial Sequence
  derived and/or modified sequence opt2 from SSUH2__Homo_sapiens__NP_001243677
auggaccgcgaccucaacgaggacgacuccgucgucgaccucuccuucgaggccgaguccccccucgccccccccaccgagcuccucgagcgccuccccuccuacgacuggcuccuccagggcggccgcggccagaucuucuuccccccccucgaggcccccggccgcccccaggagcagcgcuccuggcccuccuuccucgagcaccgcguccccgccaugaccgaggaggucgcccgcgaggcccuccucuccuucgucgacuccaagugcugcuacuccuccaccgucgccggcgaccucgucauccaggagcucaagcgccagacccucugccgcuaccgccucgagaccuucuccgagucccgcaucuccgaguggaccuuccagcccuucaccaaccacuccgucgacggcccccagcgcggcgccuccccccgccucugggacaucaagguccagggcccccccauguuccaggaggacacccgcaaguuccaggucccccacuccucccucgucaaggagugccacaagugccacggccgcggccgcuacaagugcuccggcugccacggcgccggcaccguccgcugccccuccugcugcggcgccaagcgcaaggccaagcagucccgccgcugccagcucugcgccggcuccggccgccgccgcugcuccaccugcuccggccgcggcaacaagaccugcgccaccugcaagggcgagaagaagcuccuccacuucauccagcucgucaucauguggaagaacucccucuucgaguucgucuccgagcaccgccucaacugcccccgcgagcuccucgccaaggccaagggcgagaaccucuucaaggacgagaacuccgucgucuaccccaucgucgacuucccccuccgcgacaucucccucgccucccagcgcggcaucgccgagcacuccgccgcccucgccucccgcgcccgcguccuccagcagcgccagaccaucgagcucaucccccucaccgagguccacuacugguaccagggcaagaccuacgucuacuacaucuacggcaccgaccaccaggucuacgccgucgacuaccccgagcgcuacugcugcggcugcaccaucgucuga

SEQ ID NO: 50196 - RNA, 567 nt, Artificial Sequence
  derived and/or modified sequence opt2 from SSX1__Homo_sapiens__NP_005626
augaacggcgacgacaccuucgccaagcgcccccgcgacgacgccaaggccuccgagaagcgcuccaaggccuucgacgacaucgccaccuacuucuccaagaaggaguggaagaagaugaaguacuccgagaagaucuccuacgucuacaugaagcgcaacuacaaggccaugaccaagcucggcuucaaggucacccucccccccuucaugugcaacaagcaggccaccgacuuccagggcaacgacuucgacaacgaccacaaccgccgcauccaggucgagcacccccagaugaccuucggccgccuccaccgcaucauccccaagaucaugcccaagaagcccgccgaggacgagaacgacuccaagggcgucuccgaggccuccggcccccagaacgacggcaagcagcuccacccccccggcaaggccaacaucuccgagaagaucaacaagcgcuccggccccaagcgcggcaagcacgccuggacccaccgccuccgcgagcgcaagcagcucgucaucuacgaggagaucuccgaccccgaggaggacgacgaguga

SEQ ID NO: 50197 - RNA, 567 nt, Artificial Sequence
  derived and/or modified sequence opt2 from SSX2B__Homo_sapiens__NP_001157889
augaacggcgacgacgccuucgcccgccgccccaccgucggcgcccagauccccgagaagauccagaaggccuucgacgacaucgccaaguacuucuccaaggaggagugggagaagaugaaggccuccgagaagaucuucuacgucuacaugaagcgcaaguacgaggccaugaccaagcucggcuucaaggccacccucccccccuucaugugcaacaagcgcgccgaggacuuccagggcaacgaccucgacaacgaccccaaccgcggcaaccaggucgagcgcccccagaugaccuucggccgccuccagggcaucucccccaagaucaugcccaagaagcccgccgaggagggcaacgacuccgaggagguccccgaggccuccggcccccagaacgacggcaaggagcucugcccccccggcaagcccaccaccuccgagaagauccacgagcgcuccggccccaagcgcggcgagcacgccuggacccaccgccuccgcgagcgcaagcagcucgucaucuacgaggagaucuccgaccccgaggaggacgacgaguga

SEQ ID NO: 50198 - RNA, 1521 nt, Artificial Sequence
  derived and/or modified sequence opt2 from SSX2IP__Homo_sapiens__XP_011538914
augggcgacuggaugaccgucaccgaccccggccucuccuccgaguccaagaccaucucccaguacaccuccgagaccaagaugucccccuccucccucuacucccagcagguccucugcuccuccaucccccucuccaagaacguccacuccuucuucuccgccuucugcaccgaggacaacaucgagcaguccaucuccuaccucgaccaggagcucaccaccuucggcuuccccucccucuacgaggaguccaagggcaaggagaccaagcgcgagcucaacaucgucgccguccucaacugcaugaacgagcuccucguccuccagcgcaagaaccuccucgcccaggagaacgucgagacccagaaccucaagcucggcuccgacauggaccaccuccaguccugcuacuccaagcucaaggagcagcucgagaccucccgccgcgagaugaucggccuccaggagcgcgaccgccagcuccagugcaagaaccgcaaccuccaccagcuccucaagaacgagaaggacgagguccagaagcuccagaacaucaucgccucccgcgccacccaguacaaccacgacaugaagcgcaaggagcgcgaguacaacaagcucaaggagcgccuccaccagcucgucaugaacaagaaggacaagaagaucgccauggacauccucaacuacgucggccgcgccgacggcaagcgcggcuccuggcgcaccggcaagaccgaggcccgcaacgaggacgagauguacaagauccuccucaacgacuacgaguaccgccagaagcagauccucauggagaacgccgagcucaagaagguccuccagcagaugaagaaggagaugaucucccuccucuccccccagaagaagaagccccgcgagcgcgucgacgacuccaccggcaccgucaucuccgacgucgaggaggacgccggcgagcucucccgcgaguccaugugggaccucuccugcgagaccguccgcgagcagcucaccaacuccauccgcaagcaguggcgcauccucaagucccacgucgagaagcucgacaaccaggucuccaagguccaccucgagggcuucaacgacgaggacgucaucucccgccaggaccacgagcaggagaccgagaagcucgagcucgagauccagcagugcaaggagaugaucaagacccagcagcagcuccuccagcagcagcucgccaccgccuacgacgacgacaccaccucccuccuccgcgacugcuaccuccucgaggagaaggagcgccucaaggaggaguggucccucuucaaggagcagaagaagaacuucgagcgcgagcgccgcuccuucaccgaggccgccauccgccucggccucgagcgcaaggccuucgaggaggagcgcgccuccuggcucaagcagcaguuccucaacaugaccaccuucgaccaccagaacuccgagaacgucaagcucuucuccgccuucuccggcauccaguccauguacuga

SEQ ID NO: 50199 - RNA, 567 nt, Artificial Sequence
  derived and/or modified sequence opt2 from SSX4B__Homo_sapiens__NP_001030004
augaacggcgacgacgccuucgcccgccgcccccgcgacgacgcccagaucuccgagaagcuccgcaaggccuucgacgacaucgccaaguacuucuccaagaaggagugggagaagaugaaguccuccgagaagaucgucuacgucuacaugaagcucaacuacgaggucaugaccaagcucggcuucaaggucacccucccccccuucaugcgcuccaagcgcgccgccgacuuccacggcaacgacuucggcaacgaccgcaaccaccgcaaccaggucgagcgcccccagaugaccuucggcucccuccagcgcaucuuccccaagaucaugcccaagaagcccgccgaggaggagaacggccucaaggagguccccgaggccuccggcccccagaacgacggcaagcagcucugcccccccggcaaccccuccacccucgagaagaucaacaagaccuccggccccaagcgcggcaagcacgccuggacccaccgccuccgcgagcgcaagcagcucgucgucuacgaggagaucuccgaccccgaggaggacgacgaguga

SEQ ID NO: 50200 - RNA, 690 nt, Artificial Sequence
  derived and/or modified sequence opt2 from SSX5__Homo_sapiens__NP_066295
augaacggcgacgacgccuucguccgccgcccccgcgucggcucccagauccccgagaagaugcagaagcaccccuggcgccaggucugcgaccgcggcauccaccucgucaaccucucccccuucuggaaggucggccgcgagcccgccuccuccaucaaggcccuccucugcggccgcggcgaggcccgcgccuucgacgacaucgccaaguacuucuccgagaaggagugggagaagaugaaggccuccgagaagaucaucuacgucuacaugaagcgcaaguacgaggccaugaccaagcucggcuucaaggccacccucccccccuucaugcgcaacaagcgcgucgccgacuuccagggcaacgacuucgacaacgaccccaaccgcggcaaccaggucgagcacccccagaugaccuucggccgccuccagggcaucuuccccaagaucacccccgagaagcccgccgaggagggcaacgacuccaagggcguccccgaggccuccggcccccagaacaacggcaagcagcuccgccccuccggcaagcucaacaccuccgagaaggucaacaagaccuccggccccaagcgcggcaagcacgccuggacccaccgcguccgcgagcgcaagcagcucgucaucuacgaggagaucuccgacccccaggaggacgacgaguga

SEQ ID NO: 50201 - RNA, 1110 nt, Artificial Sequence
  derived and/or modified sequence opt2 from ST13__Homo_sapiens__NP_003923
auggacccccgcaaggucaacgagcuccgcgccuucgucaagaugugcaagcaggaccccuccguccuccacaccgaggagaugcgcuuccuccgcgagugggucgaguccaugggcggcaaggucccccccgccacccagaaggccaaguccgaggagaacaccaaggaggagaagcccgacuccaagaaggucgaggaggaccucaaggccgacgagcccuccuccgaggaguccgaccucgagaucgacaaggagggcgucaucgagcccgacaccgacgccccccaggagaugggcgacgagaacgccgagaucaccgaggagaugauggaccaggccaacgacaagaaggucgccgccaucgaggcccucaacgacggcgagcuccagaaggccaucgaccucuucaccgacgccaucaagcucaacccccgccucgccauccucuacgccaagcgcgccuccgucuucgucaagcuccagaagcccaacgccgccauccgcgacugcgaccgcgccaucgagaucaaccccgacuccgcccagcccuacaaguggcgcggcaaggcccaccgccuccucggccacugggaggaggccgcccacgaccucgcccucgccugcaagcucgacuacgacgaggacgccuccgccaugcucaaggagguccagccccgcgcccagaagaucgccgagcaccgccgcaaguacgagcgcaagcgcgaggagcgcgagaucaaggagcgcaucgagcgcgucaagaaggcccgcgaggagcacgagcgcgcccagcgcgaggaggaggcccgccgccaguccggcgcccaguacggcuccuuccccggcggcuuccccggcggcaugcccggcaacuuccccggcggcaugcccggcaugggcggcggcaugcccggcauggccggcaugcccggccucaacgagauccucuccgaccccgagguccucgccgccaugcaggaccccgaggucauggucgccuuccaggacgucgcccagaaccccgccaacauguccaaguaccaguccaaccccaaggucaugaaccucaucuccaagcucuccgccaaguucggcggccaggccuga

SEQ ID NO: 50202 - RNA, 2568 nt, Artificial Sequence
  derived and/or modified sequence opt2 from ST14__Homo_sapiens__NP_068813
augggcuccgaccgcgcccgcaagggcggcggcggccccaaggacuucggcgccggccucaaguacaacucccgccacgagaaggucaacggccucgaggagggcgucgaguuccuccccgucaacaacgucaagaaggucgagaagcacggccccggccgcugggucguccucgccgccguccucaucggccuccuccucguccuccucggcaucggcuuccucgucuggcaccuccaguaccgcgacguccgcguccagaaggucuucaacggcuacaugcgcaucaccaacgagaacuucgucgacgccuacgagaacuccaacuccaccgaguucgucucccucgccuccaaggucaaggacgcccucaagcuccucuacuccggcguccccuuccucggccccuaccacaaggaguccgccgucaccgccuucuccgagggcuccgucaucgccuacuacugguccgaguucuccaucccccagcaccucgucgaggaggccgagcgcgucauggccgaggagcgcgucgucaugcuccccccccgcgcccgcucccucaaguccuucgucgucaccuccgucgucgccuuccccaccgacuccaagaccguccagcgcacccaggacaacuccugcuccuucggccuccacgcccgcggcgucgagcucaugcgcuucaccacccccggcuuccccgacucccccuaccccgcccacgcccgcugccagugggcccuccgcggcgacgccgacuccguccucucccucaccuuccgcuccuucgaccucgccuccugcgacgagcgcggcuccgaccucgucaccgucuacaacacccucucccccauggagccccacgcccucguccagcucugcggcaccuacccccccuccuacaaccucaccuuccacuccucccagaacguccuccucaucacccucaucaccaacaccgagcgccgccaccccggcuucgaggccaccuucuuccagcucccccgcauguccuccugcggcggccgccuccgcaaggcccagggcaccuucaacucccccuacuaccccggccacuacccccccaacaucgacugcaccuggaacaucgagguccccaacaaccagcacgucaagguccgcuucaaguucuucuaccuccucgagcccggcguccccgccggcaccugccccaaggacuacgucgagaucaacggcgagaaguacugcggcgagcgcucccaguucgucgucaccuccaacuccaacaagaucaccguccgcuuccacuccgaccaguccuacaccgacaccggcuuccucgccgaguaccucuccuacgacuccuccgaccccugccccggccaguucaccugccgcaccggccgcugcauccgcaaggagcuccgcugcgacggcugggccgacugcaccgaccacuccgacgagcucaacugcuccugcgacgccggccaccaguucaccugcaagaacaaguucugcaagccccucuucugggucugcgacuccgucaacgacugcggcgacaacuccgacgagcagggcugcuccugccccgcccagaccuuccgcugcuccaacggcaagugccucuccaagucccagcagugcaacggcaaggacgacugcggcgacggcuccgacgaggccuccugccccaaggucaacgucgucaccugcaccaagcacaccuaccgcugccucaacggccucugccucuccaagggcaaccccgagugcgacggcaaggaggacugcuccgacggcuccgacgagaaggacugcgacugcggccuccgcuccuucacccgccaggcccgcgucgucggcggcaccgacgccgacgagggcgaguggcccuggcaggucucccuccacgcccucggccagggccacaucugcggcgccucccucaucucccccaacuggcucgucuccgccgcccacugcuacaucgacgaccgcggcuuccgcuacuccgaccccacccaguggaccgccuuccucggccuccacgaccagucccagcgcuccgcccccggcguccaggagcgccgccucaagcgcaucaucucccaccccuucuucaacgacuucaccuucgacuacgacaucgcccuccucgagcucgagaagcccgccgaguacuccuccaugguccgccccaucugccuccccgacgccucccacgucuuccccgccggcaaggccaucugggucaccggcuggggccacacccaguacggcggcaccggcgcccucauccuccagaagggcgagauccgcgucaucaaccagaccaccugcgagaaccuccucccccagcagaucaccccccgcaugaugugcgucggcuuccucuccggcggcgucgacuccugccagggcgacuccggcggcccccucuccuccgucgaggccgacggccgcaucuuccaggccggcgucgucuccuggggcgacggcugcgcccagcgcaacaagcccggcgucuacacccgccucccccucuuccgcgacuggaucaaggagaacaccggcgucuga

SEQ ID NO: 50203 - RNA, 3144 nt, Artificial Sequence
  derived and/or modified sequence opt2 from ST18__Homo_sapiens__NP_055497
auggacgccgaggccgaggacaagacccuccgcacccgcuccaagggcaccgagguccccauggacucccucauccaggagcucuccgucgccuacgacugcuccauggccaagaagcgcaccgccgaggaccaggcccucggcguccccgucaacaagcgcaagucccuccucaugaagccccgccacuacucccccaaggccgacugccaggaggaccgcuccgaccgcaccgaggacgacggcccccucgagacccacggccacuccaccgccgaggagaucaugaucaagcccauggacgagucccuccucuccaccgcccaggagaacuccucccgcaaggaggaccgcuacuccugcuaccaggagcucauggucaagucccucaugcaccucggcaaguucgagaagaacgucuccguccagaccgucuccgagaaccucaacgacuccggcauccagucccucaaggccgaguccgacgaggccgacgagugcuuccucauccacuccgacgacggccgcgacaagaucgacgacucccagccccccuucugcuccuccgacgacaacgaguccaacuccgaguccgccgagaacggcugggacuccggcuccaacuucuccgaggagaccaagcccccccgcguccccaaguacguccucaccgaccacaagaaggaccuccucgagguccccgagaucaagaccgagggcgacaaguucauccccugcgagaaccgcugcgacuccgagaccgagcgcaaggacccccagaacgcccucgccgagccccucgacggcaacgcccagcccuccuuccccgacgucgaggaggaggacuccgagucccucgccgucaugaccgaggagggcuccgaccucgagaaggccaagggcaaccucucccuccucgagcaggccaucgcccuccaggccgagcgcggcugcgucuuccacaacaccuacaaggagcucgaccgcuuccuccucgagcaccucgccggcgagcgccgccagaccaaggucaucgacaugggcggccgccagaucuucaacaacaagcacuccccccgccccgagaagcgcgagaccaagugccccauccccggcugcgacggcaccggccacgucaccggccucuacccccaccaccgcucccucuccggcugcccccacaagguccgcgucccccucgagauccucgccaugcacgagaacguccucaagugccccacccccggcugcaccggccgcggccacgucaacuccaaccgcaacacccaccgcucccucuccggcugccccaucgccgccgccgagaagcucgccaugucccaggacaagaaccagcucgacuccccccagaccggccagugccccgaccaggcccaccgcaccucccucgucaagcagaucgaguucaacuuccccucccaggccaucaccuccccccgcgccaccgucuccaaggagcaggagaaguucggcaagguccccuucgacuacgccuccuucgacgcccaggucuucggcaagcgcccccucauccagaccguccagggccgcaagaccccccccuuccccgaguccaagcacuuccccaaccccgucaaguuccccaaccgccuccccuccgccggcgcccacacccagucccccggccgcgccuccuccuacuccuacggccagugcuccgaggacacccacaucgccgccgccgccgccauccucaaccucuccacccgcugccgcgaggccaccgacauccucuccaacaagccccagucccuccacgccaagggcgccgagaucgaggucgacgagaacggcacccucgaccucuccaugaagaagaaccgcauccucgacaaguccgccccccucaccuccuccaacaccuccauccccacccccuccuccucccccuucaagaccuccuccauccucgucaacgccgccuucuaccaggcccucugcgaccaggagggcugggacacccccaucaacuacuccaagacccacggcaagaccgaggaggagaaggagaaggaccccgucuccucccucgagaaccucgaggagaagaaguuccccggcgaggccuccauccccucccccaagcccaagcuccacgcccgcgaccucaagaaggagcucaucaccugccccacccccggcugcgacggcuccggccacgucaccggcaacuacgccucccaccgcuccgucuccggcugcccccucgccgacaagacccucaagucccucauggccgccaacucccaggagcucaagugccccacccccggcugcgacggcuccggccacgucaccggcaacuacgccucccaccgcucccucuccggcugcccccgcgcccgcaagggcggcgucaagaugacccccaccaaggaggagaaggaggaccccgagcucaagugccccgucaucggcugcgacggccagggccacaucuccggcaaguacaccucccaccgcaccgccuccggcugcccccucgccgccaagcgccagaaggagaacccccucaacggcgccucccucuccuggaagcucaacaagcaggagcucccccacugcccccuccccggcugcaacggccucggccacgucaacaacgucuucgucacccaccgcucccucuccggcugcccccucaacgcccaggucaucaagaagggcaaggucuccgaggagcucaugaccaucaagcucaaggccaccggcggcaucgaguccgacgaggagauccgccaccucgacgaggagaucaaggagcucaacgaguccaaccucaagaucgaggccgacaugaugaagcuccagacccagaucaccuccauggaguccaaccucaagaccaucgaggaggagaacaagcucaucgagcagaacaacgagucccuccucaaggagcucgccggccucucccaggcccucaucuccucccucgccgacauccagcucccccagaugggccccaucuccgagcagaacuucgaggccuacgucaacacccucaccgacauguacuccaaccucgagcgcgacuacucccccgagugcaaggcccuccucgaguccaucaagcaggccgucaagggcauccacgucuga

SEQ ID NO: 50204 - RNA, 240 nt, Artificial Sequence
  derived and/or modified sequence opt2 from ST20__Homo_sapiens__NP_001094349
auggcccgcucccgccucaccgccaccuccgucucccagguccaggagaacggcuucgucaagaagcucgagcccaaguccggcuggaugaccuuccucgaggucaccggcaagaucugcgagaugcucuucugccccgaggccauccuccucacccgcaaggacacccccuacugcgagaccggccucaucuuccucacccucaccaagaccaucgccaacaccuacuucuacuucuga

SEQ ID NO: 50205 - RNA, 1023 nt, Artificial Sequence
  derived and/or modified sequence opt2 from ST3GAL1__Homo_sapiens__XP_005251082
auggucacccuccgcaagcgcacccucaagguccucaccuuccucguccucuucaucuuccucaccuccuucuuccucaacuacucccacaccauggucgccaccaccugguuccccaagcagaugguccucgagcucuccgagaaccucaagcgccucaucaagcaccgccccugcaccugcacccacugcaucggccagcgcaagcucuccgccugguucgacgagcgcuucaaccagaccaugcagccccuccucaccgcccagaacgcccuccucgaggacgacaccuaccgcugguggcuccgccuccagcgcgagaagaagcccaacaaccucaacgacaccaucaaggagcucuuccgcgucguccccggcaacgucgaccccaugcucgagaagcgcuccgucggcugccgccgcugcgccgucgucggcaacuccggcaaccuccgcgaguccuccuacggccccgagaucgacucccacgacuucguccuccgcaugaacaaggcccccaccgccggcuucgaggccgacgucggcaccaagaccacccaccaccucgucuaccccgaguccuuccgcgagcucggcgacaacgucuccaugauccucguccccuucaagaccaucgaccucgagugggucgucuccgccaucaccaccggcaccaucucccacaccuacauccccguccccgccaagauccgcgucaagcaggacaagauccucaucuaccaccccgccuucaucaaguacgucuucgacaacuggcuccagggccacggccgcuaccccuccaccggcauccucuccgucaucuucuccaugcacgucugcgacgaggucgaccucuacggcuucggcgccgacuccaagggcaacuggcaccacuacugggagaacaaccccuccgccggcgccuuccgcaagaccggcguccacgacgccgacuucgaguccaacgucaccgccacccucgccuccaucaacaagauccgcaucuucaagggccgcuga

SEQ ID NO: 50206 - RNA, 1053 nt, Artificial Sequence
  derived and/or modified sequence opt2 from ST3GAL2__Homo_sapiens__NP_008858
augaagugcucccuccgcgucugguuccucuccgucgccuuccuccucgucuucaucaugucccuccucuucaccuacucccaccacuccauggccacccuccccuaccucgacuccggcgcccucgacggcacccaccgcgucaagcucguccccggcuacgccggccuccagcgccucuccaaggagcgccucuccggcaaguccugcgccugccgccgcugcaugggcgacgccggcgccuccgacugguucgacucccacuucgacggcaacaucucccccgucuggacccgcgagaacauggaccucccccccgacguccagcgcugguggaugaugcuccagccccaguucaagucccacaacaccaacgagguccucgagaagcucuuccagaucguccccggcgagaaccccuaccgcuuccgcgacccccaccagugccgccgcugcgccgucgucggcaacuccggcaaccuccgcggcuccggcuacggccaggacgucgacggccacaacuucaucaugcgcaugaaccaggcccccaccgucggcuucgagcaggacgucggcucccgcaccacccaccacuucauguaccccgaguccgccaagaaccuccccgccaacgucuccuucguccucguccccuucaagguccucgaccuccucuggaucgccuccgcccucuccaccggccagauccgcuucaccuacgcccccgucaaguccuuccuccgcgucgacaaggagaagguccagaucuacaaccccgccuucuucaaguacauccacgaccgcuggaccgagcaccacggccgcuaccccuccaccggcaugcucguccucuucuucgcccuccacgucugcgacgaggucaacgucuacggcuucggcgccgacucccgcggcaacuggcaccacuacugggagaacaaccgcuacgccggcgaguuccgcaagaccggcguccacgacgccgacuucgaggcccacaucaucgacaugcucgccaaggccuccaagaucgaggucuaccgcggcaacuga

SEQ ID NO: 50207 - RNA, 1002 nt, Artificial Sequence
  derived and/or modified sequence opt2 from ST3GAL4__Homo_sapiens__NP_001241687
auggucuccaagucccgcuggaagcuccucgccaugcucgcccucguccucgucgucauggucugguacuccaucucccgcgaggaccgcuacaucgagcucuucuacuuccccauccccgagaagaaggagcccugccuccagggcgaggccgaguccaaggccuccaagcucuucggcaacuacucccgcgaccagcccaucuuccuccgccucgaggacuacuucugggucaagacccccuccgccuacgagcuccccuacggcaccaagggcuccgaggaccuccuccuccgcguccucgccaucaccuccuccuccauccccaagaacauccagucccuccgcugccgccgcugcgucgucgucggcaacggccaccgccuccgcaacuccucccucggcgacgccaucaacaaguacgacgucgucauccgccucaacaacgcccccgucgccggcuacgagggcgacgucggcuccaagaccaccaugcgccucuucuaccccgaguccgcccacuucgaccccaaggucgagaacaaccccgacacccuccucguccucgucgccuucaaggccauggacuuccacuggaucgagaccauccucuccgacaagaagcgcguccgcaagggcuucuggaagcagcccccccucaucugggacgucaaccccaagcagauccgcauccucaaccccuucuucauggagaucgccgccgacaagcuccucucccuccccaugcagcagccccgcaagaucaagcagaagcccaccaccggccuccucgccaucacccucgcccuccaccucugcgaccucguccacaucgccggcuucggcuaccccgacgccuacaacaagaagcagaccauccacuacuacgagcagaucacccucaaguccauggccggcuccggccacaacgucucccaggaggcccucgccaucaagcgcaugcucgagaugggcgccaucaagaaccucaccuccuucuga

SEQ ID NO: 50208 - RNA, 1188 nt, Artificial Sequence
  derived and/or modified sequence opt2 from ST3GAL5__Homo_sapiens__NP_001035902
auggccuccguccccaugcccuccgaguacaccuacgucaagcuccgcuccgacugcucccgccccucccuccagugguacacccgcgcccaguccaagaugcgccgccccucccuccuccucaaggacauccucaagugcacccuccucgucuucggcgucuggauccucuacauccucaagcucaacuacaccaccgaggagugcgacaugaagaagaugcacuacgucgaccccgaccacgucaagcgcgcccagaaguacgcccagcagguccuccagaaggagugccgccccaaguucgccaagaccuccauggcccuccucuucgagcaccgcuacuccgucgaccuccuccccuucguccagaaggcccccaaggacuccgaggccgaguccaaguacgacccccccuucggcuuccgcaaguucuccuccaagguccagacccuccucgagcuccuccccgagcacgaccuccccgagcaccucaaggccaagaccugccgccgcugcgucgucaucggcuccggcggcauccuccacggccucgagcucggccacacccucaaccaguucgacgucgucauccgccucaacuccgcccccgucgagggcuacuccgagcacgucggcaacaagaccaccauccgcaugaccuaccccgagggcgccccccucuccgaccucgaguacuacuccaacgaccucuucgucgccguccucuucaaguccgucgacuucaacuggcuccaggccauggucaagaaggagacccuccccuucuggguccgccucuucuucuggaagcaggucgccgagaagaucccccuccagcccaagcacuuccgcauccucaaccccgucaucaucaaggagaccgccuucgacauccuccaguacuccgagccccagucccgcuucuggggccgcgacaagaacguccccaccaucggcgucaucgccgucguccucgccacccaccucugcgacgaggucucccucgccggcuucggcuacgaccucaaccagccccgcaccccccuccacuacuucgacucccagugcauggccgccaugaacuuccagaccaugcacaacgucaccaccgagaccaaguuccuccucaagcucgucaaggagggcgucgucaaggaccucuccggcggcaucgaccgcgaguucuga

SEQ ID NO: 50209 - RNA, 1155 nt, Artificial Sequence
  derived and/or modified sequence opt2 from ST3GAL6__Homo_sapiens__NP_001258074
auguggcaggccccccgcgagcgccagcagcccgccggcgccgccgccccccaggucuccgagcccggcgccccccuccgcuccucccuccucggccucggcggcucccuccuccccgccggcuucgccgccggccuccacugccccggcgagcccgccaugcgcggcuaccucgucgccaucuuccucuccgccgucuuccucuacuacguccuccacugcauccucuggggcaccaacgucuacugggucgcccccgucgagaugaagcgccgcaacaagauccagcccugccucuccaagcccgccuucgccucccuccuccgcuuccaccaguuccaccccuuccucugcgccgccgacuuccgcaagaucgccucccucuacggcuccgacaaguucgaccuccccuacggcaugcgcaccuccgccgaguacuuccgccucgcccucuccaagcuccaguccugcgaccucuucgacgaguucgacaacauccccugcaagaagugcgucgucgucggcaacggcggcguccucaagaacaagacccucggcgagaagaucgacuccuacgacgucaucauccgcaugaacaacggccccguccucggccacgaggaggaggucggccgccgcaccaccuuccgccucuucuaccccgaguccgucuucuccgaccccauccacaacgaccccaacaccaccgucauccucaccgccuucaagccccacgaccuccgcuggcuccucgagcuccucaugggcgacaagaucaacaccaacggcuucuggaagaagcccgcccucaaccucaucuacaagcccuaccagauccgcauccucgaccccuucaucauccgcaccgccgccuacgagcuccuccacuuccccaaggucuuccccaagaaccagaagcccaagcaccccaccaccggcaucaucgccaucacccucgccuucuacaucugccacgagguccaccucgccggcuucaaguacaacuucuccgaccucaaguccccccuccacuacuacggcaacgccaccaugucccucaugaacaagaacgccuaccacaacgucaccgccgagcagcucuuccucaaggacaucaucgagaagaaccucgucaucaaccucacccaggacuga

SEQ ID NO: 50210 - RNA, 3414 nt, Artificial Sequence
  derived and/or modified sequence opt2 from ST5__Homo_sapiens__NP_005409
augaccaugaccgccaacaagaacuccuccaucacccacggcgccggcggcaccaaggccccccgcggcacccucucccgcucccaguccgucucccccccccccguccucucccccccccgcucccccaucuacccccucuccgacuccgagaccuccgccugccgcuaccccucccacuccuccucccgcguccuccucaaggaccgccacccccccgcccccuccccccagaacccccaggaccccucccccgacaccuccccccccaccugccccuucaagaccgccuccuucggcuaccucgaccgcucccccuccgccugcaagcgcgacgcccagaaggaguccguccagggcgccgcccaggacgucgccggcgucgccgccugccucccccucgcccaguccacccccuuccccggccccgccgccggcccccgcggcguccuccucacccgcaccggcacccgcgcccacucccucggcauccgcgagaagaucuccgccugggagggccgccgcgaggccuccccccgcauguccaugugcggcgagaagcgcgagggcuccggcuccgagugggccgccuccgagggcugccccucccucggcugccccuccgucguccccucccccugcuccuccgagaagaccuucgacuucaagggccuccgccgcaugucccgcaccuucuccgagugcuccuaccccgagaccgaggaggagggcgaggcccuccccguccgcgacuccuucuaccgccucgagaagcgccucggccgcuccgagcccuccgccuuccuccgcggccacggcucccgcaaggaguccuccgccguccucucccgcauccagaagaucgagcagguccucaaggagcagcccggccgcggccucccccagcuccccuccuccugcuacuccgucgaccgcggcaagcgcaagaccggcacccucggcucccucgaggagcccgccggcggcgccuccgucuccgccggcucccgcgccgucggcgucgccggcgucgccggcgaggccggccccccccccgagcgcgagggcuccggcuccaccaagcccggcacccccggcaacucccccuccucccagcgccuccccuccaaguccucccucgaccccgccgucaaccccguccccaagcccaagcgcaccuucgaguacgaggccgacaagaaccccaaguccaagcccuccaacggccucccccccucccccacccccgccgccccccccccccuccccuccacccccgccccccccgucacccgccgccccaagaaggacaugcgcggccaccgcaagucccagucccgcaaguccuucgaguucgaggacgccuccucccuccagucccucuaccccuccucccccaccgagaacggcaccgagaaccagcccaaguucggcuccaaguccacccucgaggagaacgccuacgaggacaucgucggcgaccuccccaaggagaaccccuacgaggacgucgaccucaagucccgccgcgccggccgcaagucccagcagcucuccgagaacucccucgacucccuccaccgcaugugguccccccaggaccgcaaguacaacuccccccccacccagcucucccucaagcccaacucccagucccuccgcuccggcaacugguccgagcgcaagucccaccgccucccccgccuccccaagcgccacucccacgacgacaugcuccuccucgcccagcucucccuccccuccucccccuccucccucaacgaggacucccucuccaccaccuccgagcuccucuccucccgccgcgcccgccgcauccccaagcucguccagcgcaucaacuccaucuacaacgccaagcgcggcaagaagcgccucaagaagcucuccauguccuccaucgagaccgccucccuccgcgacgagaacuccgaguccgaguccgacuccgacgaccgcuucaaggcccacacccagcgccucguccacauccaguccaugcucaagcgcgcccccuccuaccgcacccucgagcucgagcuccucgaguggcaggagcgcgagcucuucgaguacuucgucgucgucucccucaagaagaagcccucccgcaacaccuaccuccccgaggucuccuaccaguuccccaagcucgaccgccccaccaagcagaugcgcgaggccgaggagcgccucaaggccaucccccaguucugcuuccccgacgccaaggacuggcuccccgucuccgaguacuccuccgagaccuucuccuucaugcucaccggcgaggacggcucccgccgcuucggcuacugccgccgccuccuccccuccggcaagggcccccgccuccccgaggucuacugcgucaucucccgccucggcugcuucggccucuucuccaagguccucgacgaggucgagcgccgccgcggcaucuccgccgcccucgucuaccccuucaugcgcucccucauggagucccccuuccccgcccccggcaagaccaucaaggucaagaccuuccuccccggcgccggcaacgagguccucgagcuccgccgccccauggacucccgccucgagcacgucgacuucgagugccucuucaccugccucuccguccgccagcucauccgcaucuucgccucccuccuccucgagcgccgcgucaucuucgucgccgacaagcucuccacccucuccuccugcucccacgccgucgucgcccuccucuaccccuucuccuggcagcacaccuucauccccguccuccccgccuccaugaucgacaucgucugcugccccacccccuuccucgucggccuccucuccuccucccuccccaagcucaaggagcuccccgucgaggaggcccucauggucaaccucggcuccgaccgcuucauccgccagauggacgacgaggacacccuccucccccgcaagcuccaggccgcccucgagcaggcccucgagcgcaagaacgagcucaucucccaggacuccgacuccgacuccgacgacgagugcaacacccucaacggccucgucuccgaggucuucauccgcuucuucgucgagaccgucggccacuacucccucuuccucacccaguccgagaagggcgagcgcgccuuccagcgcgaggccuuccgcaaguccgucgccuccaaguccauccgccgcuuccucgaggucuucauggagucccagauguucgccggcuucauccaggaccgcgagcuccgcaagugccgcgccaagggccucuucgagcagcgcgucgagcaguaccucgaggagcuccccgacaccgagcaguccggcaugaacaaguuccuccgcggccucggcaacaagaugaaguuccuccacaagaagaacuga

SEQ ID NO: 50211 - RNA, 1221 nt, Artificial Sequence
  derived and/or modified sequence opt2 from ST6GAL1__Homo_sapiens__NP_775323
augauccacaccaaccucaagaagaaguucuccugcugcguccucgucuuccuccucuucgccgucaucugcgucuggaaggagaagaagaagggcuccuacuacgacuccuucaagcuccagaccaaggaguuccagguccucaagucccucggcaagcucgccaugggcuccgacucccaguccgucuccuccuccuccacccaggacccccaccgcggccgccagacccucggcucccuccgcggccucgccaaggccaagcccgaggccuccuuccaggucuggaacaaggacuccuccuccaagaaccucaucccccgccuccagaagaucuggaagaacuaccucuccaugaacaaguacaaggucuccuacaagggccccggccccggcaucaaguucuccgccgaggcccuccgcugccaccuccgcgaccacgucaacgucuccauggucgaggucaccgacuuccccuucaacaccuccgagugggagggcuaccuccccaaggaguccauccgcaccaaggccggccccuggggccgcugcgccgucgucuccuccgccggcucccucaaguccucccagcucggccgcgagaucgacgaccacgacgccguccuccgcuucaacggcgcccccaccgccaacuuccagcaggacgucggcaccaagaccaccauccgccucaugaacucccagcucgucaccaccgagaagcgcuuccucaaggacucccucuacaacgagggcauccucaucgucugggaccccuccgucuaccacuccgacauccccaagugguaccagaaccccgacuacaacuucuucaacaacuacaagaccuaccgcaagcuccaccccaaccagcccuucuacauccucaagccccagaugcccugggagcucugggacauccuccaggagaucucccccgaggagauccagcccaacccccccuccuccggcaugcucggcaucaucaucaugaugacccucugcgaccaggucgacaucuacgaguuccuccccuccaagcgcaagaccgacgucugcuacuacuaccagaaguucuucgacuccgccugcaccaugggcgccuaccacccccuccucuacgagaagaaccucgucaagcaccucaaccagggcaccgacgaggacaucuaccuccucggcaaggccacccuccccggcuuccgcaccauccacugcuga

SEQ ID NO: 50212 - RNA, 1401 nt, Artificial Sequence
  derived and/or modified sequence opt2 from ST6GAL2__Homo_sapiens__NP_001135824
augaagccccaccucaagcaguggcgccagcgcaugcucuucggcaucuucgccuggggccuccucuuccuccucaucuucaucuacuucaccgacuccaaccccgccgagcccguccccuccucccucuccuuccucgagacccgccgccuccuccccguccagggcaagcagcgcgccaucaugggcgccgcccacgagcccuccccccccggcggccucgacgcccgccaggcccucccccgcgcccaccccgccggcuccuuccacgccggccccggcgaccuccagaagugggcccagucccaggacggcuucgagcacaaggaguucuucuccucccaggucggccgcaagucccaguccgccuucuaccccgaggacgacgacuacuucuucgccgccggccagcccggcuggcacucccacacccagggcacccucggcuuccccucccccggcgagcccggcccccgcgagggcgccuuccccgccgcccagguccagcgccgccgcgucaagaagcgccaccgccgccagcgccgcucccacguccucgaggagggcgacgacggcgaccgccucuacuccuccaugucccgcgccuuccucuaccgccucuggaagggcaacgucuccuccaagaugcucaacccccgccuccagaaggccaugaaggacuaccucaccgccaacaagcacggcguccgcuuccgcggcaagcgcgaggccggccucucccgcgcccagcuccucugccagcuccgcucccgcgcccgcguccgcacccucgacggcaccgaggcccccuucuccgcccucggcuggcgccgccucguccccgccgucccccucucccagcuccacccccgcggccuccgcuccugcgccgucgucauguccgccggcgccauccucaacuccucccucggcgaggagaucgacucccacgacgccguccuccgcuucaacuccgcccccacccgcggcuacgagaaggacgucggcaacaagaccaccauccgcaucaucaacucccagauccucaccaaccccucccaccacuucaucgacuccucccucuacaaggacgucauccucgucgccugggaccccgcccccuacuccgccaaccucaaccucugguacaagaagcccgacuacaaccucuucacccccuacauccagcaccgccagcgcaaccccaaccagcccuucuacauccuccaccccaaguucaucuggcagcucugggacaucauccaggagaacaccaaggagaagauccagcccaacccccccuccuccggcuucaucggcuccuucgucaagaucggccacauccgcgccugcuccgagccccgcucccgcgacugcacccccgccuggaccaccgaguga

SEQ ID NO: 50213 - RNA, 1803 nt, Artificial Sequence
  derived and/or modified sequence opt2 from ST6GALNAC1__Homo_sapiens__NP_060884
augcgcuccugccucuggcgcugccgccaccucucccagggcguccaguggucccuccuccucgccguccucgucuucuuccucuucgcccuccccuccuucaucaaggagccccagaccaagcccucccgccaccagcgcaccgagaacaucaaggagcgcucccuccagucccucgccaagcccaagucccaggcccccacccgcgcccgccgcaccaccaucuacgccgagcccguccccgagaacaacgcccucaacacccagacccagcccaaggcccacaccaccggcgaccgcggcaaggaggccaaccaggccccccccgaggagcaggacaaggucccccacaccgcccagcgcgccgccuggaagucccccgagaaggagaagaccauggucaacacccucuccccccgcggccaggacgccggcauggccuccggccgcaccgaggcccaguccuggaagucccaggacaccaagaccacccagggcaacggcggccagacccgcaagcucaccgccucccgcaccgucuccgagaagcaccagggcaaggccgccaccaccgccaagacccucauccccaagucccagcaccgcaugcucgcccccaccggcgccgucuccacccgcacccgccagaagggcgucaccaccgccgucaucccccccaaggagaagaagccccaggccacccccccccccgcccccuuccagucccccaccacccagcgcaaccagcgccucaaggccgccaacuucaaguccgagccccgcugggacuucgaggagaaguacuccuucgagaucggcggccuccagaccaccugccccgacuccgucaagaucaaggccuccaagucccucuggcuccagaagcucuuccuccccaaccucacccucuuccucgacucccgccacuucaaccaguccgagugggaccgccucgagcacuucgccccccccuucggcuucauggagcucaacuacucccucguccagaaggucgucacccgcuucccccccgucccccagcagcagcuccuccucgccucccuccccgccggcucccuccgcugcaucaccugcgccgucgucggcaacggcggcauccucaacaacucccacaugggccaggagaucgacucccacgacuacgucuuccgccucuccggcgcccucaucaagggcuacgagcaggacgucggcacccgcaccuccuucuacggcuucaccgccuucucccucacccagucccuccucauccucggcaaccgcggcuucaagaacgucccccucggcaaggacguccgcuaccuccacuuccucgagggcacccgcgacuacgaguggcucgaggcccuccucaugaaccagaccgucauguccaagaaccucuucugguuccgccaccgcccccaggaggccuuccgcgaggcccuccacauggaccgcuaccuccuccuccaccccgacuuccuccgcuacaugaagaaccgcuuccuccgcuccaagacccucgacggcgcccacuggcgcaucuaccgccccaccaccggcgcccuccuccuccucaccgcccuccagcucugcgaccaggucuccgccuacggcuucaucaccgagggccacgagcgcuucuccgaccacuacuacgacaccuccuggaagcgccucaucuucuacaucaaccacgacuucaagcucgagcgcgaggucuggaagcgccuccacgacgagggcaucauccgccucuaccagcgccccggccccggcaccgccaaggccaagaacuga

SEQ ID NO: 50214 - RNA, 1125 nt, Artificial Sequence
  derived and/or modified sequence opt2 from ST6GALNAC2__Homo_sapiens__NP_006447
augggccucccccgcggcuccuucuucuggcuccuccuccuccucaccgccgccugcuccggccuccucuucgcccucuacuucuccgccguccagcgcuaccccggccccgccgccggcgcccgcgacaccaccuccuucgaggccuucuuccaguccaaggccuccaacuccuggaccggcaagggccaggccugccgccaccuccuccaccucgccauccagcgccacccccacuuccgcggccucuucaaccucuccauccccguccuccucuggggcgaccucuucacccccgcccucugggaccgccucucccagcacaaggcccccuacggcuggcgcggccucucccaccaggucaucgccuccacccucucccuccucaacggcuccgaguccgccaagcucuucgcccccccccgcgacaccccccccaagugcauccgcugcgccgucgucggcaacggcggcauccucaacggcucccgccagggccccaacaucgacgcccacgacuacgucuuccgccucaacggcgccgucaucaagggcuucgagcgcgacgucggcaccaagaccuccuucuacggcuucaccgucaacaccaugaagaacucccucgucuccuacuggaaccucggcuucaccuccgucccccagggccaggaccuccaguacaucuucauccccuccgacauccgcgacuacgucaugcuccgcuccgccauccucggcguccccguccccgagggccucgacaagggcgaccgcccccacgccuacuucggccccgaggccuccgccuccaaguucaagcuccuccaccccgacuucaucuccuaccucaccgagcgcuuccucaaguccaagcucaucaacacccacuucggcgaccucuacaugcccuccaccggcgcccucaugcuccucaccgcccuccacaccugcgaccaggucuccgccuacggcuucaucaccuccaacuacuggaaguucuccgaccacuacuucgagcgcaagaugaagccccucaucuucuacgccaaccacgaccucucccucgaggccgcccucuggcgcgaccuccacaaggccggcauccuccagcucuaccagcgcuga

SEQ ID NO: 50215 - RNA, 909 nt, Artificial Sequence
  derived and/or modified sequence opt2 from ST6GALNAC4__Homo_sapiens__NP_778204
augaaggcccccggccgccucguccucaucauccucugcuccgucgucuucuccgccgucuacauccuccucugcugcugggccggccucccccucugccucgccaccugccucgaccaccacuuccccaccggcucccgccccaccguccccggcccccuccacuucuccggcuacuccuccguccccgacggcaagccccucguccgcgagcccugccgcuccugcgccgucgucuccuccuccggccagaugcucggcuccggccucggcgccgagaucgacuccgccgagugcgucuuccgcaugaaccaggcccccaccgucggcuucgaggccgacgucggccagcgcuccacccuccgcgucgucucccacaccuccgucccccuccuccuccgcaacuacucccacuacuuccagaaggcccgcgacacccucuacauggucuggggccagggccgccacauggaccgcguccucggcggccgcaccuaccgcacccuccuccagcucacccgcauguaccccggccuccaggucuacaccuucaccgagcgcaugauggccuacugcgaccagaucuuccaggacgagaccggcaagaaccgccgccaguccggcuccuuccucuccaccggcugguucaccaugauccucgcccucgagcucugcgaggagaucgucgucuacggcauggucuccgacuccuacugccgcgagaagucccaccccuccguccccuaccacuacuucgagaagggccgccucgacgagugccagauguaccucgcccacgagcaggccccccgcuccgcccaccgcuucaucaccgagaaggccgucuucucccgcugggccaagaagcgccccaucgucuucgcccaccccuccuggcgcaccgaguga

SEQ ID NO: 50216 - RNA, 1125 nt, Artificial Sequence
  derived and/or modified sequence opt2 from ST6GALNAC6__Homo_sapiens__NP_001273928
auggccugcucccgcccccccucccagugcgagcccaccucccucccccccggcccccccgccggccgccgccaccucccccucucccgccgccgccgcgagauguccuccaacaaggagcagcgcuccgccgucuucgucauccucuucgcccucaucaccauccucauccucuacuccuccaacuccgccaacgaggucuuccacuacggcucccuccgcggccgcucccgccgccccgucaaccucaagaagugguccaucaccgacggcuacguccccauccucggcaacaagacccuccccucccgcugccaccagugcgucaucgucuccuccuccucccaccuccucggcaccaagcucggccccgagaucgagcgcgccgagugcaccauccgcaugaacgacgcccccaccaccggcuacuccgccgacgucggcaacaagaccaccuaccgcgucgucgcccacuccuccgucuuccgcguccuccgccgcccccaggaguucgucaaccgcacccccgagaccgucuucaucuucuggggcccccccuccaagaugcagaagccccagggcucccucguccgcgucauccagcgcgccggccucgucuuccccaacauggaggccuacgccgucucccccggccgcaugcgccaguucgacgaccucuuccgcggcgagaccggcaaggaccgcgagaagucccacuccuggcucuccaccggcugguucaccauggucaucgccgucgagcucugcgaccacguccacgucuacggcauggucccccccaacuacugcuccggccccgccuccuccgccugccccaccaccaccaccuccccccgcggccgcaccaacgucucccccaccucccgcauguccaccgucgcccgcgccaccaccaccgccuccuccccccgcaagggcuccucccaccgcggccccuccugcauggccucccccucccccaccccccccggcccccgcccccccucccucugggaccuccgccgcguccgcggcgaggccgccuccgcccagccccucggccagggccccuccuccggccagucccgccucgccggcgucucccccucccaguccggccccuga

SEQ ID NO: 50217 - RNA, 1665 nt, Artificial Sequence
  derived and/or modified sequence opt2 from ST7__Homo_sapiens__NP_060882
auggccgaggccgccaccggcuuccucgagcagcucaaguccugcaucgucugguccuggaccuaccucuggaccgucugguucuucaucguccucuuccucgucuacauccuccgcgucccccucaagaucaacgacaaccucuccaccgucuccauguuccucaacacccucacccccaaguucuacgucgcccucaccggcaccuccucccucaucuccggccucauccucaucuucgaguggugguacuuccgcaaguacggcaccuccuucaucgagcaggucuccgucucccaccuccgcccccuccucggcggcgucgacaacaacuccuccaacaacuccaacuccuccaacggcgacuccgacuccaaccgccaguccgucuccgagugcaaggucuggcgcaacccccucaaccucuuccgcggcgccgaguacaaccgcuacaccugggucaccggccgcgagccccucaccuacuacgacaugaaccucuccgcccaggaccaccagaccuucuucaccugcgacuccgaccaccuccgccccgccgacgccaucaugcagaaggccuggcgcgagcgcaacccccaggcccgcaucuccgccgcccacgaggcccucgagaucaacgagugcgccaccgccuacauccuccucgccgaggaggaggccaccaccaucgccgaggccgagaagcucuucaagcaggcccucaaggccggcgacggcugcuaccgccgcucccagcagcuccagcaccacggcucccaguacgaggcccagcaccgccgcgacaccaacguccucgucuacaucaagcgccgccucgccaugugcgcccgccgccucggccgcacccgcgaggccgucaagaugaugcgcgaccucaugaaggaguucccccuccucuccauguucaacauccacgagaaccuccucgaggcccuccucgagcuccaggccuacgccgacguccaggccguccucgccaaguacgacgacaucucccuccccaaguccgccaccaucugcuacaccgccgcccuccucaaggcccgcgccgucuccgacaaguucucccccgaggccgccucccgccgcggccucuccaccgccgagaugaacgccgucgaggccauccaccgcgccgucgaguucaacccccacguccccaaguaccuccucgagaugaagucccucauccucccccccgagcacauccucaagcgcggcgacuccgaggccaucgccuacgccuucuuccaccucgcccacuggaagcgcgucgagggcgcccucaaccuccuccacugcaccugggagggcaccuuccgcaugauccccuacccccucgagaagggccaccucuucuaccccuaccccaucugcaccgagaccgccgaccgcgagcuccuccccuccuuccacgaggucuccgucuaccccaagaaggagcuccccuucuucauccucuucaccgccggccucugcuccuucaccgccaugcucgcccuccucacccaccaguuccccgagcucaugggcgucuucgccaaggccuuccucuccacccucuucgccccccucaacuucgucauggagaaggucgaguccauccuccccuccucccucuggcaccagcucacccgcaucuga

SEQ ID NO: 50218 - RNA, 1560 nt, Artificial Sequence
  derived and/or modified sequence opt2 from ST7L__Homo_sapiens__XP_011539931
augucccccuuccucuuccgcgacgacaugaaggaccucaccgucuuccucaacucccucacccccaaguucuacgucgcccucaccggcaccuccucccucaucuccggccucaucuucaucuucgaguggugguacuuccacaagcacggcaccuccuucaucgagcaggucuccgucucccaccuccagccccucaugggcggcaccgaguccuccaucuccgagcccggcucccccucccgcaaccgcgagaacgagaccucccgccagaaccucuccgagugcaaggucuggcgcaacccccucaaccucuuccgcggcgccgaguaccgccgcuacaccugggucaccggcaaggagccccucaccuacuacgacaugaaccucuccgcccaggaccaccagaccuucuucaccugcgacaccgacuuccuccgccccuccgacaccgucaugcagaaggccuggcgcgagcgcaacccccccgcccgcaucaaggccgccuaccaggcccucgagcucaacaacgacugcgccaccgccuacguccuccucgccgaggaggaggccaccaccaucgucgacgccgagcgccucuucaagcaggcccucaaggccggcgagaccaucuaccgccagucccagcagugccagcaccaguccccccagcacgaggcccagcuccgccgcgacaccaacguccucgucuacaucaagcgccgccucgccaugugcgcccgcaagcucggccgcauccgcgaggccgucaagaucaugcgcgaccucaugaaggaguuccccccccucaccaugcucaacauccacgagaaccuccucgagucccuccucgagcuccaggccuaccccgacguccaggccguccucgccaaguacgacgacaucucccuccccaaguccgccgccaucugcuacaccgccgcccuccucaagacccgcaccgucuccgagaaguucucccccgagaccgccucccgccgcggccucuccaccgccgagaucaacgccgucgaggccauccaccgcgccgucgaguucaacccccacguccccaaguaccuccucgagaugaagucccucauccucccccccgagcacauccucaagcgcggcgacuccgaggccaucgccuacgccuucuuccaccuccagcacuggaagcgcaucgagggcgcccucaaccuccuccagugcaccugggagggcaccuuccgcaugauccccuacccccucgagaagggccaccucuucuaccccuaccccuccugcaccgagaccgccgaccgcgagcuccuccccaccuuccaccacgucuccgucuaccccaagaaggagcucccccucuucauccacuucaccgccggcuucugcuccuccaccgccaugaucgccauccucacccaccaguuccccgagaucaugggcaucuucgccaaggccguccucggccucuggugcccccagcccugggccuccuccggcuucgaggagaacacccaggaccucaaguccgaggaccucggccucuccuccggcuga

SEQ ID NO: 50219 - RNA, 642 nt, Artificial Sequence
  derived and/or modified sequence opt2 from ST8SIA1__Homo_sapiens__NP_001291379
augaccggcuccuucuacacccacuccccccucaccauccagcucacccucuccucccaccgcugcaaccuccccccccucuccuccgaguacaccaaggacgucggcuccaagucccagcucgucaccgccaaccccuccaucauccgccagcgcuuccagaaccuccucuggucccgcaagaccuucgucgacaacaugaagaucuacaaccacuccuacaucuacaugcccgccuucuccaugaagaccggcaccgagcccucccuccgcgucuacuacacccucuccgacgucggcgccaaccagaccguccucuucgccaaccccaacuuccuccgcuccaucggcaaguucuggaagucccgcggcauccacgccaagcgccucuccaccggccucuuccucgucuccgccgcccucggccucugcgaggaggucgccaucuacggcuucuggcccuucuccgucaacaugcacgagcagcccaucucccaccacuacuacgacaacguccuccccuucuccggcuuccacgccaugcccgaggaguuccuccagcucugguaccuccacaagaucggcgcccuccgcaugcagcucgaccccugcgaggacaccucccuccagcccaccuccuga

SEQ ID NO: 50220 - RNA, 1128 nt, Artificial Sequence
  derived and/or modified sequence opt2 from ST8SIA2__Homo_sapiens__NP_006002
augcagcuccaguuccgcuccuggaugcucgccgcccucacccuccucgucgucuuccucaucuucgccgacaucuccgagaucgaggaggagaucggcaacuccggcggccgcggcaccauccgcuccgccgucaacucccuccacuccaaguccaaccgcgccgaggucgucaucaacggcuccuccucccccgccgucgucgaccgcuccaacgaguccaucaagcacaacauccagcccgccuccuccaaguggcgccacaaccagacccucucccuccgcauccgcaagcagauccucaaguuccucgacgccgagaaggacaucuccguccucaagggcacccucaagcccggcgacaucauccacuacaucuucgaccgcgacuccaccaugaacgucucccagaaccucuacgagcuccucccccgcaccuccccccucaagaacaagcacuucggcaccugcgccaucgucggcaacuccggcguccuccucaacuccggcugcggccaggagaucgacgcccacuccuucgucauccgcugcaaccucgcccccguccaggaguacgcccgcgacgucggccucaagaccgaccucgucaccaugaaccccuccgucauccagcgcgccuucgaggaccucgucaacgccaccuggcgcgagaagcuccuccagcgccuccacucccucaacggcuccauccucuggauccccgccuucauggcccgcggcggcaaggagcgcgucgagugggucaacgagcucauccucaagcaccacgucaacguccgcaccgccuaccccucccuccgccuccuccacgccguccgcggcuacuggcucaccaacaagguccacaucaagcgccccaccaccggccuccucauguacacccucgccacccgcuucugcaagcagaucuaccucuacggcuucuggcccuucccccucgaccagaaccagaaccccgucaaguaccacuacuacgacucccucaaguacggcuacaccucccaggccuccccccacaccaugccccucgaguucaaggcccucaagucccuccacgagcagggcgcccucaagcucaccgucggccagugcgacggcgccaccuga

SEQ ID NO: 50221 - RNA, 1143 nt, Artificial Sequence
  derived and/or modified sequence opt2 from ST8SIA3__Homo_sapiens__NP_056963
augcgcaacugcaagauggcccgcgucgccuccguccucggccucgucaugcucuccgucgcccuccucauccucucccucaucuccuacgucucccucaagaaggagaacaucuucaccacccccaaguacgccucccccggcgccccccgcauguacauguuccacgccggcuuccgcucccaguucgcccucaaguuccucgaccccuccuucguccccaucaccaacucccucacccaggagcuccaggagaagcccuccaaguggaaguucaaccgcaccgccuuccuccaccagcgccaggagauccuccagcacgucgacgucaucaagaacuucucccucaccaagaacuccguccgcaucggccagcucaugcacuacgacuacuccucccacaaguacgucuucuccaucuccaacaacuuccgcucccuccuccccgacgucucccccaucaugaacaagcacuacaacaucugcgccgucgucggcaacuccggcauccucaccggcucccagugcggccaggagaucgacaaguccgacuucgucuuccgcugcaacuucgcccccaccgaggccuuccagcgcgacgucggccgcaagaccaaccucaccaccuucaaccccuccauccucgagaaguacuacaacaaccuccucaccauccaggaccgcaacaacuucuuccucucccucaagaagcucgacggcgccauccucuggauccccgccuucuucuuccacaccuccgccaccgucacccgcacccucgucgacuucuucgucgagcaccgcggccagcucaagguccagcucgccuggcccggcaacaucaugcagcacgucaaccgcuacuggaagaacaagcaccucucccccaagcgccucuccaccggcauccucauguacacccucgccuccgccaucugcgaggagauccaccucuacggcuucuggcccuucggcuucgaccccaacacccgcgaggaccuccccuaccacuacuacgacaagaagggcaccaaguucaccaccaaguggcaggagucccaccagcuccccgccgaguuccagcuccucuaccgcaugcacggcgagggccucaccaagcucacccucucccacugcgccuga

SEQ ID NO: 50222 - RNA, 1080 nt, Artificial Sequence
  derived and/or modified sequence opt2 from ST8SIA4__Homo_sapiens__NP_005659
augcgcuccauccgcaagcgcuggaccaucugcaccaucucccuccuccucaucuucuacaagaccaaggagaucgcccgcaccgaggagcaccaggagacccagcucaucggcgacggcgagcucucccucucccgcucccucgucaacuccuccgacaagaucauccgcaaggccggcuccuccaucuuccagcacaacgucgagggcuggaagaucaacuccucccucguccucgagauccgcaagaacauccuccgcuuccucgacgccgagcgcgacgucuccgucgucaaguccuccuucaagcccggcgacgucauccacuacguccucgaccgccgccgcacccucaacaucucccacgaccuccacucccuccuccccgaggucucccccaugaagaaccgccgcuucaagaccugcgccgucgucggcaacuccggcauccuccucgacuccgagugcggcaaggagaucgacucccacaacuucgucauccgcugcaaccucgcccccgucgucgaguucgccgccgacgucggcaccaaguccgacuucaucaccaugaaccccuccgucguccagcgcgccuucggcggcuuccgcaacgaguccgaccgcgagaaguucguccaccgccucuccaugcucaacgacuccguccucuggauccccgccuucauggucaagggcggcgagaagcacgucgagugggucaacgcccucauccucaagaacaagcucaagguccgcaccgccuaccccucccuccgccucauccacgccguccgcggcuacuggcucaccaacaagguccccaucaagcgccccuccaccggccuccucauguacacccucgccacccgcuucugcgacgagauccaccucuacggcuucuggcccuuccccaaggaccucaacggcaaggccgucaaguaccacuacuacgacgaccucaaguaccgcuacuucuccaacgccuccccccaccgcaugccccucgaguucaagacccucaacguccuccacaaccgcggcgcccucaagcucaccaccggcaagugcgucaagcaguga

SEQ ID NO: 50223 - RNA, 1197 nt, Artificial Sequence
  derived and/or modified sequence opt2 from ST8SIA6__Homo_sapiens__NP_001004470
augcgccccggcggcgcccuccucgcccuccucgccucccuccuccuccuccuccuccuccgccuccucuggugccccgccgacgcccccggccgcgcccgcauccucgucgaggagucccgcgaggccacccacggcacccccgccgcccuccgcacccuccgcucccccgccaccgccgucccccgcgccaccaacuccaccuaccucaacgagaagucccuccagcucaccgagaagugcaagaaccuccaguacggcaucgaguccuucuccaacaagaccaagggcuacuccgagaacgacuaccuccagaucaucaccgacauccaguccugccccuggaagcgccaggccgaggaguacgccaacuuccgcgccaagcucgccuccugcugcgacgccguccagaacuucgucgucucccagaacaacacccccgucggcaccaacauguccuacgaggucgaguccaagaaggagauccccaucaagaagaacaucuuccacauguuccccgucucccagcccuucgucgacuaccccuacaaccagugcgccgucgucggcaacggcggcauccucaacaagucccucugcggcaccgagaucgacaaguccgacuucgucuuccgcugcaaccucccccccaccaccggcgacgucuccaaggacgucggcuccaagaccaaccucgucaccaucaaccccuccaucaucacccucaaguacggcaaccucaaggagaagaaggcccucuuccucgaggacaucgccaccuacggcgacgccuucuuccuccuccccgccuucuccuuccgcgccaacaccggcaccuccuucaaggucuacuacacccucgaggaguccaaggcccgccagaagguccucuucuuccaccccaaguaccucaaggaccucgcccucuucuggcgcaccaagggcgucaccgccuaccgccucuccaccggccucaugaucaccuccgucgccgucgagcucugcaagaacgucaagcucuacggcuucuggcccuucuccaagaccgucgaggacauccccgucucccaccacuacuacgacaacaagcuccccaagcacggcuuccaccagaugcccaaggaguacucccagauccuccagcuccacaugaagggcauccucaagcuccaguucuccaagugcgaggucgccuga

SEQ ID NO: 50224 - RNA, 7713 nt, Artificial Sequence
  derived and/or modified sequence opt2 from STAB1__Homo_sapiens__NP_055951
auggccggcccccgcggccuccucccccucugccuccucgccuucugccucgccggcuucuccuucguccgcggccagguccucuucaagggcugcgacgucaagaccaccuucgucacccacguccccugcaccuccugcgccgccaucaagaagcagaccugccccuccggcuggcuccgcgagcuccccgaccagaucacccaggacugccgcuacgagguccagcucggcggcuccauggucuccauguccggcugccgccgcaagugccgcaagcaggucguccagaaggccugcugccccggcuacuggggcucccgcugccacgagugccccggcggcgccgagacccccugcaacggccacggcaccugccucgacggcauggaccgcaacggcaccugcgucugccaggagaacuuccgcggcuccgccugccaggagugccaggaccccaaccgcuucggccccgacugccaguccgucugcuccugcguccacggcgucugcaaccacggcccccgcggcgacggcuccugccucugcuucgccggcuacaccggcccccacugcgaccaggagcuccccgucugccaggagcuccgcugcccccagaacacccagugcuccgccgaggcccccuccugccgcugccuccccggcuacacccagcagggcuccgagugccgcgcccccaaccccugcuggcccucccccugcucccuccucgcccagugcuccgucucccccaagggccaggcccagugccacugccccgagaacuaccacggcgacggcauggucugccuccccaaggaccccugcaccgacaaccucggcggcugccccuccaacuccacccucugcgucuaccagaagcccggccaggccuucugcaccugccgccccggccucgucuccaucaacuccaacgccuccgccggcugcuucgccuucugcucccccuucuccugcgaccgcuccgccaccugccaggucaccgccgacggcaagaccuccugcgucugccgcgaguccgaggucggcgacggccgcgccugcuacggccaccuccuccacgagguccagaaggccacccagaccggccgcgucuuccuccagcuccgcgucgccgucgccaugauggaccagggcugccgcgagauccucaccaccgccggccccuucaccguccucguccccuccgucuccuccuucuccucccgcaccaugaacgccucccucgcccagcagcucugccgccagcacaucaucgccggccagcacauccucgaggacacccgcacccagcagacccgccgcugguggacccucgccggccaggagaucaccgucaccuucaaccaguucaccaaguacuccuacaaguacaaggaccagccccagcagaccuucaacaucuacaaggccaacaacaucgccgccaacggcgucuuccacgucgucaccggccuccgcuggcaggcccccuccggcacccccggcgaccccaagcgcaccaucggccagauccucgccuccaccgaggccuucucccgcuucgagaccauccucgagaacugcggccuccccuccauccucgacggccccggccccuucaccgucuucgcccccuccaacgaggccgucgacucccuccgcgacggccgccucaucuaccucuucaccgccggccucuccaagcuccaggagcucguccgcuaccacaucuacaaccacggccagcucaccgucgagaagcucaucuccaagggccgcauccucaccauggccaaccagguccucgccgucaacaucuccgaggagggccgcauccuccucggccccgagggcgucccccuccagcgcgucgacgucauggccgccaacggcgucauccacaugcucgacggcauccuccucccccccaccauccuccccauccuccccaagcacugcuccgaggagcagcacaagaucgucgccggcuccugcgucgacugccaggcccucaacaccuccaccugcccccccaacuccgucaagcucgacaucuuccccaaggagugcgucuacauccacgaccccaccggccucaacguccucaagaagggcugcgccuccuacugcaaccagaccaucauggagcagggcugcugcaagggcuucuucggccccgacugcacccagugccccggcggcuucuccaaccccugcuacggcaagggcaacugcuccgacggcauccagggcaacggcgccugccucugcuuccccgacuacaagggcaucgccugccacaucugcuccaaccccaacaagcacggcgagcagugccaggaggacugcggcugcguccacggccucugcgacaaccgccccggcuccggcggcgucugccagcagggcaccugcgcccccggcuucuccggccgcuucugcaacgaguccaugggcgacugcggccccaccggccucgcccagcacugccaccuccacgcccgcugcgucucccaggagggcgucgcccgcugccgcugccucgacggcuucgagggcgacggcuucuccugcacccccuccaaccccugcucccaccccgaccgcggcggcugcuccgagaacgccgagugcguccccggcucccucggcacccaccacugcaccugccacaagggcugguccggcgacggccgcgucugcgucgccaucgacgagugcgagcucgacaugcgcggcggcugccacaccgacgcccucugcuccuacgucggccccggccagucccgcugcaccugcaagcucggcuucgccggcgacggcuaccagugcucccccaucgaccccugccgcgccggcaacggcggcugccacggccucgccaccugccgcgccgucggcggcggccagcgcgucugcaccugcccccccggcuucggcggcgacggcuucuccugcuacggcgacaucuuccgcgagcucgaggccaacgcccacuucuccaucuucuaccaguggcucaaguccgccggcaucacccuccccgccgaccgccgcgucaccgcccucguccccuccgaggccgccguccgccagcucucccccgaggaccgcgccuucuggcuccagccccgcacccuccccaaccucguccgcgcccacuuccuccagggcgcccucuucgaggaggagcucgcccgccucggcggccaggaggucgccacccucaaccccaccacccgcugggagauccgcaacaucuccggccgcgucuggguccagaacgccuccgucgacgucgccgaccuccucgccaccaacggcguccuccacauccucucccagguccuccuccccccccgcggcgacguccccggcggccagggccuccuccagcagcucgaccucguccccgccuucucccucuuccgcgagcuccuccagcaccacggccucgucccccagaucgaggccgccaccgccuacaccaucuucguccccaccaaccgcucccucgaggcccagggcaacuccucccaccucgacgccgacaccguccgccaccacgucguccucggcgaggcccucuccauggagacccuccgcaagggcggccaccgcaacucccuccucggccccgcccacuggaucgucuucuacaaccacuccggccagcccgaggucaaccacgucccccucgagggccccaugcucgaggcccccggccgcucccucaucggccucuccggcguccucaccgucggcuccucccgcugccuccacucccacgccgaggcccuccgcgagaagugcgucaacugcacccgccgcuuccgcugcacccagggcuuccagcuccaggacaccccccgcaaguccugcgucuaccgcuccggcuucuccuucucccgcggcugcuccuacaccugcgccaagaagauccagguccccgacugcugccccggcuucuucggcacccucugcgagcccugccccggcggccucggcggcgucugcuccggccacggccagugccaggaccgcuuccucggcuccggcgagugccacugccacgagggcuuccacggcaccgccugcgaggucugcgagcucggccgcuacggccccaacugcaccggcgucugcgacugcgcccacggccucugccaggagggccuccagggcgacggcuccugcgucugcaacgucggcuggcagggccuccgcugcgaccagaagaucaccuccccccagugcccccgcaagugcgaccccaacgccaacugcguccaggacuccgccggcgccuccaccugcgccugcgccgccggcuacuccggcaacggcaucuucugcuccgaggucgaccccugcgcccacggccacggcggcugcuccccccacgccaacugcaccaaggucgcccccggccagcgcaccugcaccugccaggacggcuacaugggcgacggcgagcucugccaggagaucaacuccugccucauccaccacggcggcugccacauccacgccgagugcauccccaccggcccccagcaggucuccugcuccugccgcgagggcuacuccggcgacggcauccgcaccugcgagcuccucgaccccugcuccaagaacaacggcggcugcucccccuacgccaccugcaaguccaccggcgacggccagcgcaccugcaccugcgacaccgcccacaccgucggcgacggccucaccugccgcgcccgcgucggccucgagcuccuccgcgacaagcacgccuccuucuucucccuccgccuccucgaguacaaggagcucaagggcgacggccccuucaccaucuucgucccccacgccgaccucauguccaaccucucccaggacgagcucgcccgcauccgcgcccaccgccagcucgucuuccgcuaccacgucgucggcugccgccgccuccgcuccgaggaccuccucgagcagggcuacgccaccgcccucuccggccacccccuccgcuucuccgagcgcgagggcuccaucuaccucaacgacuucgcccgcgucgucuccuccgaccacgaggccgucaacggcauccuccacuucaucgaccgcguccuccucccccccgaggcccuccacugggagcccgacgacgcccccaucccccgccgcaacgucaccgccgccgcccagggcuucggcuacaagaucuucuccggccuccucaaggucgccggccuccucccccuccuccgcgaggccucccaccgccccuucaccaugcucuggcccaccgacgccgccuuccgcgcccucccccccgaccgccaggccuggcucuaccacgaggaccaccgcgacaagcucgccgccauccuccgcggccacaugauccgcaacgucgaggcccucgccuccgaccuccccaaccucggcccccuccgcaccaugcacggcacccccaucuccuucuccugcucccgcacccgcgccggcgagcucauggucggcgaggacgacgcccgcaucguccagcgccaccuccccuucgagggcggccucgccuacggcaucgaccagcuccucgagccccccggccucggcgcccgcugcgaccacuucgagacccgcccccuccgccucaacaccugcuccaucugcggccucgagccccccugccccgagggcucccaggagcagggcucccccgaggccugcuggcgcuucuaccccaaguucuggaccucccccccccuccacucccucggccuccgcuccgucuggguccaccccucccucuggggccgcccccagggccucggccgcggcugccaccgcaacugcgucaccaccaccuggaagcccuccugcugccccggccacuacggcuccgagugccaggccugccccggcggccccuccucccccugcuccgaccgcggcgucugcauggacggcauguccggcuccggccagugccucugccgcuccggcuucgccggcaccgccugcgagcucugcgcccccggcgccuucggcccccacugccaggccugccgcugcaccguccacggccgcugcgacgagggccucggcggcuccggcuccugcuucugcgacgagggcuggaccggcccccgcugcgagguccagcucgagcuccagcccgucugcaccccccccugcgcccccgaggccgucugccgcgccggcaacuccugcgagugcucccucggcuacgagggcgacggccgcgucugcaccgucgccgaccucugccaggacggccacggcggcugcuccgagcacgccaacugcucccaggucggcaccauggucaccugcaccugccuccccgacuacgagggcgacggcugguccugccgcgcccgcaaccccugcaccgacggccaccgcggcggcugcuccgagcacgccaacugccucuccaccggccucaacacccgccgcugcgagugccacgccggcuacgucggcgacggccuccagugccucgaggaguccgagccccccgucgaccgcugccucggccagcccccccccugccacuccgacgccaugugcaccgaccuccacuuccaggagaagcgcgccggcgucuuccaccuccaggccaccuccggccccuacggccucaacuucuccgaggccgaggccgccugcgaggcccagggcgccguccucgccuccuucccccagcucuccgccgcccagcagcucggcuuccaccucugccucaugggcuggcucgccaacggcuccaccgcccaccccgucgucuuccccgucgccgacugcggcaacggccgcgucggcaucgucucccucggcgcccgcaagaaccucuccgagcgcugggacgccuacugcuuccgcguccaggacgucgccugccgcugccgcaacggcuucgucggcgacggcaucuccaccugcaacggcaagcuccucgacguccucgccgccaccgccaacuucuccaccuucuacggcaugcuccucggcuacgccaacgccacccagcgcggccucgacuuccucgacuuccucgacgacgagcucaccuacaagacccucuucguccccgucaacgagggcuucgucgacaacaugacccucuccggccccgaccucgagcuccacgccuccaacgccacccuccucuccgccaacgccucccagggcaagcuccuccccgcccacuccggccucucccucaucaucuccgacgccggccccgacaacuccuccugggcccccgucgcccccggcaccgucgucgucucccgcaucaucgucugggacaucauggccuucaacggcaucauccacgcccucgccuccccccuccucgcccccccccagccccaggccguccucgcccccgaggccccccccgucgccgccggcgucggcgccguccucgccgccggcgcccuccucggccucgucgccggcgcccucuaccuccgcgcccgcggcaagcccaugggcuucggcuucuccgccuuccaggccgaggacgacgccgacgacgacuucucccccuggcaggagggcaccaaccccacccucgucuccguccccaaccccgucuucggcuccgacaccuucugcgagcccuucgacgacucccuccucgaggaggacuuccccgacacccagcgcauccucaccgucaaguga

SEQ ID NO: 50225 - RNA, 7656 nt, Artificial Sequence
  derived and/or modified sequence opt2 from STAB2__Homo_sapiens__NP_060034
augaugcuccagcaccucgucaucuucugccucggccucgucguccagaacuucugcucccccgccgagaccaccggccaggcccgccgcugcgaccgcaagucccuccucaccauccgcaccgagugccgcuccugcgcccucaaccucggcgucaagugccccgacggcuacaccaugaucaccuccggcuccgucggcguccgcgacugccgcuacaccuucgagguccgcaccuacucccucucccuccccggcugccgccacaucugccgcaaggacuaccuccagccccgcugcugccccggccgcuggggccccgacugcaucgagugccccggcggcgccggcucccccugcaacggccgcggcuccugcgccgagggcauggagggcaacggcaccugcuccugccaggagggcuucggcggcaccgccugcgagaccugcgccgacgacaaccucuucggccccuccugcuccuccgucugcaacugcguccacggcgucugcaacuccggccucgacggcgacggcaccugcgagugcuacuccgccuacaccggccccaagugcgacaagcccauccccgagugcgccgcccuccucugccccgagaacucccgcugcucccccuccaccgaggacgagaacaagcucgagugcaagugccuccccaacuaccgcggcgacggcaaguacugcgaccccaucaaccccugccuccgcaagaucugccacccccacgcccacugcaccuaccucggccccaaccgccacuccugcaccugccaggagggcuaccgcggcgacggccaggucugccuccccgucgaccccugccagaucaacuucggcaacugccccaccaaguccaccgucugcaaguacgacggccccggccagucccacugcgagugcaaggagcacuaccagaacuucguccccggcgucggcugcuccaugaccgacaucugcaaguccgacaaccccugccaccgcaacgccaacugcaccaccgucgcccccggccgcaccgagugcaucugccagaagggcuacgucggcgacggccucaccugcuacggcaacaucauggagcgccuccgcgagcucaacaccgagccccgcggcaaguggcagggccgccucaccuccuucaucucccuccucgacaaggccuacgccuggccccucuccaagcucggccccuucaccguccuccuccccaccgacaagggccucaagggcuucaacgucaacgagcuccucgucgacaacaaggccgcccaguacuucgucaagcuccacaucaucgccggccagaugaacaucgaguacaugaacaacaccgacauguucuacacccucaccggcaaguccggcgagaucuucaacuccgacaaggacaaccagaucaagcucaagcuccacggcggcaagaagaaggucaagaucauccagggcgacaucaucgccuccaacggccuccuccacauccucgaccgcgccauggacaagcucgagcccaccuucgaguccaacaacgagcagaccaucaugaccaugcuccagccccgcuacuccaaguuccgcucccuccucgaggagaccaaccucggccacgcccucgacgaggacggcgucggcggccccuacaccaucuucguccccaacaacgaggcccucaacaacaugaaggacggcacccucgacuaccuccucucccccgagggcucccgcaagcuccucgagcucguccgcuaccacaucguccccuucacccagcucgaggucgccacccucaucuccaccccccacauccgcuccauggccaaccagcucauccaguucaacaccaccgacaacggccagauccucgccaacgacgucgccauggaggagaucgagaucaccgccaagaacggccgcaucuacacccucaccggcguccucaucccccccuccaucguccccauccucccccaccgcugcgacgagaccaagcgcgagaugaagcucggcaccugcgucuccugcucccucgucuacuggucccgcugccccgccaacuccgagcccaccgcccucuucacccaccgcugcgucuacuccggccgcuucggcucccucaaguccggcugcgcccgcuacugcaacgccaccgucaagauccccaagugcugcaagggcuucuacggccccgacugcaaccagugccccggcggcuucuccaaccccugcuccggcaacggccagugcgccgacucccucggcggcaacggcaccugcaucugcgaggagggcuuccagggcucccagugccaguucugcuccgaccccaacaaguacggcccccgcugcaacaagaagugccucugcguccacggcaccugcaacaaccgcaucgacuccgacggcgccugccucaccggcaccugccgcgacggcuccgccggccgccucugcgacaagcagaccuccgccugcggccccuacguccaguucugccacauccacgccaccugcgaguacuccaacggcaccgccuccugcaucugcaaggccggcuacgagggcgacggcacccucugcuccgagauggaccccugcaccggccucacccccggcggcugcucccgcaacgccgagugcaucaagaccggcaccggcacccacaccugcgucugccagcagggcuggaccggcaacggccgcgacugcuccgagaucaacaacugccuccuccccuccgccggcggcugccacgacaacgccuccugccucuacgucggccccggccagaacgagugcgagugcaagaagggcuuccgcggcaacggcaucgacugcgagcccaucaccuccugccucgagcagaccggcaagugccacccccucgccuccugccaguccaccuccuccggcgucugguccugcgucugccaggagggcuacgagggcgacggcuuccucugcuacggcaacgccgccgucgagcucuccuuccucuccgaggccgccaucuucaaccgcuggaucaacaacgccucccuccagcccacccucuccgccaccuccaaccucaccguccucguccccucccagcaggccaccgaggacauggaccaggacgagaaguccuucuggcucucccaguccaacauccccgcccucaucaaguaccacaugcuccucggcaccuaccgcgucgccgaccuccagacccucuccuccuccgacaugcucgccaccucccuccagggcaacuuccuccaccucgccaaggucgacggcaacaucaccaucgagggcgccuccaucgucgacggcgacaacgccgccaccaacggcgucauccacaucaucaacaagguccucgucccccagcgccgccucaccggcucccuccccaaccuccucaugcgccucgagcagaugcccgacuacuccaucuuccgcggcuacaucauccaguacaaccucgccaacgccaucgaggccgccgacgccuacaccgucuucgcccccaacaacaacgccaucgagaacuacauccgcgagaagaagguccucucccucgaggaggacguccuccgcuaccacgucguccucgaggagaagcuccucaagaacgaccuccacaacggcaugcaccgcgagaccaugcucggcuucuccuacuuccucuccuucuuccuccacaacgaccagcucuacgucaacgaggcccccaucaacuacaccaacgucgccaccgacaagggcgucauccacggccucggcaagguccucgagauccagaagaaccgcugcgacaacaacgacaccaccaucauccgcggccgcugccgcaccugcuccuccgagcucaccugccccuucggcaccaagucccucggcaacgagaagcgccgcugcaucuacaccuccuacuucaugggccgccgcacccucuucaucggcugccagcccaagugcguccgcaccgucaucacccgcgagugcugcgccggcuucuucggcccccagugccagcccugccccggcaacgcccagaacgucugcuucggcaacggcaucugccucgacggcgucaacggcaccggcgucugcgagugcggcgagggcuucuccggcaccgccugcgagaccugcaccgagggcaaguacggcauccacugcgaccaggccugcuccugcguccacggccgcugcaaccagggcccccucggcgacggcuccugcgacugcgacgucggcuggcgcggcguccacugcgacaacgccaccaccgaggacaacugcaacggcaccugccacaccuccgccaacugccucaccaacuccgacggcaccgccuccugcaagugcgccgccggcuuccagggcaacggcaccaucugcaccgccaucaacgccugcgagaucuccaacggcggcugcuccgccaaggccgacugcaagcgcaccacccccggccgccgcgucugcaccugcaaggccggcuacaccggcgacggcaucgucugccucgagaucaaccccugccucgagaaccacggcggcugcgacaagaacgccgagugcacccagaccggccccaaccaggccgccugcaacugccuccccgccuacaccggcgacggcaaggucugcacccucaucaacgucugccucaccaagaacggcggcugcuccgaguucgccaucugcaaccacaccggccaggucgagcgcaccugcaccugcaagcccaacuacaucggcgacggcuucaccugccgcggcuccaucuaccaggagcuccccaagaaccccaagaccucccaguacuucuuccagcuccaggagcacuucgucaaggaccucgucggccccggccccuucaccgucuucgccccccucuccgccgccuucgacgaggaggcccgcgucaaggacugggacaaguacggccucaugccccagguccuccgcuaccacgucgucgccugccaccagcuccuccucgagaaccucaagcucaucuccaacgccaccucccuccagggcgagcccaucgucaucuccgucucccaguccaccgucuacaucaacaacaaggccaagaucaucuccuccgacaucaucuccaccaacggcaucguccacaucaucgacaagcuccucucccccaagaaccuccucaucacccccaaggacaacuccggccgcauccuccagaaccucaccacccucgccaccaacaacggcuacaucaaguucuccaaccucauccaggacuccggccuccucuccgucaucaccgaccccauccacacccccgucacccucuucuggcccaccgaccaggcccuccacgcccuccccgccgagcagcaggacuuccucuucaaccaggacaacaaggacaagcucaaggaguaccucaaguuccacgucauccgcgacgccaagguccucgccgucgaccuccccaccuccaccgccuggaagacccuccagggcuccgagcucuccgucaagugcggcgccggccgcgacaucggcgaccucuuccucaacggccagaccugccgcaucguccagcgcgagcuccucuucgaccucggcgucgccuacggcaucgacugccuccucaucgaccccacccucggcggccgcugcgacaccuucaccaccuucgacgccuccggcgagugcggcuccugcgucaacacccccuccugcccccgcugguccaagcccaagggcgucaagcagaagugccucuacaaccuccccuucaagcgcaaccucgagggcugccgcgagcgcugcucccucgucauccagaucccccgcugcugcaagggcuacuucggccgcgacugccaggccugccccggcggccccgacgcccccugcaacaaccgcggcgucugccucgaccaguacuccgccaccggcgagugcaagugcaacaccggcuucaacggcaccgccugcgagaugugcuggcccggccgcuucggccccgacugccuccccugcggcugcuccgaccacggccagugcgacgacggcaucaccggcuccggccagugccucugcgagaccggcuggaccggccccuccugcgacacccaggccguccuccccgccgucugcaccccccccugcuccgcccacgccaccugcaaggagaacaacaccugcgagugcaaccucgacuacgagggcgacggcaucaccugcaccgucgucgacuucugcaagcaggacaacggcggcugcgccaaggucgcccgcugcucccagaagggcaccaaggucuccugcuccugccagaagggcuacaagggcgacggccacuccugcaccgagaucgaccccugcgccgacggccucaacggcggcugccacgagcacgccaccugcaagaugaccggccccggcaagcacaagugcgagugcaagucccacuacgucggcgacggccucaacugcgagcccgagcagcuccccaucgaccgcugccuccaggacaacggccagugccacgccgacgccaagugcgucgaccuccacuuccaggacaccaccgucggcgucuuccaccuccgcuccccccucggccaguacaagcucaccuucgacaaggcccgcgaggccugcgccaacgaggccgccaccauggccaccuacaaccagcucuccuacgcccagaaggccaaguaccaccucugcuccgccggcuggcucgagaccggccgcgucgccuaccccaccgccuucgccucccagaacugcggcuccggcgucgucggcaucgucgacuacggcccccgccccaacaaguccgagaugugggacgucuucugcuaccgcaugaaggacgucaacugcaccugcaaggucggcuacgucggcgacggcuucuccugcuccggcaaccuccuccagguccucauguccuuccccucccucaccaacuuccucaccgagguccucgccuacuccaacuccuccgcccgcggccgcgccuuccucgagcaccucaccgaccucuccauccgcggcacccucuucgucccccagaacuccggccucggcgagaacgagacccucuccggccgcgacaucgagcaccaccucgccaacgucuccauguucuucuacaacgaccucgucaacggcaccacccuccagacccgccucggcuccaagcuccucaucaccgccucccaggacccccuccagcccaccgagacccgcuucgucgacggccgcgccauccuccagugggacaucuucgccuccaacggcaucauccacgucaucucccgcccccucaaggccccccccgcccccgucacccucacccacaccggccucggcgccggcaucuucuucgccaucauccucgucaccggcgccgucgcccucgccgccuacuccuacuuccgcaucaaccgccgcaccaucggcuuccagcacuucgaguccgaggaggacaucaacgucgccgcccucggcaagcagcagcccgagaacaucuccaacccccucuacgaguccaccaccuccgccccccccgagcccuccuacgaccccuucaccgacuccgaggagcgccagcucgagggcaacgacccccuccgcacccucuga

SEQ ID NO: 50226 - RNA, 978 nt, Artificial Sequence
  derived and/or modified sequence opt2 from STAC3__Homo_sapiens__NP_001273185
auggagcucccccccgagccccaggccaacggcgaggccgucggcgccggcggcggccccaucuacuacaucuacgaggaggaggaggaggaggaggaggaggaggaggagcccccccccgagccccccaagcucgucaacgacaagccccacaaguucaaggaccacuucuucaagaagcccaaguucugcgacgucugcgcccgcaugaucguccucaacaacaaguucggccuccgcugcaagaacugcaagaccaacauccacgagcacugccaguccuacgucgagaugcagcgcugcuucggcaagaucccccccggcuuccaccgcgccuacuccuccccccucuacuccaaccagcaguacgccugcgucaaggaccucuccgccgccaaccgcaacgaccccgucuucgagacccuccgcaccggcgucaucauggccaacaaggagcgcaagaagggccaggccgacaagaagaaccccgucgccgccaugauggaggaggagcccgaguccgcccgccccgaggagggcaagccccaggacggcaaccccgagggcgacaagaaggccgagaagaagacccccgacgacaagcacaagcagcccggcuuccagcagucccacuacuucgucgcccucuaccgcuucaaggcccucgagaaggacgaccucgacuucccccccggcgagaagaucaccgucaucgacgacuccaacgaggagugguggcgcggcaagaucggcgagaaggucggcuucuucccccccaacuucaucauccgcguccgcgccggcgagcgcguccaccgcgucacccgcuccuucgucggcaaccgcgagaucggccagaucacccucaagaaggaccagaucgucguccagaagggcgacgaggccggcggcuacgucaaggucuacaccggccgcaaggucggccucuuccccaccgacuuccucgaggagaucuga

SEQ ID NO: 50227 - RNA, 1209 nt, Artificial Sequence
  derived and/or modified sequence opt2 from STAC__Homo_sapiens__NP_003140
augaucccccccuccuccccccgcgaggacggcgucgacggccuccccaaggaggccgucggcgccgagcagccccccucccccgccuccaccuccucccaggaguccaagcuccagaagcucaagcgcucccucuccuucaagaccaagucccuccgcuccaaguccgccgacaacuucuuccagcgcaccaacuccgaggacaugaagcuccaggcccacauggucgccgagaucucccccuccuccuccccccuccccgcccccggcucccucaccuccacccccgcccgcgccggccuccaccccggcggcaaggcccacgccuuccaggaguacaucuucaagaagcccaccuucugcgacgucugcaaccacaugaucgucggcaccaacgccaagcacggccuccgcugcaaggccugcaagauguccauccaccacaagugcaccgacggccucgccccccagcgcugcaugggcaagcuccccaagggcuuccgccgcuacuacuccuccccccuccucauccacgagcaguucggcugcaucaaggaggucaugcccaucgccugcggcaacaaggucgaccccgucuacgagacccuccgcuucggcaccucccucgcccagcgcaccaagaagggcuccuccggcuccggcuccgacuccccccaccgcaccuccaccuccgaccucgucgagguccccgaggaggccaacggccccggcggcggcuacgaccuccgcaagcgcuccaacuccgucuucaccuaccccgagaacggcaccgacgacuuccgcgaccccgccaagaacaucaaccaccagggcucccucuccaaggacccccuccagaugaacaccuacgucgcccucuacaaguucgucccccaggagaacgaggaccucgagaugcgccccggcgacaucaucacccuccucgaggacuccaacgaggacugguggaagggcaagauccaggaccgcaucggcuucuuccccgccaacuucguccagcgccuccagcagaacgagaagaucuuccgcugcguccgcaccuucaucggcugcaaggagcagggccagaucacccucaaggagaaccagaucugcgucuccuccgaggaggagcaggacggcuucauccgcguccucuccggcaagaagaagggccucaucccccucgacguccucgagaacaucuga

SEQ ID NO: 50228 - RNA, 3777 nt, Artificial Sequence
  derived and/or modified sequence opt2 from STAG1__Homo_sapiens__NP_005853
augaucaccuccgagcuccccguccuccaggacuccaccaacgagaccaccgcccacuccgacgccggcuccgagcucgaggagaccgaggucaagggcaagcgcaagcgcggccgccccggccgcccccccuccaccaacaagaagccccgcaagucccccggcgagaagucccgcaucgaggccggcauccgcggcgccggccgcggccgcgccaacggccacccccagcagaacggcgagggcgagcccgucacccucuucgaggucgucaagcucggcaaguccgccaugcaguccgucgucgacgacuggaucgaguccuacaagcaggaccgcgacaucgcccuccucgaccucaucaacuucuucauccagugcuccggcugccgcggcaccguccgcaucgagauguuccgcaacaugcagaacgccgagaucauccgcaagaugaccgaggaguucgacgaggacuccggcgacuacccccucaccaugcccggcccccaguggaagaaguuccgcuccaacuucugcgaguucaucggcguccucauccgccagugccaguacuccaucaucuacgacgaguacaugauggacaccgucaucucccuccucaccggccucuccgacucccagguccgcgccuuccgccacaccuccacccucgccgccaugaagcucaugaccgcccucgucaacgucgcccucaaccucuccauccaccaggacaacacccagcgccaguacgaggccgagcgcaacaagaugaucggcaagcgcgccaacgagcgccucgagcuccuccuccagaagcgcaaggagcuccaggagaaccaggacgagaucgagaacaugaugaacuccaucuucaagggcaucuucguccaccgcuaccgcgacgccaucgccgagauccgcgccaucugcaucgaggagaucggcgucuggaugaagauguacuccgacgccuuccucaacgacuccuaccucaaguacgucggcuggacccuccacgaccgccagggcgagguccgccucaagugccucaaggcccuccagucccucuacaccaaccgcgagcucuuccccaagcucgagcucuucaccaaccgcuucaaggaccgcaucgucuccaugacccucgacaaggaguacgacgucgccgucgaggccauccgccucgucacccucauccuccacggcuccgaggaggcccucuccaacgaggacugcgagaacgucuaccaccucgucuacuccgcccaccgccccgucgccgucgccgccggcgaguuccuccacaagaagcucuucucccgccacgacccccaggccgaggaggcccucgccaagcgccgcggccgcaacucccccaacggcaaccucauccgcaugcucguccucuucuuccucgaguccgagcuccacgagcacgccgccuaccucgucgacucccucugggaguccucccaggagcuccucaaggacugggagugcaugaccgagcuccuccucgaggagcccguccagggcgaggaggccauguccgaccgccaggaguccgcccucaucgagcucauggucugcaccauccgccaggccgccgaggcccacccccccgucggccgcggcaccggcaagcgcguccucaccgccaaggagcgcaagacccagaucgacgaccgcaacaagcucaccgagcacuucaucaucacccuccccaugcuccucuccaaguacuccgccgacgccgagaaggucgccaaccuccuccagaucccccaguacuucgaccucgagaucuacuccaccggccgcauggagaagcaccucgacgcccuccucaagcagaucaaguucgucgucgagaagcacgucgaguccgacguccucgaggccugcuccaagaccuacuccauccucugcuccgaggaguacaccauccagaaccgcgucgacaucgcccgcucccagcucaucgacgaguucgucgaccgcuucaaccacuccgucgaggaccuccuccaggagggcgaggaggccgacgacgacgacaucuacaacguccucuccacccucaagcgccucaccuccuuccacaacgcccacgaccucaccaagugggaccucuucggcaacugcuaccgccuccucaagaccggcaucgagcacggcgccaugcccgagcagaucgucguccaggcccuccagugcucccacuacuccauccucuggcagcucgucaagaucaccgacggcucccccuccaaggaggaccuccucguccuccgcaagaccgucaaguccuuccucgccgucugccagcagugccucuccaacgucaacacccccgucaaggagcaggccuucaugcuccucugcgaccuccucaugaucuucucccaccagcucaugaccggcggccgcgagggccuccagccccucgucuucaaccccgacaccggccuccaguccgagcuccucuccuucgucauggaccacgucuucaucgaccaggacgaggagaaccaguccauggagggcgacgaggaggacgaggccaacaagaucgaggcccuccacaagcgccgcaaccuccucgccgccuucuccaagcucaucaucuacgacaucgucgacaugcacgccgccgccgacaucuucaagcacuacaugaaguacuacaacgacuacggcgacaucaucaaggagacccucuccaagacccgccagaucgacaagauccagugcgccaagacccucauccucucccuccagcagcucuucaacgagcucguccaggagcagggccccaaccucgaccgcaccuccgcccacgucuccggcaucaaggagcucgcccgccgcuucgcccucaccuucggccucgaccagaucaagacccgcgaggccgucgccacccuccacaaggacggcaucgaguucgccuucaaguaccagaaccagaagggccaggaguaccccccccccaaccucgccuuccucgagguccucuccgaguucuccuccaagcuccuccgccaggacaagaagaccguccacuccuaccucgagaaguuccucaccgagcagaugauggagcgccgcgaggacgucuggcucccccucaucuccuaccgcaacucccucgucaccggcggcgaggacgaccgcauguccgucaacuccggcuccuccuccuccaagaccuccuccguccgcaacaagaagggccgccccccccuccacaagaagcgcgucgaggacgagucccucgacaacaccuggcucaaccgcaccgacaccaugauccagacccccggcccccuccccgccccccagcucaccuccaccguccuccgcgagaacucccgccccaugggcgaccagauccaggagcccgaguccgagcacggcuccgagcccgacuuccuccacaacccccagaugcagaucuccuggcucggccagcccaagcucgaggaccucaaccgcaaggaccgcaccggcaugaacuacaugaagguccgcaccggcguccgccacgccguccgcggccucauggaggaggacgccgagcccaucuucgaggacgucaugauguccucccgcucccagcucgaggacaugaacgaggaguucgaggacaccauggucaucgaccucccccccucccgcaaccgccgcgagcgcgccgagcuccgccccgacuucuucgacuccgccgccaucaucgaggacgacuccggcuucggcaugcccauguucuga

SEQ ID NO: 50229 - RNA, 3807 nt, Artificial Sequence
  derived and/or modified sequence opt2 from STAG2__Homo_sapiens__NP_001036215
augaucgccgcccccgagauccccaccgacuucaaccuccuccaggaguccgagacccacuucuccuccgacaccgacuucgaggacaucgagggcaagaaccagaagcagggcaagggcaagaccugcaagaagggcaagaagggccccgccgagaagggcaagggcggcaacggcggcggcaagccccccuccggccccaaccgcaugaacggccaccaccagcagaacggcgucgagaacaugaugcucuucgaggucgucaagaugggcaaguccgccaugcaguccgucgucgacgacuggaucgaguccuacaagcacgaccgcgacaucgcccuccucgaccucaucaacuucuucauccagugcuccggcugcaagggcgucgucaccgccgagauguuccgccacaugcagaacuccgagaucauccgcaagaugaccgaggaguucgacgaggacuccggcgacuacccccucaccauggccggcccccaguggaagaaguucaaguccuccuucugcgaguucaucggcguccucguccgccagugccaguacuccaucaucuacgacgaguacaugauggacaccgucaucucccuccucaccggccucuccgacucccagguccgcgccuuccgccacaccuccacccucgccgccaugaagcucaugaccgcccucgucaacgucgcccucaaccucuccaucaacauggacaacacccagcgccaguacgaggccgagcgcaacaagaugaucggcaagcgcgccaacgagcgccucgagcuccuccuccagaagcgcaaggagcuccaggagaaccaggacgagaucgagaacaugaugaacgccaucuucaagggcgucuucguccaccgcuaccgcgacgccaucgccgagauccgcgccaucugcaucgaggagaucggcaucuggaugaagauguacuccgacgccuuccucaacgacuccuaccucaaguacgucggcuggaccaugcacgacaagcagggcgagguccgccucaagugccucaccgcccuccagggccucuacuacaacaaggagcucaacuccaagcucgagcucuucaccucccgcuucaaggaccgcaucgucuccaugacccucgacaaggaguacgacgucgccguccaggccaucaagcuccucacccucguccuccaguccuccgaggagguccucaccgccgaggacugcgagaacgucuaccaccucgucuacuccgcccaccgccccgucgccgucgccgccggcgaguuccucuacaagaagcucuucucccgccgcgaccccgaggaggacggcaugaugaagcgccgcggccgccagggccccaacgccaaccucgucaagacccucgucuucuucuuccucgaguccgagcuccacgagcacgccgccuaccucgucgacuccaugugggacugcgccaccgagcuccucaaggacugggagugcaugaacucccuccuccucgaggagccccucuccggcgaggaggcccucaccgaccgccaggaguccgcccucaucgagaucaugcucugcaccauccgccaggccgccgagugccacccccccgucggccgcggcaccggcaagcgcguccucaccgccaaggagaagaagacccagcucgacgaccgcaccaagaucaccgagcucuucgccgucgcccucccccagcuccucgccaaguacuccgucgacgccgagaaggucaccaaccuccuccagcucccccaguacuucgaccucgagaucuacaccaccggccgccucgagaagcaccucgacgcccuccuccgccagauccgcaacaucgucgagaagcacaccgacaccgacguccucgaggccugcuccaagaccuaccacgcccucugcaacgaggaguucaccaucuucaaccgcgucgacaucucccgcucccagcucaucgacgagcucgccgacaaguucaaccgccuccucgaggacuuccuccaggagggcgaggagcccgacgaggacgacgccuaccagguccucuccacccucaagcgcaucaccgccuuccacaacgcccacgaccucuccaagugggaccucuucgccugcaacuacaagcuccucaagaccggcaucgagaacggcgacaugcccgagcagaucgucauccacgcccuccagugcacccacuacgucauccucuggcagcucgccaagaucaccgaguccuccuccaccaaggaggaccuccuccgccucaagaagcagaugcgcgucuucugccagaucugccagcacuaccucaccaacgucaacaccaccgucaaggagcaggccuucaccauccucugcgacauccucaugaucuucucccaccagaucauguccggcggccgcgacaugcucgagccccucgucuacacccccgacuccucccuccaguccgagcuccucuccuucauccucgaccacgucuucaucgagcaggacgacgacaacaacuccgccgacggccagcaggaggacgaggccuccaagaucgaggcccuccacaagcgccgcaaccuccucgccgccuucugcaagcucaucgucuacaccgucgucgagaugaacaccgccgccgacaucuucaagcaguacaugaaguacuacaacgacuacggcgacaucaucaaggagaccauguccaagacccgccagaucgacaagauccagugcgccaagacccucauccucucccuccagcagcucuucaacgagaugauccaggagaacggcuacaacuucgaccgcuccuccuccaccuucuccggcaucaaggagcucgcccgccgcuucgcccucaccuucggccucgaccagcucaagacccgcgaggccaucgccaugcuccacaaggacggcaucgaguucgccuucaaggagcccaacccccagggcgagucccaccccccccucaaccucgccuuccucgacauccucuccgaguucuccuccaagcuccuccgccaggacaagcgcaccgucuacgucuaccucgagaaguucaugaccuuccagaugucccuccgccgcgaggacgucuggcucccccucauguccuaccgcaacucccuccucgccggcggcgacgacgacaccauguccgucaucuccggcaucuccucccgcggcuccaccguccgcuccaagaaguccaagcccuccaccggcaagcgcaaggucgucgagggcaugcagcucucccucaccgaggaguccuccuccuccgacuccauguggcucucccgcgagcagacccuccacacccccgucaugaugcagaccccccagcucaccuccaccaucaugcgcgagcccaagcgccuccgccccgaggacuccuucauguccgucuaccccaugcagaccgagcaccaccagaccccccucgacuacaacacccaggucaccuggaugcucgcccagcgccagcaggaggaggcccgccagcagcaggagcgcgccgccauguccuacgucaagcuccgcaccaaccuccagcacgccauccgccgcggcaccucccucauggaggacgacgaggagcccaucgucgaggacgucaugauguccuccgagggccgcaucgaggaccucaacgagggcauggacuucgacaccauggacaucgaccucccccccuccaagaaccgccgcgagcgcaccgagcucaagcccgacuucuucgaccccgccuccaucauggacgaguccguccucggcgucuccauguucuga

SEQ ID NO: 50230 - RNA, 3681 nt, Artificial Sequence
  derived and/or modified sequence opt2 from STAG3__Homo_sapiens__NP_001269646
auguccuccccccuccagcgcgccgucggcgacaccaagcgcgcccucuccgccuccuccuccuccuccgccucccuccccuucgacgaccgcgacuccaaccacaccuccgagggcaacggcgacucccuccucgccgacgaggacaccgacuucgaggacucccucaaccgcaacgucaagaagcgcgccgccaagcgcccccccaagaccacccccgucgccaagcaccccaagaagggcucccgcgucguccaccgccacucccgcaagcaguccgagccccccgccaacgaccucuucaacgccgucaaggccgccaaguccgacaugcagucccucgucgacgaguggcucgacuccuacaagcaggaccaggacgccggcuuccucgagcucgucaacuucuucauccaguccugcggcugcaagggcaucgucacccccgagauguucaagaagauguccaacuccgagaucauccagcaccucaccgagcaguucaacgaggacuccggcgacuacccccucaucgcccccggccccuccuggaagaaguuccagggcuccuucugcgaguucguccgcacccucgucugccagugccaguacucccuccucuacgacggcuuccccauggacgaccucaucucccuccucaccggccucuccgacucccagguccgcgccuuccgccacaccuccacccucgccgccaugaagcucaugaccucccucgucaaggucgcccuccagcucuccguccaccaggacaacaaccagcgccaguacgaggccgagcgcaacaagggccccggccagcgcgcccccgagcgccucgagucccuccucgagaagcgcaaggagcuccaggagcaccaggaggagaucgagggcaugaugaacgcccucuuccgcggcgucuucguccaccgcuaccgcgacguccuccccgagauccgcgccaucugcaucgaggagaucggcugcuggaugcaguccuacuccaccuccuuccucaccgacuccuaccucaaguacaucggcuggacccuccacgacaagcaccgcgagguccgccucaagugcgucaaggcccucaagggccucuacggcaaccgcgaccucaccacccgccucgagcucuucaccucccgcuucaaggaccgcauggucuccauggucauggaccgcgaguacgacgucgccgucgaggccguccgccuccucauccucauccucaagaacauggagggcguccucaccgacgccgacugcgaguccgucuaccccgucgucuacgccucccaccgcggccucgccuccgccgccggcgaguuccucuacuggaagcucuucuaccccgagugcgagauccgcaugaugggcggccgcgagcagcgccagucccccggcgcccagcgcaccuucuuccagcuccuccucuccuucuucgucgaguccgagcuccacgaccacgccgccuaccucgucgacucccucugggacugcgccggcgcccgccucaaggacugggagggccucaccucccuccuccucgagaaggaccagaaccucggcgacguccaggaguccacccucaucgagauccucgucuccuccgcccgccaggccuccgagggccacccccccgucggccgcgucaccggccgcaagggccucaccuccaaggagcgcaagacccaggccgacgaccgcgucaagcucaccgagcaccucaucccccuccucccccagcuccucgccaaguucuccgccgacgccgagaaggucaccccccuccuccagcuccucuccugcuucgaccuccacaucuacugcaccggccgccucgagaagcaccucgagcucuuccuccagcagcuccaggaggucgucgucaagcacgccgagcccgccguccucgaggccggcgcccacgcccucuaccuccucugcaaccccgaguucaccuucuucucccgcgccgacuucgcccgcucccagcucgucgaccuccucaccgaccgcuuccagcaggagcucgaggagcuccuccaguccuccuuccucgacgaggacgaggucuacaaccucgccgccacccucaagcgccucuccgccuucuacaacacccacgaccucacccgcugggagcucuacgagcccugcugccagcuccuccagaaggccgucgacaccggcgaggucccccaccaggucauccuccccgcccucacccucgucuacuucuccauccucuggacccucacccacaucuccaaguccgacgccucccagaagcagcucuccucccuccgcgaccgcauggucgccuucugcgagcucugccaguccugccucuccgacgucgacaccgagauccaggagcaggccuucguccuccucuccgaccuccuccucaucuucuccccccagaugaucgucggcggccgcgacuuccuccgcccccucgucuucuuccccgaggccacccuccaguccgagcucgccuccuuccucauggaccacgucuucauccagcccggcgaccucggcuccggcgacucccaggaggaccaccuccagaucgagcgccuccaccagcgccgccgccuccucgccggcuucugcaagcuccuccucuacggcguccucgagauggacgccgccuccgacgucuucaagcacuacaacaaguucuacaacgacuacggcgacaucaucaaggagacccucacccgcgcccgccagaucgaccgcucccacugcucccgcauccuccuccucucccucaagcagcucuacaccgagcuccuccaggagcacggcccccagggccucaacgagcuccccgccuucaucgagaugcgcgaccucgcccgccgcuucgcccucuccuucggcccccagcagcuccagaaccgcgaccucgucgucaugcuccacaaggagggcauccaguucucccucuccgagcucccccccgccggcuccuccaaccagccccccaaccucgccuuccucgagcuccucuccgaguucuccccccgccucuuccaccaggacaagcagcuccuccucuccuaccucgagaagugccuccagcacgucucccaggcccccggccaccccuggggccccgucaccaccuacugccacucccucucccccgucgagaacaccgccgagaccuccccccagguccuccccuccuccaagcgccgccgcgucgagggccccgccaagcccaaccgcgaggacgucuccuccucccaggaggagucccuccagcucaacuccaucccccccacccccacccucaccuccaccgccgucaagucccgccagccccucuggggccucaaggagauggaggaggaggacggcuccgagcucgacuucgcccagggcucccagcccgucgccggcaccgagcgcucccgcuuccucggcccccaguacuuccagaccccccacaaccccuccggccccggccucggcaaccagcucaugcgccucucccucauggaggaggacgaggaggaggagcucgagauccaggacgaguccaacgaggagcgccaggacaccgacaugcaggccuccuccuacuccuccaccuccgagcgcggccucgaccuccucgacuccaccgagcucgacaucgaggacuucuga

SEQ ID NO: 50231 - RNA, 1578 nt, Artificial Sequence
  derived and/or modified sequence opt2 from STAM2__Homo_sapiens__NP_005834
augccccucuucaccgccaaccccuucgagcaggacgucgagaaggccaccaacgaguacaacaccaccgaggacuggucccucaucauggacaucugcgacaaggucggcuccacccccaacggcgccaaggacugccucaaggccaucaugaagcgcgucaaccacaaggucccccacgucgcccuccaggcccucacccuccucggcgccugcgucgccaacugcggcaagaucuuccaccucgaggucugcucccgcgacuucgccaccgagguccgcgccgucaucaagaacaaggcccaccccaaggucugcgagaagcucaagucccucauggucgagugguccgaggaguuccagaaggacccccaguucucccucaucuccgccaccaucaaguccaugaaggaggagggcaucaccuucccccccgccggcucccagaccgucuccgccgccgccaagaacggcaccuccuccaacaagaacaaggaggacgaggacaucgccaaggccaucgagcucucccuccaggagcagaagcagcagcacaccgagaccaagucccucuaccccuccuccgagauccagcucaacaacaaggucgcccgcaagguccgcgcccucuacgacuucgaggccgucgaggacaacgagcucaccuucaagcacggcgagaucaucaucguccucgacgacuccgacgccaacugguggaagggcgagaaccaccgcggcaucggccucuuccccuccaacuucgucaccaccaaccucaacaucgagaccgaggccgccgccgucgacaagcucaacgucaucgacgacgacgucgaggagaucaagaaguccgagcccgagcccgucuacaucgacgaggacaagauggaccgcgcccuccagguccuccaguccaucgaccccaccgacuccaagcccgacucccaggaccuccucgaccucgaggacaucugccagcagaugggccccaugaucgacgagaagcucgaggagaucgaccgcaagcacuccgagcucuccgagcucaacgucaagguccucgaggcccucgagcucuacaacaagcucgucaacgaggcccccgucuacuccgucuacuccaagcuccacccccccgcccacuacccccccgccuccuccggcguccccaugcagaccuaccccguccagucccacggcggcaacuacaugggccaguccauccaccaggucaccgucgcccaguccuacucccucggccccgaccagaucggcccccuccgcucccucccccccaacgucaacuccuccgucaccgcccagcccgcccagaccuccuaccucuccaccggccaggacaccgucuccaaccccaccuacaugaaccagaacuccaaccuccaguccgccaccggcaccaccgccuacacccagcagaugggcauguccgucgacauguccuccuaccagaacaccaccuccaaccucccccagcucgccggcuuccccgucaccguccccgcccaccccgucgcccagcagcacaccaacuaccaccagcagccccuccucuga

SEQ ID NO: 50232 - RNA, 1275 nt, Artificial Sequence
  derived and/or modified sequence opt2 from STAMBP__Homo_sapiens__NP_998787
auguccgaccacggcgacgucucccucccccccgaggaccgcguccgcgcccucucccagcucggcuccgccgucgaggucaacgaggacauccccccccgccgcuacuuccgcuccggcgucgagaucauccgcauggccuccaucuacuccgaggagggcaacaucgagcacgccuucauccucuacaacaaguacaucacccucuucaucgagaagcuccccaagcaccgcgacuacaaguccgccgucauccccgagaagaaggacaccgucaagaagcucaaggagaucgccuuccccaaggccgaggagcucaaggccgagcuccucaagcgcuacaccaaggaguacaccgaguacaacgaggagaagaagaaggaggccgaggagcucgcccgcaacauggccauccagcaggagcucgagaaggagaagcagcgcgucgcccagcagaagcagcagcagcucgagcaggagcaguuccacgccuucgaggagaugauccgcaaccaggagcucgagaaggagcgccucaagaucguccaggaguucggcaaggucgaccccggccucggcggcccccucguccccgaccucgagaagcccucccucgacgucuuccccacccucaccgucuccuccauccagcccuccgacugccacaccaccguccgccccgccaagccccccgucgucgaccgcucccucaagcccggcgcccucuccaacuccgaguccauccccaccaucgacggccuccgccacgucgucguccccggccgccucugcccccaguuccuccagcucgccuccgccaacaccgcccgcggcgucgagaccugcggcauccucugcggcaagcucaugcgcaacgaguucaccaucacccacguccucauccccaagcaguccgccggcuccgacuacugcaacaccgagaacgaggaggagcucuuccucauccaggaccagcagggccucaucacccucggcuggauccacacccaccccacccagaccgccuuccucuccuccgucgaccuccacacccacugcuccuaccagaugaugcuccccgaguccgucgccaucgucugcucccccaaguuccaggagaccggcuucuucaagcucaccgaccacggccucgaggagaucuccuccugccgccagaagggcuuccacccccacuccaaggaccccccccucuucugcuccugcucccacgucaccgucgucgaccgcgccgucaccaucaccgaccuccgcuga

SEQ ID NO: 50233 - RNA, 1311 nt, Artificial Sequence
  derived and/or modified sequence opt2 from STAMBPL1__Homo_sapiens__NP_065850
auggaccagcccuucaccgucaacucccucaagaagcucgccgccaugcccgaccacaccgacgucucccucucccccgaggagcgcguccgcgcccucuccaagcucggcugcaacaucaccaucuccgaggacaucaccccccgccgcuacuuccgcuccggcgucgagauggagcgcauggccuccgucuaccucgaggagggcaaccucgagaacgccuucguccucuacaacaaguucaucacccucuucgucgagaagcuccccaaccaccgcgacuaccagcagugcgccguccccgagaagcaggacaucaugaagaagcucaaggagaucgccuucccccgcaccgacgagcucaagaacgaccuccucaagaaguacaacgucgaguaccaggaguaccuccaguccaagaacaaguacaaggccgagauccucaagaagcucgagcaccagcgccucaucgaggccgagcgcaagcgcaucgcccagaugcgccagcagcagcucgaguccgagcaguuccucuucuucgaggaccagcucaagaagcaggagcucgcccgcggccagaugcgcucccagcagaccuccggccucuccgagcagaucgacggcuccgcccucuccugcuucuccacccaccagaacaacucccuccucaacgucuucgccgaccagcccaacaaguccgacgccaccaacuacgccucccacuccccccccgucaaccgcgcccucacccccgccgccacccucuccgccguccagaaccucgucgucgagggccuccgcugcgucguccuccccgaggaccucugccacaaguuccuccagcucgccgaguccaacaccguccgcggcaucgagaccugcggcauccucugcggcaagcucacccacaacgaguucaccaucacccacgucaucguccccaagcaguccgccggccccgacuacugcgacauggagaacgucgaggagcucuucaacguccaggaccagcacgaccuccucacccucggcuggauccacacccaccccacccagaccgccuuccucuccuccgucgaccuccacacccacugcuccuaccagcucaugcuccccgaggccaucgccaucgucugcucccccaagcacaaggacaccggcaucuuccgccucaccaacgccggcaugcucgaggucuccgccugcaagaagaagggcuuccacccccacaccaaggagccccgccucuucuccaucugcaagcacguccucgucaaggacaucaagaucaucguccucgaccuccgcuga

SEQ ID NO: 50234 - RNA, 1623 nt, Artificial Sequence
  derived and/or modified sequence opt2 from STAM__Homo_sapiens__NP_003464
augccccucuucgccaccaaccccuucgaccaggacgucgagaaggccaccuccgagaugaacaccgccgaggacuggggccucauccucgacaucugcgacaaggucggccagucccgcaccggccccaaggacugccuccgcuccaucaugcgccgcgucaaccacaaggacccccacgucgccaugcaggcccucacccuccucggcgccugcgucuccaacugcggcaagaucuuccaccucgaggucugcucccgcgacuucgccuccgaggucuccaacguccucaacaagggccaccccaaggucugcgagaagcucaaggcccucauggucgaguggaccgacgaguucaagaacgacccccagcucucccucaucuccgccaugaucaagaaccucaaggagcagggcgucaccuuccccgccaucggcucccaggccgccgagcaggccaaggccucccccgcccucgucgccaaggaccccggcaccgucgccaacaagaaggaggaggaggaccucgccaaggccaucgagcucucccucaaggagcagcgccagcaguccaccacccucuccacccucuaccccuccaccuccucccuccucaccaaccaccagcacgagggccgcaagguccgcgccaucuacgacuucgaggccgccgaggacaacgagcucaccuucaaggccggcgagaucaucaccguccucgacgacuccgaccccaacugguggaagggcgagacccaccagggcaucggccucuuccccuccaacuucgucaccgccgaccucaccgccgagcccgagaugaucaagaccgagaagaagaccguccaguucuccgacgacguccaggucgagaccaucgagcccgagcccgagcccgccuucaucgacgaggacaagauggaccagcuccuccagaugcuccaguccaccgaccccuccgacgaccagcccgaccuccccgagcuccuccaccucgaggccaugugccaccagaugggcccccucaucgacgagaagcucgaggacaucgaccgcaagcacuccgagcucuccgagcucaacgucaaggucauggaggcccucucccucuacaccaagcucaugaacgaggaccccauguacuccauguacgccaagcuccagaaccagcccuacuacaugcaguccuccggcgucuccggcucccaggucuacgccggccccccccccuccggcgccuaccucgucgccggcaacgcccagaugucccaccuccaguccuacucccucccccccgagcagcucuccucccucucccaggccgucgucccccccuccgccaaccccgcccuccccucccagcagacccaggccgccuaccccaacaccauggucuccuccguccagggcaacaccuaccccucccaggcccccgucuacucccccccccccgccgccaccgccgccgccgccaccgccgacgucacccucuaccagaacgccggccccaacaugccccagguccccaacuacaaccucaccuccuccacccucccccagcccggcggcucccagcagcccccccagccccagcagcccuacucccagaaggcccuccucuga

SEQ ID NO: 50235 - RNA, 888 nt, Artificial Sequence
  derived and/or modified sequence opt2 from STAP1__Homo_sapiens__NP_036240
augauggccaagaagccccccaagcccgccccccgccgcaucuuccaggagcgccucaagaucaccgcccucccccucuacuucgagggcuuccuccucaucaagcgcuccggcuaccgcgaguacgagcacuacuggaccgagcuccgcggcaccacccucuucuucuacaccgacaagaaguccaucaucuacgucgacaagcucgacaucgucgaccucaccugccucaccgagcagaacuccaccgagaagaacugcgccaaguucacccucguccuccccaaggaggagguccagcucaagaccgagaacaccgaguccggcgaggaguggcgcggcuucauccucaccgucaccgagcucuccgucccccagaacgucucccuccuccccggccaggucaucaagcuccacgagguccucgagcgcgagaagaagcgccgcaucgagaccgagcaguccaccuccgucgagaaggagaaggagcccaccgaggacuacgucgacguccucaaccccaugcccgccugcuucuacaccgucucccgcaaggaggccaccgagaugcuccagaagaaccccucccucggcaacaugauccuccgccccggcuccgacucccgcaacuacuccaucaccauccgccaggagaucgacaucccccgcaucaagcacuacaaggucauguccgucggccagaacuacaccaucgagcucgagaagcccgucacccuccccaaccucuucuccgucaucgacuacuucgucaaggagacccgcggcaaccuccgccccuucaucugcuccaccgacgagaacaccggccaggagcccuccauggagggccgcuccgagaagcucaagaagaacccccacaucgccuga

SEQ ID NO: 50236 - RNA, 1212 nt, Artificial Sequence
  derived and/or modified sequence opt2 from STAP2__Homo_sapiens__NP_001013863
auggccuccgcccuccgccccccccgcguccccaagcccaagggcguccuccccucccacuacuacgaguccuuccucgagaagaagggccccugcgaccgcgacuacaagaaguucugggccggccuccagggccucaccaucuacuucuacaacuccaaccgcgacuuccagcacgucgagaagcucaaccucggcgccuucgagaagcucaccgacgagauccccuggggcuccucccgcgaccccggcacccacuucucccucauccuccgcgaccaggagaucaaguucaaggucgagacccucgagugccgcgagauguggaagggcuucauccucaccgucgucgagcuccgcguccccaccgaccucacccuccuccccggccaccucuacaugauguccgagguccucgccaaggaggaggcccgccgcgcccucgagacccccuccugcuuccucaaggucucccgccucgaggcccagcuccuccucgagcgcuaccccgagugcggcaaccuccuccuccgccccuccggcgacggcgccgacggcgucuccgucaccacccgccagaugcacaacggcacccacgucguccgccacuacaaggucaagcgcgagggccccaaguacgucaucgacgucgagcagcccuucuccugcaccucccucgacgccgucgucaacuacuucgucucccacaccaagaaggcccucguccccuuccuccucgacgaggacuacgagaagguccucggcuacgucgaggccgacaaggagaacggcgagaacgucugggucgcccccuccgcccccggccccggccccgcccccugcaccggcggccccaagccccucucccccgccuccucccaggacaagcuccccccccuccccccccuccccaaccaggaggagaacuacgucacccccaucggcgacggccccgccgucgacuacgagaaccaggacgucgccuccuccuccuggcccgucauccucaagcccaagaagcuccccaagccccccgccaagcuccccaagccccccgucggccccaagcccgagcccaaggucuucaacggcggccucggccgcaagcuccccgucuccuccgcccagccccucuuccccaccgccggccucgccgacaugaccgccgagcuccagaagaagcucgagaagcgccgcgcccucgagcacuga

SEQ ID NO: 50237 - RNA, 876 nt, Artificial Sequence
  derived and/or modified sequence opt2 from STARD10__Homo_sapiens__NP_006636
auggagaagcucgccgccuccaccgagccccagggcccccgccccguccucggccgcgaguccguccagguccccgacgaccaggacuuccgcuccuuccgcuccgagugcgaggccgaggucggcuggaaccucaccuacucccgcgccggcgucuccgucuggguccaggccgucgagauggaccgcacccuccacaagaucaagugccgcauggagugcugcgacguccccgccgagacccucuacgacguccuccacgacaucgaguaccgcaagaagugggacuccaacgucaucgagaccuucgacaucgcccgccucaccgucaacgccgacgucggcuacuacuccuggcgcugccccaagccccucaagaaccgcgacgucaucacccuccgcuccuggcuccccaugggcgccgacuacaucaucaugaacuacuccgucaagcaccccaaguaccccccccgcaaggaccucguccgcgccgucuccauccagaccggcuaccucauccaguccaccggccccaaguccugcgucaucaccuaccucgcccaggucgaccccaagggcucccuccccaagugggucgucaacaaguccucccaguuccucgcccccaaggccaugaagaagauguacaaggccugccucaaguaccccgaguggaagcagaagcaccucccccacuucaagcccuggcuccaccccgagcaguccccccuccccucccucgcccucuccgagcucuccguccagcacgccgacucccucgagaacaucgacgaguccgccgucgccgagucccgcgaggagcgcaugggcggcgccggcggcgagggcuccgacgacgacaccucccucaccuga

SEQ ID NO: 50238 - RNA, 2064 nt, Artificial Sequence
  derived and/or modified sequence opt2 from STARD13__Homo_sapiens__NP_001230395
augcucgagcccuccuccguccuccacgccaacgucaaccaggccccccucuggugccucguccuccgcuggugccgcgagugcaaggacaccgucugcggcggcaagcagaagucccgcgucaaccacaccuuccagcgccgcgagaucgaggccaaggaggccugcgacuggcuccgcgccgccggcuucccccaguacgcccagcucuacgaggacucccaguuccccaucaacaucgucgccgucaagaacgaccacgacuuccucgagaaggaccucgucgagccccucugccgccgccucaacacccucaacaagugcgccuccaugaagcucgacgucaacuuccagcgcaagaagggcgacgacuccgacgaggaggaccucugcaucuccaacaaguggaccuuccagcgcaccucccgccgcuggucccgcgucgacgaccucuacacccuccucccccgcggcgaccgcaacggcucccccggcggcaccggcaugcgcaacaccaccuccuccgaguccguccucaccgaccucuccgagcccgaggucugcuccauccacuccgaguccuccggcggcuccgacucccgcucccagcccggccagugcugcaccgacaaccccgucaugcucgacgccccccucgucuccuccucccucccccagcccccccgcgacguccucaaccaccccuuccaccccaagaacgagaagcccacccgcgcccgcgccaaguccuuccucaagcgcauggagacccuccgcggcaagggcgcccacggccgccacaagggcuccggccgcaccggcggccucgucaucuccggccccaugcuccagcaggagcccgaguccuucaaggccaugcagugcauccagauccccaacggcgaccuccagaacucccccccccccgccugccgcaagggccuccccugcuccggcaaguccuccggcgaguccucccccuccgagcacuccuccuccggcgucuccacccccugccucaaggagcgcaagugccacgaggccaacaagcgcggcggcauguaccucgaggaccucgacguccucgccggcaccgcccuccccgacgccggcgaccagucccgcaugcacgaguuccacucccaggagaaccucgucguccacauccccaaggaccacaagcccggcaccuuccccaaggcccucuccaucgagucccucucccccaccgacuccuccaacggcgucaacuggcgcaccggcuccaucucccucggccgcgagcagguccccggcgcccgcgagccccgccucauggccuccugccaccgcgccucccgcgucuccaucuacgacaacguccccggcucccaccucuacgccuccaccggcgaccuccucgaccucgagaaggacgaccucuucccccaccucgacgacauccuccagcacgucaacggccuccaggaggucgucgacgacugguccaaggacguccuccccgagcuccagacccacgacacccucgucggcgagcccggccucuccaccuuccccucccccaaccagaucacccucgacuucgagggcaacuccgucuccgagggccgcaccacccccuccgacgucgagcgcgacgucaccucccucaacgaguccgagccccccggcguccgcgaccgccgcgacuccggcgucggcgccucccucacccgccccaaccgccgccuccgcuggaacuccuuccagcucucccaccagccccgccccgcccccgccuccccccacaucuccucccagaccgccucccagcucucccuccuccagcgcuucucccuccuccgccucaccgccaucauggagaagcacuccauguccaacaagcacggcuggaccugguccguccccaaguucaugaagcgcaugaagguccccgacuacaaggacaaggccgucuucggcgucccccucaucguccacguccagcgcaccggccagccccucccccaguccauccagcaggcccuccgcuaccuccgcuccaacugccucgaccaggaguga

SEQ ID NO: 50239 - RNA, 1338 nt, Artificial Sequence
  derived and/or modified sequence opt2 from STARD3__Homo_sapiens__NP_001159409
auguccaagcucccccgcgagcucacccgcgaccucgagcgcucccuccccgccgucgccucccucggcuccucccucucccacucccagucccucuccucccaccuccuccccccccccgagaagcgccgcgccaucuccgacguccgccgcaccuucugccucuucgucaccuucgaccuccucuucaucucccuccucuggaucaucgagcucaacaccaacaccggcauccgcaagaaccucgagcaggagaucauccaguacaacuucaagaccuccuucuucgacaucuucguccucgccuucuuccgcuucuccggccuccuccucggcuacgccguccuccgccuccgccacuggucccgccgcuggugccccguccacuccucccucucccgcuccuccucccucuccugcuccgccaagggccaccucgccaccugcucccccuccucccuccucuccucccccggcuggcgccccggcucccucaccuccaaguccuacccccgcaagcucaagcgcuccgacuccgccccccccggcuaccucgccgcccaggucgccgucgcccgcggcccccuccucuucuccggcgcccucuccgagggccaguucuacuccccccccgaguccuucgccggcuccgacaacgaguccgacgaggaggucgccggcaagaaguccuucuccgcccaggagcgcgaguacauccgccagggcaaggaggccaccgccgucgucgaccagauccucgcccaggaggagaacuggaaguucgagaagaacaacgaguacggcgacaccgucuacaccaucgagguccccuuccacggcaagaccuucauccucaagaccuuccuccccugccccgccgagcucgucuaccaggaggucauccuccagcccgagcgcaugguccucuggaacaagaccgucaccgccugccagauccuccagcgcgucgaggacaacacccucaucuccuacgacgucuccgccggcgccgccggcggcgucgucuccccccgcgacuucgucaacguccgccgcaucgagcgccgccgcgaccgcuaccucuccuccggcaucgccaccucccacuccgccaagccccccacccacaaguacguccgcggcgagaacggccccggcggcuucaucguccucaaguccgccuccaacccccgcgucugcaccuucgucuggauccucaacaccgaccucaagggccgccucccccgcuaccucauccaccagucccucgccgccaccauguucgaguucgccuuccaccuccgccagcgcaucuccgagcucggcgcccgcgccuga

SEQ ID NO: 50240 - RNA, 705 nt, Artificial Sequence
  derived and/or modified sequence opt2 from STARD3NL__Homo_sapiens__NP_114405
augaaccaccuccccgaggacauggagaacgcccucaccggcucccaguccucccacgccucccuccgcaacauccacuccaucaaccccacccagcucauggcccgcaucgaguccuacgagggccgcgagaagaagggcaucuccgacguccgccgcaccuucugccucuucgucaccuucgaccuccucuucgucacccuccucuggaucaucgagcucaacgucaacggcggcaucgagaacacccucgagaaggaggucaugcaguacgacuacuacuccuccuacuucgacaucuuccuccucgccgucuuccgcuucaagguccucauccucgccuacgccgucugccgccuccgccacuggugggccaucgcccucaccaccgccgucaccuccgccuuccuccucgccaaggucauccucuccaagcucuucucccagggcgccuucggcuacguccuccccaucaucuccuucauccucgccuggaucgagaccugguuccucgacuucaagguccucccccaggaggccgaggaggagaaccgccuccucaucguccaggacgccuccgagcgcgccgcccucauccccggcggccucuccgacggccaguucuacuccccccccgaguccgaggccggcuccgaggaggccgaggagaagcaggacuccgagaagccccuccucgagcucuga

SEQ ID NO: 50241 - RNA, 642 nt, Artificial Sequence
  derived and/or modified sequence opt2 from STARD5__Homo_sapiens__NP_871629
auggaccccgcccucgccgcccagauguccgaggccgucgccgagaagaugcuccaguaccgccgcgacaccgccggcuggaagaucugccgcgagggcaacggcgucuccgucuccuggcgccccuccgucgaguuccccggcaaccucuaccgcggcgagggcaucgucuacggcacccucgaggaggucugggacugcgucaagcccgccgucggcggccuccgcgucaagugggacgagaacgucaccggcuucgagaucauccaguccaucaccgacacccucugcgucucccgcaccuccacccccuccgccgccaugaagcucaucuccccccgcgacuucgucgaccucguccucgucaagcgcuacgaggacggcaccaucuccuccaacgccacccacgucgagcacccccucugcccccccaagcccggcuucguccgcggcuucaaccaccccugcggcugcuucugcgagccccuccccggcgagcccaccaagaccaaccucgucaccuucuuccacaccgaccucuccggcuaccucccccagaacgucgucgacuccuucuucccccgcuccaugacccgcuucuacgccaaccuccagaaggccgucaagcaguuccacgaguga

SEQ ID NO: 50242 - RNA, 1113 nt, Artificial Sequence
  derived and/or modified sequence opt2 from STARD7__Homo_sapiens__NP_064536
augcucccccgccgccuccucgccgccuggcucgccggcacccgcggcggcggccuccucgcccuccucgccaaccagugccgcuucgucaccggccuccgcguccgccgcgcccagcagaucgcccagcucuacggccgccucuacuccgaguccucccgccgcguccuccucggccgccucuggcgccgccuccacggccgccccggccacgccuccgcccucauggccgcccucgccggcgucuucgucugggacgaggagcgcauccaggaggaggagcuccagcgcuccaucaacgagaugaagcgccucgaggagauguccaacauguuccaguccuccggcguccagcaccacccccccgagcccaaggcccagaccgagggcaacgaggacuccgagggcaaggagcagcgcugggagauggucauggacaagaagcacuucaagcucuggcgccgccccaucaccggcacccaccucuaccaguaccgcgucuucggcaccuacaccgacgucaccccccgccaguucuucaacguccagcucgacaccgaguaccgcaagaagugggacgcccucgucaucaagcucgaggucaucgagcgcgacgucgucuccggcuccgagguccuccacugggucacccacuuccccuaccccauguacucccgcgacuacgucuacguccgccgcuacuccgucgaccaggagaacaacaugaugguccucgucucccgcgccgucgagcaccccuccguccccgagucccccgaguucguccgcguccgcuccuacgagucccagauggucauccgcccccacaaguccuucgacgagaacggcuucgacuaccuccucaccuacuccgacaacccccagaccgucuucccccgcuacugcgucuccuggauggucuccuccggcaugcccgacuuccucgagaagcuccacauggccacccucaaggccaagaacauggagaucaaggucaaggacuacaucuccgccaagccccucgagauguccuccgaggccaaggccaccucccaguccuccgagcgcaagaacgagggcuccugcggccccgcccgcaucgaguacgccuga

SEQ ID NO: 50243 - RNA, 3312 nt, Artificial Sequence
  derived and/or modified sequence opt2 from STARD8__Homo_sapiens__NP_001135975
augccccuccucgacgucuucugguccugcuuccgcaaggucaagugcuucccccuccuccaggucaagaagaacgccgaggccgaggccaagcgcgccugcgaguggcuccaggccaccggcuucccccaguacguccagcucuucgaggagggcuccuucccccucgacaucggcuccgucaagaagaaccacggcuuccucgacgaggacucccucggcgcccucugccgccgccucaugacccucaacaacugcgccuccaugaagcucgagguccacuuccaguccaagcagaacgaggacuccgaggaggaggagcagugcaccaucuccucccacugggccuuccagcaggaguccaagugcuggucccccaugggcuccuccgaccuccucgccccccccucccccggccuccccgccaccuccuccugcgaguccguccucaccgagcucuccgccaccucccuccccgucaucaccgucucccucccccccgagcccgccgaccucccccuccccggccgcgcccccuccuccuccgaccgcccccuccucucccccacccagggccaggagggcccccaggacaaggccaagaagcgccaccgcaaccgcuccuuccucaagcaccucgagucccuccgccgcaaggagaaguccggcucccagcaggccgagcccaagcacucccccgccaccuccgagaaggucuccaaggccuccuccuuccgcuccugccgcggcuuccucuccgccggcuucuaccgcgccaagaacugggccgccaccuccgccggcggcuccggcgccaacacccgcaaggccugggaggccuggcccgucgccuccuuccgccacccccaguggacccaccgcggcgacugccucguccacguccccggcgaccacaagcccggcaccuucccccgcucccucuccaucgagucccucugccccgaggacggccaccgccucgccgacuggcagcccggccgccgcuggggcugcgagggccgccgcggcuccugcggcuccaccggcucccacgccuccaccuacgacaaccuccccgagcucuaccccgccgagcccgucauggucggcgccgaggccgaggacgaggacgacgaggaguccggcggcuccuacgcccaccucgacgacauccuccagcacgucuggggccuccagcagcgcgucgagcucuggucccgcgccauguaccccgaccucggccccggcgacgaggaggaggaggaggccaccuccuccgucgagaucgccaccgucgaggucaagugccaggccgaggcccucucccagauggagguccccgcccacggcgagucccccgccugggcccaggccgagguccagcccgccguccucgcccccgcccaggcccccgccgaggccgagcccgucgcccaggaggaggccgaggcccccgcccccgcccccgcccccgcccccgcccaggacuccgagcaggaggcccacuccggcggcgagcccaccuucgccuccucccucuccgucgaggagggccacuccaucuccgacaccgucgccuccuccuccgagcucgacuccuccggcaacuccaugaacgaggccgaggccgccggcccccucgccggccuccaggccuccaugccccgcgagcgccgcgacuccggcgucggcgccucccucacccgccccugccgcaagcuccgcuggcacuccuuccagaacucccaccgccccucccucaacuccgagucccucgagaucaaccgccaguucgccggccagaucaaccuccuccacaagggcucccuccuccgccucaccgccuucauggagaaguacaccgucccccacaagcagggcugggucugguccaugcccaaguucaugcgccgcaacaagacccccgacuaccgcggccagcacgucuucggcguccccccccucauccacguccagcgcaccggccagccccucccccaguccauccagcaggccaugcgcuaccuccgcucccagugccucgaccaggucggcaucuuccgcaaguccggcgucaagucccgcauccagaaccuccgccagaugaacgagaccucccccgacaacgucugcuacgagggccaguccgccuacgacgucgccgaccuccucaagcaguacuuccgcgaccuccccgagcccaucuucaccuccaagcucaccaccaccuuccuccagaucuaccagcuccuccccaaggaccaguggcucgccgccgcccaggccgccacccuccuccuccccgacgagaaccgcgagguccuccagacccuccucuacuuccucuccgacaucgccuccgccgaggagaaccagaugaccgccggcaaccucgccgucugccucgcccccuccaucuuccaccucaacgucuccaagaaggacucccccuccccccgcaucaaguccaagcgcucccucaucggccgccccggcccccgcgaccucuccgacaacauggccgccacccagggccucucccacaugaucuccgacugcaagaagcucuuccaggucccccaggacaugguccuccagcucugcuccuccuacuccgccgccgagcucuccccccccggccccgcccucgccgagcuccgccaggcccaggccgccggcgucucccucucccucuacauggaggagaacauccaggaccuccuccgcgacgccgccgagcgcuucaagggcuggauguccguccccggcccccagcacaccgagcucgccugccgcaaggcccccgacggccacccccuccgccucuggaaggccuccaccgaggucgccgccccccccgccgucguccuccaccgcguccuccgcgagcgcgcccucugggacgaggaccuccuccgcgcccagguccucgaggcccucaugcccggcgucgagcucuaccacuacgucaccgacuccauggccccccaccccugccgcgacuucgucguccuccgcauguggcgcuccgaccucccccgcggcggcugccuccucgucucccagucccucgaccccgagcagcccguccccgaguccggcguccgcgcccucaugcucaccucccaguaccucauggagcccugcggccucggccgcucccgccucacccacaucugccgcgccgaccuccgcggccgcucccccgacugguacaacaaggucuucggccaccucugcgccauggaggucgccaagauccgcgacuccuuccccacccuccaggccgccggccccgagaccaagcucuga

SEQ ID NO: 50244 - RNA, 14103 nt, Artificial Sequence
  derived and/or modified sequence opt2 from STARD9__Homo_sapiens__NP_065810
auggccaacguccaggucgccguccgcguccgcccccucuccaagcgcgagaccaaggagggcggccgcaucaucgucgaggucgacggcaaggucgccaagauccgcaaccucaaggucgacaaccgccccgacggcuucggcgacucccgcgagaaggucauggccuucggcuucgacuacugcuacugguccgucaaccccgaggacccccaguacgccucccaggacgucgucuuccaggaccucggcauggagguccucuccggcgucgccaagggcuacaacaucugccucuucgccuacggccagaccggcuccggcaagaccuacaccaugcucggcacccccgccuccgucggccucaccccccgcaucugcgagggccucuucguccgcgagaaggacugcgccucccuccccuccuccugccgcaucaaggucuccuuccucgagaucuacaacgagcgcguccgcgaccuccucaagcaguccggccagaagaaguccuacacccuccgcguccgcgagcaccccgagaugggccccuacguccagggccucucccagcacgucgucaccaacuacaagcaggucauccagcuccucgaggagggcaucgccaaccgcaucaccgccgccacccacguccacgaggccuccucccgcucccacgccaucuucaccauccacuacacccaggccauccucgagaacaaccuccccuccgagauggccuccaagaucaaccucgucgaccucgccggcuccgagcgcgccgaccccuccuacugcaaggaccgcaucgccgagggcgccaacaucaacaagucccucgucacccucggcaucgucaucuccacccucgcccagaacucccaggucuucuccuccugccagucccucaacuccuccgucuccaacggcggcgacuccggcauccucuccucccccuccggcaccuccuccggcggcgcccccucccgccgccaguccuacauccccuaccgcgacuccguccucaccuggcuccucaaggacucccucggcggcaacuccaagaccaucauggucgccaccgucucccccgcccacaccuccuacuccgagaccauguccacccuccgcuacgccuccuccgccaagaacaucaucaacaagccccgcgucaacgaggacgccaaccucaagcucauccgcgagcuccgcgaggagaucgagcgccucaaggcccuccuccucuccuucgagcuccgcaacuucuccucccucuccgacgagaaccucaaggagcucguccuccagaacgagcucaagaucgaccagcucaccaaggacuggacccagaaguggaacgacuggcaggcccucauggagcacuacuccgucgacaucaaccgccgccgcgccggcgucgucaucgacuccucccucccccaccucauggcccucgaggacgacguccucuccaccggcgucguccucuaccaccucaaggagggcaccaccaagaucggccgcaucgacuccgaccaggagcaggacaucguccuccagggccaguggaucgagcgcgaccacugcaccaucaccuccgccugcggcgucgucguccuccgccccgcccgcggcgcccgcugcaccgucaacggccgcgaggucaccgccuccugccgccucacccagggcgccgucaucacccucggcaaggcccagaaguuccgcuucaaccaccccgccgaggccgccguccuccgccagcgccgccaggucggcgaggccgccgccggccgcggcucccucgaguggcucgaccucgacggcgaccucgccgccucccgccucggccucuccccccuccucuggaaggagcgccgcgcccucgaggagcagugcgacgaggaccaccagaccccccgcgacggcgagaccucccaccgcgcccagauccagcagcagcaguccuacgucgaggaccuccgccaccagauccucgccgaggagauccgcgccgccaaggagcucgaguucgaccaggccuggaucucccagcagaucaaggagaaccagcagugccuccuccgcgaggagaccuggcucgccucccuccagcagcagcagcaggaggaccaggucgccgagaaggagcucgaggccuccgucgcccucgacgccuggcuccagaccgaccccgagauccagcccucccccuucguccagucccagaagcgcgucguccaccuccagcuccuccgccgccacacccuccgcgccgccgagcgcaacguccgccgcaagaaggucuccuuccagcucgagcgcaucaucaagaagcagcgccuccucgaggcccagaagcgccucgagaagcucaccacccucugcuggcuccaggacgacuccacccaggagccccccuaccagguccucucccccgacgccaccgucccccgcccccccugccgcuccaagcucaccuccugcuccucccucuccccccagcgccucugcuccaagcacaugccccagcuccacuccaucuuccucuccugggaccccuccaccacccuccccccccgccccgaccccacccaccagaccuccgagaagaccuccuccgaggagcaccucccccaggccgccuccuaccccgcccgcaccggcugccuccgcaagaacggccuccacuccuccggccacggccagcccugcaccgcccgcgccgcccucgcccgcaagggcgccuccgcccccgacgccugccucaccaugucccccaacuccgucggcauccaggagauggagaugggcgucaagcagccccaccagauggucucccagggccucgccucccuccgcaaguccgccaacaagcucaagccccgccacgagcccaagaucuucaccuccaccacccagacccgcggcgccaagggccucgccgaccccucccacacccaggccggcuggcgcaaggagggcaaccucggcacccacaaggccgccaagggcgccuccugcaacucccucuacccccacggcccccgccagaccgccggccacggcaaggccgucaagaccuucuggaccgaguacaagccccccucccccucccgcgccuccaagcgccaccagcgcguccucgccacccgcguccgcaacaucaccaagaaguccucccaccucccccucggcuccccccucaagcgccagcagaacacccgcgaccccgacaccauggucccccucaccgacuucucccccgucauggaccacucccgcgagaaggacaacgaccucuccgacaccgacuccaacuacucccucgacucccucuccugcgucuacgccaaggcccucaucgagccccucaagcccgaggagcgcaagugggacuuccccgagcccgagaacuccgaguccgacgacucccagcucuccgaggacucccucgccgagaagcgcuaccagucccccaagaaccgccucggcggcaaccgccccaccaacaaccgcggccagccccgcacccgcacccgcgccuccguccgcggcuucaccgccgccuccgacuccgaccuccucgcccagacccaccgcuccuucucccucgacucccucaucgacgccgaggaggagcucggcgaggaccagcaggaggagcccuuccccggcuccgccgacgagauccccaccgagaccuucuggcaccucgaggacuccucccuccccgucauggaccaggaggccaucugccgccucggccccaucaacuaccgcaccgccgcccgccucgacgccguccuccccauguccuccuccuucuaccucgacccccaguuccagccccacugcgagcuccagccccacugcgagcuccagccccacugcgagcuccagccccacugcgagcaggccgagucccaggucgagcccuccuacuccgagcaggccgacucccuccagggcaugcagcucucccgcgaguccccccucauguccauggacuccugguucuccugcgacuccaagaucaaccccuccuccccccccggcaucgucggcucccucugccccucccccgacaugcaggaguuccacuccugcaagggcgagcgccccggcuacuggcccaacaccgaggagcucaagcccuccgacgccgagaccguccuccccuacuccuccaagcuccaccagggcuccaccgagcuccucugcuccgcccgcgacgagcacaccgccuccgccgccgacaccucccgccucucccucuggggcauccagcgccucauccagcccggcgccgacggcaccuuccagggccgcugcauccccgacaugacccagcagggcuccuccgaggccucccacaacuccuccgucuccaacguccucgccgccuccgccaccacccucacccacgucggcuccacccacgagcgcgacugguccgcccuccagcagaaguaccuccucgagcucuccugccccguccucgaggccaucggcgcccccaagcccgccuaccccuaccucgaggaggacuccggcucccucgcccaggccuccuccaagggcggcgacacccuccuccccgucggcccccgcgucuccuccaaccucaaccucaacaacuuccccguccaccucucccgcauccgccgccuccgcgccgagaaggagcaggacucccucaacgccaagcucgagggcgucuccgacuucuucuccaccuccgagaaggaggccuccuacgacgagaccuacuccgccgaccucgagucccucuccgccucccgcuccaccaacgcccaggucuucgccaccgagaacgccauccccgacuccaugaccgaggccugcgaggucaagcagaacaaccucgaggagugccuccaguccugccgcaagcccggccucaugaccuccuccgacgaggacuucuuccagaagaacgccugccacuccaacgucaccaccgccaccaaggccgaccacuggucccagggcugggccccccuccgcaagaacuccgccguccagcccggccagcucucccccgacucccacuacccccucgaggaggagaagaccgacugccaggaguccuccaaggaggccguccgccgccacaucaacgucuccuucgcccuccccuccggccccgagcucuaccuccacuccgcccccuggaacccccucuccuccucccuccagcccccccuccucgagaccuucuacgucaccaagucccgcgacgcccucaccgagaccgcccucgagauccccgccugccgcgagguccgcguccccuccccccccccccgcgaggccuggggcuucggccacaaccaccaggcccuccagggcgccuaccucaagaacaaccuccccguccuccuccagaaccagaacuccaagaucgccuccucccagcaggucaccgccgagauccccgucgaccucaacacccgcgaggucauccgcgaguccggcaagugccccggcaacaucaccgaggagucccacgacuccgucuacuccuccgucacccagaaccgccacuuccuccccuccaccuccaccaaggucugcgaguucgagaaccaggucgucauccucaacaagaagcacuccuuccccgcccucgagggcggcgaggucaccgcccaguccugcugcggcgccuccuccgacuccaccgaguccggcaagucccuccucuuccgcgaguccgaggcccgcgaggaggaggagcucgaccagaacaccguccuccgccagaccaucaacgucucccucgagaaggacaugcccggcgaguccgccgucucccucaagucccgcuccgucgaccgccgcgucuccucccccgucauggucgcccagggcggcggccccacccccaagugggagggcaagaacgagaccggccuccucgagaagggccuccgccccaaggacuccuccgaggaguucaagcuccccggcaccaagcccgccuacgagcgcuuccagcucgucgccugcccccaggagcgcaaccccuccgagugcaagucccaggagaugcucaaccccaaccgcgagcccuccggcaagaagcagaacaagcgcgucaacaacaccgacgagauggcccgccucauccgcuccgucaugcagcucgagaacggcauccucgagaucgaguccaagcagaacaagcagguccacgccucccacacccccggcaccgacaaggagcucgucuuccaggaccagaaggagcaggagaagaccgaccacgccuuccgccccgacuccuccggcaacccccuccccuccaaggaccagcccuccuccccccgccagaccgacgacaccgucuuccgcgacuccgaggccggcgccauggaggucaacuccaucggcaaccacccccagguccagaagaucacccccaaccccuuccgcucccgcgagggcguccgcgaguccgagcccguccgcgagcacacccaccccgccggcuccgaccgccccgcccgcgacaucugcgacucccucggcaagcacaccaccugccgcgaguucaccaacaccucccuccacccccagcgcaugaaggcccucgcccgcgcccucccccuccagccccgccucgagcgcuccuccaagaacaacggccaguucgucaaggccuccgccucccucaagggccagcccuggggccucggcucccucgaggagcucgagaccgucaagggcuuccaggagucccaggucgccgagcacgucuccuccuccaaccaggaggagcccaaggcccagggcaaggucgaggagaugcccaugcagcgcggcggcucccuccaggaggagaacaaggucacccagaaguuccccucccucucccagcucugccgcgacaccuucuuccgccaggagaccgucuccccccuccucucccgcaccgaguucugcaccgccccccuccaccaggaccucuccaacacccucccccucaacuccccccgcuggccccgccgcugccuccacguccccgucgcccucggcaucuccucccucgacugcguccucgaccucaccaugcucaagauccacaacuccccccucgucaccggcgucgagcaccaggaccaguccaccgagacccgcucccacucccccgagggcaacguccgcggccgcuccuccgaggcccacaccgccuggugcggcuccguccgcuccauggccaugggcucccacucccaguccggcguccccgaguccaucccccucggcaccgaggaccgcaucuccgccuccaccuccccccaggaccacggcaaggaccuccgcaucacccuccucggcuucuccaccuccgaggacuucgccuccgaggccgaggucgccguccagaaggagauccgcgucuccucccucaacaaggucuccucccagcccgagaagcgcgucuccuucucccucgaggaggacuccgaccaggccuccaagccccgccagaaggccgagaaggagaccgaggacgucggccucaccuccggcgucucccucgcccccgucucccucccccgcguccccucccccgagccccgccuccucgagcccuccgaccacgccuccaugugccucgccauccucgaggagauccgccaggccaaggcccagcgcaagcagcuccacgacuucgucgcccgcggcaccguccucuccuacugcgagacccuccucgagcccgagugcuccucccgcgucgccggccgcccccagugcaagcagaucgaccaguccuccuccgaccagacccgcaacgagggcgaggcccccggcuuccacgucgccucccucuccgccgaggccggccagaucgaccuccuccccgacgagcgcaagguccaggccaccucccucuccgccgacuccuucgagucccuccccaacaccgagaccgaccgcgagcccugggaccccguccaggccuucucccacgccgcccccgcccaggaccgcaagcgccgcaccggcgagcuccgccaguucgccggcgccuccgagcccuucaucugccacuccuccuccuccgagaucaucgagaagaagaaggacgccacccgcacccccuccuccgccgacccccucgcccccgacuccccccgcuccuccgcccccgucgaggagguccgccgcgucgucuccaagaaggucgucgccgcccuccccucccaggcccccuacgacgacccccgcgucacccuccacgagcucucccaguccgucccccaggagaccgccgagggcaucccccccggcucccaggacuccucccccgagcaccaggagccccgcacccucgacaccaccuacggcgaggucuccgacaaccuccucgucaccgcccagggcgagaagaccgcccacuucgagucccaguccgucaccugcgacguccagaacuccaccuccgccuccggccccaagcaggaccacguccagugccccgaggccuccaccggcuucgaggagggccgcgccucccccaagcaggacaccauccuccccggcgcccucacccgcgucgcccucgaggcccccacccagcagugcguccagugcaaggaguccgucggcuccggccucaccgaggucugccgcgccggcuccaagcacucccgccccaucccccuccccgaccagcgccccuccgccaaccccggcggcaucggcgaggaggcccccugccgccacccccgcgaggcccucgacggccccgucuucucccgcaaccccgagggcucccgcacccucucccccucccgcggcaaggagucccgcacccuccccugccgccagcccugcuccucccagcccgucgccacccacgccuacuccucccacuccuccacccuccucugcuuccgcgacggcgaccucggcaaggagcccuucaaggccgccccccacaccauccacccccccugcgucguccccucccgcgccuacgagauggacgagaccggcgagaucucccgcggccccgacguccaccucacccacggccucgagcccaaggacgucaaccgcgaguuccgccucaccgaguccuccaccugcgagcccuccaccgucgccgccguccucucccgcgcccagggcugccgcucccccuccgcccccgacguccgcaccggcuccuucucccacuccgccaccgacggcuccgucggccucaucggcguccccgagaagaaggucgccgagaagcaggccuccaccgagcucgaggccgccuccuuccccgccggcauguacuccgagccccuccgccaguuccgcgacuccuccgucggcgaccagaacgcccaggucugccagaccaaccccgagccccccgccaccacccagggcccccacacccucgaccucuccgagggcuccgccgaguccaagcucgucgucgagccccagcacgagugccucgagaacaccacccgcugcuuccucgagaagccccaguucuccaccgagcuccgcgaccacaaccgccucgacucccaggccaaguucgucgcccgccucaagcacaccugcuccccccaggaggacucccccuggcaggaggaggagcagcaccgcgaccaggccuccggcggcggcgagggcuucgcccagggcgucaacccccuccccgacgaggacggccucgacggcugccagauccucgacgccggccgcgaggaggucgccgucgccaagccccccgucuccaagauccucucccagggcuucaaggaccccgccaccgucucccuccgccagaacgagaccccccagcccgccgcccagcgcuccggccaccucuacaccggccgcgagcagcccgcccccaaccaccgcggcucccuccccgucaccaccaucuucuccggccccaagcacucccgcuccucccccaccccccaguucuccgucgucggcuccucccgcucccuccaggagcucaaccucuccgucgagccccccucccccaccgacgaggacacccagggccccaaccgccucuggaacccccaccuccgcggcuacuccuccggcaaguccgucgcccgcaccucccuccaggccgaggacuccaaccagaaggccuccucccgccucgacgacggcaccaccgaccaccgccaccucaagcccgccaccccccccuaccccaugcccuccacccucucccacaugcccacccccgacuucaccaccuccuggauguccggcacccucgagcaggcccagcagggcaagcgcgagaagcucggcguccagguccgccccgagaacuggugcucccagauggacaagggcaugcuccacuucggcuccuccgacaucucccccuacgcccuccccuggcgccccgaggagcccgcccgcaucuccuggaagcaguacauguccggcuccgccgucgacgucuccugcucccagaagccccagggccucacccucuccaacgucgcccgcugcuccuccauggacaacggccucgaggaccagaacucccccuuccacucccaccucuccaccuacgccaacaucugcgaccucuccaccacccacuccuccaccgagaacgcccagggcuccaacgaggccugggaggucuuccgcggcuccuccuccaucgcccucggcgacccccacauccccaccucccccgagggcgucgcccccaccuccggccacgaccgccgcccccaguuccgcggccccuccggcgaggccgacugccuccgcuccaagcccccccucgccaagggcuccgccgccggccccgucgacgagaucaugcuccucuaccccuccgaggccggcugccccgucggccagacccgcaccaacaccuucgagcagggcacccagacccucggcucccgccgccacugguccuccaccgacaucuccuucgcccagcccgaggccuccgccgucuccgccuucgaccucgccuccuggaccuccaugcacaaccucucccuccaccucucccagcuccuccacuccaccuccgagcuccucggcucccucucccagcccgacgucgcccgccgcgagcagaacaccaagcgcgacauccccgacaaggccccccaggcccucaugauggacggcuccacccagaccaccgucgacgagggcucccagaccgaccucacccuccccacccucugccuccagaccuccgaggccgagccccagggcgccaacgucauccucgagggccucggcuccgacaccuccaccgucucccaggaggagggcgacguccccggcgucccccagaagcgcgaggccgaggagaccgcccagaagauggcccagcuccucuaccuccaggaggaguccacccccuacaagccccagucccccuccauccccuccucccaccuccgcuuccagaaggcccccgucggccagcaccuccccuccgucucccccuccgucuccgacgccuuccucccccccuccucccagcccgaggaguccuacugccucgucgucuccucccccucccccuccuccccccacucccccggccucuuccccuccaccuccgaguaccccggcgacucccgcguccagaagaagcucggccccaccuccgcccucuucgucgaccgcgccuccucccccauccucacccucuccgccuccacccaggagcccggccucucccccggcucccucacccucuccgcccccuccacccaccccgucgagggccaccagaagcucgacuccucccccgaccccgucgacgccccccgcacccccauggacaacuacucccagaccaccgacgagcucggcggcucccagcgcggccgcuccucccuccagcgcuccaacggccgcuccuuccucgagcuccacuccccccacuccccccagcagucccccaagcuccaguucuccuuccucggccagcacccccagcagcuccagccccgcaccaccaucggcguccagucccgccuccucccccccccccuccgccaccgcucccagcgccucggcaacuccuucguccccgagaaggucgccucccccgagcacugcccccucuccggccgcgagcccucccaguggcagucccgcaccgagaacggcggcgaguccuccgccucccccggcgagccccagcgcacccucgaccgccccuccuccuggggcggccuccagcaccucucccccugccccgucuccgagcucaccgacaccgccggccuccgcggcuccgcccucggccucccccaggccugccagcccgaggagcuccucugcuucuccugccagaugugcauggcccccgagcaccagcaccacucccuccgcgaccuccccguccacaacaaguucuccaacuggugcggcguccagaagggcucccccggcggccucgacaugaccgaggaggagcucggcgccuccggcgaccucuccuccgagaagcaggagcagucccccccccagccccccaacgaccacucccaggacuccgagugguccaagcgcgagcagaucccccuccaggucggcgcccagaaccucucccucuccgucgagcucaccgaggccaagcuccaccacggcuucggcgaggccgacgcccuccuccagguccuccaguccggcaccggcgaggcccucgccgccgacgagcccgucaccuccaccuggaaggagcucuacgcccgccagaagaaggccaucgagacccuccgccgcgagcgcgccgagcgccucggcaacuucugccgcacccgcucccucuccccccagaagcagcucucccuccuccccaacaaggaccucuucaucugggaccucgaccuccccucccgccgccgcgaguaccuccagcagcuccgcaaggacgucgucgagaccacccgcucccccgaguccgucucccgcuccgcccacacccccuccgacaucgagcucaugcuccaggacuaccagcaggcccacgaggaggccaaggucgagaucgcccgcgcccgcgaccagcuccgcgagcgcaccgagcaggagaagcuccgcauccaccagaagaucaucucccagcuccucaaggaggaggacaagcuccacacccucgccaacuccuccucccucugcaccuccuccaacggcucccucuccuccggcaugaccuccggcuacaacuccucccccgcccucuccggccagcuccaguuccccgagaacaugggccacaccaaccuccccgacucccgcgacgucuggaucggcgacgagcgcggcggccacuccgccguccgcaagaacuccgccuacucccaccgcgccucccucggcuccugcugcugcucccccuccucccucuccucccucggcaccugcuucuccuccuccuaccaggaccucgccaagcacgucgucgacaccuccauggccgacgucauggccgccugcuccgacaaccuccacaaccucuucuccugccaggccaccgccggcuggaacuaccagggcgaggagcaggccguccagcucuacuacaaggucuucucccccacccgccacggcuuccucggcgccggcgucgucucccagccccucucccgcgucugggccgccgucuccgaccccaccgucuggccccucuacuacaagcccauccagaccgcccgccuccaccagcgcgucaccaacuccaucucccucgucuaccucgucugcaacaccacccucugcgcccucaagcagccccgcgacuucugcugcgucugcgucgaggccaaggagggccaccucuccgucauggccgcccaguccgucuacgacaccuccaugccccgccccucccgcaagaugguccgcggcgagauccuccccuccgccuggauccuccagcccaucaccgucgagggcaaggaggucacccgcgucaucuaccucgcccaggucgagcucggcgcccccggcuuccccccccagcuccucuccuccuucaucaagcgccagccccucgucaucgcccgccucgccuccuuccucggccgcuga

SEQ ID NO: 50245 - RNA, 858 nt, Artificial Sequence
  derived and/or modified sequence opt2 from STAR__Homo_sapiens__NP_000340
augcuccucgccaccuucaagcucugcgccggcuccuccuaccgccacaugcgcaacaugaagggccuccgccagcaggccgucauggccaucucccaggagcucaaccgccgcgcccucggcggccccacccccuccaccuggaucaaccagguccgccgccgcuccucccuccucggcucccgccucgaggagacccucuacuccgaccaggagcucgccuaccuccagcagggcgaggaggccaugcagaaggcccucggcauccucuccaaccaggagggcuggaagaaggagucccagcaggacaacggcgacaaggucauguccaaggucguccccgacgucggcaaggucuuccgccucgaggucgucgucgaccagcccauggagcgccucuacgaggagcucgucgagcgcauggaggccaugggcgaguggaaccccaacgucaaggagaucaagguccuccagaagaucggcaaggacaccuucaucacccacgagcucgccgccgaggccgccggcaaccucgucggcccccgcgacuucgucuccguccgcugcgccaagcgccgcggcuccaccugcguccucgccggcauggccaccgacuucggcaacaugcccgagcagaagggcgucauccgcgccgagcacggccccaccugcaugguccuccacccccucgccggcucccccuccaagaccaagcucaccuggcuccucuccaucgaccucaagggcuggcuccccaaguccaucaucaaccagguccucucccagacccaggucgacuucgccaaccaccuccgcaagcgccucgagucccaccccgccuccgaggcccgcugcuga

SEQ ID NO: 50246 - RNA, 2253 nt, Artificial Sequence
  derived and/or modified sequence opt2 from STAT1__Homo_sapiens__NP_009330
augucccagugguacgagcuccagcagcucgacuccaaguuccucgagcagguccaccagcucuacgacgacuccuuccccauggagauccgccaguaccucgcccaguggcucgagaagcaggacugggagcacgccgccaacgacgucuccuucgccaccauccgcuuccacgaccuccucucccagcucgacgaccaguacucccgcuucucccucgagaacaacuuccuccuccagcacaacauccgcaaguccaagcgcaaccuccaggacaacuuccaggaggaccccauccagauguccaugaucaucuacuccugccucaaggaggagcgcaagauccucgagaacgcccagcgcuucaaccaggcccaguccggcaacauccaguccaccgucaugcucgacaagcagaaggagcucgacuccaagguccgcaacgucaaggacaaggucaugugcaucgagcacgagaucaagucccucgaggaccuccaggacgaguacgacuucaagugcaagacccuccagaaccgcgagcacgagaccaacggcgucgccaaguccgaccagaagcaggagcagcuccuccucaagaagauguaccucaugcucgacaacaagcgcaaggaggucguccacaagaucaucgagcuccucaacgucaccgagcucacccagaacgcccucaucaacgacgagcucgucgaguggaagcgccgccagcaguccgccugcaucggcggcccccccaacgccugccucgaccagcuccagaacugguucaccaucgucgccgagucccuccagcagguccgccagcagcucaagaagcucgaggagcucgagcagaaguacaccuacgagcacgaccccaucaccaagaacaagcagguccucugggaccgcaccuucucccucuuccagcagcucauccaguccuccuucgucgucgagcgccagcccugcaugcccacccacccccagcgcccccucguccucaagaccggcguccaguucaccgucaagcuccgccuccucgucaagcuccaggagcucaacuacaaccucaaggucaagguccucuucgacaaggacgucaacgagcgcaacaccgucaagggcuuccgcaaguucaacauccucggcacccacaccaaggucaugaacauggaggaguccaccaacggcucccucgccgccgaguuccgccaccuccagcucaaggagcagaagaacgccggcacccgcaccaacgagggcccccucaucgucaccgaggagcuccacucccucuccuucgagacccagcucugccagcccggccucgucaucgaccucgagaccaccucccuccccgucgucgucaucuccaacgucucccagcuccccuccggcugggccuccauccucugguacaacaugcucgucgccgagccccgcaaccucuccuucuuccucaccccccccugcgcccgcugggcccagcucuccgagguccucuccuggcaguucuccuccgucaccaagcgcggccucaacgucgaccagcucaacaugcucggcgagaagcuccucggccccaacgccucccccgacggccucauccccuggacccgcuucugcaaggagaacaucaacgacaagaacuuccccuucuggcucuggaucgaguccauccucgagcucaucaagaagcaccuccucccccucuggaacgacggcugcaucaugggcuucaucuccaaggagcgcgagcgcgcccuccucaaggaccagcagcccggcaccuuccuccuccgcuucuccgaguccucccgcgagggcgccaucaccuucaccugggucgagcgcucccagaacggcggcgagcccgacuuccacgccgucgagcccuacaccaagaaggagcucuccgccgucaccuuccccgacaucauccgcaacuacaaggucauggccgccgagaacauccccgagaacccccucaaguaccucuaccccaacaucgacaaggaccacgccuucggcaaguacuacucccgccccaaggaggcccccgagcccauggagcucgacggccccaagggcaccggcuacaucaagaccgagcucaucuccgucuccgagguccaccccucccgccuccagaccaccgacaaccuccuccccaugucccccgaggaguucgacgaggucucccgcaucgucggcuccgucgaguucgacuccaugaugaacaccgucuga

SEQ ID NO: 50247 - RNA, 2556 nt, Artificial Sequence
  derived and/or modified sequence opt2 from STAT2__Homo_sapiens__NP_005410
auggcccagugggagaugcuccagaaccucgacucccccuuccaggaccagcuccaccagcucuacucccacucccuccuccccgucgacauccgccaguaccucgccgucuggaucgaggaccagaacuggcaggaggccgcccucggcuccgacgacuccaaggccaccaugcucuucuuccacuuccucgaccagcucaacuacgagugcggccgcugcucccaggaccccgagucccuccuccuccagcacaaccuccgcaaguucugccgcgacauccagcccuucucccaggaccccacccagcucgccgagaugaucuucaaccuccuccucgaggagaagcgcauccucauccaggcccagcgcgcccagcucgagcagggcgagcccguccucgagacccccgucgagucccagcagcacgagaucgagucccgcauccucgaccuccgcgccaugauggagaagcucgucaaguccaucucccagcucaaggaccagcaggacgucuucugcuuccgcuacaagauccaggccaagggcaagacccccucccucgacccccaccagaccaaggagcagaagauccuccaggagacccucaacgagcucgacaagcgccgcaaggagguccucgacgccuccaaggcccuccucggccgccucaccacccucaucgagcuccuccuccccaagcucgaggaguggaaggcccagcagcagaaggccugcauccgcgcccccaucgaccacggccucgagcagcucgagaccugguucaccgccggcgccaagcuccucuuccaccuccgccagcuccucaaggagcucaagggccucuccugccucgucuccuaccaggacgacccccucaccaagggcgucgaccuccgcaacgcccaggucaccgagcuccuccagcgccuccuccaccgcgccuucgucgucgagacccagcccugcaugccccagaccccccaccgcccccucauccucaagaccggcuccaaguucaccguccgcacccgccuccucguccgccuccaggagggcaacgagucccucaccgucgaggucuccaucgaccgcaaccccccccagcuccagggcuuccgcaaguucaacauccucaccuccaaccagaagacccucacccccgagaagggccagucccagggccucaucugggacuucggcuaccucacccucgucgagcagcgcuccggcggcuccggcaagggcuccaacaagggcccccucggcgucaccgaggagcuccacaucaucuccuucaccgucaaguacaccuaccagggccucaagcaggagcucaagaccgacacccuccccgucgucaucaucuccaacaugaaccagcucuccaucgccugggccuccguccucugguucaaccuccucucccccaaccuccagaaccagcaguucuucuccaacccccccaaggcccccuggucccuccucggccccgcccucuccuggcaguucuccuccuacgucggccgcggccucaacuccgaccagcucuccaugcuccgcaacaagcucuucggccagaacugccgcaccgaggacccccuccucuccugggccgacuucaccaagcgcgaguccccccccggcaagcuccccuucuggaccuggcucgacaagauccucgagcucguccacgaccaccucaaggaccucuggaacgacggccgcaucaugggcuucgucucccgcucccaggagcgccgccuccucaagaagaccauguccggcaccuuccuccuccgcuucuccgaguccuccgagggcggcaucaccugcuccugggucgagcaccaggacgacgacaagguccucaucuacuccguccagcccuacaccaaggagguccuccagucccucccccucaccgagaucauccgccacuaccagcuccucaccgaggagaacauccccgagaacccccuccgcuuccucuacccccgcaucccccgcgacgaggccuucggcugcuacuaccaggagaaggucaaccuccaggagcgccgcaaguaccucaagcaccgccucaucgucgucuccaaccgccaggucgacgagcuccagcagccccucgagcucaagcccgagcccgagcucgagucccucgagcucgagcucggccucguccccgagcccgagcucucccucgaccucgagccccuccucaaggccggccucgaccucggccccgagcucgaguccguccucgaguccacccucgagcccgucaucgagcccacccucugcauggucucccagaccguccccgagcccgaccagggccccgucucccagcccguccccgagcccgaccuccccugcgaccuccgccaccucaacaccgagcccauggagaucuuccgcaacugcgucaagaucgaggagaucaugcccaacggcgacccccuccucgccggccagaacaccgucgacgaggucuacgucucccgccccucccacuucuacaccgacggcccccucaugcccuccgacuucuga

SEQ ID NO: 50248 - RNA, 2310 nt, Artificial Sequence
  derived and/or modified sequence opt2 from STAT3__Homo_sapiens__NP_003141
auggcccaguggaaccagcuccagcagcucgacacccgcuaccucgagcagcuccaccagcucuacuccgacuccuuccccauggagcuccgccaguuccucgcccccuggaucgagucccaggacugggccuacgccgccuccaaggagucccacgccacccucgucuuccacaaccuccucggcgagaucgaccagcaguacucccgcuuccuccaggaguccaacguccucuaccagcacaaccuccgccgcaucaagcaguuccuccagucccgcuaccucgagaagcccauggagaucgcccgcaucgucgcccgcugccucugggaggagucccgccuccuccagaccgccgccaccgccgcccagcagggcggccaggccaaccaccccaccgccgccgucgucaccgagaagcagcagaugcucgagcagcaccuccaggacguccgcaagcgcguccaggaccucgagcagaagaugaaggucgucgagaaccuccaggacgacuucgacuucaacuacaagacccucaagucccagggcgacaugcaggaccucaacggcaacaaccaguccgucacccgccagaagaugcagcagcucgagcagaugcucaccgcccucgaccagaugcgccgcuccaucgucuccgagcucgccggccuccucuccgccauggaguacguccagaagacccucaccgacgaggagcucgccgacuggaagcgccgccagcagaucgccugcaucggcggcccccccaacaucugccucgaccgccucgagaacuggaucaccucccucgccgagucccagcuccagacccgccagcagaucaagaagcucgaggagcuccagcagaaggucuccuacaagggcgaccccaucguccagcaccgccccaugcucgaggagcgcaucgucgagcucuuccgcaaccucaugaaguccgccuucgucgucgagcgccagcccugcaugcccaugcaccccgaccgcccccucgucaucaagaccggcguccaguucaccaccaagguccgccuccucgucaaguuccccgagcucaacuaccagcucaagaucaaggucugcaucgacaaggacuccggcgacgucgccgcccuccgcggcucccgcaaguucaacauccucggcaccaacaccaaggucaugaacauggaggaguccaacaacggcucccucuccgccgaguucaagcaccucacccuccgcgagcagcgcugcggcaacggcggccgcgccaacugcgacgccucccucaucgucaccgaggagcuccaccucaucaccuucgagaccgaggucuaccaccagggccucaagaucgaccucgagacccacucccuccccgucgucgucaucuccaacaucugccagaugcccaacgccugggccuccauccucugguacaacaugcucaccaacaaccccaagaacgucaacuucuucaccaagccccccaucggcaccugggaccaggucgccgagguccucuccuggcaguucuccuccaccaccaagcgcggccucuccaucgagcagcucaccacccucgccgagaagcuccucggccccggcgucaacuacuccggcugccagaucaccugggccaaguucugcaaggagaacauggccggcaagggcuucuccuucugggucuggcucgacaacaucaucgaccucgucaagaaguacauccucgcccucuggaacgagggcuacaucaugggcuucaucuccaaggagcgcgagcgcgccauccucuccaccaagccccccggcaccuuccuccuccgcuucuccgaguccuccaaggagggcggcgucaccuucaccugggucgagaaggacaucuccggcaagacccagauccaguccgucgagcccuacaccaagcagcagcucaacaacauguccuucgccgagaucaucaugggcuacaagaucauggacgccaccaacauccucgucuccccccucgucuaccucuaccccgacauccccaaggaggaggccuucggcaaguacugccgccccgagucccaggagcaccccgaggccgaccccggcgccgcccccuaccucaagaccaaguucaucugcgucacccccaccaccugcuccaacaccaucgaccuccccauguccccccgcacccucgacucccucaugcaguucggcaacaacggcgagggcgccgagcccuccgccggcggccaguucgagucccucaccuucgacauggagcucaccuccgagugcgccaccucccccauguga

SEQ ID NO: 50249 - RNA, 2247 nt, Artificial Sequence
  derived and/or modified sequence opt2 from STAT4__Homo_sapiens__NP_003142
augucccaguggaaccagguccagcagcucgagaucaaguuccucgagcaggucgaccaguucuacgacgacaacuuccccauggagauccgccaccuccucgcccaguggaucgagaaccaggacugggaggccgccuccaacaacgagaccauggccaccauccuccuccagaaccuccucauccagcucgacgagcagcucggccgcgucuccaaggagaagaaccuccuccucauccacaaccucaagcgcauccgcaagguccuccagggcaaguuccacggcaaccccaugcacgucgccgucgucaucuccaacugccuccgcgaggagcgccgcauccucgccgccgccaacaugcccguccagggcccccucgagaagucccuccaguccuccuccgucuccgagcgccagcgcaacgucgagcacaaggucgccgccaucaagaacuccguccagaugaccgagcaggacaccaaguaccucgaggaccuccaggacgaguucgacuaccgcuacaagaccauccagaccauggaccaguccgacaagaacuccgccauggucaaccaggagguccucacccuccaggagaugcucaacucccucgacuucaagcgcaaggaggcccucuccaagaugacccagaucauccacgagaccgaccuccucaugaacaccaugcucaucgaggagcuccaggacuggaagcgccgccagcagaucgccugcaucggcggcccccuccacaacggccucgaccagcuccagaacugcuucacccuccucgccgagucccucuuccagcuccgccgccagcucgagaagcucgaggagcaguccaccaagaugaccuacgagggcgaccccauccccaugcagcgcacccacaugcucgagcgcgucaccuuccucaucuacaaccucuucaagaacuccuucgucgucgagcgccagcccugcaugcccacccacccccagcgcccccucguccucaagacccucauccaguucaccgucaagcuccgccuccucaucaagcuccccgagcucaacuaccaggucaaggucaaggccuccaucgacaagaacgucuccacccucuccaaccgccgcuucguccucugcggcaccaacgucaaggccauguccaucgaggaguccuccaacggcucccucuccgucgaguuccgccaccuccagcccaaggagaugaaguccuccgccggcggcaagggcaacgagggcugccacauggucaccgaggagcuccacuccaucaccuucgagacccagaucugccucuacggccucaccaucgaccucgagaccuccucccuccccgucgucaugaucuccaacgucucccagcuccccaacgccugggccuccaucaucugguacaacgucuccaccaacgacucccagaaccucgucuucuucaacaaccccccccccgccacccucucccagcuccucgaggucauguccuggcaguucuccuccuacgucggccgcggccucaacuccgaccagcuccacaugcucgccgagaagcucaccguccaguccuccuacuccgacggccaccucaccugggccaaguucugcaaggagcaccuccccggcaaguccuucaccuucuggaccuggcucgaggccauccucgaccucaucaagaagcacauccucccccucuggaucgacggcuacgucaugggcuucgucuccaaggagaaggagcgccuccuccucaaggacaagaugcccggcaccuuccuccuccgcuucuccgagucccaccucggcggcaucaccuucaccugggucgaccacuccgaguccggcgagguccgcuuccacuccgucgagcccuacaacaagggccgccucuccgcccuccccuucgccgacauccuccgcgacuacaaggucaucauggccgagaacauccccgagaacccccucaaguaccucuaccccgacauccccaaggacaaggccuucggcaagcacuacuccucccagcccugcgaggucucccgccccaccgagcgcggcgacaagggcuacguccccuccgucuucauccccaucuccaccauccgcuccgacuccaccgagccccacucccccuccgaccuccuccccaugucccccuccgucuacgccguccuccgcgagaaccucucccccaccaccaucgagaccgccaugaagucccccuacuccgccgaguga

SEQ ID NO: 50250 - RNA, 2295 nt, Artificial Sequence
  derived and/or modified sequence opt2 from STAT5A__Homo_sapiens__NP_001275648
auggccggcuggauccaggcccagcagcuccagggcgacgcccuccgccagaugcagguccucuacggccagcacuuccccaucgagguccgccacuaccucgcccaguggaucgagucccagcccugggacgccaucgaccucgacaacccccaggaccgcgcccaggccacccagcuccucgagggccucguccaggagcuccagaagaaggccgagcaccaggucggcgaggacggcuuccuccucaagaucaagcucggccacuacgccacccagcuccagugcuccucccccgccggcauccucgucgacgccaugucccagaagcaccuccagaucaaccagaccuucgaggagcuccgccucgucacccaggacaccgagaacgagcucaagaagcuccagcagacccaggaguacuucaucauccaguaccaggagucccuccgcauccaggcccaguucgcccagcucgcccagcucuccccccaggagcgccucucccgcgagaccgcccuccagcagaagcaggucucccucgaggccuggcuccagcgcgaggcccagacccuccagcaguaccgcgucgagcucgccgagaagcaccagaagacccuccagcuccuccgcaagcagcagaccaucauccucgacgacgagcucauccaguggaagcgccgccagcagcucgccggcaacggcggcccccccgagggcucccucgacguccuccaguccuggugcgagaagcucgccgagaucaucuggcagaaccgccagcagauccgccgcgccgagcaccucugccagcagcuccccauccccggccccgucgaggagaugcucgccgaggucaacgccaccaucaccgacaucaucuccgcccucgucaccuccaccuucaucaucgagaagcagcccccccagguccucaagacccagaccaaguucgccgccaccguccgccuccucgucggcggcaagcucaacguccacaugaaccccccccaggucaaggccaccaucaucuccgagcagcaggccaagucccuccucaagaacgagaacacccgcaacgagugcuccggcgagauccucaacaacugcugcgucauggaguaccaccaggccaccggcacccucuccgcccacuuccgcaacaugucccucaagcgcaucaagcgcgccgaccgccgcggcgccgaguccgucaccgaggagaaguucaccguccucuucgagucccaguucuccgucggcuccaacgagcucgucuuccaggucaagacccucucccuccccgucgucgucaucguccacggcucccaggaccacaacgccaccgccaccguccucugggacaacgccuucgccgagcccggccgcguccccuucgccguccccgacaagguccucuggccccagcucugcgaggcccucaacaugaaguucaaggccgagguccaguccaaccgcggccucaccaaggagaaccucgucuuccucgcccagaagcucuucaacaacuccuccucccaccucgaggacuacuccggccucuccgucuccuggucccaguucaaccgcgagaaccuccccggcuggaacuacaccuucuggcagugguucgacggcgucauggagguccucaagaagcaccacaagccccacuggaacgacggcgccauccucggcuucgucaacaagcagcaggcccacgaccuccucaucaacaagcccgacggcaccuuccuccuccgcuucuccgacuccgagaucggcggcaucaccaucgccuggaaguucgacucccccgagcgcaaccucuggaaccucaagcccuucaccacccgcgacuucuccauccgcucccucgccgaccgccucggcgaccucuccuaccucaucuacgucuuccccgaccgccccaaggacgaggucuucuccaaguacuacacccccguccucgccaaggccgucgacggcuacgucaagccccagaucaagcaggucguccccgaguucgucaacgccuccgccgacgccggcggcuccuccgccaccuacauggaccaggcccccucccccgccgucugcccccaggcccccuacaacauguacccccagaaccccgaccacguccucgaccaggacggcgaguucgaccucgacgagaccauggacgucgcccgccacgucgaggagcuccuccgccgccccauggacucccucgacucccgccucuccccccccgccggccucuucaccuccgcccgcggcucccucuccuga

SEQ ID NO: 50251 - RNA, 2364 nt, Artificial Sequence
  derived and/or modified sequence opt2 from STAT5B__Homo_sapiens__NP_036580
auggccgucuggauccaggcccagcagcuccagggcgaggcccuccaccagaugcaggcccucuacggccagcacuuccccaucgagguccgccacuaccucucccaguggaucgagucccaggccugggacuccgucgaccucgacaacccccaggagaacaucaaggccacccagcuccucgagggccucguccaggagcuccagaagaaggccgagcaccaggucggcgaggacggcuuccuccucaagaucaagcucggccacuacgccacccagcuccagaacaccuacgaccgcugccccauggagcucguccgcugcauccgccacauccucuacaacgagcagcgccucguccgcgaggccaacaacggcuccucccccgccggcucccucgccgacgccaugucccagaagcaccuccagaucaaccagaccuucgaggagcuccgccucgucacccaggacaccgagaacgagcucaagaagcuccagcagacccaggaguacuucaucauccaguaccaggagucccuccgcauccaggcccaguucggcccccucgcccagcucuccccccaggagcgccucucccgcgagaccgcccuccagcagaagcaggucucccucgaggccuggcuccagcgcgaggcccagacccuccagcaguaccgcgucgagcucgccgagaagcaccagaagacccuccagcuccuccgcaagcagcagaccaucauccucgacgacgagcucauccaguggaagcgccgccagcagcucgccggcaacggcggcccccccgagggcucccucgacguccuccaguccuggugcgagaagcucgccgagaucaucuggcagaaccgccagcagauccgccgcgccgagcaccucugccagcagcuccccauccccggccccgucgaggagaugcucgccgaggucaacgccaccaucaccgacaucaucuccgcccucgucaccuccaccuucaucaucgagaagcagcccccccagguccucaagacccagaccaaguucgccgccaccguccgccuccucgucggcggcaagcucaacguccacaugaaccccccccaggucaaggccaccaucaucuccgagcagcaggccaagucccuccucaagaacgagaacacccgcaacgacuacuccggcgagauccucaacaacugcugcgucauggaguaccaccaggccaccggcacccucuccgcccacuuccgcaacaugucccucaagcgcaucaagcgcuccgaccgccgcggcgccgaguccgucaccgaggagaaguucaccauccucuucgagucccaguucuccgucggcggcaacgagcucgucuuccaggucaagacccucucccuccccgucgucgucaucguccacggcucccaggacaacaacgccaccgccaccguccucugggacaacgccuucgccgagcccggccgcguccccuucgccguccccgacaagguccucuggccccagcucugcgaggcccucaacaugaaguucaaggccgagguccaguccaaccgcggccucaccaaggagaaccucgucuuccucgcccagaagcucuucaacaacuccuccucccaccucgaggacuacuccggccucuccgucuccuggucccaguucaaccgcgagaaccuccccggccgcaacuacaccuucuggcagugguucgacggcgucauggagguccucaagaagcaccucaagccccacuggaacgacggcgccauccucggcuucgucaacaagcagcaggcccacgaccuccucaucaacaagcccgacggcaccuuccuccuccgcuucuccgacuccgagaucggcggcaucaccaucgccuggaaguucgacucccaggagcgcauguucuggaaccucaugcccuucaccacccgcgacuucuccauccgcucccucgccgaccgccucggcgaccucaacuaccucaucuacgucuuccccgaccgccccaaggacgaggucuacuccaaguacuacacccccguccccugcgaguccgccaccgccaaggccgucgacggcuacgucaagccccagaucaagcaggucguccccgaguucgucaacgccuccgccgacgccggcggcggcuccgccaccuacauggaccaggcccccucccccgccgucugcccccaggcccacuacaacauguacccccagaaccccgacuccguccucgacaccgacggcgacuucgaccucgaggacaccauggacgucgcccgccgcgucgaggagcuccucggccgccccauggacucccaguggaucccccacgcccaguccuga

SEQ ID NO: 50252 - RNA, 2544 nt, Artificial Sequence
  derived and/or modified sequence opt2 from STAT6__Homo_sapiens__XP_006719637
augucccucuggggccucgucuccaagaugccccccgagaagguccagcgccucuacgucgacuucccccagcaccuccgccaccuccucggcgacuggcucgagucccagcccugggaguuccucgucggcuccgacgccuucugcugcaaccucgccuccgcccuccucuccgacaccguccagcaccuccaggccuccgucggcgagcagggcgagggcuccaccauccuccagcacaucuccacccucgaguccaucuaccagcgcgacccccucaagcucgucgccaccuuccgccagauccuccagggcgagaagaaggccgucauggagcaguuccgccaccuccccaugcccuuccacuggaagcaggaggagcucaaguucaagaccggccuccgccgccuccagcaccgcgucggcgagauccaccuccuccgcgaggcccuccagaagggcgccgaggccggccaggucucccuccacucccucaucgagacccccgccaacggcaccggccccuccgaggcccucgccaugcuccuccaggagaccaccggcgagcucgaggccgccaaggcccucguccucaagcgcauccagaucuggaagcgccagcagcagcucgccggcaacggcgcccccuucgaggagucccucgccccccuccaggagcgcugcgagucccucgucgacaucuacucccagcuccagcaggaggucggcgccgccggcggcgagcucgagcccaagacccgcgccucccucaccggccgccucgacgagguccuccgcacccucgucaccuccugcuuccucgucgagaagcagcccccccagguccucaagacccagaccaaguuccaggccggcguccgcuuccuccucggccuccgcuuccucggcgcccccgccaagcccccccucguccgcgccgacauggucaccgagaagcaggcccgcgagcucuccgucccccagggccccggcgccggcgccgaguccaccggcgagaucaucaacaacaccgucccccucgagaacuccauccccggcaacugcugcuccgcccucuucaagaaccuccuccucaagaagaucaagcgcugcgagcgcaagggcaccgaguccgucaccgaggagaagugcgccguccucuucuccgccuccuucacccucggccccggcaagcuccccauccagcuccaggcccucucccucccccucgucgucaucguccacggcaaccaggacaacaacgccaaggccaccauccucugggacaacgccuucuccgagauggaccgcguccccuucgucgucgccgagcgcguccccugggagaagaugugcgagacccucaaccucaaguucauggccgaggucggcaccaaccgcggccuccuccccgagcacuuccucuuccucgcccagaagaucuucaacgacaacucccucuccauggaggccuuccagcaccgcuccgucuccuggucccaguucaacaaggagauccuccucggccgcggcuucaccuucuggcagugguucgacggcguccucgaccucaccaagcgcugccuccgcuccuacugguccgaccgccucaucaucggcuucaucuccaagcaguacgucaccucccuccuccucaacgagcccgacggcaccuuccuccuccgcuucuccgacuccgagaucggcggcaucaccaucgcccacgucauccgcggccaggacggcuccccccagaucgagaacauccagcccuucuccgccaaggaccucuccauccgcucccucggcgaccgcauccgcgaccucgcccagcucaagaaccucuaccccaagaagcccaaggacgaggccuuccgcucccacuacaagcccgagcagaugggcaaggacggccgcggcuacguccccgccaccaucaagaugaccgucgagcgcgaccagccccuccccacccccgagcuccagaugcccaccaugguccccuccuacgaccucggcauggcccccgacuccuccauguccaugcagcucggccccgacauggucccccaggucuaccccccccacucccacuccaucccccccuaccagggccucucccccgaggaguccgucaacguccucuccgccuuccaggagccccaccuccagaugccccccucccucggccagaugucccuccccuucgaccagccccacccccagggccuccuccccugccagccccaggagcacgccgucuccucccccgacccccuccucugcuccgacgucaccauggucgaggacuccugccucucccagcccgucaccgccuucccccagggcaccuggaucggcgaggacaucuuccccccccuccucccccccaccgagcaggaccucaccaagcuccuccucgagggccagggcgaguccggcggcggcucccucggcgcccagccccuccuccagcccucccacuacggccaguccggcaucuccaugucccacauggaccuccgcgccaaccccuccugguga

SEQ ID NO: 50253 - RNA, 159 nt, Artificial Sequence
  derived and/or modified sequence opt2 from STATH__Homo_sapiens__NP_001009181
augaaguuccucgucuucgccuucauccucgcccucauggucuccaugaucggcgccgacuccuccgaggaguacggcuacggccccuaccagcccguccccgagcagccccucuacccccagcccuaccagccccaguaccagcaguacaccuucuga

SEQ ID NO: 50254 - RNA, 1713 nt, Artificial Sequence
  derived and/or modified sequence opt2 from STAU2__Homo_sapiens__NP_001157852
auggccaaccccaaggagaagaccgccaugugccucgucaacgagcucgcccgcuucaaccgcguccagccccaguacaagcuccucaacgagcgcggccccgcccacuccaagauguucuccguccagcucucccucggcgagcagaccugggaguccgagggcuccuccaucaagaaggcccagcaggccgucgccaacaaggcccucaccgaguccacccuccccaagcccguccagaagccccccaaguccaacgucaacaacaaccccggcuccaucacccccaccgucgagcucaacggccucgccaugaagcgcggcgagcccgccaucuaccgcccccucgaccccaagcccuuccccaacuaccgcgccaacuacaacuuccgcggcauguacaaccagcgcuaccacugccccguccccaagaucuucuacguccagcucaccgucggcaacaacgaguucuucggcgagggcaagacccgccaggccgcccgccacaacgccgccaugaaggcccuccaggcccuccagaacgagcccauccccgagcgcuccccccagaacggcgaguccggcaaggacgucgacgacgacaaggacgccaacaaguccgagaucucccucgucuucgagaucgcccucaagcgcaacaugcccgucuccuucgaggucaucaaggaguccggccccccccacaugaaguccuucgucacccgcgucuccgucggcgaguucuccgccgagggcgagggcaacuccaagaagcucuccaagaagcgcgccgccaccaccguccuccaggagcucaagaagcuccccccccuccccgucgucgagaagcccaagcucuucuucaagaagcgccccaagaccaucgucaaggccggccccgaguacggccagggcaugaaccccaucucccgccucgcccagauccagcaggccaagaaggagaaggagcccgacuacguccuccucuccgagcgcggcaugccccgccgccgcgaguucgucaugcaggucaaggucggcaacgaggucgccaccggcaccggccccaacaagaagaucgccaagaagaacgccgccgaggccaugcuccuccagcucggcuacaaggccuccaccaaccuccaggaccagcucgagaagaccggcgagaacaagggcugguccggccccaagcccggcuuccccgagcccaccaacaacacccccaagggcauccuccaccucucccccgacgucuaccaggagauggaggccucccgccacaaggucaucuccggcaccacccucggcuaccucucccccaaggacaugaaccagcccuccuccuccuucuucuccaucucccccaccuccaacuccuccgccaccaucgcccgcgagcuccucaugaacggcaccuccuccaccgccgaggccaucggccucaagggcuccucccccaccccccccugcucccccguccagcccuccaagcagcucgaguaccucgcccgcauccagggcuuccaggccgcccucuccgcccucaagcaguucuccgagcagggccucgaccccaucgacggcgccaugaacaucgagaagggcucccucgagaagcaggccaagcaccuccgcgagaaggccgacaacaaccaggccccccccggcuccaucgcccaggacugcaagaaguccaacuccgccgucuga

SEQ ID NO: 50255 - RNA, 1077 nt, Artificial Sequence
  derived and/or modified sequence opt2 from STBD1__Homo_sapiens__NP_003934
augggcgccgucugguccgcccuccucgucggcggcggccucgccggcgcccucuucgucuggcuccuccgcggcggccccggcgacaccggcaaggacggcgacgccgagcaggagaaggacgccccccucggcggcgccgccauccccggcggccaccaguccggcuccuccggccucucccccggccccuccggccaggagcucgucaccaagcccgagcaccuccaggaguccaacggccaccucaucuccaagaccaaggaccucggcaagcuccaggccgccuccuggcgccuccagaaccccucccgcgaggucugcgacaacucccgcgagcacguccccuccggccaguuccccgacaccgaggcccccgccaccuccgagaccuccaacucccgcuccuacuccgaggucucccgcaacgagucccucgagucccccaugggcgaguggggcuuccagaagggccaggagaucuccgccaaggccgccaccugcuucgccgagaagcuccccuccuccaaccuccucaagaaccgcgccaaggaggagaugucccucuccgaccucaacucccaggaccgcgucgaccacgaggagugggagauggucccccgccacuccuccuggggcgacgucggcgucggcggcucccucaaggcccccguccucaaccucaaccagggcauggacaacggccgcuccacccucgucgaggcccgcggccagcagguccacggcaagauggagcgcgucgccgucaugcccgccggcucccagcaggucuccguccgcuuccagguccacuacgucaccuccaccgacguccaguucaucgccgucaccggcgaccacgagugccucggccgcuggaacaccuacaucccccuccacuacaacaaggacggcuucuggucccacuccaucuuccuccccgccgacaccgucgucgaguggaaguucguccucgucgagaacggcggcgucacccgcugggaggagugcuccaaccgcuuccucgagaccggccacgaggacaaggucguccacgccugguggggcauccacuga

SEQ ID NO: 50256 - RNA, 744 nt, Artificial Sequence
  derived and/or modified sequence opt2 from STC1__Homo_sapiens__NP_003146
augcuccagaacuccgccguccuccucguccucgucaucuccgccuccgccacccacgaggccgagcagaacgacuccgucuccccccgcaagucccgcgucgccgcccagaacuccgccgaggucguccgcugccucaacuccgcccuccaggucggcugcggcgccuucgccugccucgagaacuccaccugcgacaccgacggcauguacgacaucugcaaguccuuccucuacuccgccgccaaguucgacacccagggcaaggccuucgucaaggagucccucaagugcaucgccaacggcgucaccuccaaggucuuccucgccauccgccgcugcuccaccuuccagcgcaugaucgccgagguccaggaggagugcuacuccaagcucaacgucugcuccaucgccaagcgcaaccccgaggccaucaccgaggucguccagcuccccaaccacuucuccaaccgcuacuacaaccgccucguccgcucccuccucgagugcgacgaggacaccgucuccaccauccgcgacucccucauggagaagaucggccccaacauggccucccucuuccacauccuccagaccgaccacugcgcccagacccacccccgcgccgacuucaaccgccgccgcaccaacgagccccagaagcucaagguccuccuccgcaaccuccgcggcgaggaggacucccccucccacaucaagcgcaccucccacgaguccgccuga

SEQ ID NO: 50257 - RNA, 909 nt, Artificial Sequence
  derived and/or modified sequence opt2 from STC2__Homo_sapiens__NP_003705
augugcgccgagcgccucggccaguucaugacccucgcccucguccucgccaccuucgaccccgcccgcggcaccgacgccaccaacccccccgagggcccccaggaccgcuccucccagcagaagggccgccucucccuccagaacaccgccgagauccagcacugccucgucaacgccggcgacgucggcugcggcgucuucgagugcuucgagaacaacuccugcgagauccgcggccuccacggcaucugcaugaccuuccuccacaacgccggcaaguucgacgcccagggcaaguccuucaucaaggacgcccucaagugcaaggcccacgcccuccgccaccgcuucggcugcaucucccgcaagugccccgccauccgcgagauggucucccagcuccagcgcgagugcuaccucaagcacgaccucugcgccgccgcccaggagaacacccgcgucaucgucgagaugauccacuucaaggaccuccuccuccacgagcccuacgucgaccucgucaaccuccuccucaccugcggcgaggaggucaaggaggccaucacccacuccguccagguccagugcgagcagaacuggggcucccucugcuccauccucuccuucugcaccuccgccauccagaagccccccaccgccccccccgagcgccagccccaggucgaccgcaccaagcucucccgcgcccaccacggcgaggccggccaccaccuccccgagcccuccucccgcgagaccggccgcggcgccaagggcgagcgcggcuccaagucccaccccaacgcccacgcccgcggccgcgucggcggccucggcgcccagggccccuccggcuccuccgagugggaggacgagcaguccgaguacuccgacauccgccgcuga

SEQ ID NO: 50258 - RNA, 1020 nt, Artificial Sequence
  derived and/or modified sequence opt2 from STEAP1__Homo_sapiens__NP_036581
auggagucccgcaaggacaucaccaaccaggaggagcucuggaagaugaagccccgccgcaaccucgaggaggacgacuaccuccacaaggacaccggcgagaccuccaugcucaagcgccccguccuccuccaccuccaccagaccgcccacgccgacgaguucgacugccccuccgagcuccagcacacccaggagcucuucccccaguggcaccuccccaucaagaucgccgccaucaucgccucccucaccuuccucuacacccuccuccgcgaggucauccacccccucgccaccucccaccagcaguacuucuacaagauccccauccucgucaucaacaagguccuccccauggucuccaucacccuccucgcccucgucuaccuccccggcgucaucgccgccaucguccagcuccacaacggcaccaaguacaagaaguucccccacuggcucgacaaguggaugcucacccgcaagcaguucggccuccucuccuucuucuucgccguccuccacgccaucuacucccucuccuaccccaugcgccgcuccuaccgcuacaagcuccucaacugggccuaccagcagguccagcagaacaaggaggacgccuggaucgagcacgacgucuggcgcauggagaucuacgucucccucggcaucgucggccucgccauccucgcccuccucgccgucaccuccauccccuccgucuccgacucccucaccuggcgcgaguuccacuacauccaguccaagcucggcaucgucucccuccuccucggcaccauccacgcccucaucuucgccuggaacaaguggaucgacaucaagcaguucgucugguacaccccccccaccuucaugaucgccgucuuccuccccaucgucguccucaucuucaaguccauccucuuccuccccugccuccgcaagaagauccucaagauccgccacggcugggaggacgucaccaagaucaacaagaccgagaucugcucccagcucuga

SEQ ID NO: 50259 - RNA, 1473 nt, Artificial Sequence
  derived and/or modified sequence opt2 from STEAP2__Homo_sapiens__NP_001231873
auggaguccaucuccaugaugggcucccccaagucccucuccgagaccuuccuccccaacggcaucaacggcaucaaggacgcccgcaaggucaccgucggcgucaucggcuccggcgacuucgccaagucccucaccauccgccucauccgcugcggcuaccacgucgucaucggcucccgcaaccccaaguucgccuccgaguucuucccccacgucgucgacgucacccaccacgaggacgcccucaccaagaccaacaucaucuucgucgccauccaccgcgagcacuacaccucccucugggaccuccgccaccuccucgucggcaagauccucaucgacgucuccaacaacaugcgcaucaaccaguaccccgaguccaacgccgaguaccucgccucccucuuccccgacucccucaucgucaagggcuucaacgucgucuccgccugggcccuccagcucggccccaaggacgccucccgccaggucuacaucugcuccaacaacauccaggcccgccagcaggucaucgagcucgcccgccagcucaacuucauccccaucgaccucggcucccucuccuccgcccgcgagaucgagaaccucccccuccgccucuucacccucuggcgcggccccgucgucgucgccaucucccucgccaccuucuucuuccucuacuccuucguccgcgacgucauccaccccuacgcccgcaaccagcaguccgacuucuacaagauccccaucgagaucgucaacaagacccuccccaucgucgccaucacccuccucucccucgucuaccucgccggccuccucgccgccgccuaccagcucuacuacggcaccaaguaccgccgcuucccccccuggcucgagaccuggcuccagugccgcaagcagcucggccuccucuccuucuucuucgccaugguccacgucgccuacucccucugccuccccaugcgccgcuccgagcgcuaccucuuccucaacauggccuaccagcagguccacgccaacaucgagaacuccuggaacgaggaggaggucuggcgcaucgagauguacaucuccuucggcaucaugucccucggccuccucucccuccucgccgucaccuccauccccuccgucuccaacgcccucaacuggcgcgaguucuccuucauccaguccacccucggcuacgucgcccuccucaucuccaccuuccacguccucaucuacggcuggaagcgcgccuucgaggaggaguacuaccgcuucuacaccccccccaacuucguccucgcccucguccuccccuccaucgucauccucggcaagaucauccucuuccuccccugcaucucccgcaagcucaagcgcaucaagaagggcugggagaagucccaguuccucgaggagggcaugggcggcaccaucccccacgucucccccgagcgcgucaccgucauguga

SEQ ID NO: 50260 - RNA, 1467 nt, Artificial Sequence
  derived and/or modified sequence opt2 from STEAP3__Homo_sapiens__NP_001008410
augcccgaggagauggacaagccccucaucucccuccaccucgucgacuccgacuccucccucgccaagguccccgacgaggcccccaaggucggcauccucggcuccggcgacuucgcccgcucccucgccacccgccucgucggcuccggcuucaaggucgucgucggcucccgcaaccccaagcgcaccgcccgccucuuccccuccgccgcccaggucaccuuccaggaggaggccgucuccucccccgaggucaucuucgucgccgucuuccgcgagcacuacuccucccucugcucccucuccgaccagcucgccggcaagauccucgucgacgucuccaaccccaccgagcaggagcaccuccagcaccgcgaguccaacgccgaguaccucgccucccucuuccccaccugcaccgucgucaaggccuucaacgucaucuccgccuggacccuccaggccggcccccgcgacggcaaccgccagguccccaucugcggcgaccagcccgaggccaagcgcgccgucuccgagauggcccucgccaugggcuucaugcccgucgacaugggcucccucgccuccgccugggaggucgaggccaugccccuccgccuccuccccgccuggaagguccccacccuccucgcccucggccucuucgucugcuucuacgccuacaacuucguccgcgacguccuccagcccuacguccaggagucccagaacaaguucuucaagcuccccgucuccgucgucaacaccacccuccccugcgucgccuacguccuccucucccucgucuaccuccccggcguccucgccgccgcccuccagcuccgccgcggcaccaaguaccagcgcuuccccgacuggcucgaccacuggcuccagcaccgcaagcagaucggccuccucuccuucuucugcgccgcccuccacgcccucuacuccuucugccucccccuccgccgcgcccaccgcuacgaccucgucaaccucgccgucaagcagguccucgccaacaagucccaccucugggucgaggaggaggucuggcgcauggagaucuaccucucccucggcguccucgcccucggcacccucucccuccucgccgucaccucccuccccuccaucgccaacucccucaacuggcgcgaguucuccuucguccaguccucccucggcuucgucgcccucguccucuccacccuccacacccucaccuacggcuggacccgcgccuucgaggagucccgcuacaaguucuaccucccccccaccuucacccucacccuccucguccccugcgucgucauccucgccaaggcccucuuccuccuccccugcaucucccgccgccucgcccgcauccgccgcggcugggagcgcgaguccaccaucaaguucacccuccccaccgaccacgcccucgccgagaagaccucccacgucuga

SEQ ID NO: 50261 - RNA, 852 nt, Artificial Sequence
  derived and/or modified sequence opt2 from STEAP4__Homo_sapiens__NP_001192245
auggagaagaccugcaucgacgcccucccccucaccaugaacuccuccgagaagcaggagaccgucugcaucuucggcaccggcgacuucggccgcucccucggccucaagaugcuccagugcggcuacuccgucgucuucggcucccgcaacccccagaagaccacccuccuccccuccggcgccgagguccucuccuacuccgaggccgccaagaaguccggcaucaucaucaucgccauccaccgcgagcacuacgacuuccucaccgagcucaccgagguccucaacggcaagauccucgucgacaucuccaacaaccucaagaucaaccaguaccccgaguccaacgccgaguaccucgcccaccucguccccggcgcccacgucgucaaggccuucaacaccaucuccgccugggcccuccaguccggcgcccucgacgccucccgccaggccauccucaagaaggagaaccccuucuccaccuccuccgccuggcucuccgacuccuacgucgcccucggcauccucggcuucuuccucuucguccuccucggcaucaccucccuccccuccgucuccaacgccgucaacuggcgcgaguuccgcuucguccaguccaagcucggcuaccucacccucauccucugcaccgcccacacccucgucuacggcggcaagcgcuuccucucccccuccaaccuccgcugguaccuccccgccgccuacguccucggccucaucauccccugcaccguccucgucaucaaguucguccucaucaugcccugcgucgacaacacccucacccgcauccgccagggcugggagcgcaacuccaagcacuga

SEQ ID NO: 50262 - RNA, 387 nt, Artificial Sequence
  derived and/or modified sequence opt2 from STH__Homo_sapiens__NP_001007533
auguccgagggcggcggccaggucuccugcaucuucgccgcccccacccgccucugccgcuggcccgcccucaucgagugcggcgucaaccucacccagccccucugcgaguggaugauccaggucgcccgcgaccgcacccucucccucgccugggaggucgccucccuccucacccucuccuccuccgaggucggccucgagggcgucggcaccaucuggcccuccuccuacuccuccgaggaguccucccgcaacggcgccgagcagggccgccagcucuccaucgagggccccuuccagggccagaacugccccucccaccccgccgccgcccucccccuccccaugcgcggcgagucccaggccaccuccugccaggucuga

SEQ ID NO: 50263 - RNA, 3867 nt, Artificial Sequence
  derived and/or modified sequence opt2 from STIL__Homo_sapiens__XP_011540294
auggagcccaucuaccccuucgcccgcccccagaugaacacccgcuuccccuccucccgcaugguccccuuccacuucccccccuccaagugcgcccucuggaaccccacccccaccggcgacuucaucuaccuccaccucuccuacuaccgcaaccccaagcucgucgucaccgagaagaccauccgccucgccuaccgccacgccaagcagaacaagaagaacuccuccugcuuccuccucggcucccucaccgccgacgaggacgaggagggcgucacccucaccgucgaccgcuucgaccccggccgcgagguccccgagugccucgagaucacccccaccgccucccuccccggcgacuuccucauccccugcaagguccacacccaggagcucugcucccgcgagaugaucguccacuccgucgacgacuucuccuccgcccucaaggcccuccagugccacaucugcuccaaggacucccucgacugcggcaagcuccucucccuccgcguccacaucaccucccgcgagucccucgacuccgucgaguucgaccuccacugggccgccgucacccucgccaacaacuucaagugcacccccgucaagcccauccccaucauccccaccgcccucgcccgcaaccucuccuccaaccucaacaucucccagguccagggcaccuacaaguacggcuaccucaccauggacgagacccgcaagcuccuccuccuccucgaguccgaccccaaggucuacucccucccccucgucggcaucuggcucuccggcaucacccacaucuacuccccccaggucugggccugcugccuccgcuacaucuucaacuccuccguccaggagcgcgucuucuccgaguccggcaacuucaucaucguccucuacuccaugacccacaaggagcccgaguucuacgagugcuuccccugcgacggcaagauccccgacuuccgcuuccagcuccucaccuccaaggagacccuccaccucuucaagaacgucgagccccccgacaagaaccccauccgcugcgagcucuccgccgagucccagaacgccgagaccgaguucuucuccaaggccuccaagaacuucuccaucaagcgcuccucccagaagcucuccuccggcaagaugcccauccacgaccacgacuccggcgucgaggacgaggacuucuccccccgccccauccccuccccccaccccgucucccagaagaucuccaagauccagcccuccguccccgagcucucccucguccucgacggcaacuucaucgaguccaacccccuccccaccccccucgagauggucaacaacgagaaccccccccucaucaaccaccucgagcaccucaagccccuccagccccagcucuacgacgagaagcacucccccgaggucgaggccggcgagcccucccuccgcggcauccccaaccagcucaaccaggacaagcccgcccuccuccgccacugcaagguccgccagccccccgccuacaagaagggcaacccccacacccgcaacuccaucaagcccuccucccacaacggccccucccacgacaucuucgagaagcuccagaccgucuccgccggcaacguccagaacgaggaguaccccauccgccccuccacccucaacucccgccaguccucccucgccccccagucccagccccacgacuucgucuucuccccccacaacuccggccgccccauggagcuccagauccccacccccccccuccccuccuacugcuccaccaacgucugccgcugcugccagcaccacucccacauccaguacuccccccucaacuccuggcagggcgccaacaccgucggcuccauccaggacguccaguccgaggcccuccagaagcacucccucuuccaccccuccggcugccccgcccucuacugcaacgccuucugcuccuccuccucccccaucgcccuccgcccccagggcgacaugggcuccugcuccccccacuccaacaucgagcccucccccgucgcccgcccccccucccacauggaccucugcaacccccagcccugcaccgucugcaugcacacccccaagaccgaguccgacaacggcaugaugggccucucccccgacgccuaccgcuuccucaccgagcaggaccgccagcuccgccuccuccaggcccagauccagcgccuccucgaggcccagucccucaugcccugcucccccaagaccaccgccgucgaggacaccguccaggccggccgccagauggagcucgucuccgucgaggcccaguccucccccggccuccacaugcgcaagggcgucuccaucgccgucuccaccggcgccucccucuucuggaacgccgccggcgaggaccaggagcccgacucccagaugaagcaggacgacaccaagaucuccuccgaggacaugaacuucuccgucgacaucaacaacgaggucaccucccuccccggcuccgccuccucccucaaggccgucgacauccccuccuucgaggaguccaacaucgccgucgaggaggaguucaaccagccccucuccgucuccaacuccuccucccucgucguccgcaaggagcccgacguccccgucuucuuccccuccggccagcucgccgaguccgucuccaugugccuccagaccggccccaccggcggcgccuccaacaacuccgagaccuccgaggagcccaagaucgagcacgucaugcagccccuccuccaccagcccuccgacaaccagaagaucuaccaggaccuccucggccaggucaaccaccuccucaacuccuccuccaaggagaccgagcagcccuccaccaaggccgucaucaucucccacgagugcacccgcacccagaacgucuaccacaccaagaagaagacccaccacucccgccucgucgacaaggacugcguccucaacgccacccucaagcagcuccgcucccucggcgucaagaucgacucccccaccaaggucaagaagaacgcccacaacgucgaccacgccuccguccucgccugcaucucccccgaggccgucaucuccggccucaacugcauguccuucgccaacgucggcauguccggccucucccccaacggcgucgaccucuccauggaggccaacgccaucgcccucaaguaccucaacgagaaccagcucucccagcucuccgucacccgcuccaaccagaacaacugcgaccccuucucccuccuccacaucaacaccgaccgcuccaccgucggccucucccucaucucccccaacaacauguccuucgccaccaagaaguacaugaagcgcuacggccuccuccaguccuccgacaacuccgaggacgaggaggagccccccgacaacgccgacuccaaguccgaguaccuccucaaccagaaccuccgcuccauccccgagcagcucggcggccagaaggagcccuccaagaacgaccacgagaucaucaacugcuccaacugcgaguccgucggcaccaacgccgacacccccguccuccgcaacaucaccaacgagguccuccagaccaaggccaagcagcagcucaccgagaagcccgccuuccucgucaagaaccucaagcccucccccgccgucaaccuccgcaccggcaaggccgaguucacccagcaccccgagaaggagaacgagggcgacaucaccaucuuccccgagucccuccagcccuccgagacccucaagcagaugaacuccaugaacuccgucggcaccuuccucgacgucaagcgccuccgccagcuccccaagcucuucuga

SEQ ID NO: 50264 - RNA, 2058 nt, Artificial Sequence
  derived and/or modified sequence opt2 from STIM1__Homo_sapiens__NP_003147
auggacgucugcguccgccucgcccucuggcuccucuggggccuccuccuccaccagggccagucccucucccacucccacuccgagaaggccaccggcaccuccuccggcgccaacuccgaggaguccaccgccgccgaguucugccgcaucgacaagccccucugccacuccgaggacgagaagcucuccuucgaggccguccgcaacauccacaagcucauggacgacgacgccaacggcgacgucgacgucgaggaguccgacgaguuccuccgcgaggaccucaacuaccacgaccccaccgucaagcacuccaccuuccacggcgaggacaagcucaucuccgucgaggaccucuggaaggccuggaaguccuccgaggucuacaacuggaccgucgacgaggucguccaguggcucaucaccuacgucgagcucccccaguacgaggagaccuuccgcaagcuccagcucuccggccacgccaugccccgccucgccgucaccaacaccaccaugaccggcaccguccucaagaugaccgaccgcucccaccgccagaagcuccagcucaaggcccucgacaccguccucuucggccccccccuccucacccgccacaaccaccucaaggacuucaugcucgucgucuccaucgucaucggcgucggcggcugcugguucgccuacauccagaaccgcuacuccaaggagcacaugaagaagaugaugaaggaccucgagggccuccaccgcgccgagcagucccuccacgaccuccaggagcgccuccacaaggcccaggaggagcaccgcaccgucgaggucgagaagguccaccucgagaagaagcuccgcgacgagaucaaccucgccaagcaggaggcccagcgccucaaggagcuccgcgagggcaccgagaacgagcgcucccgccagaaguacgccgaggaggagcucgagcagguccgcgaggcccuccgcaaggccgagaaggagcucgagucccacuccuccugguacgcccccgaggcccuccagaaguggcuccagcucacccacgaggucgagguccaguacuacaacaucaagaagcagaacgccgagaagcagcuccucgucgccaaggagggcgccgagaagaucaagaagaagcgcaacacccucuucggcaccuuccacgucgcccacuccuccucccucgacgacgucgaccacaagauccucaccgccaagcaggcccucuccgaggucaccgccgcccuccgcgagcgccuccaccgcuggcagcagaucgagauccucugcggcuuccagaucgucaacaaccccggcauccacucccucgucgccgcccucaacaucgaccccuccuggaugggcuccacccgccccaaccccgcccacuucaucaugaccgacgacgucgacgacauggacgaggagaucgucuccccccucuccaugcagucccccucccuccaguccuccguccgccagcgccucaccgagccccagcacggccucggcucccagcgcgaccucacccacuccgacuccgaguccucccuccacauguccgaccgccagcgcgucgcccccaagcccccccagaugucccgcgccgccgacgaggcccucaacgccaugaccuccaacggcucccaccgccucaucgagggcguccaccccggcucccucgucgagaagcuccccgacucccccgcccucgccaagaaggcccuccucgcccucaaccacggccucgacaaggcccacucccucauggagcucucccccuccgccccccccggcggcuccccccaccucgacuccucccgcucccacucccccuccucccccgaccccgacacccccucccccgucggcgacucccgcgcccuccaggccucccgcaacacccgcaucccccaccucgccggcaagaaggccgucgccgaggaggacaacggcuccaucggcgaggagaccgacuccucccccggccgcaagaaguucccccucaagaucuucaagaagccccucaagaaguga

SEQ ID NO: 50265 - RNA, 1800 nt, Artificial Sequence
  derived and/or modified sequence opt2 from STIM2__Homo_sapiens__NP_001162588
augcucguccucggccuccucgucgccggcgccgccgacggcugcgagcucgucccccgccaccuccgcggccgccgcgccaccggcuccgccgccaccgccgccuccucccccgccgccgccgccggcgacucccccgcccucaugaccgaccccugcaugucccucuccccccccugcuucaccgaggaggaccgcuucucccucgaggcccuccagaccauccacaagcagauggacgacgacaaggacggcggcaucgaggucgaggaguccgacgaguucauccgcgaggacaugaaguacaaggacgccaccaacaagcacucccaccuccaccgcgaggacaagcacaucaccaucgaggaccucuggaagcgcuggaagaccuccgagguccacaacuggacccucgaggacacccuccaguggcucaucgaguucgucgagcucccccaguacgagaagaacuuccgcgacaacaacgucaagggcaccacccucccccgcaucgccguccacgagcccuccuucaugaucucccagcucaagaucuccgaccgcucccaccgccagaagcuccagcucaaggcccucgacgucguccucuucggcccccucacccgccccccccacaacuggaugaaggacuucauccucaccgucuccaucgucaucggcgucggcggcugcugguucgccuacacccagaacaagaccuccaaggagcacgucgccaagaugaugaaggaccucgagucccuccagaccgccgagcagucccucauggaccuccaggagcgccucgagaaggcccaggaggagaaccgcaacgucgccgucgagaagcagaaccucgagcgcaagaugauggacgagaucaacuacgccaaggaggaggccugccgccuccgcgagcuccgcgagggcgccgagugcgagcucucccgccgccaguacgccgagcaggagcucgagcagguccgcauggcccucaagaaggccgagaaggaguucgagcuccgcuccuccugguccguccccgacgcccuccagaaguggcuccagcucacccacgaggucgagguccaguacuacaacaucaagcgccagaacgccgagaugcagcucgccaucgccaaggacgaggccgagaagaucaagaagaagcgcuccaccgucuucggcacccuccacgucgcccacuccuccucccucgacgaggucgaccacaagauccucgaggccaagaaggcccucuccgagcucaccaccugccuccgcgagcgccucuuccgcuggcagcagaucgagaagaucugcggcuuccagaucgcccacaacuccggccuccccucccucaccuccucccucuacuccgaccacuccugggucgucaugccccgcgucuccaucccccccuaccccaucgccggcggcgucgacgaccucgacgaggacaccccccccaucgucucccaguuccccggcaccauggccaagccccccggcucccucgcccgcuccuccucccucugccgcucccgccgcuccaucguccccuccuccccccagccccagcgcgcccagcucgccccccacgccccccaccccucccacccccgccacccccaccacccccagcacaccccccacucccuccccucccccgaccccgacauccucuccgucuccuccugccccgcccucuaccgcaacgaggaggaggaggaggccaucuacuucuccgccgagaagcagugcauccaccucggccucggcgccugcaaguccgaguga

SEQ ID NO: 50266 - RNA, 1632 nt, Artificial Sequence
  derived and/or modified sequence opt2 from STIP1__Homo_sapiens__NP_006810
auggagcaggucaacgagcucaaggagaagggcaacaaggcccucuccgucggcaacaucgacgacgcccuccagugcuacuccgaggccaucaagcucgacccccacaaccacguccucuacuccaaccgcuccgccgccuacgccaagaagggcgacuaccagaaggccuacgaggacggcugcaagaccgucgaccucaagcccgacuggggcaagggcuacucccgcaaggccgccgcccucgaguuccucaaccgcuucgaggaggccaagcgcaccuacgaggagggccucaagcacgaggccaacaacccccagcucaaggagggccuccagaacauggaggcccgccucgccgagcgcaaguucaugaaccccuucaacaugcccaaccucuaccagaagcucgaguccgacccccgcacccgcacccuccucuccgaccccaccuaccgcgagcucaucgagcagcuccgcaacaagcccuccgaccucggcaccaagcuccaggacccccgcaucaugaccacccucuccguccuccucggcgucgaccucggcuccauggacgaggaggaggagaucgccacccccccccccccccccccccccaagaaggagaccaagcccgagcccauggaggaggaccuccccgagaacaagaagcaggcccucaaggagaaggagcucggcaacgacgccuacaagaagaaggacuucgacaccgcccucaagcacuacgacaaggccaaggagcucgaccccaccaacaugaccuacaucaccaaccaggccgccgucuacuucgagaagggcgacuacaacaagugccgcgagcucugcgagaaggccaucgaggucggccgcgagaaccgcgaggacuaccgccagaucgccaaggccuacgcccgcaucggcaacuccuacuucaaggaggagaaguacaaggacgccauccacuucuacaacaagucccucgccgagcaccgcacccccgacguccucaagaagugccagcaggccgagaagauccucaaggagcaggagcgccucgccuacaucaaccccgaccucgcccucgaggagaagaacaagggcaacgagugcuuccagaagggcgacuacccccaggccaugaagcacuacaccgaggccaucaagcgcaaccccaaggacgccaagcucuacuccaaccgcgccgccugcuacaccaagcuccucgaguuccagcucgcccucaaggacugcgaggagugcauccagcucgagcccaccuucaucaagggcuacacccgcaaggccgccgcccucgaggccaugaaggacuacaccaaggccauggacgucuaccagaaggcccucgaccucgacuccuccugcaaggaggccgccgacggcuaccagcgcugcaugauggcccaguacaaccgccacgacucccccgaggacgucaagcgccgcgccauggccgaccccgagguccagcagaucauguccgaccccgccaugcgccucauccucgagcagaugcagaaggacccccaggcccucuccgagcaccucaagaaccccgucaucgcccagaagauccagaagcucauggacgucggccucaucgccauccgcuga

SEQ ID NO: 50267 - RNA, 2907 nt, Artificial Sequence
  derived and/or modified sequence opt2 from STK10__Homo_sapiens__NP_005981
auggccuucgccaacuuccgccgcauccuccgccucuccaccuucgagaagcgcaagucccgcgaguacgagcacguccgccgcgaccucgaccccaacgaggucugggagaucgucggcgagcucggcgacggcgccuucggcaaggucuacaaggccaagaacaaggagaccggcgcccucgccgccgccaaggucaucgagaccaaguccgaggaggagcucgaggacuacaucgucgagaucgagauccucgccaccugcgaccaccccuacaucgucaagcuccucggcgccuacuaccacgacggcaagcucuggaucaugaucgaguucugccccggcggcgccgucgacgccaucaugcucgagcucgaccgcggccucaccgagccccagauccaggucgucugccgccagaugcucgaggcccucaacuuccuccacuccaagcgcaucauccaccgcgaccucaaggccggcaacguccucaugacccucgagggcgacauccgccucgccgacuucggcgucuccgccaagaaccucaagacccuccagaagcgcgacuccuucaucggcacccccuacuggauggcccccgaggucgucaugugcgagaccaugaaggacacccccuacgacuacaaggccgacaucuggucccucggcaucacccucaucgagauggcccagaucgagcccccccaccacgagcucaaccccaugcgcguccuccucaagaucgccaaguccgacccccccacccuccucacccccuccaagugguccgucgaguuccgcgacuuccucaagaucgcccucgacaagaaccccgagacccgccccuccgccgcccagcuccucgagcaccccuucgucuccuccaucaccuccaacaaggcccuccgcgagcucgucgccgaggccaaggccgaggucauggaggagaucgaggacggccgcgacgagggcgaggaggaggacgccgucgacgccgccuccacccucgagaaccacacccagaacuccuccgaggucuccccccccucccucaacgccgacaagccccucgaggagucccccuccaccccccucgcccccucccagucccaggacuccgucaacgagcccugcucccagcccuccggcgaccgcucccuccagaccaccuccccccccgucgucgcccccggcaacgagaacggccucgccguccccgucccccuccgcaagucccgccccgucuccauggacgcccgcauccaggucgcccaggagaagcaggucgccgagcagggcggcgaccucucccccgccgccaaccgcucccagaaggccucccagucccgccccaacuccuccgcccucgagacccucggcggcgagaagcucgccaacggcucccucgagccccccgcccaggccgcccccggccccuccaagcgcgacuccgacugcuccucccucugcaccuccgaguccauggacuacggcaccaaccucuccaccgaccucucccucaacaaggagaugggcucccucuccaucaaggaccccaagcucuacaagaagacccucaagcgcacccgcaaguucgucgucgacggcgucgaggucuccaucaccaccuccaagaucaucuccgaggacgagaagaaggacgaggagaugcgcuuccuccgccgccaggagcuccgcgagcuccgccuccuccagaaggaggagcaccgcaaccagacccagcucuccaacaagcacgagcuccagcucgagcagaugcacaagcgcuucgagcaggagaucaacgccaagaagaaguucuucgacaccgagcucgagaaccucgagcgccagcagaagcagcaggucgagaagauggagcaggaccacgccguccgccgccgcgaggaggcccgccgcauccgccucgagcaggaccgcgacuacacccgcuuccaggagcagcucaagcucaugaagaaggaggucaagaacgaggucgagaagcucccccgccagcagcgcaaggaguccaugaagcagaagauggaggagcacacccagaagaagcagcuccucgaccgcgacuucgucgccaagcagaaggaggaccucgagcucgccaugaagcgccucaccaccgacaaccgccgcgagaucugcgacaaggagcgcgagugccucaugaagaagcaggagcuccuccgcgaccgcgaggccgcccucugggagauggaggagcaccagcuccaggagcgccaccagcucgucaagcagcagcucaaggaccaguacuuccuccagcgccacgagcuccuccgcaagcacgagaaggagcgcgagcagaugcagcgcuacaaccagcgcaugaucgagcagcucaagguccgccagcagcaggagaaggcccgccuccccaagauccagcgcuccgagggcaagacccgcauggccauguacaagaagucccuccacaucaacggcggcggcuccgccgccgagcagcgcgagaagaucaagcaguucucccagcaggaggagaagcgccagaaguccgagcgccuccagcagcagcagaagcacgagaaccagaugcgcgacaugcucgcccagugcgaguccaacauguccgagcuccagcagcuccagaacgagaagugccaccuccucgucgagcacgagacccagaagcucaaggcccucgacgagucccacaaccagaaccucaaggaguggcgcgacaagcuccgcccccgcaagaaggcccucgaggaggaccucaaccagaagaagcgcgagcaggagauguucuucaagcucuccgaggaggccgagugccccaaccccuccacccccuccaaggccgccaaguucuuccccuacuccuccgccgacgccuccuga

SEQ ID NO: 50268 - RNA, 1302 nt, Artificial Sequence
  derived and/or modified sequence opt2 from STK11__Homo_sapiens__NP_000446
auggaggucgucgacccccagcagcucggcauguucaccgagggcgagcucauguccgucggcauggacaccuucauccaccgcaucgacuccaccgaggucaucuaccagccccgccgcaagcgcgccaagcucaucggcaaguaccucaugggcgaccuccucggcgagggcuccuacggcaaggucaaggagguccucgacuccgagacccucugccgccgcgccgucaagauccucaagaagaagaagcuccgccgcauccccaacggcgaggccaacgucaagaaggagauccagcuccuccgccgccuccgccacaagaacgucauccagcucgucgacguccucuacaacgaggagaagcagaagauguacauggucauggaguacugcgucugcggcaugcaggagaugcucgacuccguccccgagaagcgcuuccccgucugccaggcccacggcuacuucugccagcucaucgacggccucgaguaccuccacucccagggcaucguccacaaggacaucaagcccggcaaccuccuccucaccaccggcggcacccucaagaucuccgaccucggcgucgccgaggcccuccaccccuucgccgccgacgacaccugccgcaccucccagggcucccccgccuuccagccccccgagaucgccaacggccucgacaccuucuccggcuucaaggucgacaucugguccgccggcgucacccucuacaacaucaccaccggccucuaccccuucgagggcgacaacaucuacaagcucuucgagaacaucggcaagggcuccuacgccauccccggcgacugcggccccccccucuccgaccuccucaagggcaugcucgaguacgagcccgccaagcgcuucuccauccgccagauccgccagcacuccugguuccgcaagaagcacccccccgccgaggcccccguccccaucccccccucccccgacaccaaggaccgcuggcgcuccaugaccgucguccccuaccucgaggaccuccacggcgccgacgaggacgaggaccucuucgacaucgaggacgacaucaucuacacccaggacuucaccguccccggccagguccccgaggaggaggccucccacaacggccagcgccgcggccuccccaaggccgucugcaugaacggcaccgaggccgcccagcucuccaccaagucccgcgccgagggccgcgcccccaaccccgcccgcaaggccugcuccgccuccuccaagauccgccgccucuccgccugcaagcagcaguga

SEQ ID NO: 50269 - RNA, 3267 nt, Artificial Sequence
  derived and/or modified sequence opt2 from STK11IP__Homo_sapiens__NP_443134
augaccaccgcccagcgcgacucccuccucuggaagcucgccggccuccuccgcgaguccggcgacgucguccucuccggcugcuccacccucucccuccucacccccacccuccagcagcucaaccacgucuucgagcuccaccucggccccuggggccccggccagaccggcuucgucgcccuccccucccaccccgccgacucccccgucauccuccagcuccaguuccucuucgacguccuccagaagacccucucccucaagcucguccacgucgccggccccggccccaccggccccaucaagaucuuccccuucaagucccuccgccaccucgagcuccgcggcgucccccuccacugccuccacggccuccgcggcaucuacucccagcucgagacccucaucugcucccgcucccuccaggcccucgaggagcuccucuccgccugcggcggcgacuucugcuccgcccuccccuggcucgcccuccucuccgccaacuucuccuacaacgcccucaccgcccucgacuccucccuccgccuccucuccgcccuccgcuuccucaaccucucccacaaccagguccaggacugccagggcuuccucauggaccucugcgagcuccaccaccucgacaucuccuacaaccgccuccaccucgucccccgcaugggccccuccggcgccgcccucggcguccucauccuccgcggcaacgagcuccgcucccuccacggccucgagcagcuccgcaaccuccgccaccucgaccucgccuacaaccuccucgagggccaccgcgagcucuccccccucuggcuccucgccgagcuccgcaagcucuaccucgagggcaacccccucugguuccaccccgagcaccgcgccgccaccgcccaguaccucuccccccgcgcccgcgacgccgccaccggcuuccuccucgacggcaagguccucucccucaccgacuuccagacccacaccucccucggccucucccccaugggccccccccuccccuggcccgucggcuccacccccgagaccuccggcggccccgaccucuccgacucccucuccuccggcggcgucgucacccagccccuccuccacaaggucaagucccgcguccgcguccgccgcgccuccaucuccgagcccuccgacaccgaccccgagccccgcacccucaaccccucccccgccggcugguucguccagcagcaccccgagcucgagcucauguccuccuuccgcgagcgcuucggccgcaacuggcuccaguaccgcucccaccucgagcccuccggcaacccccuccccgccacccccaccaccuccgcccccuccgccccccccgccuccucccagggccccgacaccgccccccgccccucccccccccaggaggaggcccgcggcccccaggaguccccccagaagauguccgaggagguccgcgccgagccccaggaggaggaggaggagaaggagggcaaggaggagaaggaggagggcgagauggucgagcagggcgaggaggaggccggcgaggaggaggaggaggagcaggaccagaaggaggucgaggccgagcucugccgcccccuccucgucugcccccucgagggccccgagggcguccgcggccgcgagugcuuccuccgcgucaccuccgcccaccucuucgaggucgagcuccaggccgcccgcacccucgagcgccucgagcuccagucccucgaggccgccgagaucgagcccgaggcccaggcccagcgcuccccccgccccaccggcuccgaccuccuccccggcgcccccauccucucccuccgcuucuccuacaucugccccgaccgccagcuccgccgcuaccucguccucgagcccgacgcccacgccgccguccaggagcuccucgccguccucacccccgucaccaacgucgcccgcgagcagcucggcgaggcccgcgaccuccuccucggccgcuuccagugccuccgcugcggccacgaguucaagcccgaggagccccgcaugggccucgacuccgaggagggcuggcgcccccucuuccagaagaccgagucccccgccgucugccccaacugcggcuccgaccacgucguccuccucgccgucucccgcggcacccccaaccgcgagcgcaagcagggcgagcagucccucgcccccucccccuccgccucccccgucugccacccccccggccacggcgaccaccucgaccgcgccaagaacucccccccccaggcccccuccacccgcgaccacggcuccuggucccucucccccccccccgagcgcugcggccuccgcuccgucgaccaccgccuccgccucuuccucgacgucgaggucuucuccgacgcccaggaggaguuccagugcugccucaagguccccgucgcccucgccggccacaccggcgaguucaugugccucgucgucgucuccgaccgccgccucuaccuccucaaggucaccggcgagaugcgcgagccccccgccuccuggcuccagcucacccucgccgucccccuccaggaccucuccggcaucgagcucggccucgccggccagucccuccgccucgagugggccgccggcgccggccgcugcguccuccucccccgcgacgcccgccacugccgcgccuuccucgaggagcuccucgacguccuccagucccucccccccgccuggcgcaacugcgucuccgccaccgaggaggaggucaccccccagcaccgccucuggccccuccucgagaaggacuccucccucgaggcccgccaguucuucuaccuccgcgccuuccucgucgagggccccuccaccugccucgucucccuccuccucacccccuccacccucuuccuccucgacgaggacgccgccggcucccccgccgagcccuccccccccgccgccuccggcgaggccuccgagaaggucccccccuccggccccggccccgccguccgcguccgcgagcagcagccccucuccucccucuccuccguccuccucuaccgcuccgcccccgaggaccuccgccuccucuucuacgacgaggucucccgccucgaguccuucugggcccuccgcgucgucugccaggagcagcucaccgcccuccucgccuggauccgcgagcccugggaggagcucuucuccaucggccuccgcaccgucauccaggaggcccucgcccucgaccgcuga

SEQ ID NO: 50270 - RNA, 1245 nt, Artificial Sequence
  derived and/or modified sequence opt2 from STK17A__Homo_sapiens__NP_004751
augaucccccucgagaagcccggcuccggcggcuccucccccggcgccaccuccggcuccggccgcgccggccgcggccucuccggccccugccgcccccccccccccccccaggcccgcggccuccucaccgagauccgcgccgucguccgcaccgagcccuuccaggacggcuacucccucugccccggccgcgagcucggccgcggcaaguucgccgucguccgcaagugcaucaagaaggacuccggcaaggaguucgccgccaaguucaugcgcaagcgccgcaagggccaggacugccgcauggagaucauccacgagaucgccguccucgagcucgcccaggacaaccccugggucaucaaccuccacgaggucuacgagaccgccuccgagaugauccucguccucgaguacgccgccggcggcgagaucuucgaccagugcgucgccgaccgcgaggaggccuucaaggagaaggacguccagcgccucaugcgccagauccucgagggcguccacuuccuccacacccgcgacgucguccaccucgaccucaagccccagaacauccuccucaccuccgaguccccccucggcgacaucaagaucgucgacuucggccucucccgcauccucaagaacuccgaggagcuccgcgagaucaugggcacccccgaguacgucgcccccgagauccucuccuacgaccccaucuccauggccaccgacaugugguccaucggcguccucaccuacgucaugcucaccggcaucucccccuuccucggcaacgacaagcaggagaccuuccucaacaucucccagaugaaccucuccuacuccgaggaggaguucgacguccucuccgaguccgccgucgacuucauccgcacccuccucgucaagaagcccgaggaccgcgccaccgccgaggagugccucaagcaccccuggcucacccaguccuccauccaggagcccuccuuccgcauggagaaggcccucgaggaggccaacgcccuccaggagggccacuccguccccgagaucaacuccgacaccgacaaguccgagaccaaggaguccaucgucaccgaggagcucaucgucgucaccuccuacacccucggccagugccgccaguccgagaaggagaagauggagcagaaggccaucuccaagcgcuucaaguucgaggagccccuccuccaggagauccccggcgaguucaucuacuga

SEQ ID NO: 50271 - RNA, 1119 nt, Artificial Sequence
  derived and/or modified sequence opt2 from STK17B__Homo_sapiens__NP_004217
augucccgccgccgcuucgacugccgcuccaucuccggccuccucaccaccaccccccagauccccaucaagauggagaacuucaacaacuucuacauccucaccuccaaggagcucggccgcggcaaguucgccgucguccgccagugcaucuccaaguccaccggccaggaguacgccgccaaguuccucaagaagcgccgccgcggccaggacugccgcgccgagauccuccacgagaucgccguccucgagcucgccaaguccugcccccgcgucaucaaccuccacgaggucuacgagaacaccuccgagaucauccucauccucgaguacgccgccggcggcgagaucuucucccucugccuccccgagcucgccgagauggucuccgagaacgacgucauccgccucaucaagcagauccucgagggcgucuacuaccuccaccagaacaacaucguccaccucgaccucaagccccagaacauccuccucuccuccaucuacccccucggcgacaucaagaucgucgacuucggcaugucccgcaagaucggccacgccugcgagcuccgcgagaucaugggcacccccgaguaccucgcccccgagauccucaacuacgaccccaucaccaccgccaccgacauguggaacaucggcaucaucgccuacaugcuccucacccacaccucccccuucgucggcgaggacaaccaggagaccuaccucaacaucucccaggucaacgucgacuacuccgaggagaccuucuccuccgucucccagcucgccaccgacuucauccagucccuccucgucaagaaccccgagaagcgccccaccgccgagaucugccucucccacuccuggcuccagcagugggacuucgagaaccucuuccaccccgaggagaccuccuccuccucccagacccaggaccacuccguccgcuccuccgaggacaagaccuccaaguccuccugcaacggcaccugcggcgaccgcgaggacaaggagaacauccccgaggacuccuccauggucuccaagcgcuuccgcuucgacgacucccuccccaacccccacgagcucgucuccgaccuccucugcuga

SEQ ID NO: 50272 - RNA, 1095 nt, Artificial Sequence
  derived and/or modified sequence opt2 from STK19__Homo_sapiens__NP_004188
augcagaagugguucuccgccuucgacgacgccaucauccagcgccaguggcgcgccaaccccucccgcggcggcggcggcgucuccuucaccaaggaggucgacaccaacgucgccaccggcgcccccccccgccgccagcgcguccccggccgcgccugccccuggcgcgagcccauccgcggccgccgcggcgcccgccccggcggcggcgacgccggcggcacccccggcgagaccguccgccacugcuccgcccccgaggaccccaucuuccgcuucuccucccuccacuccuaccccuuccccggcaccaucaagucccgcgacauguccuggaagcgccaccaccucauccccgagaccuucggcgucaagcgccgccgcaagcgcggccccgucgaguccgacccccuccgcggcgagcccggcuccgcccgcgccgccgucuccgagcucaugcagcucuucccccgcggccucuucgaggacgcccucccccccaucguccuccgcucccaggucuacucccucguccccgaccgcaccgucgccgaccgccagcucaaggagcuccaggagcagggcgagauccgcaucguccagcucggcuucgaccucgacgcccacggcaucaucuucaccgaggacuaccgcacccgcguccucaaggccugcgacggccgccccuacgccggcgccguccagaaguuccucgccuccguccuccccgccugcggcgaccucuccuuccagcaggaccagaugacccagaccuucggcuuccgcgacuccgagaucacccaccucgucaacgccggcguccucaccguccgcgacgccggcuccugguggcucgccguccccggcgccggccgcuucaucaaguacuucgucaagggccgccaggccguccucuccaugguccgcaaggccaaguaccgcgagcuccuccucuccgagcuccucggccgccgcgcccccgucgucguccgccucggccucaccuaccacguccacgaccucaucggcgcccagcucgucgacugcaucuccaccaccuccggcacccuccuccgccuccccgagaccuga

SEQ ID NO: 50273 - RNA, 1296 nt, Artificial Sequence
  derived and/or modified sequence opt2 from STK24__Homo_sapiens__NP_001027467
auggcccacucccccguccaguccggccuccccggcaugcagaaccucaaggccgaccccgaggagcucuucaccaagcucgagaagaucggcaagggcuccuucggcgaggucuucaagggcaucgacaaccgcacccagaaggucgucgccaucaagaucaucgaccucgaggaggccgaggacgagaucgaggacauccagcaggagaucaccguccucucccagugcgacucccccuacgucaccaaguacuacggcuccuaccucaaggacaccaagcucuggaucaucauggaguaccucggcggcggcuccgcccucgaccuccucgagcccggcccccucgacgagacccagaucgccaccauccuccgcgagauccucaagggccucgacuaccuccacuccgagaagaagauccaccgcgacaucaaggccgccaacguccuccucuccgagcacggcgaggucaagcucgccgacuucggcgucgccggccagcucaccgacacccagaucaagcgcaacaccuucgucggcacccccuucuggauggcccccgaggucaucaagcaguccgccuacgacuccaaggccgacaucuggucccucggcaucaccgccaucgagcucgcccgcggcgagcccccccacuccgagcuccaccccaugaagguccucuuccucauccccaagaacaacccccccacccucgagggcaacuacuccaagccccucaaggaguucgucgaggccugccucaacaaggagcccuccuuccgccccaccgccaaggagcuccucaagcacaaguucauccuccgcaacgccaagaagaccuccuaccucaccgagcucaucgaccgcuacaagcgcuggaaggccgagcagucccacgacgacuccuccuccgaggacuccgacgccgagaccgacggccaggccuccggcggcuccgacuccggcgacuggaucuucaccauccgcgagaaggaccccaagaaccucgagaacggcgcccuccagcccuccgaccucgaccgcaacaagaugaaggacauccccaagcgccccuucucccagugccucuccaccaucaucuccccccucuucgccgagcucaaggagaagucccaggccugcggcggcaaccucggcuccaucgaggagcuccgcggcgccaucuaccucgccgaggaggccugccccggcaucuccgacaccauggucgcccagcucguccagcgccuccagcgcuacucccucuccggcggcggcaccuccucccacuga

SEQ ID NO: 50274 - RNA, 1281 nt, Artificial Sequence
  derived and/or modified sequence opt2 from STK25__Homo_sapiens__NP_001258907
auggcccaccuccgcggcuucgccaaccagcacucccgcgucgaccccgaggagcucuucaccaagcucgaccgcaucggcaagggcuccuucggcgaggucuacaagggcaucgacaaccacaccaaggaggucgucgccaucaagaucaucgaccucgaggaggccgaggacgagaucgaggacauccagcaggagaucaccguccucucccagugcgacucccccuacaucacccgcuacuucggcuccuaccucaaguccaccaagcucuggaucaucauggaguaccucggcggcggcuccgcccucgaccuccucaagcccggcccccucgaggagaccuacaucgccaccauccuccgcgagauccucaagggccucgacuaccuccacuccgagcgcaagauccaccgcgacaucaaggccgccaacguccuccucuccgagcagggcgacgucaagcucgccgacuucggcgucgccggccagcucaccgacacccagaucaagcgcaacaccuucgucggcacccccuucuggauggcccccgaggucaucaagcaguccgccuacgacuucaaggccgacaucuggucccucggcaucaccgccaucgagcucgccaagggcgagccccccaacuccgaccuccaccccaugcgcguccucuuccucauccccaagaacuccccccccacccucgagggccagcacuccaagcccuucaaggaguucgucgaggccugccucaacaaggacccccgcuuccgccccaccgccaaggagcuccucaagcacaaguucaucacccgcuacaccaagaagaccuccuuccucaccgagcucaucgaccgcuacaagcgcuggaaguccgagggccacggcgaggaguccuccuccgaggacuccgacaucgacggcgaggccgaggacggcgagcagggccccaucuggaccuucccccccaccauccgccccuccccccacuccaagcuccacaagggcaccgcccuccacuccucccagaagcccgccgagcccgucaagcgccagccccgcucccagugccucuccacccucguccgccccgucuucggcgagcucaaggagaagcacaagcaguccggcggcuccgucggcgcccucgaggagcucgagaacgccuucucccucgccgaggaguccugccccggcaucuccgacaagcucaugguccaccucgucgagcgcguccagcgcuucucccacaaccgcaaccaccucaccuccacccgcuga

SEQ ID NO: 50275 - RNA, 1065 nt, Artificial Sequence
  derived and/or modified sequence opt2 from STK26__Homo_sapiens__NP_001035917
auggcccacucccccgucgccguccagguccccggcaugcagaacaacaucgccgaccccgaggagcucuucaccaagcucgagcgcaucggcaagggcuccuucggcgaggucuucaagggcaucgacaaccgcacccagcaggucgucgccaucaagaucaucgaccucgaggaggccgaggacgagaucgaggacauccagcaggagaucaccguccucucccagugcgacuccuccuacgucaccaaguacuacggcuccuaccucaagggcuccaagcucuggaucaucauggaguaccucggcggcggcuccgcccucgaccuccuccgcgccggccccuucgacgaguuccagaucgccaccaugcucaaggagauccucaagggccucgacuaccuccacuccgagaagaagauccaccgcgacaucaaggccgccaacguccuccucuccgagcagggcgacgucaagcucgccgacuucggcgucgccggccagcucaccgacacccagaucaagcgcaacaccuucgucggcacccccuucuggauggcccccgaggucauccagcaguccgccuacgacuccaagcgccccaccgccaaggagcuccucaagcacaaguucaucgucaagaacuccaagaagaccuccuaccucaccgagcucaucgaccgcuucaagcgcuggaaggccgagggccacuccgacgacgaguccgacuccgagggcuccgacuccgaguccaccucccgcgagaacaacacccaccccgagugguccuucaccaccguccgcaagaagcccgaccccaagaagguccagaacggcgccgagcaggaccucguccagacccucuccugccucuccaugaucaucacccccgccuucgccgagcucaagcagcaggacgagaacaacgccucccgcaaccaggccaucgaggagcucgagaaguccaucgccgucgccgaggccgccugccccggcaucaccgacaagauggucaagaagcucaucgagaaguuccagaagugcuccgccgacgagucccccuga

SEQ ID NO: 50276 - RNA, 2991 nt, Artificial Sequence
  derived and/or modified sequence opt2 from STK31__Homo_sapiens__NP_001247433
auggacgaggacacccacuacgacaaggucgaggacgucgucggcucccacaucgaggacgccgucaccuucugggcccaguccaucaaccgcaacaaggacaucaugaagaucggcugcucccucuccgaggucugcccccaggccuccuccguccucggcaaccucgaccccaacaagaucuacggcggccucuucuccgaggaccagugcugguaccgcugcaagguccucaagaucaucuccgucgagaagugccucguccgcuacaucgacuacggcaacaccgagauccucaaccgcuccgacaucgucgagaucccccucgagcuccaguucuccuccgucgccaagaaguacaagcucuggggccuccacauccccuccgaccaggaggucacccaguucgaccagggcaccaccuuccucggcucccucaucuucgagaaggagaucaagaugcgcaucaaggccaccuccgaggacggcaccgucaucgcccaggccgaguacggcuccgucgacaucggcgaggagguccucaagaagggcuucgccgagaagugccgccucgccucccgcaccgacaucugcgaggagaagaagcucgaccccggccagcucguccuccgcaaccucaagucccccaucccccucuggggccaccgcuccaaccaguccaccuucucccgccccaagggccaccucuccgagaagaugacccucgaccucaaggacgagaacgacgccggcaaccucaucaccuuccccaaggagucccucgccgucggcgacuucaaccucggcuccaacgucucccucgagaagaucaagcaggaccagaagcucaucgaggagaacgagaagcucaagaccgagaaggacgcccuccucgaguccuacaaggcccucgagcucaaggucgagcagaucgcccaggagcuccagcaggagaaggccgccgccgucgaccucaccaaccaccucgaguacacccucaagaccuacaucgacacccgcaugaagaaccucgccgccaagauggagauccucaaggagaugcgccacgucgacaucuccguccgcuucggcaaggaccucuccgacgccauccagguccucgacgagggcugcuucaccacccccgccucccucaacggccucgagaucaucugggccgaguacucccucgcccaggagaacaucaagaccugcgaguacgucuccgagggcaacauccucaucgcccagcgcaacgagaugcagcagaagcucuacauguccgucgaggacuucauccucgaggucgacgaguccucccucaacaagcgccucaagacccuccaggaccucuccgucucccucgaggccgucuacggccaggccaaggagggcgccaacuccgacgagauccucaagaaguucuacgacuggaagugcgacaagcgcgaggaguucaccuccguccgcuccgagaccgacgccucccuccaccgccucgucgccugguuccagcgcacccucaaggucuucgaccucuccgucgagggcucccucaucuccgaggacgccauggacaacaucgacgagauccucgagaagaccgaguccuccgucugcaaggagcucgagaucgcccucgucgaccagggcgacgccgacaaggagaucaucuccaacaccuacucccagguccuccagaagauccacuccgaggagcgccucaucgccaccguccaggccaaguacaaggacuccaucgaguucaagaagcagcucaucgaguaccucaacaagucccccuccgucgaccaccuccucuccaucaagaagacccucaagucccucaaggcccuccuccgcuggaagcucgucgagaaguccaaccucgaggaguccgacgaccccgacggcucccagaucgagaagaucaaggaggagaucacccagcuccgcaacaacgucuuccaggagaucuaccacgagcgcgaggaguacgagaugcucaccucccucgcccagaagugguuccccgagcucccccuccuccaccccgagaucggccuccucaaguacaugaacuccggcggccuccucaccaugucccucgagcgcgaccuccucgacgccgagcccaugaaggagcucuccuccaagcgcccccucguccgcuccgaggucaacggccagaucauccuccucaagggcuacuccgucgacgucgacaccgaggccaaggucaucgagcgcgccgccaccuaccaccgcgccuggcgcgaggccgagggcgacuccggccuccucccccucaucuuccucuuccucugcaaguccgaccccauggccuaccucaugguccccuacuacccccgcgccaaccucaacgccguccaggccaacaugccccucaacuccgaggagacccucaaggucaugaagggcgucgcccagggccuccacacccuccacaaggccgacaucauccacggcucccuccaccagaacaacgucuucgcccucaaccgcgagcagggcaucgucggcgacuucgacuucaccaaguccgucucccagcgcgccuccgucaacaugauggucggcgaccucucccucaugucccccgagcucaagaugggcaagcccgccucccccggcuccgaccucuacgccuacggcugccuccuccucuggcucuccguccagaaccaggaguucgagaucaacaaggacggcauccccaaggucgaccaguuccaccucgacgacaaggucaagucccuccucugcucccucaucugcuaccgcuccuccaugaccgccgagcagguccucaacgccgagugcuuccucaugcccaaggagcaguccguccccaaccccgagaaggacaccgaguacacccucuacaagaaggaggaggagaucaagaccgagaaccucgacaagugcauggagaagacccgcaacggcgaggccaacuucgacugcuga

SEQ ID NO: 50277 - RNA, 1191 nt, Artificial Sequence
  derived and/or modified sequence opt2 from STK32A__Homo_sapiens__NP_001106195
augggcgccaacaccucccgcaagccccccgucuucgacgagaacgaggacgucaacuucgaccacuucgagauccuccgcgccaucggcaagggcuccuucggcaaggucugcaucguccagaagaacgacaccaagaagauguacgccaugaaguacaugaacaagcagaagugcgucgagcgcaacgagguccgcaacgucuucaaggagcuccagaucaugcagggccucgagcaccccuuccucgucaaccucugguacuccuuccaggacgaggaggacauguucauggucgucgaccuccuccucggcggcgaccuccgcuaccaccuccagcagaacguccacuucaaggaggagaccgucaagcucuucaucugcgagcucgucauggcccucgacuaccuccagaaccagcgcaucauccaccgcgacaugaagcccgacaacauccuccucgacgagcacggccacguccacaucaccgacuucaacaucgccgccaugcucccccgcgagacccagaucaccaccauggccggcaccaagcccuacauggcccccgagauguucuccucccgcaagggcgccggcuacuccuucgccgucgacugguggucccucggcgucaccgccuacgagcuccuccgcggccgccgccccuaccacauccgcuccuccaccuccuccaaggagaucguccacaccuucgagaccaccgucgucaccuaccccuccgccuggucccaggagauggucucccuccucaagaagcuccucgagcccaaccccgaccagcgcuucucccagcucuccgacguccagaacuuccccuacaugaacgacaucaacugggacgccgucuuccagaagcgccucauccccggcuucauccccaacaagggccgccucaacugcgaccccaccuucgagcucgaggagaugauccucgaguccaagccccuccacaagaagaagaagcgccucgccaagaaggagaaggacaugcgcaagugcgacuccucccagaccugccuccuccaggagcaccucgacuccguccagaaggaguucaucaucuucaaccgcgagaaggucaaccgcgacuucaacaagcgccagcccaaccucgcccucgagcagaccaaggacccccagggcgaggacggccagaacaacaaccucuga

SEQ ID NO: 50278 - RNA, 1245 nt, Artificial Sequence
  derived and/or modified sequence opt2 from STK32B__Homo_sapiens__NP_060871
augggcggcaaccacucccacaagccccccgucuucgacgagaacgaggaggucaacuucgaccacuuccagauccuccgcgccaucggcaagggcuccuucggcaaggucugcaucguccagaagcgcgacaccaagaagauguacgccaugaaguacaugaacaagcagaagugcaucgagcgcgacgagguccgcaacgucuuccgcgagcuccagaucaugcagggccucgagcaccccuuccucgucaaccucugguacuccuuccaggacgaggaggacauguucauggucgucgaccuccuccucggcggcgaccuccgcuaccaccuccagcagaacguccacuucaccgagggcaccgucaagcucuacaucugcgagcucgcccucgcccucgaguaccuccagcgcuaccacaucauccaccgcgacaucaagcccgacaacauccuccucgacgagcacggccacguccacaucaccgacuucaacaucgccaccgucgucaagggcgccgagcgcgccuccuccauggccggcaccaagcccuacauggcccccgaggucuuccaggucuacauggaccgcggccccggcuacuccuaccccgucgacugguggucccucggcaucaccgccuacgagcuccuccgcggcuggcgccccuacgagauccacuccgucacccccaucgacgagauccucaacauguucaaggucgagcgcguccacuacuccuccaccuggugcaagggcauggucgcccuccuccgcaagcuccucaccaaggaccccgagucccgcgucuccucccuccacgacauccaguccguccccuaccucgccgacaugaacugggacgccgucuucaagaaggcccucaugcccggcuucguccccaacaagggccgccucaacugcgaccccaccuucgagcucgaggagaugauccucgaguccaagccccuccacaagaagaagaagcgccucgccaagaaccgcucccgcgacggcaccaaggacuccugcccccucaacggccaccuccagcacugccucgagaccguccgcgaggaguucaucaucuucaaccgcgagaagcuccgccgccagcagggccagggcucccagcuccucgacaccgacucccgcggcggcggccaggcccaguccaagcuccaggacggcugcaacaacaaccuccucacccacaccugcacccgcggcugcuccuccuga

SEQ ID NO: 50279 - RNA, 1461 nt, Artificial Sequence
  derived and/or modified sequence opt2 from STK32C__Homo_sapiens__NP_775846
augcgcuccggcgccgagcgccgcggcuccuccgccgccgccucccccggcucccccccccccggccgcgcccgccccgccggcuccgacgcccccuccgcccuccccccccccgccgccggccagccccgcgcccgcgacuccggcgacguccgcucccagccccgcccccucuuccagugguccaaguggaagaagcgcaugggcuccuccauguccgccgccaccgcccgccgccccgucuucgacgacaaggaggacgucaacuucgaccacuuccagauccuccgcgccaucggcaagggcuccuucggcaaggucugcaucguccagaagcgcgacaccgagaagauguacgccaugaaguacaugaacaagcagcagugcaucgagcgcgacgagguccgcaacgucuuccgcgagcucgagauccuccaggagaucgagcacgucuuccucgucaaccucugguacuccuuccaggacgaggaggacauguucauggucgucgaccuccuccucggcggcgaccuccgcuaccaccuccagcagaacguccaguucuccgaggacaccguccgccucuacaucugcgagauggcccucgcccucgacuaccuccgcggccagcacaucauccaccgcgacgucaagcccgacaacauccuccucgacgagcgcggccacgcccaccucaccgacuucaacaucgccaccaucaucaaggacggcgagcgcgccaccgcccucgccggcaccaagcccuacauggcccccgagaucuuccacuccuucgucaacggcggcaccggcuacuccuucgaggucgacuggugguccgucggcgucauggccuacgagcuccuccgcggcuggcgccccuacgacauccacuccuccaacgccgucgagucccucguccagcucuucuccaccgucuccguccaguacguccccaccugguccaaggagauggucgcccuccuccgcaagcuccucaccgucaaccccgagcaccgccucuccucccuccaggacguccaggccgcccccgcccucgccggcguccucugggaccaccucuccgagaagcgcgucgagcccggcuucguccccaacaagggccgccuccacugcgaccccaccuucgagcucgaggagaugauccucgagucccgcccccuccacaagaagaagaagcgccucgccaagaacaagucccgcgacaacucccgcgacuccucccaguccgagaacgacuaccuccaggacugccucgacgccauccagcaggacuucgucaucuucaaccgcgagaagcucaagcgcucccaggaccucccccgcgagccccuccccgcccccgagucccgcgacgccgccgagcccgucgaggacgaggccgagcgcuccgcccuccccaugugcggccccaucugccccuccgccggcuccggcuga

SEQ ID NO: 50280 - RNA, 1545 nt, Artificial Sequence
  derived and/or modified sequence opt2 from STK33__Homo_sapiens__NP_001275990
auggccgacuccggccucgacaagaaguccaccaagugccccgacugcuccuccgccucccagaaggacguccucugcgucugcuccuccaagacccgcgucccccccguccucgucgucgagaugucccagaccuccuccaucggcuccgccgagucccucaucucccucgagcgcaagaaggagaagaacaucaaccgcgacaucaccucccgcaaggaccuccccucccgcaccuccaacgucgagcgcaaggccucccagcagcaguggggccgcggcaacuucaccgagggcaaggucccccacauccgcaucgagaacggcgccgccaucgaggagaucuacaccuucggccgcauccucggcaagggcuccuucggcaucgucaucgaggccaccgacaaggagaccgagaccaagugggccaucaagaaggucaacaaggagaaggccggcuccuccgccgucaagcuccucgagcgcgaggucaacauccucaaguccgucaagcacgagcacaucauccaccucgagcaggucuucgagacccccaagaagauguaccucgucauggagcucugcgaggacggcgagcucaaggagauccucgaccgcaagggccacuucuccgagaacgagacccgcuggaucauccagucccucgccuccgccaucgccuaccuccacaacaacgacaucguccaccgcgaccucaagcucgagaacaucauggucaaguccucccucaucgacgacaacaacgagaucaaccucaacaucaaggucaccgacuucggccucgccgucaagaagcagucccgcuccgaggccaugcuccaggccaccugcggcacccccaucuacauggcccccgaggucaucuccgcccacgacuacucccagcagugcgacaucugguccaucggcgucgucauguacaugcuccuccgcggcgagccccccuuccucgccuccuccgaggagaagcucuucgagcucauccgcaagggcgagcuccacuucgagaacgccgucuggaacuccaucuccgacugcgccaaguccguccucaagcagcucaugaaggucgaccccgcccaccgcaucaccgccaaggagcuccucgacaaccaguggcucaccggcaacaagcucuccuccguccgccccaccaacguccucgagaugaugaaggaguggaagaacaaccccgaguccgucgaggagaacaccaccgaggagaagaacaagcccuccaccgaggagaagcucaaguccuaccagcccuggggcaacguccccgacgccaacuacaccuccgacgaggaggaggagaagcaguccaccgccuacgagaagcaguuccccgccaccuccaaggacaacuucgacaugugcuccuccuccuucaccuccuccaagcuccuccccgccgagaucaagggcgagauggagaagacccccgucacccccucccagggcaccgccaccaaguaccccgccaaguccggcgcccucucccgcaccaagaagaagcucuga

SEQ ID NO: 50281 - RNA, 1605 nt, Artificial Sequence
  derived and/or modified sequence opt2 from STK35__Homo_sapiens__NP_543026
augggccaccaggaguccccccucgcccgcgcccccgccggcggcgccgccuacgucaagcgccucugcaagggccucuccuggcgcgagcacgucgagucccacggcucccucggcgcccaggccucccccgccuccgccgccgccgccgagggcuccgccacccgccgcgcccgcgccgccaccucccgcgccgcccgcucccgccgccagcccggccccggcgccgaccacccccaggccggcgcccccggcggcaagcgcgccgcccgcaaguggcgcugcgccggccaggucaccauccagggccccgcccccccccgcccccgcgccggccgccgcgacgaggccggcggcgcccgcgccgccccccuccuccucccccccccccccgccgccauggagaccggcaaggacggcgcccgccgcggcacccagucccccgagcgcaagcgccgcucccccgucccccgcgcccccuccaccaagcuccgccccgccgccgccgcccgcgccauggaccccgucgccgccgaggcccccggcgaggccuuccucgcccgccgccgccccgagggcggcggcggcuccgcccgcccccgcuacucccuccucgccgagaucggccgcggcuccuacggcgucgucuacgaggccgucgccggccgcuccggcgcccgcgucgccgucaagaagauccgcugcgacgcccccgagaacgucgagcucgcccucgccgaguucugggcccucaccucccucaagcgccgccaccagaacgucguccaguucgaggagugcguccuccagcgcaacggccucgcccagcgcaugucccacggcaacaaguccucccagcucuaccuccgccucgucgagaccucccucaagggcgagcgcauccucggcuacgccgaggagcccugcuaccucugguucgucauggaguucugcgagggcggcgaccucaaccaguacguccucucccgccgccccgaccccgccaccaacaaguccuucaugcuccagcucaccuccgccaucgccuuccuccacaagaaccacaucguccaccgcgaccucaagcccgacaacauccucaucaccgagcgcuccggcacccccauccucaaggucgccgacuucggccucuccaaggucugcgccggccucgccccccgcggcaaggagggcaaccaggacaacaagaacgucaacgucaacaaguacuggcucuccuccgccugcggcuccgacuucuacauggcccccgaggucugggagggccacuacaccgccaaggccgacaucuucgcccucggcaucaucaucugggccaugaucgagcgcaucaccuucaucgacuccgagaccaagaaggagcuccucggcaccuacaucaagcagggcaccgagaucguccccgucggcgaggcccuccucgagaaccccaagauggagcuccacaucccccagaagcgccgcaccuccauguccgagggcaucaagcagcuccucaaggacaugcucgccgccaacccccaggaccgccccgacgccuucgagcucgagacccgcauggaccaggucaccugcgccgccuga

SEQ ID NO: 50282 - RNA, 1395 nt, Artificial Sequence
  derived and/or modified sequence opt2 from STK38L__Homo_sapiens__NP_055815
auggccaugaccgccggcaccaccaccaccuuccccauguccaaccacacccgcgagcgcgucaccgucgccaagcucacccucgagaacuucuacuccaaccucauccuccagcacgaggagcgcgagacccgccagaagaagcucgaggucgccauggaggaggagggccucgccgacgaggagaagaagcuccgccgcucccagcacgcccgcaaggagaccgaguuccuccgccucaagcgcacccgccucggccucgacgacuucgagucccucaaggucaucggccgcggcgccuucggcgagguccgccucguccagaagaaggacaccggccacaucuacgccaugaagauccuccgcaaguccgacaugcucgagaaggagcaggucgcccacauccgcgccgagcgcgacauccucgucgaggccgacggcgccugggucgucaagauguucuacuccuuccaggacaagcgcaaccucuaccucaucauggaguuccuccccggcggcgacaugaugacccuccucaugaagaaggacacccucaccgaggaggagacccaguucuacaucuccgagaccguccucgccaucgacgccauccaccagcucggcuucauccaccgcgacaucaagcccgacaaccuccuccucgacgccaagggccacgucaagcucuccgacuucggccucugcaccggccucaagaaggcccaccgcaccgaguucuaccgcaaccucacccacaacccccccuccgacuucuccuuccagaacaugaacuccaagcgcaaggccgagaccuggaagaagaaccgccgccagcucgccuacuccaccgucggcacccccgacuacaucgcccccgaggucuucaugcagaccggcuacaacaagcucugcgacugguggucccucggcgucaucauguacgagaugcucaucggcuacccccccuucugcuccgagaccccccaggagaccuaccgcaaggucaugaacuggaaggagacccucgucuucccccccgagguccccaucuccgagaaggccaaggaccucauccuccgcuucugcaucgacuccgagaaccgcaucggcaacuccggcgucgaggagaucaagggccaccccuucuucgagggcgucgacugggagcacauccgcgagcgccccgccgccauccccaucgagaucaaguccaucgacgacaccuccaacuucgacgacuuccccgaguccgacauccuccagcccguccccaacaccaccgagcccgacuacaaguccaaggacugggucuuccucaacuacaccuacaagcgcuucgagggccucacccagcgcggcuccauccccaccuacaugaaggccggcaagcucuga

SEQ ID NO: 50283 - RNA, 1638 nt, Artificial Sequence
  derived and/or modified sequence opt2 from STK39__Homo_sapiens__NP_037365
auggccgagcccuccggcucccccguccacguccagcucccccagcaggccgcccccgucaccgccgccgccgccgccgcccccgccgccgccaccgccgcccccgcccccgccgcccccgccgcccccgcccccgcccccgcccccgccgcccaggccgucggcuggcccaucugccgcgacgccuacgagcuccaggaggucaucggcuccggcgccaccgccgucguccaggccgcccucugcaagccccgccaggagcgcgucgccaucaagcgcaucaaccucgagaagugccagaccuccauggacgagcuccucaaggagauccaggccaugucccagugcucccaccccaacgucgucaccuacuacaccuccuucgucgucaaggacgagcucuggcucgucaugaagcuccucuccggcggcuccaugcucgacaucaucaaguacaucgucaaccgcggcgagcacaagaacggcguccucgaggaggccaucaucgccaccauccucaaggagguccucgagggccucgacuaccuccaccgcaacggccagauccaccgcgaccucaaggccggcaacauccuccucggcgaggacggcuccguccagaucgccgacuucggcgucuccgccuuccucgccaccggcggcgacgucacccgcaacaagguccgcaagaccuucgucggcacccccugcuggauggcccccgaggucauggagcagguccgcggcuacgacuucaaggccgacaugugguccuucggcaucaccgccaucgagcucgccaccggcgccgcccccuaccacaaguacccccccaugaagguccucaugcucacccuccagaacgacccccccacccucgagaccggcgucgaggacaaggagaugaugaagaaguacggcaaguccuuccgcaagcuccucucccucugccuccagaaggaccccuccaagcgccccaccgccgccgagcuccucaagugcaaguucuuccagaaggccaagaaccgcgaguaccucaucgagaagcuccucacccgcacccccgacaucgcccagcgcgccaagaagguccgccgcguccccggcuccuccggccaccuccacaagaccgaggacggcgacugggagugguccgacgacgagauggacgagaaguccgaggagggcaaggccgccuucucccaggagaagucccgccgcgucaaggaggagaaccccgagaucgccgucuccgccuccaccauccccgagcagauccagucccucuccguccacgacucccagggcccccccaacgccaacgaggacuaccgcgaggccuccuccugcgccgucaaccucguccuccgccuccgcaacucccgcaaggagcucaacgacauccgcuucgaguucacccccggccgcgacaccgccgacggcgucucccaggagcucuucuccgccggccucgucgacggccacgacgucgucaucgucgccgccaaccuccagaagaucgucgacgaccccaaggcccucaagacccucaccuucaagcucgccuccggcugcgacggcuccgagauccccgacgaggucaagcucaucggcuucgcccagcucuccgucuccuga

SEQ ID NO: 50284 - RNA, 1476 nt, Artificial Sequence
  derived and/or modified sequence opt2 from STK3__Homo_sapiens__NP_006272
auggagcagccccccgcccccaaguccaagcucaagaagcucuccgaggacucccucaccaagcagcccgaggaggucuucgacguccucgagaagcucggcgagggcuccuacggcuccgucuucaaggccauccacaaggaguccggccaggucgucgccaucaagcagguccccgucgaguccgaccuccaggagaucaucaaggagaucuccaucaugcagcagugcgacucccccuacgucgucaaguacuacggcuccuacuucaagaacaccgaccucuggaucgucauggaguacugcggcgccggcuccgucuccgacaucauccgccuccgcaacaagacccucaucgaggacgagaucgccaccauccucaaguccacccucaagggccucgaguaccuccacuucaugcgcaagauccaccgcgacaucaaggccggcaacauccuccucaacaccgagggccacgccaagcucgccgacuucggcgucgccggccagcucaccgacaccauggccaagcgcaacaccgucaucggcacccccuucuggauggcccccgaggucauccaggagaucggcuacaacugcgucgccgacaucuggucccucggcaucaccuccaucgagauggccgagggcaagccccccuacgccgacauccaccccaugcgcgccaucuucaugauccccaccaaccccccccccaccuuccgcaagcccgagcucugguccgacgacuucaccgacuucgucaagaagugccucgucaagaaccccgagcagcgcgccaccgccacccagcuccuccagcaccccuucaucaagaacgccaagcccgucuccauccuccgcgaccucaucaccgaggccauggagaucaaggccaagcgccacgaggagcagcagcgcgagcucgaggaggaggaggagaacuccgacgaggacgagcucgacucccacaccauggucaagaccuccgucgaguccgucggcaccaugcgcgccaccuccaccauguccgagggcgcccagaccaugaucgagcacaacuccaccaugcucgaguccgaccucggcaccauggucaucaacuccgaggacgaggaggaggaggacggcaccaugaagcgcaacgccaccuccccccagguccagcgccccuccuucauggacuacuucgacaagcaggacuucaagaacaagucccacgagaacugcaaccagaacaugcacgagcccuuccccauguccaagaacgucuuccccgacaacuggaaggucccccaggacggcgacuucgacuuccucaagaaccucucccucgaggagcuccagaugcgccucaaggcccucgaccccaugauggagcgcgagaucgaggagcuccgccagcgcuacaccgccaagcgccagcccauccucgacgccauggacgccaagaagcgccgccagcagaacuucuga

SEQ ID NO: 50285 - RNA, 1464 nt, Artificial Sequence
  derived and/or modified sequence opt2 from STK4__Homo_sapiens__NP_006273
auggagaccguccagcuccgcaaccccccccgccgccagcucaagaagcucgacgaggacucccucaccaagcagcccgaggaggucuucgacguccucgagaagcucggcgagggcuccuacggcuccgucuacaaggccauccacaaggagaccggccagaucgucgccaucaagcagguccccgucgaguccgaccuccaggagaucaucaaggagaucuccaucaugcagcagugcgacuccccccacgucgucaaguacuacggcuccuacuucaagaacaccgaccucuggaucgucauggaguacugcggcgccggcuccgucuccgacaucauccgccuccgcaacaagacccucaccgaggacgagaucgccaccauccuccaguccacccucaagggccucgaguaccuccacuucaugcgcaagauccaccgcgacaucaaggccggcaacauccuccucaacaccgagggccacgccaagcucgccgacuucggcgucgccggccagcucaccgacaccauggccaagcgcaacaccgucaucggcacccccuucuggauggcccccgaggucauccaggagaucggcuacaacugcgucgccgacaucuggucccucggcaucaccgccaucgagauggccgagggcaagccccccuacgccgacauccaccccaugcgcgccaucuucaugauccccaccaaccccccccccaccuuccgcaagcccgagcucugguccgacaacuucaccgacuucgucaagcagugccucgucaagucccccgagcagcgcgccaccgccacccagcuccuccagcaccccuucguccgcuccgccaagggcgucuccauccuccgcgaccucaucaacgaggccauggacgucaagcucaagcgccaggagucccagcagcgcgaggucgaccaggacgacgaggagaacuccgaggaggacgagauggacuccggcaccaugguccgcgccgucggcgacgagaugggcaccguccgcgucgccuccaccaugaccgacggcgccaacaccaugaucgagcacgacgacacccuccccucccagcucggcaccauggucaucaacgccgaggacgaggaggaggagggcaccaugaagcgccgcgacgagaccaugcagcccgccaagcccuccuuccucgaguacuucgagcagaaggagaaggagaaccagaucaacuccuucggcaaguccguccccggcccccucaagaacuccuccgacuggaagaucccccaggacggcgacuacgaguuccucaaguccuggaccgucgaggaccuccagaagcgccuccucgcccucgaccccaugauggagcaggagaucgaggagauccgccagaaguaccaguccaagcgccagcccauccucgacgccaucgaggccaagaagcgccgccagcagaacuucuga

SEQ ID NO: 50286 - RNA, 564 nt, Artificial Sequence
  derived and/or modified sequence opt2 from STMN2__Homo_sapiens__NP_001186143
auggccaagaccgccauggccuacaaggagaagaugaaggagcucuccaugcucucccucaucugcuccugcuucuaccccgagccccgcaacaucaacaucuacaccuacgacgacauggaggucaagcagaucaacaagcgcgccuccggccaggccuucgagcucauccucaagccccccucccccaucuccgaggccccccgcacccucgccucccccaagaagaaggaccucucccucgaggagauccagaagaagcucgaggccgccgaggagcgccgcaagucccaggaggcccagguccucaagcagcucgccgagaagcgcgagcacgagcgcgagguccuccagaaggcccucgaggagaacaacaacuucuccaagauggccgaggagaagcucauccucaagauggagcagaucaaggagaaccgcgaggccaaccucgccgccaucaucgagcgccuccaggagaagcucgucaaguucaucuccuccgagcucaaggaguccaucgagucccaguuccucgagcuccagcgcgagggcgagaagcaguga

SEQ ID NO: 50287 - RNA, 510 nt, Artificial Sequence
  derived and/or modified sequence opt2 from STMN3__Homo_sapiens__NP_001263239
augaaggagcucuccguccucucccucaucugcuccugcuucuacacccagccccaccccaacaccgucuaccaguacggcgacauggaggucaagcagcucgacaagcgcgccuccggccaguccuucgaggucauccucaagucccccuccgaccucucccccgagucccccaugcucuccuccccccccaagaagaaggacaccucccucgaggagcuccagaagcgccucgaggccgccgaggagcgccgcaagacccaggaggcccagguccucaagcagcucgccgagcgccgcgagcacgagcgcgagguccuccacaaggcccucgaggagaacaacaacuucucccgccaggccgaggagaagcucaacuacaagauggagcucuccaaggagauccgcgaggcccaccucgccgcccuccgcgagcgccuccgcgagaaggagcuccacgccgccgagguccgccgcaacaaggagcagcgcgaggagauguccggcuga

SEQ ID NO: 50288 - RNA, 570 nt, Artificial Sequence
  derived and/or modified sequence opt2 from STMN4__Homo_sapiens__NP_001269983
augacccucgccgccuacaaggagaagaugaaggagcucccccucgucucccucuucugcuccugcuuccucgccgacccccucaacaaguccuccuacaaguacgaggccgacaccgucgaccucaacuggugcgucaucuccgacauggaggucaucgagcucaacaagugcaccuccggccaguccuucgaggucauccucaagccccccuccuucgacggcguccccgaguucaacgccucccucccccgccgccgcgaccccucccucgaggagauccagaagaagcucgaggccgccgaggagcgccgcaaguaccaggaggccgagcuccucaagcaccucgccgagaagcgcgagcacgagcgcgaggucauccagaaggccaucgaggagaacaacaacuucaucaagauggccaaggagaagcucgcccagaagauggaguccaacaaggagaaccgcgaggcccaccucgccgccaugcucgagcgccuccaggagaaggacaagcacgccgaggagguccgcaagaacaaggagcucaaggaggaggccucccgcuga

SEQ ID NO: 50289 - RNA, 867 nt, Artificial Sequence
  derived and/or modified sequence opt2 from STOM__Homo_sapiens__NP_004090
auggccgagaagcgccacacccgcgacuccgaggcccagcgccuccccgacuccuucaaggacucccccuccaagggccucggccccugcggcuggauccucgucgccuucuccuuccucuucaccgucaucaccuuccccaucuccaucuggaugugcaucaagaucaucaaggaguacgagcgcgccaucaucuuccgccucggccgcauccuccagggcggcgccaagggccccggccucuucuucauccuccccugcaccgacuccuucaucaaggucgacaugcgcaccaucuccuucgacauccccccccaggagauccucaccaaggacuccgucaccaucuccgucgacggcgucgucuacuaccgcguccagaacgccacccucgccgucgccaacaucaccaacgccgacuccgccacccgccuccucgcccagaccacccuccgcaacguccucggcaccaagaaccucucccagauccucuccgaccgcgaggagaucgcccacaacaugcaguccacccucgacgacgccaccgacgccuggggcaucaaggucgagcgcgucgagaucaaggacgucaagcuccccguccagcuccagcgcgccauggccgccgaggccgaggccucccgcgaggcccgcgccaaggucaucgccgccgagggcgagaugaacgccucccgcgcccucaaggaggccuccauggucaucaccgagucccccgccgcccuccagcuccgcuaccuccagacccucaccaccaucgccgccgagaagaacuccaccaucgucuucccccuccccaucgacaugcuccagggcaucaucggcgccaagcacucccaccucggcuga

SEQ ID NO: 50290 - RNA, 1047 nt, Artificial Sequence
  derived and/or modified sequence opt2 from STOML1__Homo_sapiens__NP_001243602
augcucggccgcuccggcuaccgcgcccucccccucggcgacuucgaccgcuuccagcaguccuccuucggcuuccucggcucccagaagggcugccucucccccgagcgcggcggcgucggcaccggcgccgacgucccccaguccuggcccuccugccucugccacggccucaucuccuuccucggcuuccuccuccuccucgucaccuuccccaucuccggcugguucgcccucaagcucgccuccaaggacggcgccguccucuccgucggcgccgacguccaguuccgcaucugggaccccguccucuccgucaugaccgucaaggaccucaacaccgccacccgcaugaccgcccagaacgccaugaccaaggcccuccucaagcgcccccuccgcgagauccagauggagaagcucaagaucuccgaccagcuccuccucgagaucaacgacgucacccgcgccuggggccucgaggucgaccgcgucgagcucgccgucgaggccguccuccagcccccccaggacucccccgccggccccaaccucgacuccacccuccagcagcucgcccuccacuuccucggcggcuccaugaacuccauggccggcggcgcccccucccccggccccgccgacaccgucgagauggucuccgaggucgagccccccgccccccaggucggcgcccgcuccucccccaagcagccccucgccgagggccuccucaccgcccuccagcccuuccucuccgaggcccucgucucccaggucggcgccugcuaccaguucaacgucguccuccccuccggcacccaguccgccuacuuccucgaccucaccaccggccgcggccgcgucggccacggcguccccgacggcauccccgacgucgucgucgagauggccgaggccgaccuccgcgcccuccucugccgcgagcuccgcccccucggcgccuacauguccggccgccucaaggucaagggcgaccucgccauggccaugaagcucgaggccguccuccgcgcccucaaguga

SEQ ID NO: 50291 - RNA, 936 nt, Artificial Sequence
  derived and/or modified sequence opt2 from STOML2__Homo_sapiens__NP_001273960
augcucgcccgcgccgcccgcggcaccggcgcccuccuccuccgcggcucccuccucgccuccggccgcgccccccgccgcgccuccuccggccucccccgcaacaccgucguccucuucgucccccagcaggaggccugggucgucgagcgcaugggccgcuuccaccgcauccucgagcccggccucaacauccucauccccguccucgaccgcauccgcuacguccagucccucaaggagaucgucaucaacguccccgagcaguccgccgucacccucgacaacgucacccuccagaucgacggcguccucuaccuccgcaucauggaccccuacaaggccuccuacggcgucgaggaccccgaguacgccgucacccagcucgcccagaccaccaugcgcuccgagcucggcaagcucucccucgacaaggucuuccgcgucgaggccgagcgccgcaagcgcgccaccguccucgaguccgagggcacccgcgaguccgccaucaacgucgccgagggcaagaagcaggcccagauccucgccuccgaggccgagaaggccgagcagaucaaccaggccgccggcgaggccuccgccguccucgccaaggccaaggccaaggccgaggccauccgcauccucgccgccgcccucacccagcacaacggcgacgccgccgccucccucaccgucgccgagcaguacgucuccgccuucuccaagcucgccaaggacuccaacaccauccuccuccccuccaaccccggcgacgucaccuccauggucgcccaggccaugggcgucuacggcgcccucaccaaggcccccguccccggcacccccgacucccucuccuccggcuccucccgcgacguccagggcaccgacgccucccucgacgaggagcucgaccgcgucaagauguccuga

SEQ ID NO: 50292 - RNA, 849 nt, Artificial Sequence
  derived and/or modified sequence opt2 from STOML3__Homo_sapiens__NP_001137505
augaacucccgcggcgagcucgucggcgucaacaacaagcgccucggcgucugcggcuggauccucuucucccucuccuuccuccucgucaucaucaccuuccccaucuccaucuggaugugccucaagaucaucaaggaguacgagcgcgccgucgucuuccgccucggccgcauccaggccgacaaggccaagggccccggccucauccucguccuccccugcaucgacgucuucgucaaggucgaccuccgcaccgucaccugcaacauccccccccaggagauccucacccgcgacuccgucaccacccaggucgacggcgucgucuacuaccgcaucuacuccgccgucuccgccgucgccaacgucaacgacguccaccaggccaccuuccuccucgcccagaccacccuccgcaacguccucggcacccagacccucucccagauccucgccggccgcgaggagaucgcccacuccauccagacccuccucgacgacgccaccgagcucuggggcauccgcgucgcccgcgucgagaucaaggacguccgcauccccguccagcuccagcgcuccauggccgccgaggccgaggccacccgcgaggcccgcgccaagguccucgccgccgagggcgagaugaacgccuccaagucccucaaguccgccuccaugguccucgccgagucccccaucgcccuccagcuccgcuaccuccagacccucuccaccgucgccaccgagaagaacuccaccaucgucuucccccuccccaugaacauccucgagggcaucggcggcgucuccuacgacaaccacaagaagcuccccaacaaggccuga

SEQ ID NO: 50293 - RNA, 3477 nt, Artificial Sequence
  derived and/or modified sequence opt2 from STON1-GTF2A1L__Homo_sapiens__NP_001185522
augugcuccaccaaccccggcaagugggucaccuucgacgacgaccccgccguccaguccucccagaaguccaagaacuucccccucgagaaccagggcgucugccgccccaacggccucaagcucaaccuccccggccuccgcgaguuccccuccggcuccuccuccaccuccuccaccccccucuccucccccaucgucgacuucuacuucucccccggcccccccuccaacuccccccucuccacccccaccaaggacuuccccggcuuccccggcauccccaaggccggcacccacguccucuaccccauccccgaguccuccuccgacuccccccucgccaucuccggcggcgaguccucccuccuccccacccgccccaccugccucucccacgcccuccuccccuccgaccacuccugcacccaccccacccccaaggucggccuccccgacgaggucaacccccagcaggccgagucccucggcuuccaguccgacgaccucccccaguuccaguacuuccgcgaggacugcgccuucuccucccccuucuggaaggacgagggcuccgacucccacuucacccucgacccccccggcuccaagaagauguucuccucccgcaacaaggagaugcccaucgaccagaagucccucaacaagugcucccucaacuacaucugcgagaagcucgagcaccuccaguccgccgagaaccaggacucccuccgcucccucuccaugcacugccucugcgccgaggagaacgccuccuccuucgucccccacacccucuuccgcucccagcccaaguccggcugguccuucaugcuccgcauccccgagaagaagaacaugauguccucccgccaguggggccccaucuuccucaagguccuccccggcggcauccuccagauguacuacgagcagggccucgagaagcccuucaaggagauccagcucgaccccuacugccgccucuccgagcccaaggucgagaacuucuccgucgccggcaagauccacaccgucaagaucgagcacgucuccuacaccgagaagcgcaaguaccacuccaagaccgaggucguccacgagcccgacaucgagcagaugcucaagcucggcuccaccuccuaccacgacuuccucgacuuccucaccaccgucgaggaggagcucaugaagcuccccgccgucuccaagcccaagaagaacuacgaggagcaggagaucucccucgagaucgucgacaacuucuggggcaaggucaccaaggagggcaaguucgucgaguccgccgucaucacccagaucuacugccucugcuucgucaacggcaaccucgagugcuuccucacccucaacgaccucgagcuccccaagcgcgacgaguccuacuacgagaaggacuccgagaagaagggcaucgacauccucgacuaccacuuccacaagugcgucaacguccaggaguucgagcagucccgcaucaucaaguucgucccccucgacgccugccgcuucgagcucaugcgcuucaagacccucuacaacggcgacaaccuccccuucucccucaaguccgucgucgucguccagggcgccuacgucgagcuccaggccuucgucaacauggccucccucgcccagcgcuccuccuacgccggcucccuccgcuccugcgacaacauccgcauccacuuccccguccccucccaguggaucaaggcccucuggaccaugaaccuccagcgccagaagucccucaaggccaagaugaaccgccgcgccugccucggcucccuccaggagcucgaguccgagcccgucauccaggucaccgucggcuccgccaaguacgaguccgccuaccaggccgucgucuggaagaucgaccgccuccccgacaagaacuccucccucgaccacccccacugccucuccuacaagcucgagcucggcuccgaccaggagauccccuccgacugguaccccuucgccaccguccaguucuccguccccgacaccugcgccucccgcaccgagguccgcucccucggcgucgaguccgacguccagccccagaagcacguccagcagcgcgccugcuacaacauccagcccaagcucuaccgcuccgucaucgaggacgucaucgagggcguccgcaaccucuucgccgaggagggcaucgaggagcagguccucaaggaccucaagcagcucugggagaccaagguccuccaguccaaggccaccgaggacuucuuccgcaacuccauccaguccccccucuucacccuccagcucccccacucccuccaccagacccuccaguccuccaccgccucccucgucauccccgccggccgcacccuccccuccuucaccaccgccgagcucggcaccuccaacuccuccgccaacuucaccuuccccggcuaccccauccacguccccgccggcgucacccuccagaccgucuccggccaccucuacaaggucaacguccccaucauggucaccgagaccuccggccgcgccggcauccuccagcaccccauccagcaggucuuccagcagcucggccagcccuccgucauccagaccuccgucccccagcucaaccccuggucccuccaggccaccaccgagaagucccagcgcaucgagaccguccuccagcagcccgccauccuccccuccggccccgucgaccgcaagcaccucgagaacgccaccuccgacauccucgucucccccggcaacgagcacaagaucguccccgaggcccuccucugccaccaggaguccucccacuacaucucccuccccggcgucgucuucuccccccaggucucccagaccaacuccaacgucgaguccguccucuccggcuccgccuccauggcccagaaccuccacgacgagucccucuccaccuccccccacggcgcccuccaccagcacgucaccgacauccagcuccacauccucaagaaccgcauguacggcugcgacuccgucaagcagccccgcaacaucgaggagcccuccaacauccccgucuccgagaaggacuccaacucccaggucgaccucuccauccgcgucaccgacgacgacaucggcgagaucauccaggucgacggcuccggcgacaccuccuccaacgaggagaucggcuccacccgcgacgccgacgagaacgaguuccucggcaacaucgacggcggcgaccucaagguccccgaggaggaggccgacuccaucuccaacgaggacuccgccaccaacuccuccgacaacgaggacccccaggucaacaucgucgaggaggacccccucaacuccggcgacgacgucuccgagcaggacguccccgaccucuucgacaccgacaacgucaucgucugccaguacgacaagcagggcgacacccgcguccgccacggccagcaguga

SEQ ID NO: 50294 - RNA, 2208 nt, Artificial Sequence
  derived and/or modified sequence opt2 from STON1__Homo_sapiens__NP_001185524
augugcuccaccaaccccggcaagugggucaccuucgacgacgaccccgccguccaguccucccagaaguccaagaacuucccccucgagaaccagggcgucugccgccccaacggccucaagcucaaccuccccggccuccgcgaguuccccuccggcuccuccuccaccuccuccaccccccucuccucccccaucgucgacuucuacuucucccccggcccccccuccaacuccccccucuccacccccaccaaggacuuccccggcuuccccggcauccccaaggccggcacccacguccucuaccccauccccgaguccuccuccgacuccccccucgccaucuccggcggcgaguccucccuccuccccacccgccccaccugccucucccacgcccuccuccccuccgaccacuccugcacccaccccacccccaaggucggccuccccgacgaggucaacccccagcaggccgagucccucggcuuccaguccgacgaccucccccaguuccaguacuuccgcgaggacugcgccuucuccucccccuucuggaaggacgagggcuccgacucccacuucacccucgacccccccggcuccaagaagauguucuccucccgcaacaaggagaugcccaucgaccagaagucccucaacaagugcucccucaacuacaucugcgagaagcucgagcaccuccaguccgccgagaaccaggacucccuccgcucccucuccaugcacugccucugcgccgaggagaacgccuccuccuucgucccccacacccucuuccgcucccagcccaaguccggcugguccuucaugcuccgcauccccgagaagaagaacaugauguccucccgccaguggggccccaucuuccucaagguccuccccggcggcauccuccagauguacuacgagcagggccucgagaagcccuucaaggagauccagcucgaccccuacugccgccucuccgagcccaaggucgagaacuucuccgucgccggcaagauccacaccgucaagaucgagcacgucuccuacaccgagaagcgcaaguaccacuccaagaccgaggucguccacgagcccgacaucgagcagaugcucaagcucggcuccaccuccuaccacgacuuccucgacuuccucaccaccgucgaggaggagcucaugaagcuccccgccgucuccaagcccaagaagaacuacgaggagcaggagaucucccucgagaucgucgacaacuucuggggcaaggucaccaaggagggcaaguucgucgaguccgccgucaucacccagaucuacugccucugcuucgucaacggcaaccucgagugcuuccucacccucaacgaccucgagcuccccaagcgcgacgaguccuacuacgagaaggacuccgagaagaagggcaucgacauccucgacuaccacuuccacaagugcgucaacguccaggaguucgagcagucccgcaucaucaaguucgucccccucgacgccugccgcuucgagcucaugcgcuucaagacccucuacaacggcgacaaccuccccuucucccucaaguccgucgucgucguccagggcgccuacgucgagcuccaggccuucgucaacauggccucccucgcccagcgcuccuccuacgccggcucccuccgcuccugcgacaacauccgcauccacuuccccguccccucccaguggaucaaggcccucuggaccaugaaccuccagcgccagaagucccucaaggccaagaugaaccgccgcgccugccucggcucccuccaggagcucgaguccgagcccgucauccaggucaccgucggcuccgccaaguacgaguccgccuaccaggccgucgucuggaagaucgaccgccuccccgacaagaacuccucccucgaccacccccacugccucuccuacaagcucgagcucggcuccgaccaggagauccccuccgacugguaccccuucgccaccguccaguucuccguccccgacaccugcgccucccgcaccgagguccgcucccucggcgucgaguccgacguccagccccagaagcacguccagcagcgcgccugcuacaacauccaggucgagaucgagaagaaguggaucaagaucgacggcgaggaccccgacaagaucggcgacugcaucacccaguga

SEQ ID NO: 50295 - RNA, 684 nt, Artificial Sequence
  derived and/or modified sequence opt2 from STOX1__Homo_sapiens__NP_001123631
auggcccgccccguccagcucgcccccggcucccucgcccucguccucugccgccucgaggcccagaaggccgccggcgccgccgaggagcccggcggccgcgccgucuuccgcgccuuccgccgcgccaacgcccgcugcuucuggaacgcccgccucgcccgcgccgccucccgccucgccuuccagggcuggcuccgccgcggcguccuccucguccgcgccccccccgccugccuccagguccuccgcgacgccuggcgccgccgcgcccuccgccccccccgcggcuuccgcauccgcgccgucggcgacgucuuccccguccagaugaaccccaucacccagucccaguucgucccccucggcgagguccucugcugcgccaucuccgacaugaacaccgcccagaucgucgucacccaggagucccuccucgagcgccucaugaagcacuaccccggcaucgccauccccuccgaggacauccucuacaccacccucggcacccucaucaaggagcgcaagaucuaccacaccggcgagggcuacuucaucgucaccccccagaccuacuucaucaccaacaccaccacccaggagaacaagcgcaugcuccccuccgacgagucccgccucaugcccgccuccaugaccuaccucgacaccgaguccggcaucuga

SEQ ID NO: 50296 - RNA, 246 nt, Artificial Sequence
  derived and/or modified sequence opt2 from STRA13__Homo_sapiens__NP_001257935
auggagggcgccggcgccggcuccggcuuccgcaaggagcucgucucccgccuccuccaccuccacuucaaggacgacaagaccaaggucuccggcgacgcccuccagcucauggucgagcuccucaaggucuucgucgucgaggccgccguccgcggcguccgccaggcccaggccgaggacgcccuccgcgucgacgucgaccagcucgagaagguccucccccagcuccuccucgacuucuga

SEQ ID NO: 50297 - RNA, 1977 nt, Artificial Sequence
  derived and/or modified sequence opt2 from STRA6__Homo_sapiens__NP_001136091
auguccucccagcccgccggcaaccagaccucccccggcgccaccgaggacuacuccuacggcuccugguacaucgacgagccccagggcggcgaggagcuccagcccgagggcgagguccccuccugccacaccuccaucccccccggccucuaccacgccugccucgccucccucuccauccucguccuccuccuccucgccaugcucguccgccgccgccagcucuggcccgacugcguccgcggccgccccggccucccccgcccccgcgccguccccgccgccgucuucaugguccuccucuccucccucugccuccuccuccccgacgaggacgcccuccccuuccucacccucgccuccgcccccucccaggacggcaagaccgaggccccccgcggcgccuggaagauccucggccucuucuacuacgccgcccucuacuacccccucgccgccugcgccaccgccggccacaccgccgcccaccuccucggcuccacccucuccugggcccaccucggcguccaggucuggcagcgcgccgagugcccccagguccccaagaucuacaaguacuacucccuccucgccucccucccccuccuccucggccucggcuuccucucccucugguaccccguccagcucguccgcuccuucucccgccgcaccggcgccggcuccaagggccuccaguccuccuacuccgaggaguaccuccgcaaccuccucugccgcaagaagcucggcuccuccuaccacaccuccaagcacggcuuccucuccugggcccgcgucugccuccgccacugcaucuacaccccccagcccggcuuccaccucccccucaagcucguccucuccgccacccucaccggcaccgccaucuaccaggucgcccuccuccuccucgucggcgucguccccaccauccagaagguccgcgccggcgucaccaccgacgucuccuaccuccucgccggcuucggcaucguccucuccgaggacaagcaggaggucgucgagcucgucaagcaccaccucugggcccucgaggucugcuacaucuccgcccucguccucuccugccuccucaccuuccucguccucaugcgcucccucgucacccaccgcaccaaccuccgcgcccuccaccgcggcgccgcccucgaccucuccccccuccaccgcuccccccaccccucccgccaggccaucuucugcuggauguccuucuccgccuaccagaccgccuucaucugccucggccuccucguccagcagaucaucuucuuccucggcaccaccgcccucgccuuccucguccucaugcccguccuccacggccgcaaccuccuccucuuccgcucccucgaguccuccuggcccuucuggcucacccucgcccucgccgucauccuccagaacauggccgcccacugggucuuccucgagacccacgacggccacccccagcucaccaaccgccgcguccucuacgccgccaccuuccuccucuucccccucaacguccucgucggcgccauggucgccaccuggcgcguccuccucuccgcccucuacaacgccauccaccucggccagauggaccucucccuccuccccccccgcgccgccacccucgaccccggcuacuacaccuaccgcaacuuccucaagaucgaggucucccagucccaccccgccaugaccgccuucugcucccuccuccuccaggcccagucccuccucccccgcaccauggccgccccccaggacucccuccgccccggcgaggaggacgagggcaugcagcuccuccagaccaaggacuccauggccaagggcgcccgccccggcgccucccgcggccgcgcccgcuggggccucgccuacacccuccuccacaaccccacccuccaggucuuccgcaagaccgcccuccucggcgccaacggcgcccagcccuga

SEQ ID NO: 50298 - RNA, 993 nt, Artificial Sequence
  derived and/or modified sequence opt2 from STRA8__Homo_sapiens__NP_872295
augggcaagaucgacgucgacaagauccucuucuucaaccaggagauccgccucuggcagcucaucauggccacccccgaggagaacuccaacccccacgaccgcgccaccccccagcuccccgcccagcuccaggagcucgagcaccgcgucgcccgccgccgccucucccaggcccgccaccgcgccacccucgccgcccucuucaacaaccuccgcaagaccgucuacucccaguccgaccucaucgccuccaaguggcagguccucaacaaggccaagucccacauccccgagcucgagcagacccucgacaaccuccucaagcucaaggccuccuucaaccucgaggacggccacgccuccucccucgaggaggucaagaaggaguacgccuccauguacuccggcaacgacuccuucccccagaacggcuccucccccugguaccucaacuucuacaagcagaccauggaccuccucaccggcuccggcaucaucaccccccaggaggccgcccuccccaucgucuccgccgccaucucccaccucuggcagaaccucuccgaggagcgcaaggccucccuccgccaggccugggcccagaagcaccgcggccccgccacccucgccgaggccugccgcgagcccgccugcgccgagggcuccgucaaggacuccggcgucgacucccagggcgccuccugcucccucgucuccacccccgaggagauccucuucgaggacgccuucgacgucgccuccuuccucgacaaguccgagguccccuccaccuccuccuccuccuccguccucgccuccugcaaccccgagaaccccgaggagaaguuccagcucuacaugcagaucaucaacuucuucaagggccucuccugcgccaacacccaggucaagcaggaggccuccuuccccgucgacgaggagaugaucaugcuccagugcaccgagaccuucgacgacgaggaccucuga

SEQ ID NO: 50299 - RNA, 1296 nt, Artificial Sequence
  derived and/or modified sequence opt2 from STRADA__Homo_sapiens__NP_001003787
auguccuuccucgucuccaagcccgagcgcauccgccgcugggucuccgagaaguucaucgucgagggccuccgcgaccucgagcucuucggcgagcagccccccggcgacacccgccgcaagaccaacgacgccuccuccgaguccaucgccuccuucuccaagcaggaggucauguccuccuuccuccccgagggcggcugcuacgagcuccucaccgucaucggcaagggcuucgaggaccucaugaccgucaaccucgcccgcuacaagcccaccggcgaguacgucaccguccgccgcaucaaccucgaggccugcuccaacgagauggucaccuuccuccagggcgagcuccacgucuccaagcucuucaaccaccccaacaucguccccuaccgcgccaccuucaucgccgacaacgagcucugggucgucaccuccuucauggccuacggcuccgccaaggaccucaucugcacccacuucauggacggcaugaacgagcucgccaucgccuacauccuccagggcguccucaaggcccucgacuacauccaccacaugggcuacguccaccgcuccgucaaggccucccacauccucaucuccgucgacggcaaggucuaccucuccggccuccgcuccaaccucuccaugaucucccacggccagcgccagcgcgucguccacgacuuccccaaguacuccgucaagguccuccccuggcucucccccgagguccuccagcagaaccuccagggcuacgacgccaaguccgacaucuacuccgucggcaucaccgccugcgagcucgccaacggccacguccccuucaaggacaugcccgccacccagaugcuccucgagaagcucaacggcaccguccccugccuccucgacaccuccaccauccccgccgaggagcucaccaugucccccucccgcuccgucgccaacuccggccucuccgacucccucaccaccuccaccccccgccccuccaacggcgacucccccucccaccccuaccaccgcaccuucuccccccacuuccaccacuucgucgagcagugccuccagcgcaaccccgacgcccgccccuccgccuccacccuccucaaccacuccuucuucaagcagaucaagcgccgcgccuccgaggcccuccccgagcuccuccgccccgucacccccaucaccaacuucgagggcucccagucccaggaccacuccggcaucuucggccucgucaccaaccucgaggagcucgaggucgacgacugggaguucuga

SEQ ID NO: 50300 - RNA, 1134 nt, Artificial Sequence
  derived and/or modified sequence opt2 from STRADB__Homo_sapiens__NP_001193793
augucccuccucgacugcuucugcaccucccgcacccaggucgagucccuccgccccgagaagcaguccgagaccuccauccaccaguaccucgucgacgagcccacccucuccuggucccgccccuccacccgcgccuccgagguccucugcuccaccaacgucucccacuacgagcuccaggucgagaucggccgcggcuucgacaaccucaccuccguccaccucgcccgccacacccccaccggcacccucgucaccaucaagaucaccaaccucgagaacugcaacgaggagcgccucaaggcccuccagaaggccgucauccucucccacuucuuccgccaccccaacaucaccaccuacuggaccgucuucaccgucggcuccuggcucugggucaucucccccuucauggccuacggcuccgccucccagcuccuccgcaccuacuuccccgagggcauguccgagacccucauccgcaacauccucuucggcgccguccgcggccucaacuaccuccaccagaacggcugcauccaccgcuccaucaaggccucccacauccucaucuccggcgacggccucgucacccucuccggccucucccaccuccacucccucgucaagcacggccagcgccaccgcgccgucuacgacuucccccaguucuccaccuccguccagcccuggcucucccccgagcuccuccgccaggaccuccacggcuacaacgucaaguccgacaucuacuccgucggcaucaccgccugcgagcucgccuccggccagguccccuuccaggacaugcaccgcacccagaugcuccuccagaagcucaagggcccccccuacuccccccucgacaucuccaucuucccccaguccgagucccgcaugaagaacucccaguccggcgucgacuccggcaucggcgaguccguccucgucuccuccggcacccacaccgucaacuccgaccgccuccacacccccuccuccaagaccuucucccccgccuucuucucccucguccagcucugccuccagcaggaccccgagaagcgccccuccgccuccucccuccucucccacgucuucuucaagcagcccuacuucgaguuccucuga

SEQ ID NO: 50301 - RNA, 1053 nt, Artificial Sequence
  derived and/or modified sequence opt2 from STRAP__Homo_sapiens__NP_009109
auggccaugcgccagaccccccucaccugcuccggccacacccgccccgucgucgaccucgccuucuccggcaucacccccuacggcuacuuccucaucuccgccugcaaggacggcaagcccaugcuccgccagggcgacaccggcgacuggaucggcaccuuccucggccacaagggcgccgucuggggcgccacccucaacaaggacgccaccaaggccgccaccgccgccgccgacuucaccgccaaggucugggacgccgucuccggcgacgagcucaugacccucgcccacaagcacaucgucaagaccgucgacuucacccaggacuccaacuaccuccucaccggcggccaggacaagcuccuccgcaucuacgaccucaacaagcccgaggccgagcccaaggagaucuccggccacaccuccggcaucaagaaggcccucuggugcuccgaggacaagcagauccucuccgccgacgacaagaccguccgccucugggaccacgccaccaugaccgaggucaagucccucaacuucaacauguccgucuccuccauggaguacauccccgagggcgagauccucgucaucaccuacggccgcuccaucgccuuccacuccgccgucucccucgaccccaucaaguccuucgaggcccccgccaccaucaacuccgccucccuccaccccgagaaggaguuccucgucgccggcggcgaggacuucaagcucuacaaguacgacuacaacuccggcgaggagcucgaguccuacaagggccacuucggccccauccacugcguccgcuucucccccgacggcgagcucuacgccuccggcuccgaggacggcacccuccgccucuggcagaccgucgucggcaagaccuacggccucuggaagugcguccuccccgaggaggacuccggcgagcucgccaagcccaagaucggcuuccccgagaccaccgaggaggagcucgaggagaucgccuccgagaacuccgacugcaucuuccccuccgcccccgacgucaaggccuga

SEQ ID NO: 50302 - RNA, 5328 nt, Artificial Sequence
  derived and/or modified sequence opt2 from STRC__Homo_sapiens__NP_714544
auggcccucucccucuggccccuccuccuccuccuccuccuccuccuccuccucuccuucgccgucacccucgcccccaccggcccccacucccucgaccccggccucuccuuccucaagucccuccucuccacccucgaccaggccccccagggcucccucucccgcucccgcuucuucaccuuccucgccaacaucuccuccuccuucgagcccggccgcaugggcgagggccccgucggcgagccccccccccuccagccccccgcccuccgccuccacgacuuccucgucacccuccgcggcucccccgacugggagcccaugcucggccuccucggcgacaugcucgcccuccucggccaggagcagaccccccgcgacuuccucguccaccaggccggcguccucggcggccucgucgagguccuccucggcgcccucguccccggcggcccccccacccccacccgcccccccugcacccgcgacggccccuccgacugcguccucgccgccgacuggcuccccucccuccuccuccuccucgagggcacccgcuggcaggcccucguccagguccagcccuccgucgaccccaccaacgccaccggccucgacggccgcgaggccgccccccacuuccuccagggccuccucggccuccucacccccaccggcgagcucggcuccaaggaggcccucuggggcggccuccuccgcaccgucggcgccccccucuacgccgccuuccaggagggccuccuccgcgucacccacucccuccaggacgaggucuucuccauccucggccagcccgagcccgacaccaacggccagugccagggcggcaaccuccagcagcuccuccucuggggcguccgccacaaccucuccugggacguccaggcccucggcuuccucuccggcucccccccccccccccccgcccuccuccacugccucuccaccggcgucccccucccccgcgccucccagcccuccgcccacaucuccccccgccagcgccgcgccaucaccgucgaggcccucugcgagaaccaccucggccccgccccccccuacuccaucuccaacuucuccauccaccuccucugccagcacaccaagcccgccaccccccagccccaccccuccaccaccgccaucugccagaccgccgucugguacgccgucuccugggcccccggcgcccagggcuggcuccaggccugccacgaccaguuccccgacgaguuccucgacgccaucugcuccaaccucuccuucuccgcccucuccggcuccaaccgccgccucgucaagcgccucugcgccggccuccuccccccccccaccuccugccccgagggccucccccccgucccccucacccccgacaucuucuggggcugcuuccucgagaacgagacccucugggccgagcgccucugcggcgaggccucccuccaggccgucccccccuccaaccaggccuggguccagcacgucugccagggccccacccccgacgucaccgccuccccccccugccacaucggccccugcggcgagcgcugccccgacggcggcuccuuccucgucauggucugcgccaacgacaccauguacgagguccucguccccuucuggcccuggcucgccggccagugccgcaucucccgcggcggcaacgacaccugcuuccucgagggccuccucggcccccuccuccccucccuccccccccucggccccuccccccucugccucacccccggccccuuccuccucggcaugcucucccagcucccccgcugccaguccuccguccccgcccucgcccaccccacccgccuccacuaccuccuccgccuccucaccuuccuccucggccccggcgccggcggcgccgaggcccagggcaugcucggccgcgcccuccuccucuccucccuccccgacaacugcuccuucugggacgccuuccgccccgagggccgccgcuccguccuccgcaccaucggcgaguaccucgagcaggacgaggagcagcccacccccuccggcuucgagcccaccgucaaccccuccuccggcaucuccaagauggagcuccucgccugcuucucccccguccucugggaccuccuccagcgcgagaaguccgucugggcccuccagauccucguccaggccuaccuccacaugccccccgagaaccuccagcagcucguccucuccgccgagcgcgaggccgcccagggcuuccucacccucaugcuccagggcaagcuccagggcaagcuccaggucccccccuccgaggagcaggcccucggccgccucaccgcccuccuccuccagcgcuacccccgccucaccucccagcucuucaucgaccucuccccccucauccccuuccucgccgucuccgaccucaugcgcuucccccccucccuccucgccaacgacuccguccucgccgccauccgcgacuacucccccggcaugcgccccgagcagaaggaggcccucgccaagcgccuccucgcccccgagcucuucggcgagguccccgccuggccccaggagcuccucugggccguccucccccuccucccccaccucccccucgagaacuuccuccagcucuccccccaccagauccaggcccucgaggacuccuggcccgccgccggccucggccccggccacgcccgccacguccuccgcucccucgucaaccaguccguccaggacggcgaggagcagguccgccgccucggcccccucgccugcuuccucucccccgaggagcuccagucccucgucccccucuccgaccccaccggccccgucgagcgcggccuccucgagugcgccgccaacggcacccucucccccgagggccgcgucgccuacgagcuccucggcguccuccgcuccuccggcggcgccguccucuccccccgcgagcuccgcgucugggccccccucuucucccagcucggccuccgcuuccuccaggagcucuccgagccccagcuccgcgccaugcuccccguccuccagggcaccuccgucacccccgcccaggccguccuccuccucggccgccuccucccccgccacgaccucucccucgaggagcucugcucccuccaccuccuccuccccggccucuccccccagacccuccaggccaucccccgccgcguccucgucggcgccugcuccugccucgcccccgagcucucccgccucuccgccugccagaccgccgcccuccuccagaccuuccgcgucaaggacggcgucaagaacaugggcaccaccggcgccggccccgccgucugcauccccggccagcccauccccaccaccuggcccgacugccuccucccccuccucccccucaagcuccuccagcucgacucccucgcccuccucgccaaccgccgccgcuacugggagcuccccugguccgagcagcaggcccaguuccucuggaagaagaugcagguccccaccaaccucacccuccgcaaccuccaggcccucggcacccucgccggcggcauguccugcgaguuccuccagcagaucaacuccauggucgacuuccucgaggucguccacaugaucuaccagcuccccacccgcguccgcggcucccuccgcgccugcaucugggccgagcuccagcgccgcauggccaugcccgagcccgaguggaccaccgucggccccgagcucaacggccucgacuccaagcuccuccucgaccuccccauccagcucauggaccgccucuccaacgaguccaucaugcucgucgucgagcucguccagcgcgcccccgagcagcuccucgcccucaccccccuccaccaggccgcccucgccgagcgcgcccuccagaaccucgcccccaaggagacccccgucuccggcgagguccucgagacccucggcccccucgucggcuuccucggcaccgaguccacccgccagaucccccuccagauccuccucucccaccucucccagcuccagggcuucugccucggcgagaccuucgccaccgagcucggcuggcuccuccuccaggaguccguccucggcaagcccgagcucuggucccaggacgaggucgagcaggccggccgccucgucuucacccucuccaccgaggccaucucccucaucccccgcgaggcccucggccccgagacccucgagcgccuccucgagaagcagcaguccugggagcagucccgcgucggccagcucugccgcgagccccagcucgccgccaagaaggccgcccucgucgccggcgucguccgccccgccgccgaggaccuccccgagcccguccccaacugcgccgacguccgcggcaccuuccccgccgccugguccgccacccagaucgccgagauggagcucuccgacuucgaggacugccucacccucuucgccggcgaccccggccucggccccgaggagcuccgcgccgccaugggcaaggccaagcagcucuggggccccccccgcggcuuccgccccgagcagauccuccagcucggccgccuccucaucggccucggcgaccgcgagcuccaggagcucauccucgucgacuggggcguccucuccacccucggccagaucgacggcugguccaccacccagcuccgcaucgucgucuccuccuuccuccgccaguccggccgccacgucucccaccucgacuucguccaccucaccgcccucggcuacacccucugcggccuccgccccgaggagcuccagcacaucuccuccugggaguucucccaggccgcccucuuccucggcacccuccaccuccagugcuccgaggagcagcucgagguccucgcccaccuccucguccuccccggcggcuucggccccaucuccaacuggggccccgagaucuucaccgagaucggcaccaucgccgccggcauccccgaccucgcccucuccgcccuccuccgcggccagauccagggcgucaccccccucgccaucuccgucauccccccccccaaguucgccgucgucuucucccccauccagcucuccucccucaccuccgcccaggccgucgccgucacccccgagcagauggccuuccucucccccgagcagcgccgcgccgucgccugggcccagcacgagggcaaggagucccccgagcagcagggccgcuccaccgccuggggccuccaggacuggucccgccccuccuggucccucguccucaccaucuccuuccucggccaccuccucuga

SEQ ID NO: 50303 - RNA, 2394 nt, Artificial Sequence
  derived and/or modified sequence opt2 from STRN3__Homo_sapiens__NP_001077362
auggacgagcucgccggcggcggcggcggcggccccggcauggccgcccccccccgccagcagcagggccccggcggcaaccucggccucucccccggcggcaacggcgccgccggcggcggcggcccccccgccuccgagggcgccggccccgccgccggccccgagcucucccgcccccagcaguacaccauccccggcauccuccacuacauccagcacgagugggcccgcuucgagauggagcgcgcccacugggaggucgagcgcgccgagcuccaggcccgcaucgccuuccuccagggcgagcgcaagggccaggagaaccucaagaaggaccucguccgccgcaucaagaugcucgaguacgcccucaagcaggagcgcgccaaguaccacaagcucaaguacggcaccgagcucaaccagggcgaccucaagaugcccaccuucgaguccgaggagaccaaggacaccgaggcccccaccgccccccagaacucccagcucaccuggaagcagggccgccagcuccuccgccaguaccuccaggaggucggcuacaccgacaccauccucgacguccgcucccagcgcguccgcucccuccucggccucuccaacuccgagcccaacggcuccgucgagaccaagaaccucgagcagauccucaacggcggcgagucccccaagcagaagggccaggagaucaagcgcuccuccggcgacguccucgagaccuucaacuuccucgagaacgccgacgacuccgacgaggacgaggagaacgacaugaucgagggcauccccgagggcaaggacaagcaccgcaugaacaagcacaagaucggcaacgagggccucgccgccgaccucaccgacgaccccgacaccgaggaggcccucaaggaguucgacuuccucgucaccgccgaggacggcgagggcgccggcgaggcccgcuccuccggcgacggcaccgagugggacaaggacgaccucucccccaccgccgaggucugggacgucgaccagggccucaucuccaagcucaaggagcaguacaagaaggagcgcaagggcaagaagggcgucaagcgcgccaaccgcaccaagcucuacgacaugaucgccgaccucggcgacgacgagcucccccacauccccuccggcaucaucaaccagucccgcuccgccuccacccgcaugaccgaccacgagggcgcccgcgccgaggaggccgagcccaucaccuuccccuccggcggcggcaaguccuucaucaugggcuccgacgacguccuccucuccguccucggccucggcgaccucgccgaccucaccgucaccaacgacgccgacuacuccuacgaccuccccgccaacaaggacgccuuccgcaagaccuggaaccccaaguacacccuccgcucccacuucgacggcguccgcgcccucgccuuccaccccgucgagcccguccucgucaccgccuccgaggaccacacccucaagcucuggaaccuccagaagaccguccccgccaagaaguccgccucccucgacgucgagcccaucuacaccuuccgcgcccacaucggccccguccucucccucgccaucuccuccaacggcgagcagugcuucuccggcggcaucgacgccaccauccagugguggaacaugcccucccccuccgucgaccccuacgacaccuacgagcccaacguccucgccggcacccucgucggccacaccgacgccgucuggggccucgccuacuccggcaucaagaaccagcuccucuccugcuccgccgacggcaccguccgccucuggaacccccaggagaagcuccccugcaucugcaccuacaacggcgacaagaagcacggcauccccaccuccgucgacuucaucggcugcgaccccgcccacauggucaccuccuucaacaccggcuccgccgucaucuacgaccucgagaccucccagucccucgucauccucuccucccaggucgacuccggccuccaguccaacaaccacaucaaccgcgucgucucccaccccacccuccccgucaccaucaccgcccacgaggaccgccacaucaaguucuucgacaacaagaccggcaagaugauccacuccauggucgcccaccucgacgccgucaccucccucgccgucgaccccaacggcaucuaccucauguccggcucccacgacugcuccauccgccucuggaaccucgacuccaagaccugcguccaggagaucaccgcccaccgcaagaagcucgacgaguccaucuacgacgucgccuuccacuccuccaaggccuacaucgccuccgccggcgccgacgcccucgccaaggucuucgucuga

SEQ ID NO: 50304 - RNA, 2283 nt, Artificial Sequence
  derived and/or modified sequence opt2 from STRN4__Homo_sapiens__NP_001034966
augauggaggagcgcgccgccgccgccgucgccgccgccgccuccuccugccgcccccucggcuccggcgccggccccggccccaccggcgccgcccccgucuccgcccccgcccccggccccggccccgccggcaagggcggcggcggcggcggcucccccggccccaccgccggccccgagccccucucccuccccggcauccuccacuucauccagcacgagugggcccgcuucgaggccgagaaggcccgcugggaggccgagcgcgccgagcuccaggcccaggucgccuuccuccagggcgagcgcaagggccaggagaaccucaagaccgaccucguccgccgcaucaagaugcucgaguacgcccucaagcaggagcgcgccaaguaccacaagcucaaguucggcaccgaccucaaccagggcgagaagaaggccgacgucuccgagcaggucuccaacggccccgucgaguccgucacccucgagaacuccccccucgucuggaaggagggccgccagcuccuccgccaguaccucgaggaggucggcuacaccgacaccauccucgacaugcgcuccaagcgcguccgcucccuccucggccgcucccucgagcucaacggcgccgucgagcccuccgagggcgccccccgcgccccccccggccccgccggccucuccggcggcgagucccuccucgucaagcagaucgaggagcagaucaagcgcaacgccgccggcaaggacggcaaggagcgccucggcggcuccguccucggccagauccccuuccuccagaacugcgaggacgaggacuccgacgaggacgacgagcucgacuccguccagcacaagaagcagcgcgucaagcuccccuccaaggcccucguccccgagauggaggacgaggacgaggaggacgacuccgaggacgccaucaacgaguucgacuuccucggcuccggcgaggacggcgagggcgcccccgacccccgccgcugcaccgucgacggcuccccccacgagcucgagucccgccgcgucaagcuccagggcauccucgccgaccuccgcgacgucgacggccucccccccaaggucaccggccccccccccggcaccccccagccccgcccccacgagggcuccuucggcuucuccuccgacgucuucaucauggacaccaucggcggcggcgaggucucccucggcgaccucgccgaccucaccgucaccaacgacaacgaccucuccugcgaccucuccgacuccaaggacgccuucaagaagaccuggaaccccaaguucacccuccgcucccacuacgacggcauccgcucccucgccuuccaccacucccaguccgcccuccucaccgccuccgaggacggcacccucaagcucuggaaccuccagaaggccgucaccgccaagaagaacgccgcccucgacgucgagcccauccacgccuuccgcgcccaccgcggccccguccucgccgucgccaugggcuccaacuccgaguacugcuacuccggcggcgccgacgccugcauccacuccuggaagauccccgaccucuccauggaccccuacgacggcuacgaccccuccguccucucccacguccucgagggccacggcgacgccgucuggggccucgccuucucccccaccucccagcgccucgccuccugcuccgccgacggcaccguccgcaucugggaccccuccuccuccucccccgccugccucugcaccuuccccaccgccuccgagcacggcguccccaccuccgucgccuucaccuccaccgagcccgcccacaucgucgccuccuuccgcuccggcgacaccguccucuacgacauggaggucggcuccgcccuccucacccucgagucccgcggcuccuccggccccacccagaucaaccaggucgucucccaccccaaccagccccucaccaucaccgcccacgacgaccgcggcauccgcuuccucgacaaccgcaccggcaagcccguccacuccauggucgcccaccucgacgccgucaccugccucgccgucgaccccaacggcgccuuccucauguccggcucccacgacugcucccuccgccucuggucccucgacaacaagaccugcguccaggagaucaccgcccaccgcaagaagcacgaggaggccauccacgccgucgccugccaccccuccaaggcccucaucgccuccgccggcgccgacgcccucgccaaggucuucgucuga

SEQ ID NO: 50305 - RNA, 2343 nt, Artificial Sequence
  derived and/or modified sequence opt2 from STRN__Homo_sapiens__NP_003153
auggacgagcaggccggccccggcgucuucuucuccaacaaccaccccggcgccggcggcgccaagggccucggcccccucgccgaggccgccgccgccggcgacggcgccgccgccgccggcgccgcccgcgcccaguacucccuccccggcauccuccacuuccuccagcacgagugggcccgcuucgaggucgagcgcgcccagugggaggucgagcgcgccgagcuccaggcccagaucgccuuccuccagggcgagcgcaagggccaggagaaccucaagaaggaccucguccgccgcaucaagaugcucgaguacgcccucaagcaggagcgcgccaaguaccacaagcucaaguacggcaccgagcucaaccagggcgacaugaagccccccuccuacgacuccgacgagggcaacgagaccgagguccagccccagcagaacucccagcucauguggaagcagggccgccagcuccuccgccaguaccuccaggaggucggcuacaccgacaccauccucgacgucaaguccaagcgcguccgcgcccuccucggcuucuccuccgacgucaccgaccgcgaggacgacaagaaccaggacuccgucgucaacggcaccgaggccgaggucaaggagaccgccaugaucgccaaguccgagcucaccgacuccgccuccguccucgacaacuucaaguuccucgaguccgccgccgccgacuucuccgacgaggacgaggacgacgacgucgacggccgcgagaaguccgucaucgacaccuccaccaucguccgcaagaaggcccuccccgacuccggcgaggaccgcgacaccaaggaggcccucaaggaguucgacuuccucgucaccuccgaggagggcgacaacgagucccgcuccgccggcgacggcaccgacugggagaaggaggaccagugccucaugcccgaggccuggaacgucgaccagggcgucaucaccaagcucaaggagcaguacaagaaggagcgcaagggcaagaagggcgucaagcgccccaaccgcuccaagcuccaggacaugcucgccaaccuccgcgacgucgacgagcuccccucccuccagcccuccgucggcucccccucccgccccuccuccucccgccuccccgagcacgagaucaaccgcgccgacgaggucgaggcccucaccuucccccccuccuccggcaaguccuucaucaugggcgccgacgaggcccucgaguccgagcucggccucggcgagcucgccggccucaccgucgccaacgaggccgacucccucaccuacgacaucgccaacaacaaggacgcccuccgcaagaccuggaaccccaaguucacccuccgcucccacuucgacggcauccgcgcccucgccuuccaccccaucgagcccguccucaucaccgccuccgaggaccacacccucaagauguggaaccuccagaagaccgcccccgccaagaaguccaccucccucgacgucgagcccaucuacaccuuccgcgcccacaagggccccguccucugcgucgucauguccuccaacggcgagcagugcuacuccggcggcaccgacggccucauccagggcuggaacaccaccaaccccaacaucgaccccuacgacuccuacgaccccuccguccuccgcggcccccuccucggccacaccgacgccgucuggggccucgccuacuccgccgcccaccagcgccuccucuccugcuccgccgacggcacccuccgccucuggaacaccaccgaggucgcccccgcccucuccgucuucaacgacaccaaggagcucggcauccccgccuccgucgaccucgucuccuccgaccccucccacauggucgccuccuucuccaagggcuacaccuccaucuucaacauggagacccagcagcgcauccucacccucgaguccaacgucgacaccaccgccaacuccuccugccagaucaaccgcgucaucucccaccccacccuccccaucuccaucaccgcccacgaggaccgccacaucaaguucuacgacaacaacaccggcaagcucauccacuccauggucgcccaccucgaggccgucaccucccucgccgucgaccccaacggccucuaccucauguccggcucccacgacugcuccauccgccucuggaaccucgaguccaagaccugcauccaggaguucaccgcccaccgcaagaaguucgaggaguccauccacgacgucgccuuccaccccuccaagugcuacaucgccuccgccggcgccgacgcccucgccaaggucuucgucuga

SEQ ID NO: 50306 - RNA, 1752 nt, Artificial Sequence
  derived and/or modified sequence opt2 from STS__Homo_sapiens__NP_000342
augccccuccgcaagaugaagauccccuuccuccuccucuucuuccucugggaggccgagucccacgccgccucccgccccaacaucauccucgucauggccgacgaccucggcaucggcgaccccggcugcuacggcaacaagaccauccgcacccccaacaucgaccgccucgccuccggcggcgucaagcucacccagcaccucgccgccuccccccucugcacccccucccgcgccgccuucaugaccggccgcuaccccguccgcuccggcauggccuccuggucccgcaccggcgucuuccucuucaccgccuccuccggcggccuccccaccgacgagaucaccuucgccaagcuccucaaggaccagggcuacuccaccgcccucaucggcaaguggcaccucggcauguccugccacuccaagaccgacuucugccaccacccccuccaccacggcuucaacuacuucuacggcaucucccucaccaaccuccgcgacugcaagcccggcgagggcuccgucuucaccaccggcuucaagcgccucgucuuccucccccuccagaucgucggcgucacccuccucacccucgccgcccucaacugccucggccuccuccacgucccccucggcgucuucuucucccuccucuuccucgccgcccucauccucacccucuuccucggcuuccuccacuacuuccgcccccucaacugcuucaugaugcgcaacuacgagaucauccagcagcccauguccuacgacaaccucacccagcgccucaccgucgaggccgcccaguucauccagcgcaacaccgagacccccuuccuccucguccucuccuaccuccacguccacaccgcccucuucuccuccaaggacuucgccggcaagucccagcacggcgucuacggcgacgccgucgaggagauggacugguccgucggccagauccucaaccuccucgacgagcuccgccucgccaacgacacccucaucuacuucaccuccgaccagggcgcccacgucgaggaggucuccuccaagggcgagauccacggcggcuccaacggcaucuacaagggcggcaaggccaacaacugggagggcggcauccgcguccccggcauccuccgcuggccccgcgucauccaggccggccagaagaucgacgagcccaccuccaacauggacaucuuccccaccgucgccaagcucgccggcgccccccuccccgaggaccgcaucaucgacggccgcgaccucaugccccuccucgagggcaagucccagcgcuccgaccacgaguuccucuuccacuacugcaacgccuaccucaacgccguccgcuggcacccccagaacuccaccuccaucuggaaggccuucuucuucacccccaacuucaaccccgucggcuccaacggcugcuucgccacccacgucugcuucugcuucggcuccuacgucacccaccacgaccccccccuccucuucgacaucuccaaggacccccgcgagcgcaacccccucacccccgccuccgagccccgcuucuacgagauccucaaggucaugcaggaggccgccgaccgccacacccagacccuccccgagguccccgaccaguucuccuggaacaacuuccucuggaagcccuggcuccagcucugcugccccuccaccggccucuccugccagugcgaccgcgagaagcaggacaagcgccucucccgcuga

SEQ ID NO: 50307 - RNA, 2118 nt, Artificial Sequence
  derived and/or modified sequence opt2 from STT3A__Homo_sapiens__NP_001265432
augaccaaguucggcuuccuccgccucuccuacgagaagcaggacacccuccucaagcuccucauccucuccauggccgccguccucuccuucuccacccgccucuucgccguccuccgcuucgaguccgucauccacgaguucgaccccuacuucaacuaccgcaccacccgcuuccucgccgaggagggcuucuacaaguuccacaacugguucgacgaccgcgccugguacccccucggccgcaucaucggcggcaccaucuaccccggccucaugaucaccuccgccgccaucuaccacguccuccacuucuuccacaucaccaucgacauccgcaacgucugcgucuuccucgccccccucuucuccuccuucaccaccaucgucaccuaccaccucaccaaggagcucaaggacgccggcgccggccuccucgccgccgccaugaucgccgucguccccggcuacaucucccgcuccgucgccggcuccuacgacaacgagggcaucgccaucuucugcaugcuccucaccuacuacauguggaucaaggccgucaagaccggcuccaucugcugggccgccaagugcgcccucgccuacuucuacauggucuccuccuggggcggcuacgucuuccucaucaaccucaucccccuccacguccucguccucaugcucaccggccgcuucucccaccgcaucuacgucgccuacugcaccgucuacugccucggcaccauccucuccaugcagaucuccuucgucggcuuccagcccguccucuccuccgagcacauggccgccuucggcgucuucggccucugccagauccacgccuucgucgacuaccuccgcuccaagcucaacccccagcaguucgagguccucuuccgcuccgucaucucccucgucggcuucguccuccucaccgucggcgcccuccucaugcucaccggcaagaucucccccuggaccggccgcuucuacucccuccucgaccccuccuacgccaagaacaacauccccaucaucgccuccgucuccgagcaccagcccaccaccugguccuccuacuacuucgaccuccagcuccucgucuucauguuccccgucggccucuacuacugcuucuccaaccucuccgacgcccgcaucuucaucaucauguacggcgucaccuccauguacuucuccgccgucaugguccgccucaugcucguccucgcccccgucaugugcauccucuccggcaucggcgucucccagguccucuccaccuacaugaagaaccucgacaucucccgccccgacaagaaguccaagaagcagcaggacuccaccuaccccaucaagaacgaggucgccuccggcaugauccucgucauggccuucuuccucaucaccuacaccuuccacuccaccugggucaccuccgaggccuacuccucccccuccaucguccucuccgcccgcggcggcgacggcucccgcaucaucuucgacgacuuccgcgaggccuacuacuggcuccgccacaacacccccgaggacgccaaggucauguccuggugggacuacggcuaccagaucaccgccauggccaaccgcaccauccucgucgacaacaacaccuggaacaacacccacaucucccgcgucggccaggccauggccuccaccgaggagaaggccuacgagaucaugcgcgagcucgacgucuccuacguccucgucaucuucggcggccucaccggcuacuccuccgacgacaucaacaaguuccucuggaugguccgcaucggcggcuccaccgacaccggcaagcacaucaaggagaacgacuacuacacccccaccggcgaguuccgcgucgaccgcgagggcucccccguccuccucaacugccucauguacaagaugugcuacuaccgcuucggccaggucuacaccgaggccaagcgcccccccggcuucgaccgcguccgcaacgccgagaucggcaacaaggacuucgagcucgacguccucgaggaggccuacaccaccgagcacuggcucguccgcaucuacaaggucaaggaccucgacaaccgcggccucucccgcaccuga

SEQ ID NO: 50308 - RNA, 2481 nt, Artificial Sequence
  derived and/or modified sequence opt2 from STT3B__Homo_sapiens__NP_849193
auggccgagcccuccgcccccgaguccaagcacaaguccucccucaacuccucccccugguccggccucauggcccucggcaacucccgccacggccaccacggccccggcgcccagugcgcccacaaggccgccggcggcgccgccccccccaagcccgcccccgccggccucuccggcggccucucccagcccgccggcuggcagucccuccucuccuucaccauccucuuccucgccuggcucgccggcuucuccucccgccucuucgccgucauccgcuucgaguccaucauccacgaguucgaccccugguucaacuaccgcuccacccaccaccucgccucccacggcuucuacgaguuccucaacugguucgacgagcgcgccugguacccccucggccgcaucgucggcggcaccgucuaccccggccucaugaucaccgccggccucauccacuggauccucaacacccucaacaucaccguccacauccgcgacgucugcgucuuccucgcccccaccuucuccggccucaccuccaucuccaccuuccuccucacccgcgagcucuggaaccagggcgccggccuccucgccgccugcuucaucgccaucguccccggcuacaucucccgcuccgucgccggcuccuucgacaacgagggcaucgccaucuucgcccuccaguucaccuacuaccucugggucaaguccgucaagaccggcuccgucuucuggaccaugugcugcugccucuccuacuucuacauggucuccgccuggggcggcuacgucuucaucaucaaccucaucccccuccacgucuucguccuccuccucaugcagcgcuacuccaagcgcgucuacaucgccuacuccaccuucuacaucgucggccucauccucuccaugcagauccccuucgucggcuuccagcccauccgcaccuccgagcacauggccgccgccggcgucuucgcccuccuccaggccuacgccuuccuccaguaccuccgcgaccgccucaccaagcaggaguuccagacccucuucuuccucggcgucucccucgccgccggcgccgucuuccucuccgucaucuaccucaccuacaccggcuacaucgcccccugguccggccgcuucuacucccucugggacaccggcuacgccaagauccacauccccaucaucgccuccgucuccgagcaccagcccaccaccugggucuccuucuucuucgaccuccacauccucgucugcaccuuccccgccggccucugguucugcaucaagaacaucaacgacgagcgcgucuucgucgcccucuacgccaucuccgccgucuacuucgccggcgucaugguccgccucaugcucacccucacccccgucgucugcaugcucuccgccaucgccuucuccaacgucuucgagcacuaccucggcgacgacaugaagcgcgagaacccccccgucgaggacuccuccgacgaggacgacaagcgcaaccagggcaaccucuacgacaaggccggcaagguccgcaagcacgccaccgagcaggagaagaccgaggagggccucggccccaacaucaaguccaucgucaccaugcucaugcucaugcuccucaugauguucgccguccacugcaccugggucaccuccaacgccuacuccucccccuccgucguccucgccuccuacaaccacgacggcacccgcaacauccucgacgacuuccgcgaggccuacuucuggcuccgccagaacaccgacgagcacgcccgcgucauguccuggugggacuacggcuaccagaucgccggcauggccaaccgcaccacccucgucgacaacaacaccuggaacaacucccacaucgcccucgucggcaaggccauguccuccaacgagaccgccgccuacaagaucaugcgcacccucgacgucgacuacguccucgucaucuucggcggcgucaucggcuacuccggcgacgacaucaacaaguuccucuggaugguccgcaucgccgagggcgagcaccccaaggacauccgcgaguccgacuacuucaccccccagggcgaguuccgcgucgacaaggccggcucccccacccuccucaacugccucauguacaagauguccuacuaccgcuucggcgagaugcagcucgacuuccgcaccccccccggcuucgaccgcacccgcaacgccgagaucggcaacaaggacaucaaguucaagcaccucgaggaggccuucaccuccgagcacuggcucguccgcaucuacaaggucaaggcccccgacaaccgcgagacccucgaccacaagccccgcgucaccaacaucuuccccaagcagaaguaccucuccaagaagaccaccaagcgcaagcgcggcuacaucaagaacaagcucgucuucaagaagggcaagaagaucuccaagaagaccgucuga

SEQ ID NO: 50309 - RNA, 912 nt, Artificial Sequence
  derived and/or modified sequence opt2 from STUB1__Homo_sapiens__NP_005852
augaagggcaaggaggagaaggagggcggcgcccgccucggcgccggcggcggcucccccgagaagucccccuccgcccaggagcucaaggagcagggcaaccgccucuucgucggccgcaaguaccccgaggccgccgccugcuacggccgcgccaucacccgcaacccccucgucgccgucuacuacaccaaccgcgcccucugcuaccucaagaugcagcagcacgagcaggcccucgccgacugccgccgcgcccucgagcucgacggccaguccgucaaggcccacuucuuccucggccagugccagcucgagauggaguccuacgacgaggccaucgccaaccuccagcgcgccuacucccucgccaaggagcagcgccucaacuucggcgacgacauccccuccgcccuccgcaucgccaagaagaagcgcuggaacuccaucgaggagcgccgcauccaccaggaguccgagcuccacuccuaccucucccgccucaucgccgccgagcgcgagcgcgagcucgaggagugccagcgcaaccacgagggcgacgaggacgacucccacguccgcgcccagcaggccugcaucgaggccaagcacgacaaguacauggccgacauggacgagcucuucucccaggucgacgagaagcgcaagaagcgcgacauccccgacuaccucugcggcaagaucuccuucgagcucaugcgcgagcccugcaucacccccuccggcaucaccuacgaccgcaaggacaucgaggagcaccuccagcgcgucggccacuucgaccccgucacccgcuccccccucacccaggagcagcucauccccaaccucgccaugaaggaggucaucgacgccuucaucuccgagaacggcugggucgaggacuacuga

SEQ ID NO: 50310 - RNA, 864 nt, Artificial Sequence
  derived and/or modified sequence opt2 from STX11__Homo_sapiens__NP_003755
augaaggaccgccucgccgagcuccucgaccucuccaagcaguacgaccagcaguuccccgacggcgacgacgaguucgacuccccccacgaggacaucgucuucgagaccgaccacauccucgagucccucuaccgcgacauccgcgacauccaggacgagaaccagcuccucgucgccgacgucaagcgccucggcaagcagaacgcccgcuuccucaccuccaugcgccgccucuccuccaucaagcgcgacaccaacuccaucgccaaggccaucaaggcccgcggcgaggucauccacugcaagcuccgcgccaugaaggagcucuccgaggccgccgaggcccagcacggcccccacuccgccgucgcccgcaucucccgcgcccaguacaacgcccucacccucaccuuccagcgcgccaugcacgacuacaaccaggccgagaugaagcagcgcgacaacugcaagauccgcauccagcgccagcucgagaucaugggcaaggaggucuccggcgaccagaucgaggacauguucgagcagggcaagugggacgucuucuccgagaaccuccucgccgacgucaagggcgcccgcgccgcccucaacgagaucgagucccgccaccgcgagcuccuccgccucgagucccgcauccgcgacguccacgagcucuuccuccagauggccguccucgucgagaagcaggccgacacccucaacgucaucgagcucaacguccagaagaccgucgacuacaccggccaggccaaggcccagguccgcaaggccguccaguacgaggagaagaaccccugccgcacccucugcugcuucugcugccccugccucaaguga

SEQ ID NO: 50311 - RNA, 978 nt, Artificial Sequence
  derived and/or modified sequence opt2 from STX16__Homo_sapiens__NP_001001433
auggccacccgccgccucaccgacgccuuccuccuccuccgcaacaacuccauccagaaccgccagcuccucgccgagcaggucuccucccacaucaccuccuccccccuccacucccgcuccaucgccgccgagcucgacgagcucgccgacgaccgcauggcccucgucuccggcaucucccucgaccccgaggccgccaucggcgucaccaagcgccccccccccaagugggucgacggcgucgacgagauccaguacgacgucggccgcaucaagcagaagaugaaggagcucgccucccuccacgacaagcaccucaaccgccccacccucgacgacuccuccgaggaggagcacgccaucgagaucaccacccaggagaucacccagcucuuccaccgcugccagcgcgccguccaggcccuccccucccgcgcccgcgccugcuccgagcaggagggccgccuccucggcaacgucgucgccucccucgcccaggcccuccaggagcucuccaccuccuuccgccacgcccaguccggcuaccucaagcgcaugaagaaccgcgaggagcgcucccagcacuucuucgacaccuccgucccccucauggacgacggcgacgacaacacccucuaccaccgcggcuucaccgaggaccagcucguccucgucgagcagaacacccucauggucgaggagcgcgagcgcgagauccgccagaucguccaguccaucuccgaccucaacgagaucuuccgcgaccucggcgccaugaucgucgagcagggcaccguccucgaccgcaucgacuacaacgucgagcaguccugcaucaagaccgaggacggccucaagcagcuccacaaggccgagcaguaccagaagaagaaccgcaagaugcucgucauccucauccucuucgucaucaucaucguccucaucgucguccucgucggcgucaagucccgcuga

SEQ ID NO: 50312 - RNA, 909 nt, Artificial Sequence
  derived and/or modified sequence opt2 from STX17__Homo_sapiens__NP_060389
auguccgaggacgaggagaaggucaagcuccgccgccucgagcccgccauccagaaguucaucaagaucgucauccccaccgaccucgagcgccuccgcaagcaccagaucaacaucgagaaguaccagcgcugccgcaucugggacaagcuccacgaggagcacaucaacgccggccgcaccguccagcagcuccgcuccaacauccgcgagaucgagaagcucugccucaagguccgcaaggacgaccucguccuccucaagcgcaugaucgaccccgucaaggaggaggccuccgccgccaccgccgaguuccuccagcuccaccucgaguccgucgaggagcucaagaagcaguucaacgacgaggagacccuccuccagcccccccucacccgcuccaugaccgucggcggcgccuuccacaccaccgaggccgaggccuccucccagucccucacccagaucuacgcccuccccgagaucccccaggaccagaacgccgccgaguccugggagacccucgaggccgaccucaucgagcucucccagcucgucaccgacuucucccuccucgucaacucccagcaggagaagaucgacuccaucgccgaccacgucaacuccgccgccgucaacgucgaggagggcaccaagaaccucggcaaggccgccaaguacaagcucgccgcccuccccgucgccggcgcccucaucggcggcauggucggcggccccaucggccuccucgccggcuucaaggucgccggcaucgccgccgcccucggcggcggcguccucggcuucaccggcggcaagcucauccagcgcaagaagcagaagaugauggagaagcucaccuccuccugccccgaccuccccucccagaccgacaagaagugcuccuga

SEQ ID NO: 50313 - RNA, 1008 nt, Artificial Sequence
  derived and/or modified sequence opt2 from STX18__Homo_sapiens__NP_058626
auggccgucgacaucacccuccucuuccgcgccuccgucaagaccgucaagacccgcaacaaggcccucggcgucgccgucggcggcggcgucgacggcucccgcgacgagcucuuccgccgcuccccccgccccaagggcgacuucuccucccgcgcccgcgaggucaucucccacaucggcaagcuccgcgacuuccuccucgagcaccgcaaggacuacaucaacgccuacucccacaccauguccgaguacggccgcaugaccgacaccgagcgcgaccagaucgaccaggacgcccagaucuucaugcgcaccugcuccgaggccauccagcagcuccgcaccgaggcccacaaggagauccacucccagcaggucaaggagcaccgcaccgccguccucgacuucaucgaggacuaccucaagcgcgucugcaagcucuacuccgagcagcgcgccauccgcgucaagcgcgucgucgacaagaagcgccucuccaagcucgagcccgagcccaacaccaagacccgcgaguccaccuccuccgagaaggucucccagucccccuccaaggacuccgaggagaaccccgccaccgaggagcgccccgagaagauccucgccgagacccagcccgagcucggcaccuggggcgacggcaagggcgaggacgagcucucccccgaggagauccagauguucgagcaggagaaccagcgccucaucggcgagaugaacucccucuucgacgagguccgccagaucgagggccgcgucgucgagaucucccgccuccaggagaucuucaccgagaagguccuccagcaggaggccgagaucgacuccauccaccagcucgucgucggcgccaccgagaacaucaaggagggcaacgaggacauccgcgaggccaucaagaacaacgccggcuuccgcgucuggauccucuucuuccucgucaugugcuccuucucccuccucuuccucgacugguacgacuccuga

SEQ ID NO: 50314 - RNA, 756 nt, Artificial Sequence
  derived and/or modified sequence opt2 from STX1A__Homo_sapiens__NP_001159375
augaaggaccgcacccaggagcuccgcaccgccaaggacuccgacgacgacgacgacgucgccgucaccgucgaccgcgaccgcuucauggacgaguucuucgagcaggucgaggagauccgcggcuucaucgacaagaucgccgagaacgucgaggaggucaagcgcaagcacuccgccauccucgccucccccaaccccgacgagaagaccaaggaggagcucgaggagcucauguccgacaucaagaagaccgccaacaagguccgcuccaagcucaaguccaucgagcaguccaucgagcaggaggagggccucaaccgcuccuccgccgaccuccgcauccgcaagacccagcacuccacccucucccgcaaguucgucgaggucauguccgaguacaacgccacccaguccgacuaccgcgagcgcugcaagggccgcauccagcgccagcucgagaucaccggccgcaccaccaccuccgaggagcucgaggacaugcucgaguccggcaaccccgccaucuucgccuccggcaucaucauggacuccuccaucuccaagcaggcccucuccgagaucgagacccgccacuccgagaucaucaagcucgagaacuccauccgcgagcuccacgacauguucauggacauggccaugcucgucgagucccagaccauguggcgcggccccugccucaccccccgccgccccuccuccacccgcgcccgccgcgccggccgcaaguccuga

SEQ ID NO: 50315 - RNA, 867 nt, Artificial Sequence
  derived and/or modified sequence opt2 from STX1B__Homo_sapiens__NP_443106
augaaggaccgcacccaggagcuccgcuccgccaaggacuccgacgacgaggaggaggucguccacgucgaccgcgaccacuucauggacgaguucuucgagcaggucgaggagauccgcggcugcaucgagaagcucuccgaggacgucgagcaggucaagaagcagcacuccgccauccucgccgcccccaaccccgacgagaagaccaagcaggagcucgaggaccucaccgccgacaucaagaagaccgccaacaagguccgcuccaagcucaaggccaucgagcaguccaucgagcaggaggagggccucaaccgcuccuccgccgaccuccgcauccgcaagacccagcacuccacccucucccgcaaguucgucgaggucaugaccgaguacaacgccacccaguccaaguaccgcgaccgcugcaaggaccgcauccagcgccagcucgagaucaccggccgcaccaccaccaacgaggagcucgaggacaugcucgaguccggcaagcucgccaucuucaccgacgacaucaagauggacucccagaugaccaagcaggcccucaacgagaucgagacccgccacaacgagaucaucaagcucgagaccuccauccgcgagcuccacgacauguucgucgacauggccaugcucgucgagucccagggcgagaugaucgaccgcaucgaguacaacgucgagcacuccgucgacuacgucgagcgcgccgucuccgacaccaagaaggccgucaaguaccaguccaaggcccgccgcaagaagaucaugaucaucaucugcugcgucguccucggcgucguccucgccuccuccaucggcggcacccucggccucuga

SEQ ID NO: 50316 - RNA, 864 nt, Artificial Sequence
  derived and/or modified sequence opt2 from STX2__Homo_sapiens__NP_001971
augcgcgaccgccuccccgaccucaccgccugccgcaagaacgacgacggcgacaccgucgucgucgucgagaaggaccacuucauggacgacuucuuccaccaggucgaggagauccgcaacuccaucgacaagaucacccaguacgucgaggaggucaagaagaaccacuccaucauccucuccgcccccaaccccgagggcaagaucaaggaggagcucgaggaccucaacaaggagaucaagaagaccgccaacaagauccgcgccaagcucaaggccaucgagcaguccuucgaccaggacgaguccggcaaccgcaccuccgucgaccuccgcauccgccgcacccagcacuccguccucucccgcaaguucgucgaggccauggccgaguacaacgaggcccagacccucuuccgcgagcgcuccaagggccgcauccagcgccagcucgagaucaccggccgcaccaccaccgacgacgagcucgaggagaugcucgaguccggcaagcccuccaucuucaccuccgacaucaucuccgacucccagaucacccgccaggcccucaacgagaucgagucccgccacaaggacaucaugaagcucgagaccuccauccgcgagcuccacgagauguucauggacauggccauguucgucgagacccagggcgagaugaucaacaacaucgagcgcaacgucaugaacgccaccgacuacgucgagcacgccaaggaggagaccaagaaggccaucaaguaccaguccaaggcccgccgcaagcucauguucaucaucaucugcgucaucguccuccucgucauccucggcaucauccucgccaccacccucuccuga

SEQ ID NO: 50317 - RNA, 834 nt, Artificial Sequence
  derived and/or modified sequence opt2 from STX3__Homo_sapiens__NP_001171511
augaaggaccgccucgagcagcucaaggccaagcagcucacccaggacgacgacaccgacgccgucgagaucgccaucgacaacaccgccuucauggacgaguucuucuccgagaucgaggagacccgccucaacaucgacaagaucuccgagcacgucgaggaggccaagaagcucuacuccaucauccucuccgcccccauccccgagcccaagaccaaggacgaccucgagcagcucaccaccgagaucaagaagcgcgccaacaacguccgcaacaagcucaaguccauggagaagcacaucgaggaggacgagguccgcuccuccgccgaccuccgcauccgcaagucccagcacuccguccucucccgcaaguucgucgaggucaugaccaaguacaacgaggcccaggucgacuuccgcgagcgcuccaagggccgcauccagcgccagcucgagaucaccggcaagaagaccaccgacgaggagcucgaggagaugcucgaguccggcaaccccgccaucuucaccuccggcaucaucgacucccagaucuccaagcaggcccucuccgagaucgagggccgccacaaggacaucguccgccucgaguccuccaucaaggagcuccacgacauguucauggacaucgccaugcucgucgagaaccagggcgagaugcucgacaacaucgagcucaacgucaugcacaccgucgaccacgucgagaaggcccgcgacgagaccaagaaggccgucaaguaccagucccaggcccgcaagaagcucaucucccuccagaccggcgucgccacccucgucuuccgcuga

SEQ ID NO: 50318 - RNA, 888 nt, Artificial Sequence
  derived and/or modified sequence opt2 from STX4__Homo_sapiens__NP_001259025
augggcaugaccgcccgcaccaagcgcacccgcuccggcucccgcugguggugcacccgcgcccgccacggcuggggcgcccgcacccgcuccuccuccaccuccccccucggccaccccccccagguccgcaccauccgccagaccaucgucaagcucggcaacaagguccaggagcucgagaagcagcaggucaccauccucgccaccccccuccccgaggaguccaugaagcaggagcuccagaaccuccgcgacgagaucaagcagcucggccgcgagauccgccuccagcucaaggccaucgagccccagaaggaggaggccgacgagaacuacaacuccgucaacacccgcaugcgcaagacccagcacggcguccucucccagcaguucgucgagcucaucaacaagugcaacuccaugcaguccgaguaccgcgagaagaacgucgagcgcauccgccgccagcucaagaucaccaacgccggcauggucuccgacgaggagcucgagcagaugcucgacuccggccaguccgaggucuucgucuccaacauccucaaggacacccaggucacccgccaggcccucaacgagaucuccgcccgccacuccgagauccagcagcucgagcgcuccauccgcgagcuccacgacaucuucaccuuccucgccaccgaggucgagaugcagggcgagaugaucaaccgcaucgagaagaacauccucuccuccgccgacuacgucgagcgcggccaggagcacgucaagaccgcccucgagaaccagaagaaggcccgcaagaagaagguccucaucgccaucugcgucuccaucaccgucguccuccucgccgucaucaucggcgucaccgucgucggcuga

SEQ ID NO: 50319 - RNA, 966 nt, Artificial Sequence
  derived and/or modified sequence opt2 from STX5__Homo_sapiens__NP_001231595
augaucccccgcaagcgcuacggcuccaagaacaccgaccagggcgucuaccucggccucuccaagacccagguccucucccccgccaccgccggcuccuccuccuccgacaucgccccccuccccccccccgucacccucgucccccccccccccgacaccauguccugccgcgaccgcacccaggaguuccucuccgccugcaagucccuccagacccgccagaacggcauccagaccaacaagcccgcccuccgcgccguccgccagcgcuccgaguucacccucauggccaagcgcaucggcaaggaccucuccaacaccuucgccaagcucgagaagcucaccauccucgccaagcgcaagucccucuucgacgacaaggccgucgagaucgaggagcucaccuacaucaucaagcaggacaucaacucccucaacaagcagaucgcccagcuccaggacuucguccgcgccaagggcucccaguccggccgccaccuccagacccacuccaacaccaucgucgucucccuccaguccaagcucgccuccauguccaacgacuucaaguccguccucgagguccgcaccgagaaccucaagcagcagcgcucccgccgcgagcaguucucccgcgcccccgucuccgcccucccccucgcccccaaccaccucggcggcggcgccgucguccucggcgccgagucccacgccuccaaggacgucgccaucgacaugauggacucccgcaccucccagcagcuccagcucaucgacgagcaggacuccuacauccagucccgcgccgacaccaugcagaacaucgaguccaccaucgucgagcucggcuccaucuuccagcagcucgcccacauggucaaggagcaggaggagaccauccaguccguccuccucuucccccuccuccccgcccucucccccggcuccacccgcaccugcuga

SEQ ID NO: 50320 - RNA, 465 nt, Artificial Sequence
  derived and/or modified sequence opt2 from STX6__Homo_sapiens__NP_001273139
augaaggaccagauguccaccuccuccguccaggcccucgccgagcgcaagaaccgccaggcccuccucggcgacuccggcucccagaacugguccaccggcaccaccgacaaguacggccgccucgaccgcgagcuccagcgcgccaacucccacuucaucgaggagcagcaggcccagcagcagcucaucgucgagcagcaggacgagcagcucgagcucgucuccggcuccaucggcguccucaagaacaugucccagcgcaucggcggcgagcucgaggagcaggccgucaugcucgaggacuucucccacgagcucgaguccacccagucccgccucgacaacgucaugaagaagcucgccaaggucucccacaugaccuccgaccgccgccaguggugcgccaucgccauccucuucgccguccuccucgucguccucauccucuuccucguccucuga

SEQ ID NO: 50321 - RNA, 711 nt, Artificial Sequence
  derived and/or modified sequence opt2 from STX8__Homo_sapiens__NP_004844
auggcccccgaccccugguucuccaccuacgacuccaccugccagaucgcccaggagaucgccgagaagauccagcagcgcaaccaguacgagcgcaagggcgagaaggcccccaagcucaccgucaccauccgcgcccuccuccagaaccucaaggagaagaucgcccuccucaaggaccuccuccuccgcgccgucuccacccaccagaucacccagcucgagggcgaccgccgccagaaccuccucgacgaccucgucacccgcgagcgccuccuccucgccuccuucaagaacgagggcgccgagcccgaccucauccgcuccucccucauguccgaggaggccaagcgcggcgcccccaaccccuggcucuucgaggagcccgaggagacccgcggccucggcuucgacgagauccgccagcagcagcagaagaucauccaggagcaggacgccggccucgacgcccucuccuccaucaucucccgccagaagcagaugggccaggagaucggcaacgagcucgacgagcagaacgagaucaucgacgaccucgccaaccucgucgagaacaccgacgagaagcuccgcaacgagacccgccgcgucaacauggucgaccgcaaguccgccuccugcggcaugaucauggucauccuccuccuccucgucgccaucgucgucgucgccgucuggcccaccaacuga

SEQ ID NO: 50322 - RNA, 1785 nt, Artificial Sequence
  derived and/or modified sequence opt2 from STXBP1__Homo_sapiens__NP_001027392
auggcccccaucggccucaaggccgucgucggcgagaagaucaugcacgacgucaucaagaaggucaagaagaagggcgaguggaagguccucgucgucgaccagcucuccaugcgcaugcucuccuccugcugcaagaugaccgacaucaugaccgagggcaucaccaucgucgaggacaucaacaagcgccgcgagccccuccccucccucgaggccgucuaccucaucacccccuccgagaaguccguccacucccucaucuccgacuucaaggacccccccaccgccaaguaccgcgccgcccacgucuucuucaccgacuccugccccgacgcccucuucaacgagcucgucaagucccgcgccgccaaggucaucaagacccucaccgagaucaacaucgccuuccuccccuacgagucccaggucuacucccucgacuccgccgacuccuuccaguccuucuacuccccccacaaggcccagaugaagaaccccauccucgagcgccucgccgagcagaucgccacccucugcgccacccucaaggaguaccccgccguccgcuaccgcggcgaguacaaggacaacgcccuccucgcccagcucauccaggacaagcucgacgccuacaaggccgacgaccccaccaugggcgagggccccgacaaggcccgcucccagcuccucauccucgaccgcggcuucgaccccuccucccccguccuccacgagcucaccuuccaggccauguccuacgaccuccuccccaucgagaacgacgucuacaaguacgagaccuccggcaucggcgaggcccgcgucaaggagguccuccucgacgaggacgacgaccucuggaucgcccuccgccacaagcacaucgccgaggucucccaggaggucacccgcucccucaaggacuucuccuccuccaagcgcaugaacaccggcgagaagaccaccaugcgcgaccucucccagaugcucaagaagaugccccaguaccagaaggagcucuccaaguacuccacccaccuccaccucgccgaggacugcaugaagcacuaccagggcaccgucgacaagcucugccgcgucgagcaggaccucgccaugggcaccgacgccgagggcgagaagaucaaggaccccaugcgcgccaucguccccauccuccucgacgccaacgucuccaccuacgacaagauccgcaucauccuccucuacaucuuccucaagaacggcaucaccgaggagaaccucaacaagcucauccagcacgcccagaucccccccgaggacuccgagaucaucaccaacauggcccaccucggcguccccaucgucaccgacuccacccuccgccgccgcuccaagcccgagcgcaaggagcgcaucuccgagcagaccuaccagcucucccgcuggacccccaucaucaaggacaucauggaggacaccaucgaggacaagcucgacaccaagcacuaccccuacaucuccacccgcuccuccgccuccuucuccaccaccgccgucuccgcccgcuacggccacuggcacaagaacaaggcccccggcgaguaccgcuccggcccccgccucaucaucuucauccucggcggcgucucccucaacgagaugcgcugcgccuacgaggucacccaggccaacggcaagugggagguccucaucggcuccacccacauccucaccccccagaagcuccucgacacccucaagaagcucaacaagaccgacgaggagaucuccuccuga

SEQ ID NO: 50323 - RNA, 1773 nt, Artificial Sequence
  derived and/or modified sequence opt2 from STXBP2__Homo_sapiens__NP_001120868
auggcccccuccggccucaaggccgucgucggcgagaagauccucuccggcgucauccgcuccgucaagaaggacggcgaguggaagguccucaucauggaccaccccuccaugcgcauccucuccuccugcugcaagauguccgacauccucgccgagggcaucaccaucgucgaggacaucaacaagcgccgcgagcccauccccucccucgaggccaucuaccuccucucccccaccgagaaggcccucaucaaggacuuccagggcacccccaccuucaccuacaaggccgcccacaucuucuucaccgacaccugccccgagccccucuucuccgagcucggccgcucccgccucgccaaggucgucaagacccucaaggagauccaccucgccuuccuccccuacgaggcccaggucuucucccucgacgccccccacuccaccuacaaccucuacugccccuuccgcgccgaggagcgcacccgccagcucgagguccucgcccagcagaucgccacccucugcgccacccuccaggaguaccccgccauccgcuaccgcaagggccccgaggacaccgcccagcucgcccacgccguccucgccaagcucaacgccuucaaggccgacacccccucccucggcgagggccccgagaagacccgcucccagcuccucaucauggaccgcgccgccgaccccgucuccccccuccuccacgagcucaccuuccaggccauggccuacgaccuccucgacaucgagcaggacaccuaccgcuacgagaccaccggccucuccgaggcccgcgagaaggccguccuccucgacgaggacgacgaccucugggucgagcuccgccacaugcacaucgccgacgucuccaagaaggucaccgagcuccuccgcaccuucugcgaguccaagcgccucaccaccgacaaggccaacaucaaggaccucucccagauccucaagaagaugccccaguaccagaaggagcucaacaaguacuccacccaccuccaccucgccgacgacugcaugaagcacuucaagggcuccgucgagaagcucugcuccgucgagcaggaccucgccaugggcuccgacgccgagggcgagaagaucaaggacuccaugaagcucaucguccccguccuccucgacgccgccguccccgccuacgacaagauccgcguccuccuccucuacauccuccuccgcaacggcgucuccgaggagaaccucgccaagcucauccagcacgccaacguccaggcccacuccucccucauccgcaaccucgagcagcucggcggcaccgucaccaaccccggcggcuccggcaccuccucccgccucgagccccgcgagcgcauggagcccaccuaccagcucucccgcuggacccccgucaucaaggacgucauggaggacgccgucgaggaccgccucgaccgcaaccucuggcccuucgucuccgaccccgcccccaccgccuccucccaggccgccgucuccgcccgcuucggccacuggcacaagaacaaggccggcaucgaggcccgcgccggcccccgccucaucgucuacgucaugggcggcgucgccauguccgagaugcgcgccgccuacgaggucacccgcgccaccgagggcaagugggagguccucaucggcuccucccacauccucacccccacccgcuuccucgacgaccucaaggcccucgacaagaagcucgaggacaucgcccuccccuga

SEQ ID NO: 50324 - RNA, 1662 nt, Artificial Sequence
  derived and/or modified sequence opt2 from STXBP4__Homo_sapiens__NP_848604
augaacaagaacaccuccaccgucgucucccccucccuccucgagaaggaccccgccuuccagaugaucaccaucgccaaggagaccggccucggccucaagguccucggcggcaucaaccgcaacgagggcccccucgucuacauccaggagaucauccccggcggcgacugcuacaaggacggccgccucaagcccggcgaccagcucgucuccgucaacaaggaguccaugaucggcgucuccuucgaggaggccaaguccaucaucaccggcgccaagcuccgccucgaguccgccugggagaucgccuucauccgccagaaguccgacaacauccagcccgagaaccucuccugcaccucccucaucgaggccuccggcgaguacggcccccaggccuccacccucucccucuucuccuccccccccgagauccucauccccaagaccuccuccacccccaagaccaacaacgacauccucuccuccugcgagaucaagaccggcuacaacaagaccguccagauccccaucaccuccgagaacuccaccgucggccucuccaacaccgacgucgccuccgccuggaccgagaacuacggccuccaggagaagaucucccucaaccccuccguccgcuucaaggccgagaagcucgagauggcccucaacuaccucggcauccagcccaccaaggagcagcaccaggcccuccgccagcagguccaggccgacuccaagggcaccgucuccuucggcgacuucguccaggucgcccgcaaccucuucugccuccagcucgacgaggucaacgucggcgcccacgagaucuccaacauccucgacucccagcuccuccccugcgacuccuccgaggccgacgagauggagcgccucaagugcgagcgcgacgacgcccucaaggaggucaacacccucaaggagaagcuccucgaguccgacaagcagcgcaagcagcucaccgaggagcuccagaacgucaagcaggaggccaaggccgucgucgaggagacccgcgcccuccgcucccgcauccaccucgccgaggccgcccagcgccaggcccacggcauggagauggacuacgaggaggucauccgccuccucgaggccaagaucaccgagcucaaggcccagcucgccgacuacuccgaccagaacaaggaguccguccaggaccucaagaagcgcaucaugguccucgacugccagcuccgcaaguccgagauggcccgcaagaccuucgaggccuccaccgagaagcuccuccacuucgucgaggccauccaggaggucuucuccgacaacuccaccccccucuccaaccucuccgagcgccgcgccguccucgccucccagaccucccucaccccccucggccgcaacggccgcuccauccccgccacccucgcccucgaguccaaggagcucgucaaguccguccgcgcccuccucgacauggacugccuccccuacggcugggaggaggccuacaccgccgacggcaucaaguacuucaucaaccacgucacccagaccaccuccuggauccaccccgucauguccguccucaaccucucccgcuccgaggagaacgaggaggacugcucccgcgagcuccccaaccagaaguccuga

SEQ ID NO: 50325 - RNA, 3456 nt, Artificial Sequence
  derived and/or modified sequence opt2 from STXBP5__Homo_sapiens__NP_001121187
augcgcaaguucaacauccgcaagguccucgacggccucaccgccggcuccuccuccgccucccagcagcagcagcagcagcacccccccggcaaccgcgagcccgagauccaggagacccuccaguccgagcacuuccagcucugcaagaccguccgccacggcuuccccuaccagcccuccgcccucgccuucgaccccguccagaagauccucgccgucggcacccagaccggcgcccuccgccucuucggccgccccggcgucgagugcuacugccagcacgacuccggcgccgccgucauccagcuccaguuccucaucaacgagggcgcccucgucuccgcccucgccgacgacacccuccaccucuggaaccuccgccagaagcgccccgccauccuccacucccucaaguucugccgcgagcgcgucaccuucugccaccuccccuuccaguccaaguggcucuacgucggcaccgagcgcggcaacauccacaucgucaacgucgaguccuucacccucuccggcuacgucaucauguggaacaaggccaucgagcucuccuccaagucccaccccggccccgucguccacaucuccgacaaccccauggacgagggcaagcuccucaucggcuucgaguccggcaccgucguccucugggaccucaaguccaagaaggccgacuaccgcuacaccuacgacgaggccauccacuccgucgccuggcaccacgagggcaagcaguucaucugcucccacuccgacggcacccucaccaucuggaacguccgcucccccgccaagcccguccagaccaucaccccccacggcaagcagcucaaggacggcaagaagcccgagcccugcaagcccauccucaaggucgaguucaagaccacccgcuccggcgagcccuucaucauccucuccggcggccucuccuacgacaccgucggccgccgccccugccucaccgucaugcacggcaaguccaccgccguccucgagauggacuacuccaucgucgacuuccucacccucugcgagacccccuaccccaacgacuuccaggagcccuacgccgucgucguccuccucgagaaggaccucguccucaucgaccucgcccagaacggcuaccccaucuucgagaaccccuacccccucuccauccacgagucccccgucaccugcugcgaguacuucgccgacugccccgucgaccucauccccgcccucuacuccgucggcgcccgccagaagcgccagggcuacuccaagaaggaguggcccaucaacggcggcaacuggggccucggcgcccaguccuaccccgagaucaucaucaccggccacgccgacggcuccgucaaguucugggacgccuccgccaucacccuccagguccucuacaagcucaagaccuccaaggucuucgagaagucccgcaacaaggacgaccgccccaacaccgacaucgucgacgaggaccccuacgccauccagaucaucuccuggugccccgagucccgcaugcucugcaucgccggcgucuccgcccacgucaucaucuaccgcuucuccaagcaggaggucaucaccgaggucauccccaugcucgagguccgccuccucuacgagaucaacgacgucgagacccccgagggcgagcagccccccccccuccccacccccgucggcggcuccaacccccagcccauccccccccagucccaccccuccaccuccuccuccuccuccgacggccuccgcgacaacguccccugccucaaggucaagaacuccccccucaagcagucccccggcuaccagaccgagcucgucauccagcucgucugggucggcggcgagcccccccagcagaucaccucccucgccgucaacuccuccuacggccucgucgucuucggcaacugcaacggcaucgccauggucgacuaccuccagaaggccguccuccucaaccucggcaccaucgagcucuacggcuccaacgaccccuaccgccgcgagccccgcuccccccgcaagucccgccagcccuccggcgccggccucugcgacaucuccgagggcaccgucguccccgaggaccgcugcaagucccccaccuccggcuccuccuccccccacaacuccgacgacgagcagaagaugaacaacuucaucgagaaggucaagaccaagucccgcaaguucuccaagauggucgccaacgacaucgccaagaugucccgcaagcucucccuccccaccgaccucaagcccgaccucgacgucaaggacaacuccuucucccgcucccgcuccuccuccgucaccuccaucgacaaggagucccgcgaggccaucuccgcccuccacuucugcgagaccuucacccgcaagaccgacuccucccccucccccugccucugggucggcaccacccucggcaccguccucgucaucgcccucaaccucccccccggcggcgagcagcgccuccuccagcccgucaucgucucccccuccggcaccauccuccgccucaagggcgccauccuccgcauggccuuccucgacaccaccggcugccucaucccccccgccuacgagcccuggcgcgagcacaacguccccgaggagaaggacgagaaggagaagcucaagaagcgccgccccgucuccgucucccccuccuccucccaggagaucuccgagaaccaguacgccgucaucugcuccgagaagcaggccaaggucaucucccuccccacccagaacugcgccuacaagcagaacaucaccgagaccuccuucguccuccgcggcgacaucgucgcccucuccaacuccaucugccucgccugcuucugcgccaacggccacaucaugaccuucucccuccccucccuccgcccccuccucgacgucuacuaccucccccucaccaacaugcgcaucgcccgcaccuucugcuucaccaacaacggccaggcccucuaccucgucucccccaccgagauccagcgccucaccuacucccaggagaccugcgagaaccuccaggagaugcucggcgagcucuucacccccgucgagacccccgaggcccccaaccgcggcuucuucaagggccucuucggcggcggcgcccagucccucgaccgcgaggagcucuucggcgaguccuccuccggcaaggccucccgcucccucgcccagcacauccccggccccggcggcaucgagggcgucaagggcgccgccuccggcgucgucggcgagcucgcccgcgcccgccucgcccucgacgagcgcggccagaagcucggcgaccucgaggagcgcaccgccgccaugcucuccuccgccgaguccuucuccaagcacgcccacgagaucaugcucaaguacaaggacaagaagugguaccaguucuga

SEQ ID NO: 50326 - RNA, 3561 nt, Artificial Sequence
  derived and/or modified sequence opt2 from STXBP5L__Homo_sapiens__NP_055795
augaagaaguucaacuuccgcaagguccucgacggccucaccgccuccucccccggcuccggcuccuccuccggcuccaacuccggcggcggcgccggcuccggcuccguccaccccgccggcaccgccggcguccuccgcgaggagauccaggagacccucaccuccgaguacuuccagaucugcaagaccguccgccacggcuucccccaccagcccaccgcccucgccuucgaccccguccagaagauccucgccaucggcacccgcaccggcgccauccgcauccucggccgccccggcgucgacugcuacugccagcacgaguccggcgccgccguccuccagcuccaguuccucaucaacgagggcgcccucgucuccgccuccuccgacgacacccuccaccucuggaaccuccgccagaagcgccccgccauccuccacucccucaaguucaaccgcgagcgcaucaccuacugccaccuccccuuccaguccaaguggcucuacgucggcaccgagcgcggcaacacccacaucgucaacaucgaguccuucauccucuccggcuacgucaucauguggaacaaggccaucgagcucuccaccaagacccaccccggccccgucguccaccucuccgacuccccccgcgacgagggcaagcuccucaucggcuacgagaacggcaccgucgucuucugggaccucaaguccaagcgcgccgagcuccgcgucuacuacgacgaggccauccacuccaucgacuggcaccacgagggcaagcaguucaugugcucccacuccgacggcucccucacccucuggaaccucaagucccccucccgccccuuccagaccaccaucccccacggcaagucccagcgcgagggccgcaaguccgaguccugcaagcccauccucaaggucgaguacaagaccugcaagaacuccgagcccuucaucaucuucuccggcggccucuccuacgacaaggccugccgccgccccucccucaccaucaugcacggcaaggccaucaccguccucgagauggaccaccccaucgucgaguuccucacccucugcgagacccccuaccccaacgaguuccaggagcccuacgccgucgucguccuccucgagaaggaccucaucgucgucgaccucacccaguccaacuuccccaucuucgagaaccccuaccccauggacauccacgagucccccgucaccugcaccgccuacuucgccgacugcccccccgaccucauccucguccucuacuccaucggcgucaagcacaagaagcagggcuacuccaacaaggaguggcccaucuccggcggcgccuggaaccucggcgcccagaccuaccccgagaucaucaucaccggccacgccgacggcuccaucaaguucugggacgccuccgccaucacccuccagaugcucuacaagcucaagaccuccaaggucuucgagaagcagaaggucggcgagggcaagcagaccugcgagaucgucgaggaggaccccuucgccauccagaugaucuacuggugccccgagucccgcaucuucugcgucuccggcgucuccgccuacgucaucaucuacaaguucucccgccacgagaucaccaccgagaucgucucccucgagguccgccuccaguacgacgucgaggacaucaucacccccgagcccgagaccuccccccccuuccccgaccucuccgcccagcuccccuccucccgcucccucuccggcuccaccaacaccgucgccuccgagggcgucaccaaggacuccauccccugccucaacgucaagacccgccccguccgcaugccccccggcuaccaggccgagcucgucauccagcucgucugggucgacggcgagcccccccagcagaucaccucccucgccgucuccuccgccuacggcaucgucgccuucggcaacugcaacggccucgccgucgucgacuucauccagaagaccguccuccucuccaugggcaccaucgaccucuaccgcuccuccgaccucuaccagcgccagccccgcuccccccgcaagaacaagcaguucaucgccgacaacuucugcaugcgcggccucuccaacuucuaccccgaccucaccaagcgcauccgcaccuccuaccagucccucaccgagcucaacgacucccccgucccccucgagcucgagcgcugcaagucccccaccuccgaccacgucaacggccacugcaccucccccaccucccaguccugcuccuccggcaagcgccucuccuccgccgacgucuccaaggucaaccgcuggggccccggccgcccccccuuccgcaaggcccaguccgccgccugcauggagaucucccuccccgucaccaccgaggagaaccgcgagaacuccuacaaccgcucccgcuccuccuccaucuccuccaucgacaaggacuccaaggaggccaucaccgcccucuacuucauggacuccuucgcccgcaagaacgacuccaccaucucccccugccucuucgucggcaccucccucggcaugguccucaucaucucccucaaccucccccucgccgacgagcagcgcuucaccgagcccgucaugguccuccccuccggcaccuuccucucccucaagggcgccguccucaccuucuccugcauggaccgcaugggcggccucaugcagccccccuacgaggucuggcgcgaccccaacaacaucgacgagaacgagaaguccuggcgccgcaaggucgucaugaacuccuccuccgccucccaggagaucggcgaccaccaguacaccaucaucugcuccgagaagcaggccaaggucuucucccuccccucccagaccugccucuacguccacaacaucaccgagaccuccuucauccuccaggccaacgucgucgucaugugcuccuccgccugccucgccugcuucugcgccaacggccacaucaugaucaugucccuccccucccuccgccccaugcucgacgucaacuaccucccccucaccgacaugcgcaucgcccgcaccuucugcuucaccaacgagggccaggcccucuaccucgucucccccaccgagauccagcgccucaccuacucccaggagaugugcgacaaccuccaggacaugcucggcgaccucuucacccccaucgagacccccgaggcccagaaccgcggcuuccucaagggccucuucggcggcuccggccagaccuucgaccgcgaggagcucuucggcgaggccuccgccggcaaggccucccgcucccucgcccagcacauccccggccccggcuccaucgagggcaugaagggcgccgccggcggcgucaugggcgagcucacccgcgcccgcaucgcccucgacgagcgcggccagcgccucggcgagcucgaggagaagaccgccggcaugaugaccuccgccgaggccuucuccaagcacgcccacgagcucaugcucaaguacaaggacaagaagugguaccaguucuga

SEQ ID NO: 50327 - RNA, 633 nt, Artificial Sequence
  derived and/or modified sequence opt2 from STXBP6__Homo_sapiens__NP_001291406
auguccgccaaguccgccaucuccaaggagaucuucgccccccucgacgagcgcaugcucggcgccguccaggucaagcgccgcaccaagaagaagauccccuuccucgccaccggcggccagggcgaguaccucaccuacaucugccucuccgucaccaacaagaagcccacccaggccuccaucaccaaggucaagcaguucgagggcuccaccuccuucguccgccgcucccaguggaugcucgagcagcuccgccaggucaacggcaucgaccccaacggcgacuccgccgaguucgaccuccucuucgagaacgccuucgaccagugggucgccuccaccgccuccgagaagugcaccuucuuccagauccuccaccacaccugccagcgcuaccucaccgaccgcaagcccgaguucaucaacugccaguccaagaucaugggcggcaacuccauccuccacuccgccgccgacuccgucaccuccgccguccagaaggccucccaggcccucaacgagcgcggcgagcgccucggccgcgccgaggagaagaccgaggaccucaagaacuccgcccagcaguucgccgagaccgcccacaagcucgccaugaagcacaagugcuga

SEQ ID NO: 50328 - RNA, 1269 nt, Artificial Sequence
  derived and/or modified sequence opt2 from STYK1__Homo_sapiens__XP_005253474
augggcaugacccgcaugcuccucgagugcucccucuccgacaagcucugcgucauccaggagaagcaguacgaggucaucaucguccccacccuccucgucaccaucuuccucauccuccucggcgucauccucuggcucuucauccgcgagcagcgcacccagcagcagcgcuccggcccccagggcaucgcccccgucccccccccccgcgaccucuccugggaggccggccacggcggcaacgucgcccucccccucaaggagaccuccgucgagaacuuccucggcgccaccacccccgcccucgccaagcuccaggucccccgcgagcagcucuccgagguccucgagcagaucugcuccggcuccugcggccccaucuuccgcgccaacaugaacaccggcgaccccuccaagcccaaguccgucauccucaaggcccucaaggagcccgccggccuccacgagguccaggacuuccucggccgcauccaguuccaccaguaccucggcaagcacaagaaccucguccagcucgagggcugcugcaccgagaagcucccccucuacaugguccucgaggacgucgcccagggcgaccuccucuccuuccucuggaccugccgccgcgacgucaugaccauggacggccuccucuacgaccucaccgagaagcaggucuaccacaucggcaagcagguccuccucgcccucgaguuccuccaggagaagcaccucuuccacggcgacgucgccgcccgcaacauccucaugcaguccgaccucaccgccaagcucugcggccucggccucgccuacgaggucuacacccgcggcgccaucuccuccacccagaccaucccccucaaguggcucgcccccgagcgccuccuccuccgccccgccuccauccgcgccgacgucugguccuucggcauccuccucuacgagauggucacccucggcgccccccccuaccccgaggucccccccaccuccauccucgagcaccuccagcgccgcaagaucaugaagcgccccuccuccugcacccacaccauguacuccaucaugaaguccugcuggcgcuggcgcgaggccgaccgccccuccccccgcgagcuccgccuccgccucgaggccgccaucaagaccgccgacgacgaggccguccuccagguccccgagcucgucguccccgagcucuacgccgccgucgccggcauccgcgucgagucccucuucuacaacuacuccaugcucuga

SEQ ID NO: 50329 - RNA, 672 nt, Artificial Sequence
  derived and/or modified sequence opt2 from STYX__Homo_sapiens__NP_001124173
auggaggacgucaagcucgaguuccccucccucccccagugcaaggaggacgccgaggaguggaccuaccccaugcgccgcgagaugcaggagauccuccccggccucuuccucggccccuacuccuccgccaugaaguccaagcuccccguccuccagaagcacggcaucacccacaucaucugcauccgccagaacaucgaggccaacuucaucaagcccaacuuccagcagcucuuccgcuaccucguccucgacaucgccgacaaccccgucgagaacaucauccgcuucuuccccaugaccaaggaguucaucgacggcucccuccagaugggcggcaagguccucguccacggcaacgccggcaucucccgcuccgccgccuucgucaucgccuacaucauggagaccuucggcaugaaguaccgcgacgccuucgccuacguccaggagcgccgcuucugcaucaaccccaacgccggcuucguccaccagcuccaggaguacgaggccaucuaccucgccaagcucaccauccagaugauguccccccuccagaucgagcgcucccucuccguccacuccggcaccaccggcucccucaagcgcacccacgaggaggaggacgacuucggcaccaugcaggucgccaccgcccagaacggcuga

SEQ ID NO: 50330 - RNA, 384 nt, Artificial Sequence
  derived and/or modified sequence opt2 from SUB1__Homo_sapiens__NP_006704
augcccaaguccaaggagcucgucuccuccuccuccuccggcuccgacuccgacuccgaggucgacaagaagcucaagcgcaagaagcaggucgcccccgagaagcccgucaagaagcagaagaccggcgagaccucccgcgcccucuccuccuccaagcaguccuccuccucccgcgacgacaacauguuccagaucggcaagaugcgcuacgucuccguccgcgacuucaagggcaagguccucaucgacauccgcgaguacuggauggaccccgagggcgagaugaagcccggccgcaagggcaucucccucaaccccgagcaguggucccagcucaaggagcagaucuccgacaucgacgacgccguccgcaagcucuga

SEQ ID NO: 50331 - RNA, 1392 nt, Artificial Sequence
  derived and/or modified sequence opt2 from SUCLA2__Homo_sapiens__NP_003841
auggccgccuccauguucuacggccgccucgucgccgucgccacccuccgcaaccaccgcccccgcaccgcccagcgcgccgccgcccagguccucggcuccuccggccucuucaacaaccacggccuccagguccagcagcagcagcagcgcaaccucucccuccacgaguacauguccauggagcuccuccaggaggccggcgucuccguccccaagggcuacgucgccaagucccccgacgaggccuacgccaucgccaagaagcucggcuccaaggacgucgucaucaaggcccagguccucgccggcggccgcggcaagggcaccuucgaguccggccucaagggcggcgucaagaucgucuucucccccgaggaggccaaggccgucuccucccagaugaucggcaagaagcucuucaccaagcagaccggcgagaagggccgcaucugcaaccagguccucgucugcgagcgcaaguacccccgccgcgaguacuacuucgccaucaccauggagcgcuccuuccagggccccguccucaucggcuccucccacggcggcgucaacaucgaggacgucgccgccgagucccccgaggccaucaucaaggagcccaucgacaucgaggagggcaucaagaaggagcaggcccuccagcucgcccagaagaugggcuucccccccaacaucgucgaguccgccgccgagaacauggucaagcucuacucccucuuccucaaguacgacgccaccaugaucgagaucaaccccauggucgaggacuccgacggcgccguccucugcauggacgccaagaucaacuucgacuccaacuccgccuaccgccagaagaagaucuucgaccuccaggacuggacccaggaggacgagcgcgacaaggacgccgccaaggccaaccucaacuacaucggccucgacggcaacaucggcugccucgucaacggcgccggccucgccauggccaccauggacaucaucaagcuccacggcggcacccccgccaacuuccucgacgucggcggcggcgccaccguccaccaggucaccgaggccuucaagcucaucaccuccgacaagaagguccucgccauccucgucaacaucuucggcggcaucaugcgcugcgacgucaucgcccagggcaucgucauggccgucaaggaccucgagaucaagauccccgucgucguccgccuccagggcacccgcgucgacgacgccaaggcccucaucgccgacuccggccucaagauccucgccugcgacgaccucgacgaggccgcccgcauggucgucaagcucuccgagaucgucacccucgccaagcaggcccacgucgacgucaaguuccagcuccccaucuga

SEQ ID NO: 50332 - RNA, 1041 nt, Artificial Sequence
  derived and/or modified sequence opt2 from SUCLG1__Homo_sapiens__NP_003840
augaccgccacccucgccgccgccgccgacaucgccaccauggucuccggcuccuccggccucgccgccgcccgccuccucucccgcuccuuccuccucccccagaacggcauccgccacugcuccuacaccgccucccgccagcaccucuacgucgacaagaacaccaagaucaucugccagggcuucaccggcaagcagggcaccuuccacucccagcaggcccucgaguacggcaccaagcucgucggcggcaccacccccggcaagggcggccagacccaccucggccuccccgucuucaacaccgucaaggaggccaaggagcagaccggcgccaccgccuccgucaucuacguccccccccccuucgccgccgccgccaucaacgaggccaucgaggccgagaucccccucgucgucugcaucaccgagggcaucccccagcaggacaugguccgcgucaagcacaagcuccuccgccaggagaagacccgccucaucggccccaacugccccggcgucaucaaccccggcgagugcaagaucggcaucaugcccggccacauccacaagaagggccgcaucggcaucgucucccgcuccggcacccucaccuacgaggccguccaccagaccacccaggucggccucggccagucccucugcgucggcaucggcggcgaccccuucaacggcaccgacuucaucgacugccucgagaucuuccucaacgacuccgccaccgagggcaucauccucaucggcgagaucggcggcaacgccgaggagaacgccgccgaguuccucaagcagcacaacuccggccccaacuccaagcccgucgucuccuucaucgccggccucaccgccccccccggccgccgcaugggccacgccggcgccaucaucgccggcggcaagggcggcgccaaggagaagaucuccgcccuccaguccgccggcgucgucgucuccaugucccccgcccagcucggcaccaccaucuacaaggaguucgagaagcgcaagaugcucuga

SEQ ID NO: 50333 - RNA, 1323 nt, Artificial Sequence
  derived and/or modified sequence opt2 from SUCLG2__Homo_sapiens__NP_001171070
auggccucccccgucgccgcccaggccggcaagcuccuccgcgcccucgcccuccgcccccgcuuccucgccgccggcucccaggccguccagcucaccucccgccgcuggcucaaccuccaggaguaccaguccaagaagcucauguccgacaacggcguccgcguccagcgcuucuucgucgccgacaccgccaacgaggcccucgaggccgccaagcgccucaacgccaaggagaucguccucaaggcccagauccucgccggcggccgcggcaagggcgucuucaacuccggccucaagggcggcguccaccucaccaaggaccccaacgucgucggccagcucgccaagcagaugaucggcuacaaccucgccaccaagcagacccccaaggagggcgucaaggucaacaaggucauggucgccgaggcccucgacaucucccgcgagaccuaccucgccauccucauggaccgcuccugcaacggccccguccucgucggcuccccccagggcggcgucgacaucgaggaggucgccgccuccaaccccgagcucaucuucaaggagcagaucgacaucuucgagggcaucaaggacucccaggcccagcgcauggccgagaaccucggcuucgucggcccccucaagucccaggccgccgaccagaucaccaagcucuacaaccucuuccucaagaucgacgccacccaggucgaggucaaccccuucggcgagacccccgagggccaggucgucugcuucgacgccaagaucaacuucgacgacaacgccgaguuccgccagaaggacaucuucgccauggacgacaaguccgagaacgagcccaucgagaacgaggccgccaaguacgaccucaaguacaucggccucgacggcaacaucgccugcuucgucaacggcgccggccucgccauggccaccugcgacaucaucuuccucaacggcggcaagcccgccaacuuccucgaccucggcggcggcgucaaggaggcccaggucuaccaggccuucaagcuccucaccgccgaccccaaggucgaggccauccucgucaacaucuucggcggcaucgucaacugcgccaucaucgccaacggcaucaccaaggccugccgcgagcucgagcucaaggucccccucgucguccgccucgagggcaccuucauggagaagaagggcuccuacaugcacaucaagcaggagaccggcaacuccaacgagaacaucaccggcauccaggagaacgucgcccaccagaaccucuccaagugcgccaucuccaucuuccucugcuga

SEQ ID NO: 50334 - RNA, 1005 nt, Artificial Sequence
  derived and/or modified sequence opt2 from SUCNR1__Homo_sapiens__NP_149039
augcucggcaucauggccuggaacgccaccugcaagaacuggcucgccgccgaggccgcccucgagaaguacuaccucuccaucuucuacggcaucgaguucgucgucggcguccucggcaacaccaucgucgucuacggcuacaucuucucccucaagaacuggaacuccuccaacaucuaccucuucaaccucuccgucuccgaccucgccuuccucugcacccuccccaugcucauccgcuccuacgccaacggcaacuggaucuacggcgacguccucugcaucuccaaccgcuacguccuccacgccaaccucuacaccuccauccucuuccucaccuucaucuccaucgaccgcuaccucaucaucaaguaccccuuccgcgagcaccuccuccagaagaaggaguucgccauccucaucucccucgccaucuggguccucgucacccucgagcuccuccccauccucccccucaucaaccccgucaucaccgacaacggcaccaccugcaacgacuucgccuccuccggcgaccccaacuacaaccucaucuacuccaugugccucacccuccucggcuuccucaucccccucuucgucaugugcuucuucuacuacaagaucgcccucuuccucaagcagcgcaaccgccaggucgccaccgcccucccccucgagaagccccucaaccucgucaucauggccgucgucaucuucuccguccucuucacccccuaccacgucaugcgcaacguccgcaucgccucccgccucggcuccuggaagcaguaccagugcacccaggucgucaucaacuccuucuacaucgucacccgcccccucgccuuccucaacuccgucaucaaccccgucuucuacuuccuccucggcgaccacuuccgcgacaugcucaugaaccagcuccgccacaacuucaagucccucaccuccuucucccgcugggcccacgagcuccuccucuccuuccgcgagaaguga

SEQ ID NO: 50335 - RNA, 3765 nt, Artificial Sequence
  derived and/or modified sequence opt2 from SUCO__Homo_sapiens__NP_055098
augaagaagcaccgccgcgcccucgcccucgucuccugccucuuccucugcucccucgucuggcuccccuccuggcgcgucugcugcaaggaguccuccuccgccuccgccuccuccuacuacucccaggacgacaacugcgcccucgagaacgaggacguccaguuccagaagaaggacgagcgcgagggccccaucaacgccgagucccucggcaaguccggcuccaaccuccccaucucccccaaggagcacaagcucaaggacgacuccaucgucgacguccagaacaccgaguccaagaagcucuccccccccgucgucgagacccuccccaccgucgaccuccacgaggaguccuccaacgccgucgucgacuccgagaccgucgagaacaucuccuccuccuccaccuccgagaucacccccaucuccaagcucgacgagaucgagaaguccggcaccauccccaucgccaagcccuccgagaccgagcaguccgagaccgacugcgacgucggcgaggcccucgacgccuccgcccccaucgagcagcccuccuucgucuccccccccgacucccucgucggccagcacaucgagaacgucuccuccucccacggcaagggcaagaucaccaaguccgaguucgaguccaaggucuccgccuccgagcagggcggcggcgaccccaaguccgcccucaacgccuccgacaaccucaagaacgaguccuccgacuacaccaagcccggcgacaucgaccccaccuccgucgccucccccaaggaccccgaggacauccccaccuucgacgaguggaagaagaaggucauggaggucgagaaggagaagucccaguccaugcacgccuccuccaacggcggcucccacgccaccaagaagguccagaagaaccgcaacaacuacgccuccgucgagugcggcgccaagauccucgccgccaaccccgaggccaaguccaccuccgccauccucaucgagaacauggaccucuacaugcucaaccccugcuccaccaagaucugguucgucaucgagcucugcgagcccauccaggucaagcagcucgacaucgccaacuacgagcucuucuccuccacccccaaggacuuccucgucuccaucuccgaccgcuaccccaccaacaaguggaucaagcucggcaccuuccacggccgcgacgagcgcaacguccaguccuucccccucgacgagcagauguacgccaaguacgucaagauguucaucaaguacaucaaggucgagcuccucucccacuucggcuccgagcacuucugcccccucucccucauccgcgucuucggcaccuccauggucgaggaguacgaggagaucgccgacucccaguaccacuccgagcgccaggagcucuucgacgaggacuacgacuacccccucgacuacaacaccggcgaggacaaguccuccaagaaccuccucggcuccgccaccaacgccauccucaacauggucaacaucgccgccaacauccucggcgccaagaccgaggaccucaccgagggcaacaaguccaucuccgagaacgccaccgccaccgccgcccccaagaugcccgaguccacccccgucuccacccccguccccucccccgaguacgucaccaccgagguccacacccacgacauggagcccuccacccccgacacccccaaggagucccccaucguccagcucguccaggaggaggaggaggaggccucccccuccaccgucacccuccucggcuccggcgagcaggaggacgaguccucccccugguucgaguccgagacccagaucuucugcuccgagcucaccaccaucugcugcaucuccuccuucuccgaguacaucuacaaguggugcuccguccgcgucgcccucuaccgccagcgcucccgcaccgcccucuccaagggcaaggacuaccucguccucgcccagcccccccuccuccuccccgccgaguccgucgacgucuccguccuccagccccucuccggcgagcucgagaacaccaacaucgagcgcgaggccgagaccgucguccucggcgaccucuccuccuccaugcaccaggacgaccucgucaaccacaccgucgacgccgucgagcucgagcccucccacucccagacccucucccagucccuccuccucgacaucacccccgagaucaacccccuccccaagaucgaggucuccgaguccgucgaguacgaggccggccacauccccucccccgucaucccccaggaguccuccgucgagaucgacaacgagaccgagcagaaguccgaguccuucuccuccaucgagaagcccuccaucaccuacgagaccaacaaggucaacgagcucauggacaacaucaucaaggaggacgucaacuccaugcagaucuucaccaagcucuccgagaccaucgucccccccaucaacaccgccaccguccccgacaacgaggacggcgaggccaagaugaacaucgccgacaccgccaagcagacccucaucuccgucgucgacuccuccucccuccccgaggucaaggaggaggagcagucccccgaggacgcccuccuccgcggccuccagcgcaccgccaccgacuucuacgccgagcuccagaacuccaccgaccucggcuacgccaacggcaaccucguccacggcuccaaccagaaggaguccgucuucaugcgccucaacaaccgcaucaaggcccucgaggucaacaugucccucuccggccgcuaccucgaggagcucucccagcgcuaccgcaagcagauggaggagaugcagaaggccuucaacaagaccaucgucaagcuccagaacaccucccgcaucgccgaggagcaggaccagcgccagaccgaggccauccagcuccuccaggcccagcucaccaacaugacccagcucgucuccaaccucuccgccaccgucgccgagcucaagcgcgaggucuccgaccgccaguccuaccucgucaucucccucguccucugcgucguccucggccucaugcucugcaugcagcgcugccgcaacaccucccaguucgacggcgacuacaucuccaagcuccccaaguccaaccaguaccccucccccaagcgcugcuucuccuccuacgacgacaugaaccucaagcgccgcaccuccuucccccucaugcgcuccaagucccuccagcucaccggcaaggaggucgaccccaacgaccucuacaucgucgagccccucaaguucucccccgagaagaagaagaagcgcugcaaguacaagaucgagaagaucgagaccaucaagcccgaggagccccuccaccccaucgccaacggcgacaucaagggccgcaagcccuucaccaaccagcgcgacuucuccaacaugggcgaggucuaccacuccuccuacaagggcccccccuccgagggcuccuccgagaccuccucccaguccgaggaguccuacuucugcggcaucuccgccugcaccucccucugcaacggccagucccagaagaccaagaccgagaagcgcgcccucaagcgccgccgcuccaagguccaggaccagggcaagcucaucaagacccucauccagaccaaguccggcucccuccccucccuccacgacaucaucaagggcaacaaggagaucaccgucggcaccuucggcgucaccgccgucuccggccacaucuga

SEQ ID NO: 50336 - RNA, 987 nt, Artificial Sequence
  derived and/or modified sequence opt2 from SUDS3__Homo_sapiens__NP_071936
auguccgccgccggccuccucgcccccgcccccgcccaggccggcgccccccccgcccccgaguacuaccccgaggaggacgaggagcucgaguccgccgaggacgacgagcgcuccugccgcggccgcgaguccgacgaggacaccgaggacgccuccgagaccgaccucgccaagcacgacgaggaggacuacgucgagaugaaggagcagauguaccaggacaagcucgccucccucaagcgccagcuccagcagcuccaggagggcacccuccaggaguaccagaagcgcaugaagaagcucgaccagcaguacaaggagcgcauccgcaacgccgagcucuuccuccagcucgagaccgagcaggucgagcgcaacuacaucaaggagaagaaggccgccgucaaggaguucgaggacaagaaggucgagcucaaggagaaccucaucgccgagcucgaggagaagaagaagaugaucgagaacgagaagcucaccauggagcucaccggcgacuccauggaggucaagcccaucaugacccgcaagcuccgccgccgccccaacgaccccguccccauccccgacaagcgccgcaagcccgcccccgcccagcucaacuaccuccucaccgacgagcagaucauggaggaccuccgcacccucaacaagcucaagucccccaagcgccccgccucccccuccucccccgagcaccuccccgccacccccgccgagucccccgcccagcgcuucgaggcccgcaucgaggacggcaagcucuacuacgacaagcgcugguaccacaagucccaggccaucuaccucgaguccaaggacaaccagaagcucuccugcgucaucuccuccgucggcgccaacgagaucuggguccgcaagaccuccgacuccaccaagaugcgcaucuaccucggccagcuccagcgcggccucuucgucauccgccgccgcuccgccgccuga

SEQ ID NO: 50337 - RNA, 1302 nt, Artificial Sequence
  derived and/or modified sequence opt2 from SUFU__Homo_sapiens__NP_001171604
auggccgagcuccgccccuccggcgcccccggccccaccgccccccccgcccccggccccaccgccccccccgccuucgccucccucuucccccccggccuccacgccaucuacggcgagugccgccgccucuaccccgaccagcccaacccccuccaggucaccgccaucgucaaguacuggcucggcggccccgacccccucgacuacgucuccauguaccgcaacgucggcucccccuccgccaacauccccgagcacuggcacuacaucuccuucggccucuccgaccucuacggcgacaaccgcguccacgaguucaccggcaccgacggccccuccggcuucggcuucgagcucaccuuccgccucaagcgcgagaccggcgaguccgccccccccaccuggcccgccgagcucaugcagggccucgcccgcuacgucuuccaguccgagaacaccuucugcuccggcgaccacgucuccuggcacuccccccucgacaacuccgagucccgcauccagcacaugcuccucaccgaggacccccagaugcagcccguccagacccccuucggcgucgucaccuuccuccagaucgucggcgucugcaccgaggagcuccacuccgcccagcaguggaacggccagggcauccucgagcuccuccgcaccguccccaucgccggcggccccuggcucaucaccgacaugcgccgcggcgagaccaucuucgagaucgacccccaccuccaggagcgcgucgacaagggcaucgagaccgacggcuccaaccucuccggcgucuccgccaagugcgccugggacgaccucucccgcccccccgaggacgacgaggacucccgcuccaucugcaucggcacccagccccgccgccucuccggcaaggacaccgagcagauccgcgagacccuccgccgcggccucgagaucaacuccaagcccguccucccccccaucaacccccagcgccagaacggccucgcccacgaccgcgcccccucccgcaaggacucccucgaguccgacuccuccaccgccaucaucccccacgagcucauccgcacccgccagcucgaguccguccaccucaaguucaaccaggaguccggcgcccucaucccccucugccuccgcggccgccuccuccacggccgccacuucaccuacaaguccaucaccggcgacauggccaucaccuucgucuccaccggcgucgagggcgccuucgccaccgaggagcaccccuacgccgcccacggccccuggcuccagcucuga

SEQ ID NO: 50338 - RNA, 1416 nt, Artificial Sequence
  derived and/or modified sequence opt2 from SUGCT__Homo_sapiens__NP_001180240
augcccuccgagacccacgccaugcucgccacccucgcccgcgucgccgcccuccgccgcaccugccucuucuccggccgcggcggcggccgcggccucuggaccggccgcccccaguccgacaugaacaacaucaagccccucgagggcgucaagauccucgaccucacccgcguccucgccggccccuucgccaccaugaaccucggcgaccucggcgccgaggucaucaaggucgagcgccccggcgccggcgacgacacccgcaccuggggcccccccuucgucggcaccgaguccaccuacuaccucuccgucaaccgcaacaagaaguccaucgccgucaacaucaaggaccccaagggcgucaagaucaucaaggagcucgccgccgucugcgacgucuucgucgagaacuacguccccggcaagcucuccgccaugggccucggcuacgaggacaucgacgagaucgccccccacaucaucuacugcuccaucaccggcuacggccagaccggccccaucucccagcgcgccggcuacgacgccgucgccuccgccgucuccggccucaugcacaucaccggccccgagaacggcgaccccguccgccccggcgucgccaugaccgaccucgccaccggccucuacgccuacggcgccaucauggccggccucauccagaaguacaagaccggcaagggccucuucaucgacugcaaccuccucuccucccaggucgccugccucucccacaucgccgccaacuaccucaucggccagaaggaggccaagcgcuggggcaccgcccacggcuccaucguccccuaccaggccuucaagaccaaggacggcuacaucgucgucggcgccggcaacaaccagcaguucgccaccgucugcaagauccucgaccuccccgagcucaucgacaacuccaaguacaagaccaaccaccuccgcguccacaaccgcaaggagcucaucaagauccucuccgagcgcuucgaggaggagcucaccuccaaguggcucuaccucuucgagggcuccggcguccccuacggccccaucaacaacaugaagaacgucuucgccgagccccagaacgccgucuccggcuuccagucccuccuccacucccucgcccacggccccuuccuccaccuccagggcuccgcccgcguccuccacaacggccucgucauggagauggagcaccccaccgucggcaagaucuccguccccggccccgccguccgcuacuccaaguucaagauguccgaggcccgcccccccccccuccucggccagcacaccacccacauccucaaggagguccuccgcuacgacgaccgcgccaucggcgagcuccucuccgccggcgucgucgaccagcacgagacccacuga

SEQ ID NO: 50339 - RNA, 1938 nt, Artificial Sequence
  derived and/or modified sequence opt2 from SUGP1__Homo_sapiens__NP_757386
augucccucaagauggacaaccgcgacgucgccggcaaggccaaccgcugguucggcgucgccccccccaaguccggcaagaugaacaugaacauccuccaccaggaggagcucaucgcccagaagaagcgcgagaucgaggccaagauggagcagaaggccaagcagaaccaggucgccuccccccagcccccccaccccggcgagaucaccaacgcccacaacuccuccugcaucuccaacaaguucgccaacgacggcuccuuccuccagcaguuccucaagcuccagaaggcccagaccuccaccgacgcccccaccuccgcccccuccgccccccccuccacccccacccccuccgccggcaagcgcucccuccucaucucccgccgcaccggccucggccucgccucccuccccggccccgucaaguccuacucccacgccaagcagcuccccgucgcccaccgccccuccgucuuccagucccccgacgaggacgaggaggaggacuacgagcaguggcucgagaucaaggucuccccccccgagggcgccgagacccgcaaggucaucgagaagcucgcccgcuucgucgccgagggcggccccgagcucgagaaggucgccauggaggacuacaaggacaaccccgccuucgccuuccuccacgacaagaacucccgcgaguuccucuacuaccgcaagaaggucgccgagauccgcaaggaggcccagaagucccaggccgccucccagaaggucuccccccccgaggacgaggaggucaagaaccucgccgagaagcucgcccgcuucaucgccgacggcggccccgaggucgagaccaucgcccuccagaacaaccgcgagaaccaggccuucuccuuccucuacgagcccaacucccagggcuacaaguacuaccgccagaagcucgaggaguuccgcaaggccaaggccuccuccaccggcuccuucaccgcccccgaccccggccucaagcgcaaguccccccccgaggcccucuccggcucccucccccccgccaccaccugccccgccuccuccacccccgcccccaccaucauccccgcccccgccgcccccggcaagcccgccuccgccgccaccgucaagcgcaagcgcaagucccgcuggggccccgaggaggacaaggucgagcucccccccgccgagcucguccagcgcgacgucgacgccucccccuccccccucuccguccaggaccucaagggccucggcuacgagaagggcaagcccgucggccucgucggcgucaccgagcucuccgacgcccagaagaagcagcucaaggagcagcaggagaugcagcagauguacgacaugaucaugcagcacaagcgcgccaugcaggacaugcagcuccucugggagaaggccguccagcagcaccagcacggcuacgacuccgacgaggaggucgacuccgagcucggcaccugggagcaccagcuccgccgcauggagauggacaagacccgcgagugggccgagcagcucaccaagaugggccgcggcaagcacuucaucggcgacuuccucccccccgacgagcucgagaaguucauggagaccuucaaggcccucaaggagggccgcgagcccgacuacuccgaguacaaggaguucaagcucaccgucgagaacaucggcuaccagaugcucaugaagaugggcuggaaggagggcgagggccucggcuccgagggccagggcaucaagaaccccgucaacaagggcaccaccaccgucgacggcgccggcuucggcaucgaccgccccgccgagcucuccaaggaggacgacgaguacgaggccuuccgcaagcgcaugaugcucgccuaccgcuuccgccccaacccccucaacaacccccgccgccccuacuacuga

SEQ ID NO: 50340 - RNA, 1098 nt, Artificial Sequence
  derived and/or modified sequence opt2 from SUGT1__Homo_sapiens__NP_001124384
auggccgccgccgccgccggcaccgccaccucccagcgcuucuuccaguccuucuccgacgcccucaucgacgaggacccccaggccgcccucgaggagcucaccaaggcccucgagcagaagcccgacgacgcccaguacuacugccagcgcgccuacugccacauccuccucggcaacuacugcgucgccgucgccgacgccaagaagucccucgagcucaaccccaacaacuccaccgccaugcuccgcaagggcaucugcgaguaccacgagaagaacuacgccgccgcccucgagaccuucaccgagggccagaagcucgacaucgagaccggcuuccaccgcgucggccaggccggccuccagcuccucaccuccuccgacccccccgcccucgacucccaguccgccggcaucaccggcgccgacgccaacuucuccgucuggaucaagcgcugccaggaggcccagaacggcuccgaguccgaggucuggacccaccaguccaagaucaaguacgacugguaccagaccgagucccaggucgucaucacccucaugaucaagaacguccagaagaacgacgucaacgucgaguucuccgagaaggagcucuccgcccucgucaagcuccccuccggcgaggacuacaaccucaagcucgagcuccuccaccccaucauccccgagcaguccaccuucaagguccucuccaccaagaucgagaucaagcucaagaagcccgaggccguccgcugggagaagcucgagggccagggcgacguccccacccccaagcaguucgucgccgacgucaagaaccucuaccccuccuccucccccuacacccgcaacugggacaagcucgucggcgagaucaaggaggaggagaagaacgagaagcucgagggcgacgccgcccucaaccgccucuuccagcagaucuacuccgacggcuccgacgaggucaagcgcgccaugaacaaguccuucauggaguccggcggcaccguccucuccaccaacugguccgacgucggcaagcgcaaggucgagaucaacccccccgacgacauggaguggaagaaguacuga

SEQ ID NO: 50341 - RNA, 2616 nt, Artificial Sequence
  derived and/or modified sequence opt2 from SULF1__Homo_sapiens__NP_055985
augaaguacuccugcugcgcccucguccucgccguccucggcaccgagcuccucggcucccucugcuccaccguccgcuccccccgcuuccgcggccgcauccagcaggagcgcaagaacauccgccccaacaucauccucguccucaccgacgaccaggacgucgagcucggcucccuccaggucaugaacaagacccgcaagaucauggagcacggcggcgccaccuucaucaacgccuucgucaccacccccaugugcugccccucccgcuccuccaugcucaccggcaaguacguccacaaccacaacgucuacaccaacaacgagaacugcuccucccccuccuggcaggccaugcacgagccccgcaccuucgccgucuaccucaacaacaccggcuaccgcaccgccuucuucggcaaguaccucaacgaguacaacggcuccuacaucccccccggcuggcgcgaguggcucggccucaucaagaacucccgcuucuacaacuacaccgucugccgcaacggcaucaaggagaagcacggcuucgacuacgccaaggacuacuucaccgaccucaucaccaacgaguccaucaacuacuucaagauguccaagcgcauguacccccaccgccccgucaugauggucaucucccacgccgccccccacggccccgaggacuccgccccccaguucuccaagcucuaccccaacgccucccagcacaucacccccuccuacaacuacgcccccaacauggacaagcacuggaucaugcaguacaccggccccaugcuccccauccacauggaguucaccaacauccuccagcgcaagcgccuccagacccucauguccgucgacgacuccgucgagcgccucuacaacaugcucgucgagaccggcgagcucgagaacaccuacaucaucuacaccgccgaccacggcuaccacaucggccaguucggccucgucaagggcaaguccaugcccuacgacuucgacauccgcguccccuucuucauccgcggccccuccgucgagcccggcuccaucgucccccagaucguccucaacaucgaccucgcccccaccauccucgacaucgccggccucgacaccccccccgacgucgacggcaaguccguccucaagcuccucgaccccgagaagcccggcaaccgcuuccgcaccaacaagaaggccaagaucuggcgcgacaccuuccucgucgagcgcggcaaguuccuccgcaagaaggaggaguccuccaagaacauccagcaguccaaccaccuccccaaguacgagcgcgucaaggagcucugccagcaggcccgcuaccagaccgccugcgagcagcccggccagaaguggcagugcaucgaggacaccuccggcaagcuccgcauccacaagugcaagggccccuccgaccuccucaccguccgccaguccacccgcaaccucuacgcccgcggcuuccacgacaaggacaaggagugcuccugccgcgaguccggcuaccgcgccucccgcucccagcgcaagucccagcgccaguuccuccgcaaccagggcacccccaaguacaagccccgcuucguccacacccgccagacccgcucccucuccgucgaguucgagggcgagaucuacgacaucaaccucgaggaggaggaggagcuccagguccuccagccccgcaacaucgccaagcgccacgacgagggccacaagggcccccgcgaccuccaggccuccuccggcggcaaccgcggccgcaugcucgccgacuccuccaacgccgucggcccccccaccaccguccgcgucacccacaagugcuucauccuccccaacgacuccauccacugcgagcgcgagcucuaccaguccgcccgcgccuggaaggaccacaaggccuacaucgacaaggagaucgaggcccuccaggacaagaucaagaaccuccgcgagguccgcggccaccucaagcgccgcaagcccgaggagugcuccugcuccaagcaguccuacuacaacaaggagaagggcgucaagaagcaggagaagcucaagucccaccuccaccccuucaaggaggccgcccaggaggucgacuccaagcuccagcucuucaaggagaacaaccgccgccgcaagaaggagcgcaaggagaagcgccgccagcgcaagggcgaggagugcucccuccccggccucaccugcuucacccacgacaacaaccacuggcagaccgcccccuucuggaaccucggcuccuucugcgccugcaccuccuccaacaacaacaccuacuggugccuccgcaccgucaacgagacccacaacuuccucuucugcgaguucgccaccggcuuccucgaguacuucgacaugaacaccgaccccuaccagcucaccaacaccguccacaccgucgagcgcggcauccucaaccagcuccacguccagcucauggagcuccgcuccugccagggcuacaagcagugcaacccccgccccaagaaccucgacgucggcaacaaggacggcggcuccuacgaccuccaccgcggccagcucugggacggcugggagggcuga

SEQ ID NO: 50342 - RNA, 2613 nt, Artificial Sequence
  derived and/or modified sequence opt2 from SULF2__Homo_sapiens__NP_061325
augggcccccccucccucguccucugccuccucuccgccaccgucuucucccuccucggcggcuccuccgccuuccucucccaccaccgccucaagggccgcuuccagcgcgaccgccgcaacauccgccccaacaucauccucguccucaccgacgaccaggacgucgagcucggcuccaugcaggucaugaacaagacccgccgcaucauggagcagggcggcgcccacuucaucaacgccuucgucaccacccccaugugcugccccucccgcuccuccauccucaccggcaaguacguccacaaccacaacaccuacaccaacaacgagaacugcuccucccccuccuggcaggcccagcacgagucccgcaccuucgccgucuaccucaacuccaccggcuaccgcaccgccuucuucggcaaguaccucaacgaguacaacggcuccuacgucccccccggcuggaaggagugggucggccuccucaagaacucccgcuucuacaacuacacccucugccgcaacggcgucaaggagaagcacggcuccgacuacuccaaggacuaccucaccgaccucaucaccaacgacuccgucuccuucuuccgcaccuccaagaagauguacccccaccgccccguccucauggucaucucccacgccgccccccacggccccgaggacuccgccccccaguacucccgccucuuccccaacgccucccagcacaucacccccuccuacaacuacgcccccaaccccgacaagcacuggaucaugcgcuacaccggccccaugaagcccauccacauggaguucaccaacaugcuccagcgcaagcgccuccagacccucauguccgucgacgacuccauggagaccaucuacaacaugcucgucgagaccggcgagcucgacaacaccuacaucgucuacaccgccgaccacggcuaccacaucggccaguucggccucgucaagggcaaguccaugcccuacgaguucgacauccgcguccccuucuacguccgcggccccaacgucgaggccggcugccucaacccccacaucguccucaacaucgaccucgcccccaccauccucgacaucgccggccucgacauccccgccgacauggacggcaaguccauccucaagcuccucgacaccgagcgccccgucaaccgcuuccaccucaagaagaagaugcgcgucuggcgcgacuccuuccucgucgagcgcggcaagcuccuccacaagcgcgacaacgacaaggucgacgcccaggaggagaacuuccuccccaaguaccagcgcgucaaggaccucugccagcgcgccgaguaccagaccgccugcgagcagcucggccagaaguggcagugcgucgaggacgccaccggcaagcucaagcuccacaagugcaagggccccaugcgccucggcggcucccgcgcccucuccaaccucguccccaaguacuacggccagggcuccgaggccugcaccugcgacuccggcgacuacaagcucucccucgccggccgccgcaagaagcucuucaagaagaaguacaaggccuccuacguccgcucccgcuccauccgcuccgucgccaucgaggucgacggccgcgucuaccacgucggccucggcgacgccgcccagccccgcaaccucaccaagcgccacuggcccggcgcccccgaggaccaggacgacaaggacggcggcgacuucuccggcaccggcggccuccccgacuacuccgccgccaaccccaucaaggucacccaccgcugcuacauccucgagaacgacaccguccagugcgaccucgaccucuacaagucccuccaggccuggaaggaccacaagcuccacaucgaccacgagaucgagacccuccagaacaagaucaagaaccuccgcgagguccgcggccaccucaagaagaagcgccccgaggagugcgacugccacaagaucuccuaccacacccagcacaagggccgccucaagcaccgcggcuccucccuccaccccuuccgcaagggccuccaggagaaggacaaggucuggcuccuccgcgagcagaagcgcaagaagaagcuccgcaagcuccucaagcgccuccagaacaacgacaccugcuccaugcccggccucaccugcuucacccacgacaaccagcacuggcagaccgcccccuucuggacccucggccccuucugcgccugcaccuccgccaacaacaacaccuacuggugcaugcgcaccaucaacgagacccacaacuuccucuucugcgaguucgccaccggcuuccucgaguacuucgaccucaacaccgaccccuaccagcucaugaacgccgucaacacccucgaccgcgacguccucaaccagcuccacguccagcucauggagcuccgcuccugcaagggcuacaagcagugcaacccccgcacccgcaacauggaccucggccucaaggacggcggcuccuacgagcaguaccgccaguuccagcgccgcaaguggcccgagaugaagcgccccuccuccaagucccucggccagcucugggagggcugggagggcuga

SEQ ID NO: 50343 - RNA, 888 nt, Artificial Sequence
  derived and/or modified sequence opt2 from SULT1A1__Homo_sapiens__NP_803878
auggagcucauccaggacaccucccgccccccccucgaguacgucaagggcgucccccucaucaaguacuucgccgaggcccucggcccccuccaguccuuccaggcccgccccgacgaccuccucaucuccaccuaccccaaguccggcaccaccugggucucccagauccucgacaugaucuaccagggcggcgaccucgagaagugccaccgcgcccccaucuucaugcgcguccccuuccucgaguucaaggcccccggcauccccuccggcauggagacccucaaggacacccccgccccccgccuccucaagacccaccucccccucgcccuccucccccagacccuccucgaccagaaggucaaggucgucuacgucgcccgcaacgccaaggacgucgccgucuccuacuaccacuucuaccacauggccaagguccaccccgagcccggcaccugggacuccuuccucgagaaguucauggucggcgaggucuccuacggcuccugguaccagcacguccaggaguggugggagcucucccgcacccaccccguccucuaccucuucuacgaggacaugaaggagaaccccaagcgcgagauccagaagauccucgaguucgucggccgcucccuccccgaggagaccgucgacuucgucguccagcacaccuccuucaaggagaugaagaagaaccccaugaccaacuacaccaccgucccccaggaguucauggaccacuccaucucccccuucaugcgcaagggcauggccggcgacuggaagaccaccuucaccgucgcccagaacgagcgcuucgacgccgacuacgccgagaagauggccggcugcucccucuccuuccgcuccgagcucuga

SEQ ID NO: 50344 - RNA, 888 nt, Artificial Sequence
  derived and/or modified sequence opt2 from SULT1A2__Homo_sapiens__NP_803564
auggagcucauccaggacaucucccgccccccccucgaguacgucaagggcgucccccucaucaaguacuucgccgaggcccucggcccccuccaguccuuccaggcccgccccgacgaccuccucaucuccaccuaccccaaguccggcaccaccugggucucccagauccucgacaugaucuaccagggcggcgaccucgagaagugccaccgcgcccccaucuucaugcgcguccccuuccucgaguucaagguccccggcauccccuccggcauggagacccucaagaacacccccgccccccgccuccucaagacccaccucccccucgcccuccucccccagacccuccucgaccagaaggucaaggucgucuacgucgcccgcaacgccaaggacgucgccgucuccuacuaccacuucuaccacauggccaaggucuacccccaccccggcaccugggaguccuuccucgagaaguucauggccggcgaggucuccuacggcuccugguaccagcacguccaggaguggugggagcucucccgcacccaccccguccucuaccucuucuacgaggacaugaaggagaaccccaagcgcgagauccagaagauccucgaguucgucggccgcucccuccccgaggagaccgucgaccucauggucgagcacaccuccuucaaggagaugaagaagaaccccaugaccaacuacaccaccguccgccgcgaguucauggaccacuccaucucccccuucaugcgcaagggcauggccggcgacuggaagaccaccuucaccgucgcccagaacgagcgcuucgacgccgacuacgccgagaagauggccggcugcucccucuccuuccgcuccgagcucuga

SEQ ID NO: 50345 - RNA, 888 nt, Artificial Sequence
  derived and/or modified sequence opt2 from SULT1A4__Homo_sapiens__NP_001017390
auggagcucauccaggacaccucccgccccccccucgaguacgucaagggcgucccccucaucaaguacuucgccgaggcccucggcccccuccaguccuuccaggcccgccccgacgaccuccucaucaacaccuaccccaaguccggcaccaccugggucucccagauccucgacaugaucuaccagggcggcgaccucgagaagugcaaccgcgcccccaucuacguccgcguccccuuccucgaggucaacgaccccggcgagcccuccggccucgagacccucaaggacaccccccccccccgccucaucaagucccaccucccccucgcccuccucccccagacccuccucgaccagaaggucaaggucgucuacgucgcccgcaaccccaaggacgucgccgucuccuacuaccacuuccaccgcauggagaaggcccaccccgagcccggcaccugggacuccuuccucgagaaguucauggccggcgaggucuccuacggcuccugguaccagcacguccaggaguggugggagcucucccgcacccaccccguccucuaccucuucuacgaggacaugaaggagaaccccaagcgcgagauccagaagauccucgaguucgucggccgcucccuccccgaggagaccauggacuucaugguccagcacaccuccuucaaggagaugaagaagaaccccaugaccaacuacaccaccgucccccaggagcucauggaccacuccaucucccccuucaugcgcaagggcauggccggcgacuggaagaccaccuucaccgucgcccagaacgagcgcuucgacgccgacuacgccgagaagauggccggcugcucccucuccuuccgcuccgagcucuga

SEQ ID NO: 50346 - RNA, 891 nt, Artificial Sequence
  derived and/or modified sequence opt2 from SULT1B1__Homo_sapiens__NP_055280
augcucucccccaaggacauccuccgcaaggaccucaagcucguccacggcuaccccaugaccugcgccuucgccuccaacugggagaagaucgagcaguuccacucccgccccgacgacaucgucaucgccaccuaccccaaguccggcaccaccugggucuccgagaucaucgacaugauccucaacgacggcgacaucgagaagugcaagcgcggcuucaucaccgagaagguccccaugcucgagaugacccuccccggccuccgcaccuccggcaucgagcagcucgagaagaaccccuccccccgcaucgucaagacccaccuccccaccgaccuccuccccaaguccuucugggagaacaacugcaagaugaucuaccucgcccgcaacgccaaggacgucuccgucuccuacuaccacuucgaccucaugaacaaccuccagcccuuccccggcaccugggaggaguaccucgagaaguuccucaccggcaaggucgccuacggcuccugguucacccacgucaagaacugguggaagaagaaggaggagcaccccauccucuuccucuacuacgaggacaugaaggagaaccccaaggaggagaucaagaagaucauccgcuuccucgagaagaaccucaacgacgagauccucgaccgcaucauccaccacaccuccuucgaggucaugaaggacaacccccucgucaacuacacccaccuccccaccaccgucauggaccacuccaagucccccuucaugcgcaagggcaccgccggcgacuggaagaacuacuucaccgucgcccagaacgagaaguucgacgccaucuacgagaccgagauguccaagaccgcccuccaguuccgcaccgagaucuga

SEQ ID NO: 50347 - RNA, 891 nt, Artificial Sequence
  derived and/or modified sequence opt2 from SULT1C2__Homo_sapiens__NP_001047
auggcccucaccuccgaccucggcaagcagaucaagcucaaggaggucgagggcacccuccuccagcccgccaccgucgacaacuggucccagauccaguccuucgaggccaagcccgacgaccuccucaucugcaccuaccccaaggccggcaccaccuggauccaggagaucgucgacaugaucgagcagaacggcgacgucgagaagugccagcgcgccaucauccagcaccgccaccccuucaucgagugggcccgccccccccagcccuccggcgucgagaaggccaaggccaugcccuccccccgcauccucaagacccaccucuccacccagcuccucccccccuccuucugggagaacaacugcaaguuccucuacgucgcccgcaacgccaaggacugcauggucuccuacuaccacuuccagcgcaugaaccacaugcuccccgaccccggcaccugggaggaguacuucgagaccuucaucaacggcaaggucgucuggggcuccugguucgaccacgucaagggcuggugggagaugaaggaccgccaccagauccucuuccucuucuacgaggacaucaagcgcgaccccaagcacgagauccgcaaggucaugcaguucaugggcaagaaggucgacgagaccguccucgacaagaucguccaggagaccuccuucgagaagaugaaggagaaccccaugaccaaccgcuccaccgucuccaaguccauccucgaccaguccaucuccuccuucaugcgcaagggcaccgucggcgacuggaagaaccacuucaccgucgcccagaacgagcgcuucgacgagaucuaccgccgcaagauggagggcaccuccaucaacuucugcauggagcucuga

SEQ ID NO: 50348 - RNA, 885 nt, Artificial Sequence
  derived and/or modified sequence opt2 from SULT1E1__Homo_sapiens__NP_005411
augaacuccgagcucgacuacuacgagaaguucgaggagguccacggcauccucauguacaaggacuucgucaaguacugggacaacgucgaggccuuccaggcccgccccgacgaccucgucaucgccaccuaccccaaguccggcaccaccugggucuccgagaucgucuacaugaucuacaaggagggcgacgucgagaagugcaaggaggacgucaucuucaaccgcauccccuuccucgagugccgcaaggagaaccucaugaacggcgucaagcagcucgacgagaugaacuccccccgcaucgucaagacccaccucccccccgagcuccuccccgccuccuucugggagaaggacugcaagaucaucuaccucugccgcaacgccaaggacgucgccgucuccuucuacuacuucuuccucauggucgccggccaccccaaccccggcuccuuccccgaguucgucgagaaguucaugcagggccagguccccuacggcuccugguacaagcacgucaaguccuggugggagaagggcaaguccccccgcguccucuuccucuucuacgaggaccucaaggaggacauccgcaaggaggucaucaagcucauccacuuccucgagcgcaagcccuccgaggagcucgucgaccgcaucauccaccacaccuccuuccaggagaugaagaacaaccccuccaccaacuacaccacccuccccgacgagaucaugaaccagaagcucucccccuucaugcgcaagggcaucaccggcgacuggaagaaccacuucaccgucgcccucaacgagaaguucgacaagcacuacgagcagcagaugaaggaguccacccucaaguuccgcaccgagaucuga

SEQ ID NO: 50349 - RNA, 858 nt, Artificial Sequence
  derived and/or modified sequence opt2 from SULT2A1__Homo_sapiens__NP_003158
auguccgacgacuuccucugguucgagggcaucgccuuccccaccaugggcuuccgcuccgagacccuccgcaagguccgcgacgaguucgucauccgcgacgaggacgucaucauccucaccuaccccaaguccggcaccaacuggcucgccgagauccucugccucaugcacuccaagggcgacgccaaguggauccaguccguccccaucugggagcgcucccccugggucgaguccgagaucggcuacaccgcccucuccgagaccgaguccccccgccucuucuccucccaccuccccauccagcucuuccccaaguccuucuucuccuccaaggccaaggucaucuaccucaugcgcaacccccgcgacguccucgucuccggcuacuucuucuggaagaacaugaaguucaucaagaagcccaaguccugggaggaguacuucgagugguucugccagggcaccguccucuacggcuccugguucgaccacauccacggcuggaugcccaugcgcgaggagaagaacuuccuccuccucuccuacgaggagcucaagcaggacaccggccgcaccaucgagaagaucugccaguuccucggcaagacccucgagcccgaggagcucaaccucauccucaagaacuccuccuuccaguccaugaaggagaacaagauguccaacuacucccuccucuccgucgacuacgucgucgacaaggcccagcuccuccgcaagggcgucuccggcgacuggaagaaccacuucaccgucgcccaggccgaggacuucgacaagcucuuccaggagaagauggccgaccucccccgcgagcucuuccccugggaguga

SEQ ID NO: 50350 - RNA, 1053 nt, Artificial Sequence
  derived and/or modified sequence opt2 from SULT2B1__Homo_sapiens__NP_004596
auggccucccccccccccuuccacucccagaagcuccccggcgaguacuuccgcuacaagggcguccccuuccccgucggccucuacucccucgaguccaucucccucgccgagaacacccaggacguccgcgacgacgacaucuucaucaucaccuaccccaaguccggcaccaccuggaugaucgagaucaucugccucauccucaaggagggcgaccccuccuggauccgcuccguccccaucugggagcgcgcccccuggugcgagaccaucgucggcgccuucucccuccccgaccaguacuccccccgccucauguccucccaccuccccauccagaucuucaccaaggccuucuucuccuccaaggccaaggucaucuacaugggccgcaacccccgcgacgucgucgucucccucuaccacuacuccaagaucgccggccagcucaaggaccccggcacccccgaccaguuccuccgcgacuuccucaagggcgagguccaguucggcuccugguucgaccacaucaagggcuggcuccgcaugaagggcaaggacaacuuccucuucaucaccuacgaggagcuccagcaggaccuccagggcuccgucgagcgcaucugcggcuuccucggccgcccccucggcaaggaggcccucggcuccgucgucgcccacuccaccuucuccgccaugaaggccaacaccauguccaacuacacccuccucccccccucccuccucgaccaccgccgcggcgccuuccuccgcaagggcgucugcggcgacuggaagaaccacuucaccgucgcccaguccgaggccuucgaccgcgccuaccgcaagcagaugcgcggcaugcccaccuuccccugggacgaggaccccgaggaggacggcucccccgaccccgagcccucccccgagcccgagcccaagcccucccucgagcccaacaccucccucgagcgcgagccccgccccaacuccucccccucccccucccccggccaggccuccgagaccccccacccccgccccuccuga

SEQ ID NO: 50351 - RNA, 855 nt, Artificial Sequence
  derived and/or modified sequence opt2 from SULT4A1__Homo_sapiens__NP_055166
auggccgaguccgaggccgagacccccuccacccccggcgaguucgaguccaaguacuucgaguuccacggcguccgccucccccccuucugccgcggcaagauggaggagaucgccaacuuccccguccgccccuccgacgucuggaucgucaccuaccccaaguccggcaccucccuccuccaggaggucgucuaccucgucucccagggcgccgaccccgacgagaucggccucaugaacaucgacgagcagcuccccguccucgaguacccccagcccggccucgacaucaucaaggagcucaccuccccccgccucaucaagucccaccuccccuaccgcuuccuccccuccgaccuccacaacggcgacuccaaggucaucuacauggcccgcaaccccaaggaccucgucgucuccuacuaccaguuccaccgcucccuccgcaccauguccuaccgcggcaccuuccaggaguucugccgccgcuucaugaacgacaagcucggcuacggcuccugguucgagcacguccaggaguucugggagcaccgcauggacuccaacguccucuuccucaaguacgaggacaugcaccgcgaccucgucaccauggucgagcagcucgcccgcuuccucggcgucuccugcgacaaggcccagcucgaggcccucaccgagcacugccaccagcucgucgaccagugcugcaacgccgaggcccuccccgucggccgcggccgcgucggccucuggaaggacaucuucaccgucuccaugaacgagaaguucgaccucgucuacaagcagaagaugggcaagugcgaccucaccuucgacuucuaccucuga

SEQ ID NO: 50352 - RNA, 1050 nt, Artificial Sequence
  derived and/or modified sequence opt2 from SUMF1__Homo_sapiens__NP_001158146
auggccgcccccgcccucggccucgucugcggccgcugccccgagcucggccucguccuccuccuccuccuccucucccuccucugcggcgccgccggcucccaggaggccggcaccggcgccggcgccggcucccucgccggcuccugcggcugcggcaccccccagcgccccggcgcccacggcuccuccgccgccgcccaccgcuacucccgcgaggccaacgcccccggccccguccccggcgagcgccagcucgcccacuccaagaugguccccauccccgccggcgucuucaccaugggcaccgacgacccccagaucaagcaggacggcgaggcccccgcccgccgcgucaccaucgacgccuucuacauggacgccuacgaggucuccaacaccgaguucgagaaguucgucaacuccaccggcuaccucaccgaggucgccgccgcccccugguggcuccccgucaagggcgccaacuggcgccaccccgagggccccgacuccaccauccuccaccgccccgaccaccccguccuccacgucuccuggaacgacgccgucgccuacugcaccugggccggcaagcgccuccccaccgaggccgagugggaguacuccugccgcggcggccuccacaaccgccucuuccccuggggcaacaagcuccagcccaagggccagcacuacgccaacaucuggcagggcgaguuccccgucaccaacaccggcgaggacggcuuccagggcaccgcccccgucgacgccuucccccccaacggcuacggccucuacaacaucgucggcaacgccugggaguggaccuccgacugguggaccguccaccacuccgucgaggagacccucaaccccaagggcccccccuccggcaaggaccgcgucaagaagggcggcuccuacaugugccaccgcuccuacugcuaccgcuaccgcugcgccgcccgcucccagaacacccccgacuccuccgccuccaaccucggcuuccgcugcgccgccgaccgccuccccaccauggacuga

SEQ ID NO: 50353 - RNA, 918 nt, Artificial Sequence
  derived and/or modified sequence opt2 from SUMF2__Homo_sapiens__NP_001035934
augcgcgcccacgcccagcgcggccgcggcugcacccgccgcuccgccgccguccucauggcccgccacggccucccccuccucccccuccucucccuccucgucggcgccuggcucaagcucggcaacggccaggccaccuccaugguccagcuccagggcggccgcuuccucaugggcaccaacucccccgacucccgcgacggcgagggccccguccgcgaggccaccgucaagcccuucgccaucgacaucuuccccgucaccaacaaggacuuccgcgacuucguccgcgagaagaaguaccgcaccgaggccgagauguucggcugguccuucgucuucgaggacuucgucuccgacgagcuccgcaacaaggccacccagcccaugaagcccgccggccccggcuccggcauccgcgagcgccucgagcaccccguccuccacgucuccuggaacgacgcccgcgccuacugcgccuggcgcggcaagcgccuccccaccgaggaggagugggaguucgccgcccgcggcggccucaagggccaggucuaccccuggggcaacugguuccagcccaaccgcaccaaccucuggcagggcaaguuccccaagggcgacaaggccgaggacggcuuccacggcgucucccccgucaacgccuuccccgcccagaacaacuacggccucuacgaccuccucggcaacgucugggaguggaccgccucccccuaccaggccgccgagcaggacaugcgcguccuccgcggcgccuccuggaucgacaccgccgacggcuccgccaaccaccgcgcccgcgucaccacccgcaugggcaacacccccgacuccgccuccgacaaccucggcuuccgcugcgccgccgacgccggccgcccccccggcgagcucuga

SEQ ID NO: 50354 - RNA, 306 nt, Artificial Sequence
  derived and/or modified sequence opt2 from SUMO1__Homo_sapiens__NP_001005781
auguccgaccaggaggccaagcccuccaccgaggaccucggcgacaagaaggagggcgaguacaucaagcucaaggucaucggccaggacuccuccgagauccacuucaaggucaagaugaccacccaccucaagaagcucaaggaguccuacugccagcgccagggcguccccaugaacucccuccgcuuccucuucgagggccagcgcaucgccgacaaccacacccccaaggagcucggcauggaggaggaggacgucaucgaggucuaccaggagcagaccggcggccacuccaccgucuga

SEQ ID NO: 50355 - RNA, 216 nt, Artificial Sequence
  derived and/or modified sequence opt2 from SUMO2__Homo_sapiens__NP_001005849
auggccgacgagaagcccaaggagggcgucaagaccgagaacaacgaccacaucaaccucaaggucgccggccaggacggcuccgucguccaguucaagaucaagcgccacaccccccucuccaagcucaugaaggccuacugcgagcgccagcucgagauggaggacgaggacaccaucgacgucuuccagcagcagaccggcggcgucuacuga

SEQ ID NO: 50356 - RNA, 426 nt, Artificial Sequence
  derived and/or modified sequence opt2 from SUMO3__Homo_sapiens__NP_001273345
auguccgaggagaagcccaaggagggcgucaagaccgagaacgaccacaucaaccucaaggucgccggccaggacggcuccgucguccaguucaagaucaagcgccacaccccccucuccaagcucaugaaggccuacugcgagcgccagguccgccaccucgcccccccccagucccuccccgucugcgcccucguccucugcguccccggcaucccccgcgcccgcgccucccgcggcuggacccagaugcagcuccccgagggccucuccaugcgccagauccgcuuccgcuucgacggccagcccaucaacgagaccgacacccccgcccagcucgagauggaggacgaggacaccaucgacgucuuccagcagcagaccggcggcguccccgaguccucccucgccggccacuccuucuga

SEQ ID NO: 50357 - RNA, 288 nt, Artificial Sequence
  derived and/or modified sequence opt2 from SUMO4__Homo_sapiens__NP_001002255
auggccaacgagaagcccaccgaggaggucaagaccgagaacaacaaccacaucaaccucaaggucgccggccaggacggcuccgucguccaguucaagaucaagcgccagaccccccucuccaagcucaugaaggccuacugcgagccccgcggccucuccgucaagcagauccgcuuccgcuucggcggccagcccaucuccggcaccgacaagcccgcccagcucgagauggaggacgaggacaccaucgacgucuuccagcagcccaccggcggcgucuacuga

SEQ ID NO: 50358 - RNA, 2358 nt, Artificial Sequence
  derived and/or modified sequence opt2 from SUN1__Homo_sapiens__NP_001124437
auggacuucucccgccuccacauguacucccccccccagugcguccccgagaacaccggcuacaccuacgcccucuccuccuccuacuccuccgacgcccucgacuucgagaccgagcacaagcucgaccccgucuucgacuccccccgcaugucccgccgcucccuccgccucgccaccaccgccugcacccucggcgacggcgaggccgucggcgccgacuccggcaccuccuccgccgucucccucaagaaccgcgccgcccgcaccaccaagcagcgccgcuccaccaacaaguccgccuucuccaucaaccacgucucccgccaggucaccuccuccggcgucucccacggcggcaccgucucccuccaggacgccgucacccgccgcccccccguccucgacgaguccuggauccgcgagcagaccaccgucgaccacuucuggggccucgacgacgacggcgaccucaagggcggcaacaaggccgccauccagggcaacggcgacgucggcgccgccgccgccaccgcccacaacggcuucuccugcuccaacugcuccaugcucuccgagcgcaaggacguccucaccgcccaccccgccgcccccggccccgucucccgcgucuacucccgcgaccgcaaccagaagugcuacuuccuccuccagauccuccgccgcaucggcgccgucggccaggccgucucccgcaccgccugguccgcccucuggcucgccgucgucgcccccggcaaggccgccuccggcgucuucugguggcucggcaucggcugguaccaguucgucacccucaucuccuggcucaacgucuuccuccucacccgcugccuccgcaacaucugcaaguuccucguccuccucaucccccucuuccuccuccucgccggccucucccuccgcggccagggcaacuucuucuccuuccuccccguccucaacugggccuccaugcaccgcacccagcgcgucgacgacccccaggacgucuucaagcccaccaccucccgccucaagcagccccuccagggcgacuccgaggccuuccccuggcacuggauguccggcgucgagcagcaggucgccucccucuccggccagugccaccaccacggcgagaaccuccgcgagcucaccacccuccuccagaagcuccaggcccgcgucgaccagauggagggcggcgccgccggccccuccgccuccguccgcgacgccgucggccagcccccccgcgagaccgacuucauggccuuccaccaggagcacgagguccgcaugucccaccucgaggacauccucggcaagcuccgcgagaaguccgaggccauccagaaggagcucgagcagaccaagcagaagaccaucuccgccgucggcgagcagcuccuccccaccgucgagcaccuccagcucgagcucgaccagcucaaguccgagcucuccuccuggcgccacgucaagaccggcugcgagaccgucgacgccguccaggagcgcgucgacguccagguccgcgagauggucaagcuccucuucuccgaggaccagcagggcggcucccucgagcagcuccuccagcgcuucuccucccaguucgucuccaagggcgaccuccagaccaugcuccgcgaccuccagcuccagauccuccgcaacgucacccaccacgucuccgucaccaagcagcuccccaccuccgaggccgucgucuccgccgucuccgaggccggcgccuccggcaucaccgaggcccaggcccgcgccaucgucaacuccgcccucaagcucuacucccaggacaagaccggcauggucgacuucgcccucgaguccggcggcggcuccauccucuccacccgcugcuccgagaccuacgagaccaagaccgcccucaugucccucuucggcaucccccucugguacuucucccaguccccccgcgucgucauccagcccgacaucuaccccggcaacugcugggccuucaagggcucccagggcuaccucgucguccgccucuccaugaugauccaccccgccgccuucacccucgagcacauccccaagacccucucccccaccggcaacaucuccuccgcccccaaggacuucgccgucuacggccucgagaacgaguaccaggaggagggccagcuccucggccaguucaccuacgaccaggacggcgagucccuccagauguuccaggcccucaagcgccccgacgacaccgccuuccagaucgucgagcuccgcaucuucuccaacuggggccaccccgaguacaccugccucuaccgcuuccgcguccacggcgagcccgucaaguga

SEQ ID NO: 50359 - RNA, 2217 nt, Artificial Sequence
  derived and/or modified sequence opt2 from SUN2__Homo_sapiens__NP_001186508
augucccgccgcucccagcgccucacccgcuacucccagggcgacgacgacggcuccuccuccuccggcggcuccuccgucgccggcucccaguccacccucuucaaggacuccccccuccgcacccucaagcgcaaguccuccaacaugaagcgccucucccccgccccccagcucggccccuccuccgacgcccacaccuccuacuacuccgagucccucguccacgaguccugguuccccccccgcuccucccucgaggagcuccacggcgacgccaacuggggcgaggaccuccgcguccgccgccgccgcggcaccggcggcuccgaguccucccgcgccuccggccucgucggccgcaaggccaccgaggacuuccucggcuccuccuccggcuacuccuccgaggacgacuacgucgaggacuccgagggccgcggcuccaaggucaccgagaccgagcccgucuccuccuuccccgccggcuacuccgacgucgaccagcaguccuccuccucccgccuccgcuccgccgucucccgcgccggcucccuccucuggauggucgccaccucccccggccgccucuuccgccuccucuacuggugggccggcaccaccugguaccgccucaccaccgccgccucccuccucgacgucuucguccucacccgccgcuucuccucccucaagaccuuccucugguuccuccucccccuccuccuccucaccugccucaccuacggcgccugguacuucuaccccuacggccuccagaccuuccaccccgcccucgucuccuggugggccgccaaggacucccgccgccccgacgagggcugggaggcccgcgacuccuccccccacuuccaggccgagcagcgcgucaugucccgcguccacucccucgagcgccgccucgaggcccucgccgccgaguucuccuccaacuggcagaaggaggccaugcgccucgagcgccucgagcuccgccagggcgcccccggccagggcggcggcggcggccucucccacgaggacacccucgcccuccucgagggccucgucucccgccgcgaggccgcccucaaggaggacuuccgccgcgagaccgccgcccgcauccaggaggagcucuccgcccuccgcgccgagcaccagcaggacuccgaggaccucuucaagaagaucguccgcgccucccaggaguccgaggcccgcauccagcagcucaaguccgaguggcaguccaugacccaggaguccuuccaggaguccuccgucaaggagcuccgccgccucgaggaccagcucgccggccuccagcaggagcucgccgcccucgcccucaagcaguccuccgucgccgaggaggucggccuccucccccagcagauccaggccguccgcgacgacgucgagucccaguuccccgccuggaucucccaguuccucgcccgcggcggcggcggccgcgucggccuccuccagcgcgaggagaugcaggcccagcuccgcgagcucgaguccaagauccucacccacgucgccgagaugcagggcaaguccgcccgcgaggccgccgccucccucucccucacccuccagaaggagggcgucaucggcgucaccgaggagcagguccaccacaucgucaagcaggcccuccagcgcuacuccgaggaccgcaucggccucgccgacuacgcccucgaguccggcggcgccuccgucaucuccacccgcugcuccgagaccuacgagaccaagaccgcccuccucucccucuucggcaucccccucugguaccacucccaguccccccgcgucauccuccagcccgacguccaccccggcaacugcugggccuuccagggcccccagggcuucgccgucguccgccucuccgcccgcauccgccccaccgccgucacccucgagcacguccccaaggcccucucccccaacuccaccaucuccuccgcccccaaggacuucgccaucuucggcuucgacgaggaccuccagcaggagggcacccuccucggcaaguucaccuacgaccaggacggcgagcccauccagaccuuccacuuccaggcccccaccauggccaccuaccaggucgucgagcuccgcauccucaccaacuggggccaccccgaguacaccugcaucuaccgcuuccgcguccacggcgagcccgcccacuga

SEQ ID NO: 50360 - RNA, 1074 nt, Artificial Sequence
  derived and/or modified sequence opt2 from SUN3__Homo_sapiens__NP_001025190
auguccggcaagaccaaggcccgccgcgccgccauguucuuccgccgcugcuccgaggacgccuccggcuccgccuccggcaacgcccuccucuccgaggacgagaaccccgacgccaacggcgucacccgcuccuggaagaucauccucuccaccaugcucacccucaccuuccuccucgucggccuccucaaccaccaguggcucaaggagaccgacgucccccagaagucccgccagcucuacgccaucaucgccgaguacggcucccgccucuacaaguaccaggcccgccuccgcaugcccaaggagcagcucgagcuccucaagaaggagucccagaaccucgagaacaacuuccgccagauccucuuccucaucgagcagaucgacguccucaaggcccuccuccgcgacaugaaggacggcauggacaacaaccacaacuggaacacccacggcgaccccgucgaggaccccgaccacaccgaggaggucuccaaccucgucaacuacguccucaagaagcuccgcgaggaccaggucgagauggccgacuacgcccucaaguccgccggcgccuccaucaucgaggccggcaccuccgaguccuacaagaacaacaaggccaagcucuacuggcacggcaucggcuuccucaaccacgagaugccccccgacaucauccuccagcccgacgucuaccccggcaagugcugggccuuccccggcucccagggccacacccucaucaagcucgccaccaagaucauccccaccgccgucaccauggagcacaucuccgagaaggucucccccuccggcaacaucuccuccgcccccaaggaguucuccgucuacggcaucaccaagaagugcgagggcgaggagaucuuccucggccaguucaucuacaacaagaccggcaccaccguccagaccuucgagcuccagcacgccgucuccgaguaccuccucugcgucaagcucaacaucuucuccaacuggggccaccccaaguacaccugccucuaccgcuuccgcguccacggcacccccggcaagcacaucuga

SEQ ID NO: 50361 - RNA, 1638 nt, Artificial Sequence
  derived and/or modified sequence opt2 from SUOX__Homo_sapiens__NP_000447
augcuccuccuccaccgcgccgucguccuccgccuccagcaggccugccgccucaaguccauccccucccgcaucugcauccaggccugcuccaccaacgacuccuuccagccccagcgccccucccucaccuucuccggcgacaacuccuccacccagggcuggcgcgucaugggcacccuccucggccucggcgccguccucgccuaccaggaccaccgcugccgcgccgcccaggaguccacccacaucuacaccaaggaggaggucuccucccacaccucccccgagaccggcaucugggucacccucggcuccgaggucuucgacgucaccgaguucgucgaccuccaccccggcggccccuccaagcucaugcucgccgccggcggcccccucgagcccuucugggcccucuacgccguccacaaccagucccacguccgcgagcuccucgcccaguacaagaucggcgagcucaaccccgaggacaaggucgcccccaccgucgagaccuccgaccccuacgccgacgaccccguccgccaccccgcccucaaggucaacucccagcgccccuucaacgccgagcccccccccgagcuccucaccgagaacuacaucacccccaaccccaucuucuucacccgcaaccaccuccccguccccaaccucgaccccgacaccuaccgccuccacgucgucggcgcccccggcggccagucccucucccucucccucgacgaccuccacaacuucccccgcuacgagaucaccgucacccuccagugcgccggcaaccgccgcuccgagaugacccaggucaaggaggucaagggccucgaguggcgcaccggcgccaucuccaccgcccgcugggccggcgcccgccucugcgacguccucgcccaggccggccaccagcucugcgagaccgaggcccacgucugcuucgagggccucgacuccgaccccaccggcaccgccuacggcgccuccaucccccucgcccgcgccauggaccccgaggccgagguccuccucgccuacgagaugaacggccagccccucccccgcgaccacggcuuccccguccgcgucgucguccccggcgucgucggcgcccgccacgucaaguggcucggccgcgucuccguccagcccgaggaguccuacucccacuggcagcgccgcgacuacaagggcuucucccccuccgucgacugggagaccgucgacuucgacuccgcccccuccauccaggagcuccccguccaguccgccaucaccgagccccgcgacggcgagaccgucgaguccggcgaggucaccaucaagggcuacgccugguccggcggcggccgcgccgucauccgcgucgacgucucccucgacggcggccucaccuggcaggucgccaagcucgacggcgaggagcagcgcccccgcaaggccugggccuggcgccucuggcagcucaaggcccccguccccgccggccagaaggagcucaacaucgucugcaaggccgucgacgacggcuacaacguccagcccgacaccgucgcccccaucuggaaccuccgcggcguccucuccaacgccuggcaccgcguccacgucuacgucucccccuga

SEQ ID NO: 50362 - RNA, 2340 nt, Artificial Sequence
  derived and/or modified sequence opt2 from SUPT20H__Homo_sapiens__NP_001014308
augcagcaggcccucgagcucgcccucgaccgcgccgaguacgucaucgaguccgcccgccagcgcccccccaagcgcaaguaccucuccuccggccgcaaguccgucuuccagaagcucuacgaccucuacaucgaggagugcgagaaggagcccgaggucaagaagcuccgccgcaacgucaaccuccucgagaagcucgucaugcaggagacccucuccugccucgucgucaaccucuaccccggcaacgagggcuacucccucaugcuccgcggcaagaacggcuccgacuccgagaccauccgccuccccuacgaggagggcgagcuccucgaguaccucgacgccgaggagcucccccccauccucgucgaccuccucgagaagucccaggucaacaucuuccacugcggcugcgucaucgccgagauccgcgacuaccgccaguccuccaacaugaagucccccggcuaccagucccgccacauccuccuccgccccaccaugcagacccucaucugcgacguccacuccaucaccuccgacaaccacaaguggacccaggaggacaagcuccuccucgagucccagcucauccucgccaccgccgagccccucugccucgaccccuccaucgccgucaccugcaccgccaaccgccuccucuacaacaagcagaagaugaacacccgccccaugaagcgcugcuucaagcgcuacucccgcuccucccucaaccgccagcaggaccucucccacugccccccccccccccagcuccgccuccucgacuuccuccagaagcgcaaggagcgcaaggccggccagcacuacgaccucaagaucuccaaggccggcaacugcgucgacauguggaagcgcucccccugcaaccucgccauccccuccgaggucgacgucgagaaguacgccaaggucgagaaguccaucaaguccgacgacucccagcccaccgucuggcccgcccacgacgucaaggacgacuacgucuucgagugcgaggccggcacccaguaccagaagaccaagcucaccauccuccagucccucggcgacccccucuacuacggcaagauccagcccugcaaggccgacgaggaguccgacucccagaugucccccucccacuccuccaccgacgaccacuccaacugguucaucaucggcuccaagaccgacgccgagcgcgucgucaaccaguaccaggagcucguccagaacgaggccaagugccccgucaagaugucccacuccuccuccggcuccgccucccucucccaggucucccccggcaaggagaccgaccagaccgagaccgucuccguccaguccuccguccucggcaagggcgucaagcaccgccccccccccaucaagcuccccuccuccuccggcaacuccuccuccggcaacuacuucaccccccagcagaccuccuccuuccucaagucccccacccccccccccuccuccaagcccuccuccaucccccgcaaguccuccgucgaccucaaccaggucuccaugcucucccccgccgcccucucccccgccuccuccucccagcgcaccaccgccacccaggucauggccaacuccgccggccucaacuucaucaacgucgucggcuccgucugcggcgcccaggcccucauguccggcuccaaccccaugcucggcugcaacaccggcgccaucacccccgccggcaucaaccucuccggccuccuccccuccggcggccuccuccccaacgcccuccccuccgccaugcaggccgccucccaggccggcguccccuucggccucaagaacaccuccucccuccgcccccucaaccuccuccagcuccccggcggcucccucaucuucaacacccuccagcagcagcagcagcagcucucccaguucaccccccagcagccccagcagcccaccaccugcuccccccagcagcccggcgagcagggcuccgagcagggcuccaccucccaggagcaggcccucuccgcccagcaggccgccgucaucaaccucaccggcgucggcuccuucaugcagucccaggccgccguccucucccagcucggcuccgccgagaaccgccccgagcagucccucccccagcagcgcuuccagcucuccuccgccuuccagcagcagcagcagcagauccagcagcuccgcuuccuccagcaccagauggccauggccgccgccgccgcccagaccgcccagcuccaccaccaccgccacaccggcucccaguccaaguccaagaugaagcgcggcacccccaccacccccaaguucuga

SEQ ID NO: 50363 - RNA, 498 nt, Artificial Sequence
  derived and/or modified sequence opt2 from SUPT3H__Homo_sapiens__NP_001248752
auguucgaggacgacgagaucgacgaggucaagcaggagcgcauggagcgcgccgagcgccagacccgcaucauggacuccgcccaguacgccgaguucugcgagucccgccagcucuccuucuccaagaaggccuccaaguuccgcgacuggcucgacugcuccuccauggagaucaagcccaacgucgucgccauggagauccucgccuaccucgccuacgagaccgucgcccagcucgucgaccucgcccuccucguccgccaggacauggucaccaaggccggcgaccccuucucccacgccaucuccgccaccuucauccaguaccacaacuccgccgaguccaccgccgccugcggcgucgaggcccacuccgacgccauccagcccugccacauccgcgaggccauccgccgcuacucccaccgcaucggcccccucucccccuucaccaacgccuaccgccgcaacggcauggccuuccucgccugcuga

SEQ ID NO: 50364 - RNA, 354 nt, Artificial Sequence
  derived and/or modified sequence opt2 from SUPT4H1__Homo_sapiens__NP_003159
auggcccucgagaccguccccaaggaccuccgccaccuccgcgccugccuccucugcucccucgucaagaccaucgaccaguucgaguacgacggcugcgacaacugcgacgccuaccuccagaugaagggcaaccgcgagauggucuacgacugcaccuccuccuccuucgacggcaucaucgccaugaugucccccgaggacuccugggucuccaaguggcagcgcgucuccaacuucaagcccggcgucuacgccgucuccgucaccggccgccucccccagggcaucguccgcgagcucaagucccgcggcgucgccuacaagucccgcgacaccgccaucaagaccuga

SEQ ID NO: 50365 - RNA, 1245 nt, Artificial Sequence
  derived and/or modified sequence opt2 from SUPT7L__Homo_sapiens__NP_001269658
augaaccuccagcgcuacuggggcgagauccccaucuccuccucccagaccaaccgcuccuccuucgaccuccucccccgcgaguuccgccucgucgagguccacgaccccccccuccaccagcccuccgccaacaagcccaagccccccaccaugcucgacauccccuccgagcccugcucccucaccauccacaccauccagcucauccagcacaaccgccgccuccgcaaccucaucgccaccgcccaggcccagaaccagcagcagaccgagggcgucaagaccgaggaguccgagccccuccccuccugccccggcucccccccccuccccgacgaccuccucccccucgacugcaagaaccccaacgcccccuuccagauccgccacuccgaccccgaguccgacuucuaccgcggcaagggcgagcccgucaccgagcucuccuggcacuccugccgccagcuccucuaccaggccgucgccaccauccucgcccacgccggcuucgacugcgccaacgaguccguccucgagacccucaccgacgucgcccacgaguacugccucaaguucaccaagcuccuccgcuucgccgucgaccgcgaggcccgccucggccagacccccuuccccgacgucauggagcaggucuuccacgaggucggcaucggcuccguccucucccuccagaaguucuggcagcaccgcaucaaggacuaccacuccuacaugcuccagaucuccaagcagcucuccgaggaguacgagcgcaucgucaaccccgagaaggccaccgaggacgccaagcccgucaagaucaaggaggagcccgucuccgacaucaccuuccccgucuccgaggagcucgaggccgaccucgccuccggcgaccagucccuccccaugggcguccucggcgcccaguccgagcgcuuccccuccaaccucgaggucgaggccuccccccaggccuccuccgccgaggucaacgccuccccccucuggaaccucgcccacgucaagauggagccccaggaguccgaggagggcaacgucuccggccacggcguccucggcuccgacgucuucgaggagcccauguccggcauguccgaggccggcaucccccagucccccgacgacuccgacuccuccuacggcucccacuccaccgacucccucaugggcuccucccccgucuucaaccagcgcugcaagaagcgcaugcgcaagaucuga

SEQ ID NO: 50366 - RNA, 2361 nt, Artificial Sequence
  derived and/or modified sequence opt2 from SUPV3L1__Homo_sapiens__NP_003162
auguccuucucccgcgcccuccucugggcccgccuccccgccggccgccaggccggccaccgcgccgccaucugcuccgcccuccgcccccacuucggccccuuccccggcguccucggccaggucuccguccucgccaccgccuccuccuccgccuccggcggcuccaagauccccaacaccucccucuucgucccccucaccgucaagccccagggccccuccgccgacggcgacgucggcgccgagcucacccgcccccucgacaagaacgaggucaagaagguccucgacaaguucuacaagcgcaaggagauccagaagcucggcgccgacuacggccucgacgcccgccucuuccaccaggccuucaucuccuuccgcaacuacaucaugcagucccacucccucgacgucgacauccacaucguccucaacgacaucugcuucggcgccgcccacgccgacgaccucuuccccuucuuccuccgccacgccaagcagaucuuccccguccucgacugcaaggacgaccuccgcaagaucuccgaccuccgcaucccccccaacugguaccccgacgcccgcgccaugcagcgcaagaucaucuuccacuccggccccaccaacuccggcaagaccuaccacgccauccagaaguacuucuccgccaaguccggcgucuacugcggcccccucaagcuccucgcccacgagaucuucgagaaguccaacgccgccggcguccccugcgaccucgucaccggcgaggagcgcgucaccguccagcccaacggcaagcaggccucccacgucuccugcaccgucgagaugugcuccgucaccacccccuacgaggucgccgucaucgacgagauccagaugauccgcgaccccgcccgcggcugggccuggacccgcgcccuccucggccucugcgccgaggagguccaccucugcggcgagcccgccgccaucgaccucgucauggagcucauguacaccaccggcgaggaggucgagguccgcgacuacaagcgccucacccccaucuccguccucgaccacgcccucgagucccucgacaaccuccgccccggcgacugcaucgucugcuucuccaagaacgacaucuacuccgucucccgccagaucgagauccgcggccucgaguccgccgucaucuacggcucccucccccccggcaccaagcucgcccaggccaagaaguucaacgaccccaacgaccccugcaagauccucgucgccaccgacgccaucggcaugggccucaaccucuccauccgccgcaucaucuucuacucccucaucaagcccuccaucaacgagaagggcgagcgcgagcucgagcccaucaccaccucccaggcccuccagaucgccggccgcgccggccgcuucuccucccgcuucaaggagggcgaggucaccaccaugaaccacgaggaccucucccuccucaaggagauccucaagcgccccgucgaccccauccgcgccgccggccuccaccccaccgccgagcagaucgagauguucgccuaccaccuccccgacgccacccucuccaaccucaucgacaucuucgucgacuucucccaggucgacggccaguacuucgucugcaacauggacgacuucaaguucuccgccgagcucauccagcacaucccccucucccuccgcguccgcuacgucuucugcaccgcccccaucaacaagaagcagcccuucgucugcuccucccuccuccaguucgcccgccaguacucccgcaacgagccccucaccuucgccuggcuccgccgcuacaucaaguggccccuccucccccccaagaacaucaaggaccucauggaccucgaggccguccacgacguccucgaccucuaccucuggcucuccuaccgcuucauggacauguuccccgacgccucccucauccgcgaccuccagaaggagcucgacggcaucauccaggacggcguccacaacaucaccaagcucaucaagauguccgagacccacaagcuccucaaccucgagggcuuccccuccggcucccagucccgccucuccggcacccucaagucccaggcccgccgcacccgcggcaccaaggcccucggcuccaaggccaccgagccccccucccccgacgccggcgagcucucccucgccucccgccucguccagcagggccuccucacccccgacaugcucaagcagcucgagaaggaguggaugacccagcagaccgagcacaacaaggagaagaccgaguccggcacccaccccaagggcacccgccgcaagaagaaggagcccgacuccgacuga

SEQ ID NO: 50367 - RNA, 903 nt, Artificial Sequence
  derived and/or modified sequence opt2 from SURF1__Homo_sapiens__NP_003163
auggccgccgucgccgcccuccagcucggccuccgcgccgccggccucggccgcgcccccgccuccgccgccuggcgcuccguccuccgcgucuccccccgccccggcgucgccuggcgccccucccgcugcggcuccuccgccgccgaggccuccgccaccaaggccgaggacgacuccuuccuccaguggguccuccuccucauccccgucaccgccuucggccucggcaccuggcagguccagcgccgcaaguggaagcucaaccucaucgccgagcucgagucccgcguccucgccgagcccgucccccuccccgccgaccccauggagcucaagaaccucgaguaccgccccgucaagguccgcggcugcuucgaccacuccaaggagcucuacaugaugccccgcaccauggucgaccccguccgcgaggcccgcgagggcggccucaucuccuccuccacccaguccggcgccuacgucgucacccccuuccacugcaccgaccucggcgucaccauccucgucaaccgcggcuucgucccccgcaagaaggucaaccccgagacccgccagaagggccagaucgagggcgaggucgaccucaucggcaugguccgccucaccgagacccgccagcccuucguccccgagaacaaccccgagcgcaaccacuggcacuaccgcgaccucgaggccauggcccgcaucaccggcgccgagcccaucuucaucgacgccaacuuccaguccaccguccccggcggccccaucggcggccagacccgcgucacccuccgcaacgagcaccuccaguacaucgucaccugguacggccucuccgccgccaccuccuaccucugguucaagaaguuccuccgcggcacccccggcgucuga

SEQ ID NO: 50368 - RNA, 480 nt, Artificial Sequence
  derived and/or modified sequence opt2 from SURF4__Homo_sapiens__NP_001267718
augggccagaacgaccucaugggcaccgccgaggacuucgccgaccaguuccuccgcgucaccaagcaguaccucccccacgucgcccgccucugccucaucuccaccuuccucgaggacggcauccgcaugugguuccagugguccgagcagcgcgacuacaucgacaccaccuggaacugcggcuaccuccucgccuccuccuucgucuuccucaaccuccucggccagcucaccggcugcguccucguccucucccgcaacuucguccaguacgccugcuucggccucuucggcaucaucgcccuccagaccaucgccuacuccauccucugggaccucaaguuccucaugcgcaaccucgcccucggcggcggccuccuccuccuccucgccgagucccgcuccgagggcaaguccauguucgccggcguccccaccaugcgcgaguccucccccaagcaguaccuccccggcuga

SEQ ID NO: 50369 - RNA, 2274 nt, Artificial Sequence
  derived and/or modified sequence opt2 from SUSD1__Homo_sapiens__NP_001269569
augggccgcggccccugggacgccggccccucccgccgccuccucccccuccuccuccuccucggccucgcccgcggcgccgccggcgcccccggccccgacggccucgacgucugcgccaccugccacgagcacgccaccugccagcagcgcgagggcaagaagaucugcaucugcaacuacggcuucgucggcaacggccgcacccagugcgucgacaagaacgagugccaguucggcgccacccucgucugcggcaaccacaccuccugccacaacacccccggcggcuucuacugcaucugccucgagggcuaccgcgccaccaacaacaacaagaccuucauccccaacgacggcaccuucugcaccgacaucgacgagugcgaggucuccggccucugccgccacggcggccgcugcgucaacacccacggcuccuucgagugcuacugcauggacggcuaccucccccgcaacggccccgagcccuuccaccccaccaccgacgccaccuccugcaccgagaucgacugcggcaccccccccgagguccccgacggcuacaucaucggcaacuacaccuccucccucggcucccagguccgcuacgccugccgcgagggcuucuucuccguccccgaggacaccgucuccuccugcaccggccucggcaccugggagucccccaagcuccacugccaggagaucaacugcggcaacccccccgagaugcgccacgccauccucgucggcaaccacuccucccgccucggcggcgucgcccgcuacgucugccaggagggcuucgagucccccggcggcaagaucaccuccgucugcaccgagaagggcaccuggcgcgaguccacccucaccugcaccgagauccucaccaagaucaacgacgucucccucuucaacgacaccugcguccgcuggcagaucaacucccgccgcaucaaccccaagaucuccuacgucaucuccaucaagggccagcgccucgaccccauggaguccguccgcgaggagaccgucaaccucaccaccgacucccgcacccccgaggucugccucgcccucuaccccggcaccaacuacaccgucaacaucuccaccgcccccccccgccgcuccaugcccgccgucaucggcuuccagaccgccgaggucgaccuccucgaggacgacggcuccuucaacaucuccaucuucaacgagaccugccucaagcucaaccgccgcucccgcaaggucggcuccgagcacauguaccaguucaccguccucggccagcgcugguaccucgccaacuucucccacgccaccuccuucaacuucaccacccgcgagcagguccccgucgucugccucgaccucuaccccaccaccgacuacaccgucaacgucacccuccuccgcucccccaagcgccacuccguccagaucaccaucgccaccccccccgccgucaagcagaccaucuccaacaucuccggcuucaacgagaccugccuccgcuggcgcuccaucaagaccgccgacauggaggagauguaccucuuccacaucuggggccagcgcugguaccagaaggaguucgcccaggagaugaccuucaacaucuccuccuccucccgcgaccccgaggucugccucgaccuccgccccggcaccaacuacaacgucucccuccgcgcccucuccuccgagcuccccgucgucaucucccucaccacccagaucaccgagcccccccuccccgaggucgaguucuucaccguccaccgcggcccccucccccgccuccgccuccgcaaggccaaggagaagaacggccccaucuccuccuaccagguccucguccucccccucgcccuccaguccaccuucuccugcgacuccgagggcgccuccuccuucuucuccaacgccuccgacgccgacggcuacgucgccgccgagcuccucgccaaggacguccccgacgacgccauggagauccccaucggcgaccgccucuacuacggcgaguacuacaacgccccccucaagcgcggcuccgacuacugcaucauccuccgcaucaccuccgaguggaacaagguccgccgccacuccugcgccgucugggcccaggucaaggagauccccugcaacugcaacuuccuccgccuccacauccaccgcgccaacuccggcgacacccagauccgccacuccugcugcugccgcuggcgcguccucgacuggguccccuggcuccucuga

SEQ ID NO: 50370 - RNA, 2469 nt, Artificial Sequence
  derived and/or modified sequence opt2 from SUSD2__Homo_sapiens__NP_062547
augaagcccgcccuccuccccugggcccuccuccuccucgccaccgcccucggccccggccccggccccaccgccgacgcccaggaguccugcuccaugcgcugcggcgcccucgacggccccugcuccugccaccccaccugcuccggccucggcaccugcugccucgacuuccgcgacuucugccucgagauccuccccuacuccggcuccaugaugggcggcaaggacuucgucguccgccacuucaagauguccucccccaccgacgccuccgucaucugccgcuucaaggacuccauccagacccucggccacgucgacuccuccggccagguccacugcgucuccccccuccucuacgaguccggccgcauccccuucaccgucucccucgacaacggccacuccuucccccgcgccggcaccuggcucgccguccaccccaacaaggucuccaugauggagaaguccgagcucgucaacgagacccgcuggcaguacuacggcaccgccaacaccuccggcaaccucucccucaccuggcacgucaagucccuccccacccagaccaucaccaucgagcucuggggcuacgaggagaccggcaugcccuacucccaggaguggaccgccaagugguccuaccucuacccccucgccacccacauccccaacuccggcuccuucaccuucacccccaagcccgccccccccuccuaccagcgcuggcgcgucggcgcccuccgcaucaucgacuccaagaacuacgccggccagaaggacguccaggcccucuggaccaacgaccacgcccucgccuggcaccucuccgacgacuuccgcgaggaccccgucgccugggcccgcacccagugccaggccugggaggagcucgaggaccagcuccccaacuuccucgaggagcuccccgacugccccugcacccucacccaggcccgcgccgacuccggccgcuucuucaccgacuacggcugcgacauggagcagggcuccgucugcaccuaccaccccggcgccguccacugcguccgcuccguccaggccucccuccgcuacggcuccggccagcagugcugcuacaccgccgacggcacccagcuccucaccgccgacuccuccggcggcuccacccccgaccgcggccacgacuggggcgccccccccuuccgcacccccccccgcguccccuccaugucccacuggcucuacgacguccucuccuucuacuacugcugccucugggcccccgacugcccccgcuacaugcagcgccgccccuccaacgacugccgcaacuaccgccccccccgccucgccuccgccuucggcgacccccacuucgucaccuucgacggcaccaacuucaccuucaacggccgcggcgaguacguccuccucgaggccgcccucaccgaccuccgcguccaggcccgcgcccagcccggcaccauguccaacggcaccgagacccgcggcaccggccucaccgccgucgccguccaggagggcaacuccgacgucgucgagguccgccucgccaaccgcaccggcggccucgagguccuccucaaccaggagguccucuccuucaccgagcaguccuggauggaccucaagggcauguuccucuccgucgccgccggcgaccgcgucuccaucaugcucgccuccggcgccggccucgaggucuccguccagggccccuuccucuccgucuccguccuccuccccgagaaguuccucacccacacccacggccuccucggcacccucaacaacgaccccaccgacgacuucacccuccacuccggccgcguccucccccccggcaccuccccccaggagcucuuccucuucggcgccaacuggaccguccacaacgccuccucccuccucaccuacgacuccugguuccucguccacaacuuccucuaccagcccaagcacgaccccaccuucgagccccucuuccccuccgagaccacccucaaccccucccucgcccaggaggccgccaagcucugcggcgacgaccacuucugcaacuucgacgucgccgccaccggcucccucuccaccggcaccgccacccgcgucgcccaccagcuccaccagcgccgcaugcagucccuccagcccgucgucuccugcggcuggcucgcccccccccccaacggccagaaggagggcaaccgcuaccucgccggcuccaccaucuacuuccacugcgacaacggcuacucccucgccggcgccgagaccuccaccugccaggccgacggcaccugguccucccccacccccaagugccagcccggccgcuccuacgccguccuccucggcaucaucuucggcggccucgccgucgucgccgccgucgcccucgucuacguccuccuccgccgccgcaagggcaacacccacgucuggggcgcccagcccuga

SEQ ID NO: 50371 - RNA, 873 nt, Artificial Sequence
  derived and/or modified sequence opt2 from SUSD4__Homo_sapiens__NP_001032252
auguaccacggcaugaaccccuccaacggcgacggcuuccucgagcagcagcagcagcagcagcagccccaguccccccagcgccuccucgccgucauccucugguuccagcucgcccucugcuucggccccgcccagcucaccggcggcuucgacgaccuccaggucugcgccgaccccggcauccccgagaacggcuuccgcacccccuccggcggcgucuucuucgagggcuccgucgcccgcuuccacugccaggacggcuucaagcucaagggcgccaccaagcgccucugccucaagcacuucaacggcacccucggcuggauccccuccgacaacuccaucugcguccaggaggacugccgcaucccccagaucgaggacgccgagauccacaacaagaccuaccgccacggcgagaagcucaucaucaccugccacgagggcuucaagauccgcuaccccgaccuccacaacauggucucccucugccgcgacgacggcaccuggaacaaccuccccaucugccagggcugccuccgcccccucgccuccuccaacggcuacgucaacaucuccgagcuccagaccuccuuccccgucggcaccgucaucuccuaccgcugcuuccccggcuucaagcucgacggcuccgccuaccucgagugccuccagaaccucaucugguccuccucccccccccgcugccucgcccucgagggcggccgccccgagcaccucuuccccguccucuacuucccccacauccgccucgccgccgccguccucuacuucugccccguccucaaguccucccccacccccgcccccaccugcuccuccaccuccaccaccaccucccucuucuga

SEQ ID NO: 50372 - RNA, 912 nt, Artificial Sequence
  derived and/or modified sequence opt2 from SUSD6__Homo_sapiens__NP_055549
augugccacggccgcaucgcccccaaguccaccuccgucuucgccgucgccuccgucggccacggcgucuuccucccccucgucauccucugcacccuccucggcgacggccucgccuccgucugcccccucccccccgagcccgagaacggcggcuacaucugccacccccgccccugccgcgacccccucaccgccggcuccgucaucgaguaccucugcgccgagggcuacaugcucaagggcgacuacaaguaccucaccugcaagaacggcgaguggaagcccgccauggagaucuccugccgccucaacgaggacaaggacacccacaccucccucggcguccccacccucuccaucgucgccuccaccgccuccuccgucgcccucauccuccuccucgucguccucuucguccuccuccagcccaagcucaaguccuuccaccacucccgccgcgaccagggcgucuccggcgaccaggucuccaucauggucgacggcguccaggucgcccuccccuccuacgaggaggccgucuacggcuccuccggccacugcgucccccccgccgacccccgcguccagaucguccucuccgagggcuccggccccuccggccgcuccgucccccgcgagcagcagcuccccgaccagggcgccugcuccuccgccggcggcgaggacgaggcccccggccaguccggccucugcgaggccuggggcucccgcgccuccgagaccgucaugguccaccaggccaccaccuccuccugggucgccggcuccggcaaccgccagcucgcccacaaggagaccgccgacuccgagaacuccgacauccagucccuccucucccucaccuccgaggaguacaccgacgacaucccccuccucaaggaggccuga

SEQ ID NO: 50373 - RNA, 1272 nt, Artificial Sequence
  derived and/or modified sequence opt2 from SUV39H1__Homo_sapiens__NP_001269095
auggucggcaugucccgccuccgcaacgaccgccucgccgacccccucaccggcugcuccgucugcugcaaguccuccuggaaccagcuccaggaccucugccgccucgccaagcucuccugccccgcccucggcaucuccaagcgcaaccucuacgacuucgaggucgaguaccucugcgacuacaagaagauccgcgagcaggaguacuaccucgucaaguggcgcggcuaccccgacuccgaguccaccugggagccccgccagaaccucaagugcguccgcauccucaagcaguuccacaaggaccucgagcgcgagcuccuccgccgccaccaccgcuccaagaccccccgccaccucgaccccucccucgccaacuaccucguccagaaggccaagcagcgccgcgcccuccgccgcugggagcaggagcucaacgccaagcgcucccaccucggccgcaucaccgucgagaacgaggucgaccucgacggccccccccgcgccuucgucuacaucaacgaguaccgcgucggcgagggcaucacccucaaccaggucgccgucggcugcgagugccaggacugccucugggcccccaccggcggcugcugccccggcgccucccuccacaaguucgccuacaacgaccagggccagguccgccuccgcgccggccuccccaucuacgagugcaacucccgcugccgcugcggcuacgacugccccaaccgcgucguccagaagggcauccgcuacgaccucugcaucuuccgcaccgacgacggccgcggcuggggcguccgcacccucgagaagauccgcaagaacuccuucgucauggaguacgucggcgagaucaucaccuccgaggaggccgagcgccgcggccagaucuacgaccgccagggcgccaccuaccucuucgaccucgacuacgucgaggacgucuacaccgucgacgccgccuacuacggcaacaucucccacuucgucaaccacuccugcgaccccaaccuccaggucuacaacgucuucaucgacaaccucgacgagcgccucccccgcaucgccuucuucgccacccgcaccauccgcgccggcgaggagcucaccuucgacuacaacaugcaggucgaccccgucgacauggaguccacccgcauggacuccaacuucggccucgccggccuccccggcucccccaagaagcgcguccgcaucgagugcaagugcggcaccgaguccugccgcaaguaccucuucuga

SEQ ID NO: 50374 - RNA, 1233 nt, Artificial Sequence
  derived and/or modified sequence opt2 from SUV39H2__Homo_sapiens__NP_001180353
auggccgccgucggcgccgaggcccgcggcgccuggugcguccccugccucgucucccucgacacccuccaggagcucugccgcaaggagaagcucaccugcaaguccaucggcaucaccaagcgcaaccucaacaacuacgaggucgaguaccucugcgacuacaaggucgucaaggacauggaguacuaccucgucaaguggaagggcuggcccgacuccaccaacaccugggagccccuccagaaccucaagugcccccuccuccuccagcaguucuccaacgacaagcacaacuaccucucccaggucaagaagggcaaggccaucacccccaaggacaacaacaagacccucaagcccgccaucgccgaguacaucgucaagaaggccaagcagcgcaucgcccuccagcgcuggcaggacgagcucaaccgccgcaagaaccacaagggcaugaucuucgucgagaacaccgucgaccucgagggcccccccuccgacuucuacuacaucaacgaguacaagcccgcccccggcaucucccucgucaacgaggccaccuucggcugcuccugcaccgacugcuucuuccagaagugcugccccgccgaggccggcguccuccucgccuacaacaagaaccagcagaucaagaucccccccggcacccccaucuacgagugcaacucccgcugccagugcggccccgacugccccaaccgcaucguccagaagggcacccaguacucccucugcaucuuccgcaccuccaacggccgcggcuggggcgucaagacccucgucaagaucaagcgcauguccuucgucauggaguacgucggcgaggucaucaccuccgaggaggccgagcgccgcggccaguucuacgacaacaagggcaucaccuaccucuucgaccucgacuacgaguccgacgaguucaccgucgacgccgcccgcuacggcaacgucucccacuucgucaaccacuccugcgaccccaaccuccaggucuucaacgucuucaucgacaaccucgacacccgccucccccgcaucgcccucuucuccacccgcaccaucaacgccggcgaggagcucaccuucgacuaccagaugaagggcuccggcgacaucuccuccgacuccaucgaccacucccccgccaagaagcgcguccgcaccgucugcaagugcggcgccgucaccugccgcggcuaccucaacuga

SEQ ID NO: 50375 - RNA, 1389 nt, Artificial Sequence
  derived and/or modified sequence opt2 from SUV420H2__Homo_sapiens__NP_116090
augggccccgaccgcgucaccgcccgcgagcucugcgagaacgacgaccucgccaccucccucguccucgaccccuaccucggcuuccgcacccacaagaugaacgucucccccguccccccccuccgccgccagcagcaccuccgcuccgcccucgagaccuuccuccgccagcgcgaccucgaggccgccuaccgcgcccucacccucggcggcuggaccgcccgcuacuuccagucccgcggcccccgccaggaggccgcccucaagacccacgucuaccgcuaccuccgcgccuuccuccccgaguccggcuucaccauccuccccugcacccgcuacuccauggagaccaacggcgccaagaucgucuccacccgcgccuggaagaagaacgagaagcucgagcuccucgucggcugcaucgccgagcuccgcgaggccgacgagggccuccuccgcgccggcgagaacgacuucuccaucauguacuccacccgcaagcgcuccgcccagcucuggcucggccccgccgccuucaucaaccacgacugcaagcccaacugcaaguucguccccgccgacggcaacgccgccugcgucaagguccuccgcgacaucgagcccggcgacgaggucaccugcuucuacggcgagggcuucuucggcgagaagaacgagcacugcgagugccacaccugcgagcgcaagggcgagggcgccuuccgcacccgcccccgcgagcccgcccuccccccccgcccccucgacaaguaccagcuccgcgagaccaagcgccgccuccagcagggccucgacuccggcucccgccagggccuccucggcccccgcgccugcguccaccccuccccccuccgccgcgaccccuucugcgccgccugccagccccuccgccuccccgccugcuccgcccgccccgacaccuccccccucuggcuccaguggcucccccagccccagccccgcguccgcccccgcaagcgccgccgcccccgcccccgccgcgcccccguccucuccacccaccacgccgcccgcgucucccuccaccgcuggggcggcugcggcccccacugccgccuccgcggcgaggcccucgucgcccucggccagcccccccacgcccgcugggccccccagcaggacuggcacugggcccgccgcuacggccuccccuacgucguccgcgucgaccuccgccgccucgcccccgccccccccgccacccccgcccccgccggcacccccggccccauccucauccccaagcaggcccucgccuucgcccccuucuccccccccaagcgccuccgccucgucgucucccacggcuccaucgaccucgacgucggcggcgaggagcucuga

SEQ ID NO: 50376 - RNA, 2220 nt, Artificial Sequence
  derived and/or modified sequence opt2 from SUZ12__Homo_sapiens__NP_056170
auggccccccagaagcacggcggcggcggcggcggcggcuccggccccuccgccggcuccggcggcggcggcuucggcggcuccgccgccgucgccgccgccaccgccuccggcggcaaguccggcggcggcuccugcggcggcggcggcuccuacuccgccuccuccuccuccuccgccgccgccgccgccggcgccgccguccuccccgucaagaagcccaagauggagcacguccaggccgaccacgagcucuuccuccaggccuucgagaagcccacccagaucuaccgcuuccuccgcacccgcaaccucaucgcccccaucuuccuccaccgcacccucaccuacaugucccaccgcaacucccgcaccaacaucaagcgcaagaccuucaaggucgacgacaugcucuccaaggucgagaagaugaagggcgagcaggagucccacucccucuccgcccaccuccagcucaccuucaccggcuucuuccacaagaacgacaagcccucccccaacuccgagaacgagcagaacuccgucacccucgagguccuccucgucaaggucugccacaagaagcgcaaggacgucuccugccccauccgccagguccccaccggcaagaagcaggucccccucaaccccgaccucaaccagaccaagcccggcaacuuccccucccucgccgucuccuccaacgaguucgagcccuccaacucccacauggucaaguccuacucccuccucuuccgcgucacccgccccggccgccgcgaguucaacggcaugaucaacggcgagaccaacgagaacaucgacgucaacgaggagcuccccgcccgccgcaagcgcaaccgcgaggacggcgagaagaccuucgucgcccagaugaccgucuucgacaagaaccgccgccuccagcuccucgacggcgaguacgaggucgccaugcaggagauggaggagugccccaucuccaagaagcgcgccaccugggagaccauccucgacggcaagcgccucccccccuucgagaccuucucccagggccccacccuccaguucacccuccgcuggaccggcgagaccaacgacaaguccaccgcccccaucgccaagccccucgccacccgcaacuccgagucccuccaccaggagaacaagcccggcuccgucaagcccacccagaccaucgccgucaaggagucccucaccaccgaccuccagacccgcaaggagaaggacacccccaacgagaaccgccagaagcuccgcaucuucuaccaguuccucuacaacaacaacacccgccagcagaccgaggcccgcgacgaccuccacugccccuggugcacccucaacugccgcaagcucuacucccuccucaagcaccucaagcucugccacucccgcuucaucuucaacuacgucuaccaccccaagggcgcccgcaucgacgucuccaucaacgagugcuacgacggcuccuacgccggcaacccccaggacauccaccgccagcccggcuucgccuucucccgcaacggccccgucaagcgcacccccaucacccacauccucgucugccgccccaagcgcaccaaggccuccauguccgaguuccucgaguccgaggacggcgaggucgagcagcagcgcaccuacuccuccggccacaaccgccucuacuuccacuccgacaccugccucccccuccgcccccaggagauggaggucgacuccgaggacgagaaggaccccgaguggcuccgcgagaagaccaucacccagaucgaggaguucuccgacgucaacgagggcgagaaggaggucaugaagcucuggaaccuccacgucaugaagcacggcuucaucgccgacaaccagaugaaccacgccugcaugcucuucgucgagaacuacggccagaagaucaucaagaagaaccucugccgcaacuucaugcuccaccucgucuccaugcacgacuucaaccucaucuccaucauguccaucgacaaggccgucaccaagcuccgcgagaugcagcagaagcucgagaagggcgaguccgccucccccgccaacgaggagaucaccgaggagcagaacggcaccgccaacggcuucuccgagaucaacuccaaggagaaggcccucgagaccgacuccgucuccggcgucuccaagcaguccaagaagcagaagcucuga

SEQ ID NO: 50377 - RNA, 2052 nt, Artificial Sequence
  derived and/or modified sequence opt2 from SV2B__Homo_sapiens__NP_055663
auggacgacuacaaguaccaggacaacuacggcggcuacgcccccuccgacggcuacuaccgcggcaacgaguccaaccccgaggaggacgcccaguccgacgucaccgagggccacgacgaggaggacgagaucuacgagggcgaguaccagggcaucccccaccccgacgacgucaaggccaagcaggccaagauggcccccucccgcauggacucccuccgcggccagaccgaccucauggccgagcgccucgaggacgaggagcagcucgcccaccaguacgagaccaucauggacgagugcggccacggccgcuuccaguggauccucuucuucguccucggccucgcccucauggccgacggcgucgaggucuucgucgucuccuucgcccuccccuccgccgagaaggacaugugccucuccuccuccaagaagggcaugcucggcaugaucgucuaccucggcaugauggccggcgccuucauccucggcggccucgccgacaagcucggccgcaagcgcguccucuccaugucccucgccgucaacgccuccuucgccucccucuccuccuucguccagggcuacggcgccuuccucuucugccgccucaucuccggcaucggcaucggcggcgcccuccccaucgucuucgccuacuucuccgaguuccucucccgcgagaagcgcggcgagcaccucuccuggcucggcaucuucuggaugaccggcggccucuacgccuccgccauggccugguccaucaucccccacuacggcuggggcuucuccaugggcaccaacuaccacuuccacuccuggcgcgucuucgucaucgucugcgcccuccccugcaccgucuccauggucgcccucaaguucaugcccgaguccccccgcuuccuccucgagaugggcaagcacgacgaggccuggaugauccucaagcagguccacgacaccaacaugcgcgccaagggcacccccgagaaggucuucaccgucuccaacaucaagacccccaagcagauggacgaguucaucgagauccaguccuccaccggcaccugguaccagcgcuggcucguccgcuucaagaccaucuucaagcaggucugggacaacgcccucuacugcgucaugggccccuaccgcaugaacacccucauccucgccgucgucugguucgccauggccuucuccuacuacggccucaccgucugguuccccgacaugauccgcuacuuccaggacgaggaguacaaguccaagaugaaggucuucuucggcgagcacgucuacggcgccaccaucaacuucaccauggagaaccagauccaccagcacggcaagcucgucaacgacaaguucacccgcauguacuucaagcacguccucuucgaggacaccuucuucgacgagugcuacuucgaggacgucaccuccaccgacaccuacuucaagaacugcaccaucgaguccaccaucuucuacaacaccgaccucuacgagcacaaguucaucaacugccgcuucaucaacuccaccuuccucgagcagaaggagggcugccacauggaccucgagcaggacaacgacuuccucaucuaccucgucuccuuccucggcucccucuccguccuccccggcaacaucaucuccgcccuccucauggaccgcaucggccgccucaagaugaucggcggcuccaugcucaucuccgccgucugcugcuucuuccucuucuucggcaacuccgaguccgccaugaucggcuggcagugccucuucugcggcaccuccaucgccgccuggaacgcccucgacgucaucaccgucgagcucuaccccaccaaccagcgcgccaccgccuucggcauccucaacggccucugcaaguucggcgccauccucggcaacaccaucuucgccuccuucgucggcaucaccaaggucguccccauccuccucgccgccgccucccucgucggcggcggccucaucgcccuccgccuccccgagacccgcgagcagguccucauguga

SEQ ID NO: 50378 - RNA, 2031 nt, Artificial Sequence
  derived and/or modified sequence opt2 from SV2C__Homo_sapiens__NP_001284645
auggaggacuccuacaaggaccgcaccucccucaugaagggcgccaaggacaucgcccgcgaggucaagaagcagaccgucaagaaggucaaccaggccgucgaccgcgcccaggacgaguacacccagcgcuccuacucccgcuuccaggacgaggaggacgacgacgacuacuaccccgccggcgagaccuacaacggcgaggccaacgacgacgagggcuccuccgaggccaccgagggccacgacgaggacgacgagaucuacgagggcgaguaccagggcauccccuccaugaaccaggccaaggacuccaucgucuccgucggccagcccaagggcgacgaguacaaggaccgccgcgagcucgaguccgagcgccgcgccgacgaggaggagcucgcccagcaguacgagcucaucauccaggagugcggccacggccgcuuccagugggcccucuucuucguccucggcauggcccucauggccgacggcgucgaggucuucgucgucggcuucguccuccccuccgccgagaccgaccucugcauccccaacuccggcuccggcuggcucggcuccaucgucuaccucggcaugauggucggcgccuucuucuggggcggccucgccgacaaggucggccgcaagcagucccuccucaucugcauguccgucaacggcuucuucgccuuccucuccuccuucguccagggcuacggcuucuuccucuucugccgccuccucuccggcuucggcaucggcggcgccauccccaccgucuucuccuacuucgccgagguccucgcccgcgagaagcgcggcgagcaccucuccuggcucugcauguucuggaugaucggcggcaucuacgccuccgccauggccugggccaucaucccccacuacggcugguccuucuccaugggcuccgccuaccaguuccacuccuggcgcgucuucgucaucgucugcgcccuccccugcgucuccuccgucgucgcccucaccuucaugcccgaguccccccgcuuccuccucgaggucggcaagcacgacgaggccuggaugauccucaagcucauccacgacaccaacaugcgcgcccgcggccagcccgagaaggucuucaccgucaacaagaucaagacccccaagcagaucgacgagcucaucgagaucgaguccgacaccggcaccugguaccgccgcugcuucguccgcauccgcaccgagcucuacggcaucuggcucaccuucaugcgcugcuucaacuaccccguccgcgacaacaccaucaagcucaccaucgucugguucacccucuccuucggcuacuacggccucuccgucugguuccccgacgucaucaagccccuccaguccgacgaguacgcccuccucacccgcaacgucgagcgcgacaaguacgccaacuucaccaucaacuucaccauggagaaccagauccacaccggcauggaguacgacaacggccgcuucaucggcgucaaguucaaguccgucaccuucaaggacuccgucuucaaguccugcaccuucgaggacgucaccuccgucaacaccuacuucaagaacugcaccuucaucgacaccgucuucgacaacaccgacuucgagcccuacaaguucaucgacuccgaguucaagaacugcuccuucuuccacaacaagaccggcugccagaucaccuucgacgacgacuacuccgccuacuggaucuacuucgucaacuuccucggcacccucgccguccuccccggcaacaucgucuccgcccuccucauggaccgcaucggccgccucaccaugcucggcggcuccaugguccucuccggcaucuccugcuucuuccucugguucggcaccuccgaguccaugaugaucggcaugcucugccucuacaacggccucaccaucuccgccuggaacucccucgacgucgucaccgucgagcucuaccccaccgaccgccgccgccgcguccuccccugcugccccggcuga

SEQ ID NO: 50379 - RNA, 10716 nt, Artificial Sequence
  derived and/or modified sequence opt2 from SVEP1__Homo_sapiens__NP_699197
auguggccccgccucgccuucugcugcuggggccucgcccucgucuccggcugggccaccuuccagcagaugucccccucccgcaacuucuccuuccgccucuuccccgagaccgcccccggcgcccccggcuccauccccgccccccccgcccccggcgacgaggccgccggcucccgcgucgagcgccucggccaggccuuccgccgccgcguccgccuccuccgcgagcucuccgagcgccucgagcucgucuuccucgucgacgacuccuccuccgucggcgaggucaacuuccgcuccgagcucauguucguccgcaagcuccucuccgacuuccccgucguccccaccgccacccgcgucgccaucgucaccuucuccuccaagaacuacgucgucccccgcgucgacuacaucuccacccgccgcgcccgccagcacaagugcgcccuccuccuccaggagauccccgccaucuccuaccgcggcggcggcaccuacaccaagggcgccuuccagcaggccgcccagauccuccuccacgcccgcgagaacuccaccaaggucgucuuccucaucaccgacggcuacuccaacggcggcgacccccgccccaucgccgccucccuccgcgacuccggcgucgagaucuucaccuucggcaucuggcagggcaacauccgcgagcucaacgacauggccuccacccccaaggaggagcacugcuaccuccuccacuccuucgaggaguucgaggcccucgcccgccgcgcccuccacgaggaccuccccuccggcuccuucauccaggacgacaugguccacugcuccuaccucugcgacgagggcaaggacugcugcgaccgcaugggcuccugcaagugcggcacccacaccggccacuucgagugcaucugcgagaagggcuacuacggcaagggccuccaguacgagugcaccgccugccccuccggcaccuacaagcccgagggcucccccggcggcaucuccuccugcauccccugccccgacgagaaccacaccuccccccccggcuccaccucccccgaggacugcgucugccgcgagggcuaccgcgccuccggccagaccugcgagcucguccacugccccgcccucaagccccccgagaacggcuacuucauccagaacaccugcaacaaccacuucaacgccgccugcggcguccgcugccaccccggcuucgaccucgucggcuccuccaucauccucugccuccccaacggccucugguccggcuccgaguccuacugccgcguccgcaccugcccccaccuccgccagcccaagcacggccacaucuccugcuccacccgcgagaugcucuacaagaccaccugccucgucgccugcgacgagggcuaccgccucgagggcuccgacaagcucaccugccagggcaacucccagugggacggccccgagccccgcugcgucgagcgccacugcuccaccuuccagaugcccaaggacgucaucaucuccccccacaacugcggcaagcagcccgccaaguucggcaccaucugcuacgucuccugccgccagggcuucauccucuccggcgucaaggagaugcuccgcugcaccaccuccggcaaguggaacgucggcguccaggccgccgucugcaaggacgucgaggccccccagaucaacugccccaaggacaucgaggccaagacccucgagcagcaggacuccgccaacgucaccuggcagauccccaccgccaaggacaacuccggcgagaaggucuccguccacguccaccccgccuucaccccccccuaccucuuccccaucggcgacgucgccaucgucuacaccgccaccgaccucuccggcaaccaggccuccugcaucuuccacaucaaggucaucgacgccgagccccccgucaucgacuggugccgcucccccccccccguccaggucuccgagaagguccacgccgccuccugggacgagccccaguucuccgacaacuccggcgccgagcucgucaucacccgcucccacacccagggcgaccucuucccccagggcgagaccaucguccaguacaccgccaccgaccccuccggcaacaaccgcaccugcgacauccacaucgucaucaagggcucccccugcgagauccccuucacccccgucaacggcgacuucaucugcacccccgacaacaccggcgucaacugcacccucaccugccucgagggcuacgacuucaccgagggcuccaccgacaaguacuacugcgccuacgaggacggcgucuggaagcccaccuacaccaccgaguggcccgacugcgccaagaagcgcuucgccaaccacggcuucaaguccuucgagauguucuacaaggccgcccgcugcgacgacaccgaccucaugaagaaguucuccgaggccuucgagaccacccucggcaagaugguccccuccuucugcuccgacgccgaggacaucgacugccgccucgaggagaaccucaccaagaaguacugccucgaguacaacuacgacuacgagaacggcuucgccaucggccccggcggcuggggcgccgccaaccgccucgacuacuccuacgacgacuuccucgacaccguccaggagaccgccaccuccaucggcaacgccaaguccucccgcaucaagcgcuccgccccccucuccgacuacaagaucaagcucaucuucaacaucaccgccuccgucccccuccccgacgagcgcaacgacacccucgagugggagaaccagcagcgccuccuccagacccucgagaccaucaccaacaagcucaagcgcacccucaacaaggaccccauguacuccuuccagcucgccuccgagauccucaucgccgacuccaacucccucgagaccaagaaggccucccccuucugccgccccggcuccguccuccgcggccgcaugugcgucaacugcccccucggcaccuacuacaaccucgagcacuucaccugcgaguccugccgcaucggcuccuaccaggacgaggagggccagcucgagugcaagcucugccccuccggcauguacaccgaguacauccacucccgcaacaucuccgacugcaaggcccagugcaagcagggcaccuacuccuacuccggccucgagaccugcgaguccugcccccucggcaccuaccagcccaaguucggcucccgcuccugccucuccugccccgagaacaccuccaccgucaagcgcggcgccgucaacaucuccgccugcggcguccccugccccgagggcaaguucucccgcuccggccucaugcccugccaccccugcccccgcgacuacuaccagcccaacgccggcaaggccuucugccucgccugccccuucuacggcaccacccccuucgccggcucccgcuccaucaccgagugcuccuccuucuccuccaccuucuccgccgccgaggaguccgucgucccccccgccucccucggccacaucaagaagcgccacgagaucuccucccaggucuuccacgagugcuucuucaaccccugccacaacuccggcaccugccagcagcucggccgcggcuacgucugccucugcccccucggcuacaccggccucaagugcgagaccgacaucgacgagugcuccccccuccccugccucaacaacggcgucugcaaggaccucgucggcgaguucaucugcgagugccccuccggcuacaccggccagcgcugcgaggagaacaucaacgagugcuccuccucccccugccucaacaagggcaucugcgucgacggcgucgccggcuaccgcugcaccugcgucaagggcuucgucggccuccacugcgagaccgaggucaacgagugccaguccaaccccugccucaacaacgccgucugcgaggaccaggucggcggcuuccucugcaagugcccccccggcuuccucggcacccgcugcggcaagaacgucgacgagugccucucccagcccugcaagaacggcgccaccugcaaggacggcgccaacuccuuccgcugccucugcgccgccggcuucaccggcucccacugcgagcucaacaucaacgagugccaguccaaccccugccgcaaccaggccaccugcgucgacgagcucaacuccuacuccugcaagugccagcccggcuucuccggcaagcgcugcgagaccgagcaguccaccggcuucaaccucgacuucgaggucuccggcaucuacggcuacgucaugcucgacggcaugcuccccucccuccacgcccucaccugcaccuucuggaugaaguccuccgacgacaugaacuacggcacccccaucuccuacgccgucgacaacggcuccgacaacacccuccuccucaccgacuacaacggcuggguccucuacgucaacggccgcgagaagaucaccaacugccccuccgucaacgacggccgcuggcaccacaucgccaucaccuggaccuccgccaacggcaucuggaaggucuacaucgacggcaagcucuccgacggcggcgccggccucuccgucggccuccccauccccggcggcggcgcccucguccucggccaggagcaggacaagaagggcgagggcuucucccccgccgaguccuucgucggcuccaucucccagcucaaccucugggacuacguccucuccccccagcaggucaagucccucgccaccuccugccccgaggagcucuccaagggcaacguccucgccuggcccgacuuccucuccggcaucgucggcaaggucaagaucgacuccaaguccaucuucugcuccgacugcccccgccucggcggcuccgucccccaccuccgcaccgccuccgaggaccucaagcccggcuccaaggucaaccucuucugcgaccccggcuuccagcucgucggcaaccccguccaguacugccucaaccagggccaguggacccagccccucccccacugcgagcgcaucuccugcggcgucccccccccccucgagaacggcuuccacuccgccgacgacuucuacgccggcuccaccgucaccuaccagugcaacaacggcuacuaccuccucggcgacucccgcauguucugcaccgacaacggcuccuggaacggcgucucccccuccugccucgacgucgacgagugcgccgucggcuccgacugcuccgagcacgccuccugccucaacgucgacggcuccuacaucugcuccugcgucccccccuacaccggcgacggcaagaacugcgccgagcccaucaagugcaaggcccccggcaaccccgagaacggccacuccuccggcgagaucuacaccgucggcgccgaggucaccuucuccugccaggagggcuaccagcucaugggcgucaccaagaucaccugccucgaguccggcgaguggaaccaccucauccccuacugcaaggccgucuccugcggcaagcccgccauccccgagaacggcugcaucgaggagcucgccuucaccuucggcuccaaggucaccuaccgcugcaacaagggcuacacccucgccggcgacaaggaguccuccugccucgccaacuccuccuggucccacuccccccccgucugcgagcccgucaagugcuccucccccgagaacaucaacaacggcaaguacauccucuccggccucaccuaccucuccaccgccuccuacuccugcgacaccggcuacucccuccagggccccuccaucaucgagugcaccgccuccggcaucugggaccgcgccccccccgccugccaccucgucuucugcggcgagccccccgccaucaaggacgccgucaucaccggcaacaacuucaccuuccgcaacaccgucaccuacaccugcaaggagggcuacacccucgccggccucgacaccaucgagugccucgccgacggcaaguggucccgcuccgaccagcagugccucgccgucuccugcgacgagccccccaucgucgaccacgccucccccgagaccgcccaccgccucuucggcgacaucgccuucuacuacugcuccgacggcuacucccucgccgacaacucccagcuccucugcaacgcccagggcaagugggucccccccgagggccaggacaugccccgcugcaucgcccacuucugcgagaagccccccuccgucuccuacuccauccucgaguccgucuccaaggccaaguucgccgccggcuccgucgucuccuucaagugcauggagggcuucguccucaacaccuccgccaagaucgagugcaugcgcggcggccaguggaaccccucccccauguccauccagugcauccccguccgcugcggcgagccccccuccaucaugaacggcuacgccuccggcuccaacuacuccuucggcgccauggucgccuacuccugcaacaagggcuucuacaucaagggcgagaagaaguccaccugcgaggccaccggccagugguccucccccauccccaccugccaccccgucuccugcggcgagccccccaaggucgagaacggcuuccucgagcacaccaccggccgcaucuucgaguccgagguccgcuaccagugcaaccccggcuacaaguccgucggcucccccgucuucgucugccaggccaaccgccacuggcacuccgaguccccccucaugugcgucccccucgacugcggcaagcccccccccauccagaacggcuucaugaagggcgagaacuucgaggucggcuccaagguccaguucuucugcaacgagggcuacgagcucgucggcgacuccuccuggaccugccagaaguccggcaaguggaacaagaaguccaaccccaagugcaugcccgccaagugccccgagcccccccuccucgagaaccagcucguccucaaggagcucaccaccgaggucggcgucgucaccuucuccugcaaggagggccacguccuccagggccccuccguccucaagugccuccccucccagcaguggaacgacuccuuccccgucugcaagaucguccucugcaccccccccccccucaucuccuucggcguccccauccccuccuccgcccuccacuucggcuccaccgucaaguacuccugcgucggcggcuucuuccuccgcggcaacuccaccacccucugccagcccgacggcaccugguccuccccccuccccgagugcguccccgucgagugcccccagcccgaggagauccccaacggcaucaucgacguccagggccucgccuaccucuccaccgcccucuacaccugcaagcccggcuucgagcucgucggcaacaccaccacccucugcggcgagaacggccacuggcucggcggcaagcccaccugcaaggccaucgagugccucaagcccaaggagauccucaacggcaaguucuccuacaccgaccuccacuacggccagaccgucaccuacuccugcaaccgcggcuuccgccucgagggccccuccgcccucaccugccucgagaccggcgacugggacgucgacgcccccuccugcaacgccauccacugcgacuccccccagcccaucgagaacggcuucgucgagggcgccgacuacuccuacggcgccaucaucaucuacuccugcuuccccggcuuccaggucgccggccacgccaugcagaccugcgaggaguccggcugguccuccuccauccccaccugcaugcccaucgacugcggccuccccccccacaucgacuucggcgacugcaccaagcucaaggacgaccagggcuacuucgagcaggaggacgacaugauggagguccccuacgucaccccccacccccccuaccaccucggcgccgucgccaagaccugggagaacaccaaggagucccccgccacccacuccuccaacuuccucuacggcaccauggucuccuacaccugcaaccccggcuacgagcuccucggcaaccccguccucaucugccaggaggacggcaccuggaacggcuccgcccccuccugcaucuccaucgagugcgaccuccccaccgcccccgagaacggcuuccuccgcuucaccgagaccuccaugggcuccgccguccaguacuccugcaagcccggccacauccucgccggcuccgaccuccgccucugccucgagaaccgcaagugguccggcgccuccccccgcugcgaggccaucuccugcaagaagcccaaccccgucaugaacggcuccaucaagggcuccaacuacaccuaccucuccacccucuacuacgagugcgaccccggcuacguccucaacggcaccgagcgccgcaccugccaggacgacaagaacugggacgaggacgagcccaucugcauccccgucgacugcuccuccccccccgucuccgccaacggccagguccgcggcgacgaguacaccuuccagaaggagaucgaguacaccugcaacgagggcuuccuccucgagggcgcccgcucccgcgucugccucgccaacggcuccugguccggcgccacccccgacugcguccccguccgcugcgccacccccccccagcucgccaacggcgucaccgagggccucgacuacggcuucaugaaggaggucaccuuccacugccacgagggcuacauccuccacggcgcccccaagcucaccugccaguccgacggcaacugggacgccgagaucccccucugcaagcccgucaacugcggcccccccgaggaccucgcccacggcuuccccaacggcuucuccuucauccacggcggccacauccaguaccagugcuuccccggcuacaagcuccacggcaacuccucccgccgcugccucuccaacggcuccugguccggcuccucccccuccugccuccccugccgcugcuccacccccgucaucgaguacggcaccgucaacggcaccgacuucgacugcggcaaggccgcccgcauccagugcuucaagggcuucaagcuccucggccucuccgagaucaccugcgaggccgacggccagugguccuccggcuucccccacugcgagcacaccuccugcggcucccuccccaugauccccaacgccuucaucuccgagaccuccuccuggaaggagaacgucaucaccuacuccugccgcuccggcuacgucauccagggcuccuccgaccucaucugcaccgagaagggcgucuggucccagcccuaccccgucugcgagccccucuccugcggcuccccccccuccgucgccaacgccgucgccaccggcgaggcccacaccuacgaguccgaggucaagcuccgcugccucgagggcuacaccauggacaccgacaccgacaccuucaccugccagaaggacggccgcugguuccccgagcgcaucuccugcucccccaagaagugcccccuccccgagaacaucacccacauccucguccacggcgacgacuucuccgucaaccgccaggucuccgucuccugcgccgagggcuacaccuucgagggcgucaacaucuccgucugccagcucgacggcaccugggagccccccuucuccgacgaguccugcucccccgucuccugcggcaagcccgagucccccgagcacggcuucgucgucggcuccaaguacaccuucgaguccaccaucaucuaccagugcgagcccggcuacgagcucgagggcaaccgcgagcgcgucugccaggagaaccgccagugguccggcggcgucgccaucugcaaggagacccgcugcgagaccccccucgaguuccucaacggcaaggccgacaucgagaaccgcaccaccggccccaacgucgucuacuccugcaaccgcggcuacucccucgagggccccuccgaggcccacugcaccgagaacggcaccuggucccaccccgucccccucugcaagcccaaccccugccccguccccuucgucauccccgagaacgcccuccucuccgagaaggaguucuacgucgaccagaacgucuccaucaagugccgcgagggcuuccuccuccagggccacggcaucaucaccugcaaccccgacgagaccuggacccagaccuccgccaagugcgagaagaucuccugcggcccccccgcccacgucgagaacgccaucgcccgcggcguccacuaccaguacggcgacaugaucaccuacuccugcuacuccggcuacaugcucgagggcuuccuccgcuccgucugccucgagaacggcaccuggaccuccccccccaucugccgcgccgucugccgcuuccccugccagaacggcggcaucugccagcgccccaacgccugcuccugccccgagggcuggaugggccgccucugcgaggagcccaucugcauccuccccugccucaacggcggccgcugcgucgcccccuaccagugcgacugcccccccggcuggaccggcucccgcugccacaccgccgucugccagucccccugccucaacggcggcaagugcguccgccccaaccgcugccacugccucuccuccuggaccggccacaacugcucccgcaagcgccgcaccggcuucuga

SEQ ID NO: 50380 - RNA, 5367 nt, Artificial Sequence
  derived and/or modified sequence opt2 from SVIL__Homo_sapiens__NP_003165
augaagcgcaaggagcgcaucgcccgccgccucgagggcaucgagaacgacacccagcccauccuccuccaguccugcaccggccucgucacccaccgccuccucgaggaggacaccccccgcuacaugcgcgccuccgaccccgccuccccccacaucggccgcuccaacgaggaggaggagaccuccgacuccucccucgagaagcagacccgcuccaaguacugcaccgagaccuccggcguccacggcgacucccccuacggcuccggcaccauggacacccacucccucgaguccaaggccgagcgcaucgcccgcuacaaggccgagcgccgccgccagcucgccgagaaguacggccucacccucgaccccgaggccgacuccgaguaccucucccgcuacaccaagucccgcaaggagcccgacgccgucgagaagcgcggcggcaaguccgacaagcaggaggaguccucccgcgacgccuccucccucuaccccggcaccgagaccaugggccuccgcaccugcgccggcgaguccaaggacuacgcccuccacgucggcgacggcuccuccgaccccgagguccuccucaacaucgagaaccagcgccgcggccaggagcucuccgccacccgccaggcccacgaccucucccccgccgccgaguccuccuccaccuucuccuucuccggccgcgacuccuccuucaccgaggucccccgcucccccaagcacgcccacuccuccucccuccagcaggccgccucccgcucccccuccuucggcgacccccagcucucccccgaggcccgcccccgcugcaccucccacuccgagacccccaccgucgacgacgaggagaaggucgacgagcgcgccaagcucuccgucgccgccaagcgccuccucuuccgcgagauggagaaguccuucgacgagcagaacguccccaagcgccgcucccgcaacaccgccgucgagcagcgccuccgccgccuccaggaccgcucccucacccagcccaucaccaccgaggaggucgucaucgccgccacccuccaggccuccgcccaccagaaggcccucgccaaggaccagaccaacgagggcaaggagcucgccgagcagggcgagcccgacuccuccacccucucccucgccgagaagcucgcccucuucaacaagcucucccagcccgucuccaaggccaucuccacccgcaaccgcaucgacacccgccagcgccgcaugaacgcccgcuaccagacccagcccgucacccucggcgaggucgagcagguccaguccggcaagcucauccccuucucccccgccgucaacaccuccgucuccaccgucgccuccaccgucgcccccauguacgccggcgaccuccgcaccaagcccccccucgaccacaacgccuccgccaccgacuacaaguucuccuccuccaucgagaacuccgacucccccguccgcuccauccucaagucccaggccuggcagccccucgucgagggcuccgagaacaagggcaugcuccgcgaguacggcgagaccgaguccaagcgcgcccucaccggccgcgacuccggcauggagaaguacggcuccuucgaggaggccgaggccuccuaccccauccucaaccgcgcccgcgagggcgacucccacaaggaguccaaguacgccgucccccgccgcggcucccucgagcgcgccaacccccccaucacccaccucggcgacgagcccaaggaguucuccauggccaagaugaacgcccagggcaaccucgaccuccgcgaccgccuccccuucgaggagaaggucgaggucgagaacgucaugaagcgcaaguucucccuccgcgccgccgaguucggcgagcccaccuccgagcagaccggcaccgccgccggcaagaccaucgcccagaccaccgcccccgucuccuggaagccccaggacuccuccgagcagccccaggagaagcucugcaagaaccccugcgccauguucgccgccggcgagaucaagacccccaccggcgagggccuccucgacucccccuccaagaccauguccaucaaggagcgccucgcccuccucaagaaguccggcgaggaggacuggcgcaaccgccucucccgccgccaggagggcggcaaggcccccgccuccucccuccacacccaggaggccggccgcucccucaucaagaagcgcgucaccgagucccgcgagucccagaugaccaucgaggagcgcaagcagcucaucaccguccgcgaggaggccuggaagacccgcggccgcggcgccgccaacgacuccacccaguucaccgucgccggccgcauggucaagaagggccucgccucccccaccgccaucacccccgucgccucccccaucugcggcaagacccgcggcaccacccccgucuccaagccccucgaggacaucgaggcccgccccgacaugcagcucgaguccgaccucaagcucgaccgccucgagaccuuccuccgccgccucaacaacaaggucggcggcaugcacgagaccguccucaccgucaccggcaaguccgucaaggaggucaugaagcccgacgacgacgagaccuucgccaaguucuaccgcuccgucgacuacaacaugccccgcucccccgucgagauggacgaggacuucgacgucaucuucgaccccuacgcccccaagcucaccuccuccgucgccgagcacaagcgcgccguccgccccaagcgccgcguccaggccuccaagaacccccucaagaugcucgccgcccgcgaggaccuccuccaggaguacaccgagcagcgccucaacgucgccuucauggaguccaagcgcaugaaggucgagaagauguccuccaacuccaacuucuccgaggucacccucgccggccucgccuccaaggagaacuucuccaacgucucccuccgcuccgucaaccucaccgagcagaacuccaacaacuccgccguccccuacaagcgccucaugcuccuccagaucaagggccgccgccacguccagacccgccucgucgagccccgcgccuccgcccucaacuccggcgacugcuuccuccuccucuccccccacugcugcuuccucugggucggcgaguucgccaacgucaucgagaaggccaaggccuccgagcucgccacccucauccagaccaagcgcgagcucggcugccgcgccaccuacauccagaccaucgaggagggcaucaacacccacacccacgccgccaaggacuucuggaagcuccucggcggccagaccuccuaccaguccgccggcgaccccaaggaggacgagcucuacgaggccgccaucaucgagaccaacugcaucuaccgccucauggacgacaagcucguccccgacgacgacuacuggggcaagauccccaagugcucccuccuccagcccaaggagguccucgucuucgacuucggcuccgaggucuacgucuggcacggcaaggaggucacccucgcccagcgcaagaucgccuuccagcucgccaagcaccucuggaacggcaccuucgacuacgagaacugcgacaucaacccccucgaccccggcgagugcaacccccucaucccccgcaagggccagggccgccccgacugggccaucuucggccgccucaccgagcacaacgagaccauccucuucaaggagaaguuccucgacuggaccgagcucaagcgcuccaacgagaagaaccccggcgagcucgcccagcacaaggaggacccccgcaccgacgucaaggccuacgacgucacccgcauggucuccaugccccagaccaccgccggcaccauccucgacggcgucaacgucggccgcggcuacggccucgucgagggccacgaccgccgccaguucgagaucaccuccgucuccgucgacgucuggcacauccucgaguucgacuacucccgccuccccaagcaguccaucggccaguuccacgagggcgacgccuacgucgucaaguggaaguucauggucuccaccgccgucggcucccgccagaagggcgagcacuccguccgcgccgccggcaaggagaagugcgucuacuucuucuggcagggccgccacuccaccgucuccgagaagggcaccuccgcccucaugaccgucgagcucgacgaggagcgcggcgcccagguccagguccuccagggcaaggagccccccugcuuccuccagugcuuccagggcggcauggucguccacuccggccgccgcgaggaggaggaggagaacguccaguccgaguggcgccucuacugcguccgcggcgagguccccgucgagggcaaccuccucgaggucgccugccacugcuccucccuccgcucccgcaccuccauggucguccucaacgucaacaaggcccucaucuaccucuggcacggcugcaaggcccaggcccacaccaaggaggucggccgcaccgccgccaacaagaucaaggagcagugcccccucgaggccggccuccacuccuccuccaaggucaccauccacgagugcgacgagggcuccgagccccucggcuucugggacgcccucggccgccgcgaccgcaaggccuacgacugcaugcuccaggaccccggcuccuucaacuucgccccccgccucuucauccucuccuccuccuccggcgacuucgccgccaccgaguucgucuaccccgcccgcgcccccuccgucgucuccuccaugcccuuccuccaggaggaccucuacuccgccccccagcccgcccucuuccucgucgacaaccaccacgaggucuaccucuggcagggcugguggcccaucgagaacaagaucaccggcuccgcccgcauccgcugggccuccgaccgcaaguccgccauggagaccguccuccaguacugcaagggcaagaaccucaagaagcccgcccccaaguccuaccucauccacgccggccucgagccccucaccuucaccaacauguuccccuccugggagcaccgcgaggacaucgccgagaucaccgagauggacaccgaggucuccaaccagaucacccucgucgaggacguccucgccaagcucugcaagaccaucuacccccucgccgaccuccucgcccgcccccuccccgagggcgucgacccccucaagcucgagaucuaccucaccgacgaggacuucgaguucgcccucgacaugacccgcgacgaguacaacgcccuccccgccuggaagcaggucaaccucaagaaggccaagggccucuucuga

SEQ ID NO: 50381 - RNA, 234 nt, Artificial Sequence
  derived and/or modified sequence opt2 from SVIP__Homo_sapiens__NP_683691
augggccucugcuuccccugccccggcgaguccgccccccccacccccgaccucgaggagaagcgcgccaagcucgccgaggccgccgagcgccgccagaaggaggccgccucccgcggcauccucgacguccaguccguccaggagaagcgcaagaagaaggagaagaucgagaagcagaucgccaccuccggccccccccccgagggcggccuccgcuggaccgucuccuga

SEQ ID NO: 50382 - RNA, 1647 nt, Artificial Sequence
  derived and/or modified sequence opt2 from SVOP__Homo_sapiens__NP_061181
auggaggaggaccucuuccagcuccgccagcuccccgucgucaaguuccgccgcaccggcgaguccgcccgcuccgaggacgacaccgccuccggcgagcacgagguccagaucgagggcguccacgucggccucgaggccgucgagcucgacgacggcgccgccguccccaaggaguucgccaaccccaccgacgacaccuucauggucgaggacgccgucgaggccaucggcuucggcaaguuccaguggaagcucuccguccucaccggccucgccuggauggccgacgccauggagaugaugauccucuccauccucgccccccagcuccacugcgaguggcgccuccccuccuggcaggucgcccuccucaccuccgucgucuucgucggcaugauguccuccuccacccucuggggcaacaucuccgaccaguacggccgcaagaccggccucaagaucuccguccucuggacccucuacuacggcauccucuccgccuucgcccccgucuacuccuggauccucguccuccgcggccucgucggcuucggcaucggcggcgucccccaguccgucacccucuacgccgaguuccuccccaugaaggcccgcgccaagugcauccuccucaucgaggucuucugggccaucggcaccgucuucgaggucguccucgccgucuucgucaugcccucccucggcuggcgcuggcuccucauccucuccgccgucccccuccuccucuucgccguccucugcuucuggcuccccgaguccgcccgcuacgacguccucuccggcaaccaggagaaggccaucgccacccucaagcgcaucgccaccgagaacggcgcccccaugccccucggcaagcucaucaucucccgccaggaggaccgcggcaagaugcgcgaccucuucaccccccacuuccgcuggaccacccuccuccucugguucaucugguucuccaacgccuucuccuacuacggccucguccuccucaccaccgagcucuuccaggccggcgacgucugcggcaucuccucccgcaagaaggccgucgaggccaagugcucccucgccugcgaguaccucuccgaggaggacuacauggaccuccucuggaccacccucuccgaguuccccggcguccucgucacccucuggaucaucgaccgccucggccgcaagaagaccauggcccucugcuucgucaucuucuccuucugcucccuccuccucuucaucugcgucggccgcaacguccucacccuccuccucuucaucgcccgcgccuucaucuccggcggcuuccaggccgccuacgucuacacccccgaggucuaccccaccgccacccgcgcccucggccucggcaccugcuccggcauggcccgcgucggcgcccucaucacccccuucaucgcccaggucaugcucgaguccuccgucuaccucacccucgccgucuacuccggcugcugccuccucgccgcccucgccuccugcuuccuccccaucgagaccaagggccgcggccuccaggaguccucccaccgcgaguggggccaggagauggucggccgcggcaugcacggcgccggcgucacccgcuccaacuccggcucccaggaguga

SEQ ID NO: 50383 - RNA, 1758 nt, Artificial Sequence
  derived and/or modified sequence opt2 from SWAP70__Homo_sapiens__NP_055870
augggcucccucaaggaggagcuccucaaggccaucuggcacgccuucaccgcccucgaccaggaccacuccggcaaggucuccaagucccagcucaagguccucucccacaaccucugcaccguccucaaggucccccacgaccccgucgcccucgaggagcacuuccgcgacgacgacgagggccccgucuccaaccagggcuacaugcccuaccucaaccgcuucauccucgagaagguccaggacaacuucgacaagaucgaguucaaccgcaugugcuggacccucugcgucaagaagaaccucaccaagaacccccuccucaucaccgaggaggacgccuucaagaucugggucaucuucaacuuccucuccgaggacaaguacccccucaucaucgucuccgaggagaucgaguaccuccucaagaagcucaccgaggccaugggcggcggcuggcagcaggagcaguucgagcacuacaagaucaacuucgacgacuccaagaacggccucuccgccugggagcucaucgagcucaucggcaacggccaguucuccaagggcauggaccgccagaccgucuccauggccaucaacgaggucuucaacgagcucauccucgacguccucaagcagggcuacaugaugaagaagggccaccgccgcaagaacuggaccgagcgcugguucguccucaagcccaacaucaucuccuacuacgucuccgaggaccucaaggacaagaagggcgacauccuccucgacgagaacugcugcgucgagucccuccccgacaaggacggcaagaagugccucuuccucgucaagugcuucgacaagaccuucgagaucuccgccuccgacaagaagaagaagcaggaguggauccaggccauccacuccaccauccaccuccucaagcucggcuccccccccccccacaaggaggcccgccagcgccgcaaggagcuccgcaagaagcagcucgccgagcaggaggagcucgagcgccagaugaaggagcuccaggccgccaacgaguccaagcagcaggagcucgaggccguccgcaagaagcucgaggaggccgccucccgcgccgccgaggaggagaagaagcgccuccagacccaggucgagcuccaggcccgcuucuccaccgagcucgagcgcgagaagcucauccgccagcagauggaggagcaggucgcccagaaguccuccgagcucgagcaguaccuccagcgcguccgcgagcucgaggacauguaccucaagcuccaggaggcccucgaggacgagcgccaggcccgccaggacgaggagaccguccgcaagcuccaggcccgccuccucgaggaggaguccuccaagcgcgccgagcucgagaaguggcaccucgagcagcagcaggccauccagaccaccgaggccgagaagcaggagcucgagaaccagcgcguccucaaggagcaggcccuccaggaggccauggagcagcucgagcagcucgagcucgagcgcaagcaggcccucgagcaguacgaggaggucaagaagaagcucgagauggccaccaacaagaccaaguccuggaaggacaaggucgcccaccacgagggccucauccgccucaucgagcccggcuccaagaacccccaccucaucaccaacuggggccccgccgccuucaccgaggccgagcucgaggagcgcgagaagaacuggaaggagaagaagaccaccgaguga

SEQ ID NO: 50384 - RNA, 2703 nt, Artificial Sequence
  derived and/or modified sequence opt2 from SWT1__Homo_sapiens__NP_060143
auguccuccaaggaguccugcggcaagaaggagaccucccagcgcaaggacaccaccaccuccucccccaacuucggcgagaaggacaagaaggagcgcaagacccccgccuccuccaccuccuccuccuccauccgcuccgucuccuccgagaagcgcaagcucaaguccgaccacaccgacguccucuacuacaacaucaagcgccgccagggccucaagcgccucuccgucgagaucgacacccuccgccgccgccccaagaucggcuccuccucccagcgccccaucaagcucaaggaggccuccuacuccaacgacaaccagaucauccuccagucccccuccuccaacggcaccaagaaggacauccacaagugcgucgacuucaagcccaaggacaucaagcucaccaacgccggcuccaagcucgaccacggcaucaagucccucuccucccccaagaucgccuccgacgucaagcccaaggccgagggccaggccuccgagaacaaguggucccaccuccucguccagcgcgagaagaugaaggagcucaagaagggccgcaacuccaaguuccgcgacaacuccgagaagugcguccucgagaaguggaagcgcaaccaguucucccaggacuacaacuccaacaagaucaucaaggagccccucggcucccgccgccagaagaucuccuucaagauccccaucaagucccgcgacacccuccagaagcucgucgaggagaacgucuucaacaucgacuccaacaacuccaagaccaagcaggaggagcgcgaguaccucgaguccucccaggucucccucaacgucacccgccagaagaccgagcaccuccucuccgacuucaccuacaagcgcaccguccacgaguggaagcgcaagcaccacuacgaccaccaggaguccaacgacucccacucccgcgagaaccucacccaguccuucgaggcccccugcugcuccgucuccuccgaguccauccaggacgccgaccaggagaugcagaucgucgaggagcuccacgccgcccgcgucggcaaguccgucgaccuccccggcgagcucauguccauggagaucgaccucgaggacgacguccacuccuccuccgccaacaacaccuccgaccgcaagcuccucaucgucaucgacaccaacauccucaugaaccaccucaaguucguccgcauccucaagaccaccgagguccccggcuucgacaagcucguccucaucauccccugggucgucaugcaggagcucgaccgcaugaaggagggcaagcuccucaagcgcgcccagcacaaggccauccccgccguccacuucaucaacgacucccucaagaaccaggaccgcaagcucuggggccaguccauccagcucgccucccagaagcacuacggccucuccgacgagaacaacgacgaccgcguccucaagugcugccuccagcaccaggagcucuuccccugcuccuucgucauccucugcaccgacgaccgcaaccuccgcaacaagggccucaucuccggcgucaagucccucuccaaggaggagcucuccgccgagcuccuccaccucucccucaacaccgacgucugccaccagcccugcauccccaagcagcagcucaaggccgagaccaccccccucaaggaguccuacaaggaggaguccaccaacuccggccucuccauccuccucgaguccaucgucuccgaccucgagaagucccucggcaccggccucuccuccauccucgagaccgagaugaagaucgccuucggcaaccucuggauggagauccucuaccucaagccccccuggacccuccuccaccuccuccagugcuucaagaagcacuggcucgccgucuucggccucgucauggagaagaaccuccuccucaccaucgagucccucuacaagaaccuccgcaaggccaacaaggccgucgacuucaccaccgucaaguuccuccuccaggacucccgcucccuccuccacgccuucuccacccgcuccaacuacgacggcauccucccccagaccuucgcccaggucaacaaccuccuccagaccuucgccgaggucaagaccaagcucaagcccaacuccuccgagaacaccgucaccaagaagcaggagggcaccucccucaagaacucccacaaccaggagaucaccgucuucuccuccucccaccucccccagcccucccgccaccaggagaucugguccauccucgaguccgucuggaucaccaucuaccagaacuccaccgacgucuuccagcgccucggcuccaacuccgcccucaccaccuccaacaucgccuccuucgaggaggccuucaucugccuccagaagcucauggccgccguccgcgacauccucgagggcauccagcgcauccucgcccccaacuccaacuaccaggacgucgagacccucuacaacuuccucaucaaguacgaggucaacaagaacgucaaguucaccgcccaggagaucuacgacugcgucucccagaccgaguaccgcgagaagcucaccaucggcugccgccagcucgucgagauggaguacaccaugcagcagugcaacgccuccgucuacauggaggccaagaaccgcggcuggugcgaggacaugcucaacuaccgcaucuga

SEQ ID NO: 50385 - RNA, 1989 nt, Artificial Sequence
  derived and/or modified sequence opt2 from SYBU__Homo_sapiens__NP_001093213
augggcccccuccgcgaguccaaggagcaccgcguccagcaccacgacaaggagaucucccgcucccgcaucccccgccucauccuccgcccccacaugccccagcagcagcacaaggucucccccgccuccgagucccccuucuccgaggaggagucccgcgaguucaaccccuccuccuccggccgcuccgcccgcaccgucuccuccaacuccuucugcuccgacgacaccggcugccccuccucccaguccgucucccccgucaagacccccuccgacgccggcaacucccccaucggcuucugccccggcuccgacgagggcuucacccgcaagaagugcaccaucggcauggucggcgagggcuccauccaguccucccgcuacaagaaggaguccaaguccggccucgucaagcccggcuccgaggccgacuucuccuccuccuccuccaccggcuccaucuccgcccccgagguccacauguccaccgccggcuccaagcgcuccuccuccucccgcaaccgcggcccccacggccgcuccaacggcgccuccucccacaagcccggcuccucccccuccuccccccgcgagaaggaccuccucuccaugcucugccgcaaccagcucucccccgucaacauccaccccuccuacgcccccuccucccccuccuccuccaacuccggcuccuacaagggcuccgacugcucccccaucaugcgccgcuccggccgcuacauguccugcggcgagaaccacggcguccgcccccccaaccccgagcaguaccucaccccccuccagcagaaggaggucaccguccgccaccucaagaccaagcucaaggaguccgagcgccgccuccacgagcgcgaguccgagaucgucgagcucaagucccagcucgcccgcaugcgcgaggacuggaucgaggaggagugccaccgcgucgaggcccagcucgcccucaaggaggcccgcaaggagaucaagcagcucaagcaggucaucgagaccaugcgcuccucccucgccgacaaggacaagggcauccagaaguacuucgucgacaucaacauccagaacaagaagcucgagucccuccuccaguccauggagauggcccacuccggcucccuccgcgacgagcucugccucgacuuccccugcgacucccccgagaagucccucacccucaaccccccccucgacaccauggccgacggccucucccucgaggagcaggucaccggcgagggcgccgaccgcgagcuccucgucggcgacuccaucgccaacuccaccgaccucuucgacgagaucgucaccgccaccaccaccgaguccggcgaccucgagcucguccacuccacccccggcgccaacguccucgagcuccuccccaucgucaugggccaggaggagggcuccgucgucgucgagcgcgccguccagaccgacgucguccccuacucccccgccaucuccgagcucauccaguccguccuccagaagcuccaggaccccugccccuccucccucgccucccccgacgaguccgagcccgacuccauggaguccuuccccgagucccucuccgcccucgucgucgaccucaccccccgcaaccccaacuccgccauccuccucucccccgucgagacccccuacgccaacgucgacgccgagguccacgccaaccgccucaugcgcgagcucgacuucgccgccugcgucgaggagcgccucgacggcgucaucccccucgcccgcggcggcgucguccgccaguacugguccuccuccuuccucgucgaccuccucgccgucgccgcccccgucguccccaccguccucugggccuucuccacccagcgcggcggcaccgaccccgucuacaacaucggcgcccuccuccgcggcugcugcgucgucgcccuccacucccuccgccgcaccgccuuccgcaucaagaccuga

SEQ ID NO: 50386 - RNA, 957 nt, Artificial Sequence
  derived and/or modified sequence opt2 from SYCE1__Homo_sapiens__NP_001137235
auggccggccgcucccucaccuccaaggccgagcccaccgccggcgccgucgaccgcgccgagaaggccggcggccaggacaccuccucccagaagaucgaggaccucauggagaugguccagaagcuccagaaggucggcucccucgagccccgcgucgagguccucaucaaccgcaucaacgagguccagcaggccaagaagaaggccaacaaggaccucggcgaggcccgcaccaucugcgaggcccuccagaaggagcucgacucccuccacggcgagaagguccaccucaaggagauccucuccaagaagcaggagacccuccgcauccuccgccuccacugccaggagaaggaguccgaggcccaccgcaagcacaccaugcuccaggagugcaaggagcgcaucuccgcccucaaccuccagaucgaggaggagaagaacaagcagcgccagcuccgccucgccuucgaggagcagcucgaggaccucaugggccagcacaaggaccucugggacuuccacaugcccgagcgccucgccaaggagaucugcgcccucgacuccuccaaggagcagcuccucaaggaggagaagcucgucaaggccacccucgaggacgucaagcaccagcucugcucccucugcggcgccgagggccccuccacccucgacgagggccucuuccuccgcucccaggaggccgccgccaccguccagcucuuccaggaggagcaccgcaaggccgaggagcuccucgccgccgccgcccagcgccaccagcagcuccagcagaagugccagcagcagcagcagaagcgccagcgccucaaggaggagcucgagaagcacggcaugcagguccccgcccaggcccaguccacccaggaggaggaggccggccccggcgacgucgccccccgccccggccgccccgucaccuggugguccuga

SEQ ID NO: 50387 - RNA, 729 nt, Artificial Sequence
  derived and/or modified sequence opt2 from SYCE1L__Homo_sapiens__NP_001123451
auggccggcaagcucaagccccucaacgucgaggcccccgaggccaccgaggaggccgagggccaggccaagucccucaagaccgaggaccuccucgccauggucaucaagcuccagaaggagggcucccucgagccccagaucgaggaccucaucucccgcaucaacgaccuccagcaggccaagaagaaguccuccgaggagcuccgcgagacccacucccucugggaggcccuccaccgcgagcucgacucccucaacggcgagaagguccaccucgaggagguccucggcaagaagcaggaggcccuccgcauccuccagaugcacugccaggagaaggaguccgaggcccagcgccucgacguccgcggccagcucgaggaccucaugggccagcacaaggaccucugggaguuccacaugcucgagcagcgccucgcccgcgagauccgcgcccucgagcgcuccaaggagcagcuccucuccgagcgccgccucguccgcgccaagcuccgcgaggucgagcgccgccuccacuccccccccgaggucgagggcgccauggccgucaacgacggccucaaggccgagcucgagaucuucggcgagcagguccgcuccgcccccgaggucggcgccggcgagggcgaggccggccccgagcucccccgcgcccgcgacgaggaggaccccgagccccccgucgccgcccccgacgcccucuga

SEQ ID NO: 50388 - RNA, 4593 nt, Artificial Sequence
  derived and/or modified sequence opt2 from SYCP2__Homo_sapiens__NP_055073
augcccauccgccccgaccuccagcagcucgagaagugcaucgacgacgcccuccgcaagaacgacuucaagccccucaagacccuccuccagaucgacaucugcgaggacgucaagaucaagugcuccaagcaguucuuccacaaggucgacaaccucaucugccgcgagcucaacaaggaggacauccacaacgucuccgccauccucgucuccgucggccgcugcggcaagaacaucuccguccucggccaggccggccuccucaccaugaucaagcagggccucauccagaagauggucgccugguucgagaaguccaaggacaucauccagucccagggcaacuccaaggacgaggccguccucaacaugaucgaggaccucgucgaccuccuccucgucauccacgacgucuccgacgagggcaagaagcaggucgucgaguccuucgucccccgcaucugcucccucgucaucgacucccgcgucaacaucugcauccagcaggagaucaucaagaagaugaacgccaugcucgacaagaugccccaggacgcccgcaagauccucuccaaccaggagaugcucauccucauguccuccaugggcgagcgcauccucgacgccggcgacuacgaccuccaggucggcaucgucgaggcccucugccgcaugaccaccgagaagcagcgccaggagcucgcccaccagugguucuccauggacuucaucgccaaggccuucaagcgcaucaaggacuccgaguucgagaccgacugccgcaucuuccucaaccucgucaacggcaugcucggcgacaagcgccgcgucuucaccuuccccugccucuccgccuuccucgacaaguacgagcuccagauccccuccgacgagaagcucgaggaguucuggaucgacuucaaccucggcucccagacccucuccuucuacaucgccggcgacaacgacgaccaccagugggaggccgucaccguccccgaggagaagguccagaucuacuccaucgagguccgcgaguccaagaagcuccucaccaucauccucaagaacaccgucaagaucuccaagcgcgagggcaaggagcuccuccucuacuucgacgccucccucgagaucaccaacgucacccagaagaucuucggcgccaccaagcaccgcgaguccauccgcaagcagggcaucuccgucgccaagaccucccuccacauccucuucgacgccuccggcucccagauccucguccccgagucccagaucucccccgucggcgaggagcucgucucccucaaggagaaguccaagucccccaaggaguucgccaagcccuccaaguacaucaagaacuccgacaagggcaaccgcaacaacucccagcucgagaagaccacccccuccaagcgcaagauguccgaggccuccaugaucgucuccggcgccgaccgcuacaccaugcgcucccccguccucuucuccaacaccuccauccccccccgccgccgccgcaucaagcccccccuccagaugaccuccuccgccgagaagcccuccgucucccagaccuccgagaaccgcgucgacaacgccgccucccucaagucccgcuccuccgagggccgccaccgccgcgacaacaucgacaagcacaucaagaccgccaagugcgucgagaacaccgagaacaagaacgucgaguuccccaaccagaacuucuccgagcuccaggacgucauccccgacucccaggccgccgagaagcgcgaccacaccauccuccccggcguccucgacaacaucugcggcaacaagauccacuccaagugggccugcuggacccccgucaccaacaucgagcucugcaacaaccagcgcgccuccaccuccuccggcgacacccucaaccaggacaucgucaucaacaagaagcucaccaagcagaaguccuccuccuccaucuccgaccacaacuccgagggcaccggcaaggucaaguacaagaaggagcagaccgaccacaucaagaucgacaaggccgaggucgaggucugcaagaagcacaaccagcagcagaaccaccccaaguacuccggccagaagaacaccgagaacgccaagcaguccgacuggcccgucgaguccgagaccaccuucaaguccguccuccucaacaagaccaucgaggagucccucaucuaccgcaagaaguacauccucuccaaggacgucaacaccgccaccugcgacaagaaccccuccgccuccaagaacguccagucccaccgcaaggccgagaaggagcucaccuccgagcucaacuccugggacuccaagcagaagaagaugcgcgagaaguccaagggcaaggaguucaccaacgucgccgagucccucaucucccagaucaacaagcgcuacaagaccaaggacgacaucaaguccacccgcaagcucaaggagucccucaucaacuccggcuucuccaacaagcccgucguccagcucuccaaggagaagguccagaagaaguccuaccgcaagcucaagaccaccuucgucaacgucaccuccgagugccccgucaacgacgucuacaacuucaaccucaacggcgccgacgaccccaucaucaagcucggcauccaggaguuccaggccaccgccaaggaggccugcgccgaccgcuccauccgccucgucggcccccgcaaccacgacgagcucaaguccuccgucaagaccaaggacaagaagaucaucaccaaccaccagaagaagaaccucuucuccgacaccgagaccgaguaccgcugcgacgacuccaagaccgacaucuccuggcuccgcgagcccaaguccaagccccagcucaucgacuacucccgcaacaagaacgucaagaaccacaaguccggcaagucccgcuccucccucgagaagggccagcccuccuccaagaugacccccuccaagaacaucaccaagaagauggacaagaccauccccgagggccgcauccgccucccccgcaaggccaccaagaccaagaagaacuacaaggaccucuccaacuccgaguccgagugcgagcaggaguucucccacuccuucaaggagaacauccccgucaaggaggagaacauccacucccgcaugaagaccgucaagcuccccaagaagcagcagaaggucuucugcgccgagaccgagaaggagcucuccaagcaguggaagaacuccucccuccucaaggacgccauccgcgacaacugccucgaccucuccccccgcucccucuccggcucccccuccuccaucgaggucacccgcugcaucgagaagaucaccgagaaggacuucacccaggacuacgacugcaucaccaaguccaucucccccuaccccaagaccuccucccucgagucccucaacuccaacuccggcgucggcggcaccaucaagucccccaagaacaacgagaagaacuuccucugcgccuccgaguccugcucccccaucccccgcccccucuuccucccccgccacacccccaccaaguccaacaccaucgucaaccgcaagaagaucuccucccucguccucacccaggagacccagaacuccaacuccuacuccgacgucuccuccuacuccuccgaggagcgcuucauggagaucgaguccccccacaucaacgagaacuacauccaguccaagcgcgaggagucccaccucgccuccucccucuccaaguccuccgagggccgcgagaagaccugguucgacaugcccugcgacgccacccacgucuccggccccacccagcaccucucccgcaagcgcaucuacaucgaggacaaccucuccaacuccaacgaggucgagauggaggagaagggcgagcgccgcgccaaccuccuccccaagaagcucugcaagaucgaggacgccgaccaccacauccacaagauguccgaguccgucuccucccucuccaccaacgacuucuccauccccugggagaccuggcagaacgaguucgccggcaucgagaugaccuacgagaccuacgagcgccucaacuccgaguucaagcgccgcaacaacauccgccacaagaugcucuccuacuucaccacccaguccuggaagaccgcccagcagcaccuccgcaccaugaaccaccagucccaggacucccgcaucaagaagcucgacaaguuccaguucaucaucaucgaggagcucgagaacuucgagaaggacucccagucccucaaggaccucgagaaggaguucgucgacuucugggagaagaucuuccagaaguucuccgccuaccagaaguccgagcagcagcgccuccaccuccucaagaccucccucgccaaguccgucuucugcaacaccgacuccgaggagaccgucuucaccuccgagaugugccucaugaaggaggacaugaagguccuccaggaccgccuccucaaggacaugcucgaggaggagcuccucaacguccgccgcgagcucauguccgucuucaugucccacgagcgcaacgccaacgucuga

SEQ ID NO: 50389 - RNA, 2439 nt, Artificial Sequence
  derived and/or modified sequence opt2 from SYCP2L__Homo_sapiens__NP_001035364
augcaggccaagaacaaggacgcccuccagcccaucaaggaggaccgcaccggcaaggcccaggacgacgccuucuggcuccagucccucaucaccgacgccuuccacgacaagggcuuccagaagaucaaggaguacuuccagcagaaggagucccacuucccccagaaguacaaccgccuccuccucuaccgccucgaccgcuccaucaacaaggagcucgacaagaacgaguuccaguccgucucccuccuccucaagugcauccagcgcuuccucgucgacggccucaaggaggacgagccccuccucauccgccagggccucauccccaagcucgucuccugguucgagcgcaccaccggcauccucaccuccgagggccucgccuccgacaccucccucaucugcgucaucgaggacuucuucgacaccgcccucaucaucucccgcuccuccuccgagggcaagauccagaugcucgacuccuuccuccucucccucggcuuccucgucaccgagaagaccgucaaccaccuccuccagcaggagggccucaagaccuucaacugcauccuccacgccgucccccgcgaggagcgcaagaaguucccccucuccgagggcaugugccaccucaugaaggaccucgcccgcacccuccucaccgucggcgacuacgaccagcaggucgccaucuccgaggcccucugccgccucaccaucaagaagucccgcgacgagcucguccacaagugguucgacgacgaggucaucgccgaggccuucaaggagaucaaggaccgcgaguucgagaccgacucccgccgcuuccucaaccaccucaacaaccgccucggcgaccagcgccgcgucuacuccuuccccugcaucgccgccuucgccgacgagcacgagaugcgcaagcccgccgacgagaagcucgagaaguucuggaucgacuucaaccucggcucccaguccgucaccuucuacaucgacaacgccgagaacacccucugggacuccgucacccuccccaaggaggccgucaugaacuucuccaucaccgagaccgagaagaucaagaucuucaucaucuaccucaagaagcccaugaucaucuccuacaaggaggucaugaagaucgagauccacuucgaccuccaguucaacaucucccaggucuccauccaggcccucggcgaggacaagcagaugcuccccgaccagaccaagaucuccuccgagcucuucuccaaguccgacaaggaggaccgcgagucccccuccggccucgagcgcgagaccgagcaggccgaggaguccaccaacauggucgaguucauguccgccgaggacgaccgcugccucaucacccuccaccucaacgaccaguccgagccccccgucaucggcgagcccgccuccgacucccaccuccagcccgucccccccuucggcguccccgacuucccccagcagcccaagucccacuaccgcaagcaccucuucuccgaguccaaccaggacuccuccaccuccgagcucuccuggaccuccaaccagaagaagaagucccucaaguccuacuccucccgcaagaagacccgcacccgcuccaaccuccgcauccuccccgucuucccccccuccuccggcuccggccacgagaaggaccaggccaagcuccucucccccuccgagaaggagauccccgagcagaacaacaccaccucccccaagaccuccgagcagaaguuccaggacuccuucgccuuccucaccgccgaggacuccgcccagaagaccgagcuccaggacccccacucccucuccgagcucuccucccucaagcacuccgaggacgaggagaagcccaagaucgucaaccaggagucccucaccgaguccaccucccucaagcacaagcuccgcaaccucgaggacaaggacauccccgagggcuccuucgccaagucccagcagucccgccucgaggaggaggucgcccccggcucccccuucuccaucaccgaggagcgcgagcuccccgagggcaucuccaccuccucccucgaggucguccccgagaaccucaacggcuccgccauccuccccaccuucgagaacuucaccaagaagcgcaagcgcaaguacgagcuccgcuaccgcaagcgccccuucaacuccgagaacgccaagaaggcccccgacugccucaucaagcuccucaaccagaugcagcucuuccgccucaacaagcucgagcgcuuccagaaccucguccuccaggagcucuccucccucaagcaggacauccaggcccucgagcaccucgagaaggagguccucgaguucuggggcaagcaguccgccgaccuccaguccuucugcgaccuccagguccuccgcuucaacuccacccagaccuccuga

SEQ ID NO: 50390 - RNA, 711 nt, Artificial Sequence
  derived and/or modified sequence opt2 from SYCP3__Homo_sapiens__NP_001171420
auggucuccuccggcaagaaguacucccgcaaguccggcaagcccuccgucgaggaccaguucacccgcgccuacgacuucgagaccgaggacaagaaggaccucuccggcuccgaggaggacgucaucgagggcaagaccgccgucaucgagaagcgccgcaagaagcgcuccuccgccggcgucgucgaggacaugggcggcgagguccagaacaugcucgagggcgucggcgucgacaucaacaaggcccuccucgccaagcgcaagcgccucgagauguacaccaaggccucccucaagaccuccaaccagaagaucgagcacgucuggaagacccagcaggaccagcgccagaagcucaaccaggaguacucccagcaguuccucacccucuuccagcagugggaccucgacaugcagaaggccgaggagcaggaggagaagauccucaacauguuccgccagcagcagaagauccuccagcagucccgcaucguccagucccagcgccucaagaccaucaagcagcucuacgagcaguucaucaaguccauggaggagcucgagaagaaccacgacaaccuccucaccggcgcccagaacgaguucaagaaggagauggccaugcuccagaagaagaucaugauggagacccagcagcaggagaucgccuccguccgcaagucccuccaguccaugcucuucuga

SEQ ID NO: 50391 - RNA, 1908 nt, Artificial Sequence
  derived and/or modified sequence opt2 from SYK__Homo_sapiens__XP_011517248
auggccuccuccggcauggccgacuccgccaaccaccuccccuucuucuucggcaacaucacccgcgaggaggccgaggacuaccucguccagggcggcauguccgacggccucuaccuccuccgccagucccgcaacuaccucggcggcuucgcccucuccgucgcccacggccgcaaggcccaccacuacaccaucgagcgcgagcucaacggcaccuacgccaucgccggcggccgcacccacgccucccccgccgaccucugccacuaccacucccaggaguccgacggccucgucugccuccucaagaagcccuucaaccgcccccagggcguccagcccaagaccggccccuucgaggaccucaaggagaaccucauccgcgaguacgucaagcagaccuggaaccuccagggccaggcccucgagcaggccaucaucucccagaagccccagcucgagaagcucaucgccaccaccgcccacgagaagaugcccugguuccacggcaagaucucccgcgaggaguccgagcagaucguccucaucggcuccaagaccaacggcaaguuccucauccgcgcccgcgacaacaacggcuccuacgcccucugccuccuccacgagggcaagguccuccacuaccgcaucgacaaggacaagaccggcaagcucuccauccccgagggcaagaaguucgacacccucuggcagcucgucgagcacuacuccuacaaggccgacggccuccuccgcguccucaccguccccugccagaagaucggcacccagggcaacgucaacuucggcggccgcccccagcuccccggcucccaccccgccaccugguccgccggcggcaucaucucccgcaucaaguccuacuccuuccccaagcccggccaccgcaaguccucccccgcccagggcaaccgccaggaguccaccgucuccuucaaccccuacgagcccgagcucgcccccugggccgccgacaagggcccccagcgcgaggcccuccccauggacaccgaggucuacgagucccccuacgccgaccccgaggagauccgccccaaggaggucuaccucgaccgcaagcuccucacccucgaggacaaggagcucggcuccggcaacuucggcaccgucaagaagggcuacuaccagaugaagaaggucgucaagaccgucgccgucaagauccucaagaacgaggccaacgaccccgcccucaaggacgagcuccucgccgaggccaacgucaugcagcagcucgacaaccccuacaucguccgcaugaucggcaucugcgaggccgaguccuggaugcucgucauggagauggccgagcucggcccccucaacaaguaccuccagcagaaccgccacgucaaggacaagaacaucaucgagcucguccaccaggucuccaugggcaugaaguaccucgaggaguccaacuucguccaccgcgaccucgccgcccgcaacguccuccucgucacccagcacuacgccaagaucuccgacuucggccucuccaaggcccuccgcgccgacgagaacuacuacaaggcccagacccacggcaaguggcccgucaagugguacgcccccgagugcaucaacuacuacaaguucuccuccaaguccgacgucugguccuucggcguccucaugugggaggccuucuccuacggccagaagcccuaccgcggcaugaagggcuccgaggucaccgccaugcucgagaagggcgagcgcaugggcugccccgccggcugcccccgcgagauguacgaccucaugaaccucugcuggaccuacgacgucgagaaccgccccggcuucgccgccgucgagcuccgccuccgcaacuacuacuacgacgucgucaacuga

SEQ ID NO: 50392 - RNA, 3825 nt, Artificial Sequence
  derived and/or modified sequence opt2 from SYMPK__Homo_sapiens__XP_011525656
auggccuccggcuccggcgacuccgucacccgccgcuccgucgccucccaguucuucacccaggaggagggccccggcaucgacggcaugaccaccuccgagcgcgucgucgaccuccucaaccaggccgcccucaucaccaacgacuccaagaucaccguccucaagcagguccaggagcucaucaucaacaaggaccccacccuccucgacaacuuccucgacgagaucaucgccuuccaggccgacaaguccaucgagguccgcaaguucgucaucggcuucaucgaggaggccugcaagcgcgacaucgagcuccuccucaagcucaucgccaaccucaacaugcuccuccgcgacgagaacgucaacgucgucaagaaggccauccucaccaugacccagcucuacaaggucgcccuccaguggauggucaagucccgcgucaucuccgagcuccaggaggccugcugggacauggucuccgccauggccggcgacaucauccuccuccucgacuccgacaacgacggcauccgcacccacgccaucaaguucgucgagggccucaucgucacccucuccccccgcauggccgacuccgagaucccccgccgccaggagcacgacaucucccucgaccgcaucccccgcgaccaccccuacauccaguacaacguccucugggaggagggcaaggccgcccucgagcagcuccucaaguucaugguccaccccgccaucuccuccaucaaccucaccaccgcccucggcucccucgccaacaucgcccgccagcgccccauguucauguccgaggucauccaggccuacgagacccuccacgccaaccucccccccacccucgccaagucccaggucuccuccguccgcaagaaccucaagcuccaccuccucuccguccucaagcaccccgccucccucgaguuccaggcccagaucaccacccuccucgucgaccucggcaccccccaggccgagaucgcccgcaacaugcccuccuccaaggacacccgcaagcgcccccgcgacgacuccgacuccacccucaagaagaugaagcucgagcccaaccucggcgaggacgacgaggacaaggaccucgagcccggccccuccggcaccuccaaggccuccgcccagaucuccggccaguccgacaccgacaucaccgccgaguuccuccagccccuccucacccccgacaacgucgccaaccucguccucaucuccauggucuaccuccccgaggccaugcccgccuccuuccaggccaucuacacccccgucgaguccgccggcaccgaggcccagaucaagcaccucgcccgccucauggccacccagaugaccgccgccggccucggccccggcgucgagcagaccaagcagugcaaggaggagcccaaggaggagaaggucgucaagaccgaguccguccucaucaagcgccgccucuccgcccagggccaggccaucuccgucgucggcucccucuccuccauguccccccucgaggaggaggccccccaggccaagcgccgccccgagcccaucauccccgucacccagccccgccucgccggcgccggcggccgcaagaagaucuuccgccucuccgacguccucaagccccucaccgacgcccaggucgaggccaugaagcucggcgccgucaagcgcauccuccgcgccgagaaggccgucgccugcuccggcgccgcccagguccgcaucaagauccucgccucccucgucacccaguucaacuccggccucaaggccgagguccucuccuucauccucgaggacguccgcgcccgccucgaccucgccuucgccuggcucuaccaggaguacaacgccuaccucgccgccggcgccuccggcucccucgacaaguacgaggacugccucauccgccuccucuccggccuccaggagaagcccgaccagaaggacggcaucuucaccaaggucguccucgaggccccccucaucaccgaguccgcccucgaggucguccgcaaguacugcgaggacgagucccgcaccuaccucggcauguccacccuccgcgaccucaucuucaagcgccccucccgccaguuccaguaccuccacguccuccucgaccucuccucccacgagaaggacaagguccgcucccaggcccuccucuucaucaagcgcauguacgagaaggagcagcuccgcgaguacgucgagaaguucgcccucaacuaccuccagcuccucguccaccccaacccccccuccguccucuucggcgccgacaaggacaccgaggucgccgcccccuggaccgaggagaccgucaagcagugccucuaccucuaccucgcccuccucccccagaaccacaagcucauccacgagcucgccgccgucuacaccgaggccaucgccgacaucaagcgcaccguccuccgcgucaucgagcagcccauccgcggcaugggcaugaacucccccgagcuccuccuccucgucgagaacugccccaagggcgccgagacccucgucacccgcugccuccacucccucaccgacaaggucccccccucccccgagcucgucaagcgcguccgcgaccucuaccacaagcgccuccccgacguccgcuuccucauccccguccucaacggccucgagaagaaggaggucauccaggcccuccccaagcucaucaagcucaaccccaucgucgucaaggaggucuucaaccgccuccucggcacccagcacggcgagggcaacuccgcccucuccccccucaaccccggcgagcuccucaucgcccuccacaacaucgacuccgucaagugcgacaugaaguccaucaucaaggccaccaaccucugcuucgccgagcgcaacgucuacaccuccgagguccucgccgucgucaugcagcagcucauggagcaguccccccuccccaugcuccucaugcgcaccgucauccagucccucaccauguacccccgccucggcggcuucgucaugaacauccucucccgccucaucaugaagcaggucuggaaguaccccaaggucugggagggcuucaucaagugcugccagcgcaccaagccccaguccuuccaggucauccuccagcuccccccccagcagcucggcgccgucuucgacaagugccccgagcuccgcgagccccuccucgcccacguccgcuccuucaccccccaccagcaggcccacauccccaacuccaucaugaccauccucgaggccuccggcaagcaggagcccgaggccaaggaggcccccgccggcccccucgaggaggacgaccucgagccccucacccucgcccccgcccccgccccccgccccccccaggaccucaucggccuccgccucgcccaggagaaggcccucaagcgccagcucgaggaggagcagaagcucaagcccggcggcgucggcgcccccuccuccuccucccccucccccucccccuccgcccgccccggccccccccccuccgaggaggccauggacuuccgcgaggagggccccgagugcgagacccccggcaucuucaucuccauggacgacgacuccggccucaccgaggccgcccuccucgacuccucccucgagggcccccuccccaaggagaccgccgccggcggccucacccucaaggaggagcgcuccccccagacccucgcccccgucggcgaggacgccaugaagacccccucccccgccgccgaggacgcccgcgagcccgaggccaagggcaacuccuga

SEQ ID NO: 50393 - RNA, 2118 nt, Artificial Sequence
  derived and/or modified sequence opt2 from SYN1__Homo_sapiens__NP_008881
augaacuaccuccgccgccgccucuccgacuccaacuucauggccaaccuccccaacggcuacaugaccgaccuccagcgcccccagccccccccccccccccccggcgcccacucccccggcgccacccccggccccggcaccgccaccgccgagcgcuccuccggcgucgcccccgccgccucccccgccgcccccucccccggcuccuccggcggcggcggcuucuucuccucccucuccaacgccgucaagcagaccaccgccgccgccgccgccaccuucuccgagcaggucggcggcggcuccggcggcgccggccgcggcggcgccgccucccgcguccuccucgucaucgacgagccccacaccgacugggccaaguacuucaagggcaagaagauccacggcgagaucgacaucaaggucgagcaggccgaguucuccgaccucaaccucgucgcccacgccaacggcggcuucuccgucgacauggagguccuccgcaacggcgucaaggucguccgcucccucaagcccgacuucguccucauccgccagcacgccuucuccauggcccgcaacggcgacuaccgcucccucgucaucggccuccaguacgccggcauccccuccgucaacucccuccacuccgucuacaacuucugcgacaagcccugggucuucgcccagaugguccgccuccacaagaagcucggcaccgaggaguucccccucaucgaccagaccuucuaccccaaccacaaggagaugcucuccuccaccaccuaccccgucgucgucaagaugggccacgcccacuccggcaugggcaaggucaaggucgacaaccagcacgacuuccaggacaucgccuccgucgucgcccucaccaagaccuacgccaccgccgagcccuucaucgacgccaaguacgacguccgcguccagaagaucggccagaacuacaaggccuacaugcgcaccuccgucuccggcaacuggaagaccaacaccggcuccgccaugcucgagcagaucgccauguccgaccgcuacaagcucugggucgacaccugcuccgagaucuucggcggccucgacaucugcgccgucgaggcccuccacggcaaggacggccgcgaccacaucaucgaggucgucggcuccuccaugccccucaucggcgaccaccaggacgaggacaagcagcucaucgucgagcucgucgucaacaagauggcccaggcccucccccgccagcgccagcgcgacgccucccccggccgcggcucccacggccagacccccucccccggcgcccucccccucggccgccagaccucccagcagcccgccggcccccccgcccagcagcgcccccccccccagggcggccccccccagcccggccccggcccccagcgccagggccccccccuccagcagcgcccccccccccagggccagcagcaccucuccggccucggcccccccgccggcuccccccucccccagcgccuccccucccccaccuccgccccccagcagcccgccucccaggccgccccccccacccagggccagggccgccagucccgccccgucgccggcggccccggcgccccccccgccgcccgcccccccgccucccccuccccccagcgccaggccggccccccccaggccacccgccagaccuccgucuccggccccgccccccccaaggccuccggcgccccccccggcggccagcagcgccagggccccccccagaagccccccggccccgccggccccacccgccaggccucccaggccggccccgucccccgcaccggcccccccaccacccagcagccccgccccuccggccccggccccgccggccgccccaagccccagcucgcccagaagcccucccaggacguccccccccccgccaccgccgccgccggcggccccccccacccccagcucaacaagucccagucccucaccaacgccuucaaccuccccgagcccgcccccccccgccccucccucucccaggacgaggucaaggccgagaccauccgcucccuccgcaaguccuucgccucccucuucuccgacuga

SEQ ID NO: 50394 - RNA, 1437 nt, Artificial Sequence
  derived and/or modified sequence opt2 from SYN2__Homo_sapiens__NP_003169
augaugaacuuccuccgccgccgccucuccgacuccuccuucaucgccaaccuccccaacggcuacaugaccgaccuccagcgccccgagccccagcagcccccccccccccccccccccggccccggcgccgccuccgccuccgccgccccccccaccgccucccccggccccgagcgccgccccccccccgccuccgcccccgccccccagcccgcccccacccccuccgucggcuccuccuucuucuccucccucucccaggccgucaagcagaccgccgccuccgccggccucgucgacgcccccgcccccgcccccgccgccgcccgcaaggccaagguccuccucgucgucgacgagccccacgccgacugggccaagugcuuccgcggcaagaagguccucggcgacuacgacaucaaggucgagcaggccgaguucuccgagcucaaccucgucgcccacgccgacggcaccuacgccgucgacaugcagguccuccgcaacggcaccaaggucguccgcuccuuccgccccgacuucguccucauccgccagcacgccuucggcauggccgagaacgaggacuuccgccaccucaucaucggcaugcaguacgccggccuccccuccaucaacucccucgaguccaucuacaacuucugcgacaagcccugggucuucgcccagcucgucgccaucuacaagacccucggcggcgagaaguucccccucaucgagcagaccuacuaccccaaccacaaggagaugcucacccuccccaccuuccccgucgucgucaagaucggccacgcccacuccggcaugggcaaggucaaggucgagaaccacuacgacuuccaggacaucgccuccgucgucgcccucacccagaccuacgccaccgccgagcccuucaucgacuccaaguacgacauccgcguccagaagaucggcaacaacuacaaggccuacaugcgcaccuccaucuccggcaacuggaagaccaacaccggcuccgccaugcucgagcagaucgccauguccgaccgcuacaagcucugggucgacaccugcuccgagauguucggcggccucgacaucugcgccgucaaggccguccacggcaaggacggcaaggacuacaucuucgaggucauggacugcuccaugccccucaucggcgagcaccaggucgaggaccgccagcucaucaccgagcucgucaucuccaagaugaaccagcuccucucccgcacccccgcccucuccccccagcgcccccucaccacccagcagccccaguccggcacccucaaggaccccgacuccuccaagacccccccccagcgcccccccccccagggcugccuccaguacauccucgacugcaacggcaucgccgucggccccaagcagguccaggccuccuga

SEQ ID NO: 50395 - RNA, 1335 nt, Artificial Sequence
  derived and/or modified sequence opt2 from SYN3__Homo_sapiens__NP_598344
augaacuuccuccgccgccgccucuccgacuccuccuucauggccaaccuccccaacggcuacaugaccgaccuccagcgccccgacuccuccaccuccucccccgccucccccgccauggagcgccgccacccccagccccucgccgccuccuucuccucccccggcuccucccucuucuccucccucuccuccgccaugaagcaggccccccaggccaccuccggccucauggagccccccggccccuccacccccaucguccagcgcccccgcauccuccucgucaucgacgacgcccacaccgacugguccaaguacuuccacggcaagaaggucaacggcgagaucgagauccgcgucgagcaggccgaguucuccgagcucaaccucgccgccuacgucaccggcggcugcauggucgacaugcaggucguccgcaacggcaccaaggucgucucccgcuccuucaagcccgacuucauccucguccgccagcacgccuacuccauggcccucggcgaggacuaccgcucccucgucaucggccuccaguacggcggccuccccgccgucaacucccucuacuccgucuacaacuucugcuccaagcccugggucuucucccagcucaucaagaucuuccacucccucggccccgagaaguucccccucgucgagcagaccuucuuccccaaccacaagcccauggucaccgccccccacuuccccgucgucgucaagcucggccacgcccacgccggcaugggcaagaucaaggucgagaaccagcucgacuuccaggacaucaccuccgucgucgccauggccaagaccuacgccaccaccgaggccuucaucgacuccaaguacgacauccgcauccagaagaucggcuccaacuacaaggccuacaugcgcaccuccaucuccggcaacuggaaggccaacaccggcuccgccaugcucgagcaggucgccaugaccgagcgcuaccgccucugggucgacuccugcuccgagauguucggcggccucgacaucugcgccgucaaggccguccacuccaaggacggccgcgacuacaucaucgaggucauggacuccuccaugccccucaucggcgagcacgucgaggaggaccgccagcucauggccgaccucgucgucuccaagaugucccagcuccccaugcccggcggcaccgcccccuccccccuccgccccugggccccccagaucaaguccgccaagucccccggccaggcccagcucggcccccagcucggccagccccagccccgcccccccccccaggccaaccucucccccuga

SEQ ID NO: 50396 - RNA, 1584 nt, Artificial Sequence
  derived and/or modified sequence opt2 from SYNCRIP__Homo_sapiens__NP_001153146
auggccaccgagcacgucaacggcaacggcaccgaggagcccauggacaccaccuccgccgucauccacuccgagaacuuccagacccuccucgacgccggccucccccagaaggucgccgagaagcucgacgagaucuacgucgccggccucgucgcccacuccgaccucgacgagcgcgccaucgaggcccucaaggaguucaacgaggacggcgcccucgccguccuccagcaguucaaggacuccgaccucucccacguccagaacaaguccgccuuccucugcggcgucaugaagaccuaccgccagcgcgagaagcagggcaccaaggucgccgacuccuccaagggccccgacgaggccaagaucaaggcccuccucgagcgcaccggcuacacccucgacgucaccaccggccagcgcaaguacggcggccccccccccgacuccgucuacuccggccagcagcccuccgucggcaccgagaucuucgucggcaagaucccccgcgaccucuucgaggacgagcucgucccccucuucgagaaggccggccccaucugggaccuccgccucaugauggacccccucaccggccucaaccgcggcuacgccuucgucaccuucugcaccaaggaggccgcccaggaggccgucaagcucuacaacaaccacgagauccgcuccggcaagcacaucggcgucugcaucuccgucgccaacaaccgccucuucgucggcuccauccccaaguccaagaccaaggagcagauccucgaggaguucuccaaggucaccgagggccucaccgacgucauccucuaccaccagcccgacgacaagaagaagaaccgcggcuucugcuuccucgaguacgaggaccacaagaccgccgcccaggucaagguccucuucguccgcaaccucgccaacaccgucaccgaggagauccucgagaaggccuucucccaguucggcaagcucgagcgcgucaagaagcucaaggacuacgccuucauccacuucgacgagcgcgacggcgccgucaaggccauggaggagaugaacggcaaggaccucgagggcgagaacaucgagaucgucuucgccaagccccccgaccagaagcgcaaggagcgcaaggcccagcgccaggccgccaagaaccagauguacgacgacuacuacuacuacggccccccccacaugcccccccccacccgcggccgcggccgcggcggccgcggcggcuacggcuacccccccgacuacuacggcuacgaggacuacuacgacuacuacggcuacgacuaccacaacuaccgcggcggcuacgaggaccccuacuacggcuacgaggacuuccaggucggcgcccgcggccgcggcggccgcggcgcccgcggcgccgcccccucccgcggccgcggcgccgcccccccccgcggccgcgccggcuacucccagcgcggcggccccggcuccgcccgcggcguccgcggcgcccgcggcggcgcccagcagcagcgcggccgcggccagggcaagggcgucgaggccggccccgaccuccuccaguga

SEQ ID NO: 50397 - RNA, 777 nt, Artificial Sequence
  derived and/or modified sequence opt2 from SYNDIG1__Homo_sapiens__NP_079169
auggacggcaucaucgagcagaaguccaugcucguccacuccaagaucuccgacgccggcaagcgcaacggccucaucaacacccgcaaccucauggccgagucccgcgacggccucgucuccgucuaccccgccccccaguaccagucccaccgcgucggcgccuccaccguccccgccucccucgacuccucccgcuccgagcccaugcagcagcuccucgaccccaacacccuccagcaguccgucgagucccgcuaccgccccaacaucauccucuacuccgagggcguccuccgcuccuggggcgacggcgucgccgccgacugcugcgagaccaccuucaucgaggaccgcucccccaccaaggacucccucgaguaccccgacggcaaguucaucgaccucuccgccgacgacaucaagauccacacccucuccuacgacgucgaggaggaggaggaguuccaggagcucgaguccgacuacuccuccgacaccgaguccgaggacaacuuccucaugaugcccccccgcgaccaccucggccucuccgucuucuccaugcucugcugcuucuggccccucggcaucgccgccuucuaccucucccacgagaccaacaaggccgucgccaagggcgaccuccaccaggccuccaccuccucccgccgcgcccucuuccucgccguccucuccaucaccaucggcaccggcgucuacgucggcgucgccgucgcccucaucgccuaccucuccaagaacaaccaccucuga

SEQ ID NO: 50398 - RNA, 26250 nt, Artificial Sequence
  derived and/or modified sequence opt2 from SYNE1__Homo_sapiens__NP_149062
auggccaccucccgcggcgccucccgcugcccccgcgacaucgccaacgucaugcagcgccuccaggacgagcaggagaucguccagaagcgcaccuucaccaaguggaucaacucccaccucgccaagcgcaagccccccauggucgucgacgaccucuucgaggacaugaaggacggcgucaagcuccucgcccuccucgagguccucuccggccagaagcuccccugcgagcagggccgccgcaugaagcgcauccacgccgucgccaacaucggcaccgcccucaaguuccucgagggccgcaaguccaugcaccgcggcucccccaucaagcucgucaacaucaacuccaccgacaucgccgacggccgccccuccaucguccucggccucauguggaccaucauccucuacuuccagaucgaggagcucaccuccaaccucccccagcuccagucccucuccuccuccgccuccuccgucgacuccaucgucuccuccgagacccccuccccccccuccaagcgcaaggucaccaccaagauccagggcaacgccaagaaggcccuccucaaguggguccaguacaccgccggcaagcagaccggcaucgaggucaaggacuucggcaaguccuggcgcuccggcgucgccuuccacuccgucauccacgccauccgccccgagcucgucgaccucgagaccgucaagggccgcuccaaccgcgagaaccucgaggacgccuucaccaucgccgagaccgagcucggcaucccccgccuccucgaccccgaggacgucgacgucgacaagcccgacgagaaguccaucaugaccuacgucgcccaguuccucaagcacuaccccgacauccacaacgccuccaccgacggccaggaggacgacgagauccuccccggcuuccccuccuucgccaacuccguccagaacuucaagcgcgaggaccgcgucaucuucaaggagaugaaggucuggaucgagcaguucgagcgcgaccucacccgcgcccagauggucgaguccaaccuccaggacaaguaccaguccuucaagcacuuccgcguccaguacgagaugaagcgcaagcagaucgagcaccucauccagccccuccaccgcgacggcaagcucucccucgaccaggcccucgucaagcaguccugggaccgcgucaccucccgccucuucgacuggcacauccagcucgacaagucccuccccgccccccucggcaccaucggcgccuggcucuaccgcgccgaggucgcccuccgcgaggagaucaccguccagcagguccacgaggagaccgccaacaccauccagcgcaagcucgagcagcacaaggaccuccuccagaacaccgacgcccacaagcgcgccuuccacgagaucuaccgcacccgcuccgucaacggcauccccgucccccccgaccagcucgaggacauggccgagcgcuuccacuucgucuccuccaccuccgagcuccaccucaugaagauggaguuccucgagcucaaguaccgccuccucucccuccucguccucgccgaguccaagcucaaguccuggaucaucaaguacggccgccgcgaguccgucgagcagcuccuccagaacuacgucuccuucaucgagaacuccaaguucuucgagcaguacgaggucaccuaccagauccucaagcagaccgccgagauguacgucaaggccgacggcuccgucgaggaggccgagaacgucaugaaguucaugaacgagaccaccgcccaguggcgcaaccucuccgucgagguccgcuccguccgcuccaugcucgaggaggucaucuccaacugggaccgcuacggcaacaccgucgccucccuccaggccuggcucgaggacgccgagaagaugcucaaccaguccgagaacgccaagaaggacuucuuccgcaaccucccccacuggauccagcagcacaccgccaugaacgacgccggcaacuuccucaucgagaccugcgacgagauggucucccgcgaccucaagcagcagcuccuccuccucaacggccgcuggcgcgagcucuucauggaggucaagcaguacgcccaggccgacgagauggaccgcaugaagaaggaguacaccgacugcgucgucacccucuccgccuucgccaccgaggcccacaagaagcucuccgagccccucgaggucuccuucaugaacgucaagcuccucauccaggaccucgaggacaucgagcagcgcguccccgucauggacgcccaguacaagaucaucaccaagaccgcccaccucaucaccaaggaguccccccaggaggagggcaaggagauguucgccaccauguccaagcucaaggagcagcucaccaaggucaaggagugcuacuccccccuccucuacgagucccagcagcuccucaucccccucgaggagcucgagaagcagaugaccuccuucuacgacucccucggcaagaucaacgagaucaucaccguccucgagcgcgaggcccaguccuccgcccucuucaagcagaagcaccaggagcuccucgccugccaggagaacugcaagaagacccucacccucaucgagaagggcucccaguccguccagaaguucgucacccucuccaacguccucaagcacuucgaccagacccgccuccagcgccagaucgccgacauccacgucgccuuccaguccauggucaagaagaccggcgacuggaagaagcacgucgagaccaacucccgccucaugaagaaguucgaggagucccgcgccgagcucgagaagguccuccgcaucgcccaggagggccucgaggagaagggcgaccccgaggagcuccuccgccgccacaccgaguucuucucccagcucgaccagcgcguccucaacgccuuccucaaggccugcgacgagcucaccgacauccuccccgagcaggagcagcagggccuccaggaggccguccgcaagcuccacaagcaguggaaggaccuccagggcgaggcccccuaccaccuccuccaccucaagaucgacgucgagaagaaccgcuuccucgccuccgucgaggagugccgcaccgagcucgaccgcgagaccaagcucaugccccaggagggcuccgagaagaucaucaaggagcaccgcgucuucuucuccgacaagggcccccaccaccucugcgagaagcgccuccagcucaucgaggagcucugcgucaagcuccccguccgcgaccccguccgcgacacccccggcaccugccacgucacccucaaggagcuccgcgccgccaucgacuccaccuaccgcaagcucauggaggaccccgacaaguggaaggacuacaccucccgcuucuccgaguucuccuccuggaucuccaccaacgagacccagcucaagggcaucaagggcgaggccaucgacaccgccaaccacggcgaggucaagcgcgccgucgaggagauccgcaacggcgucaccaagcgcggcgagacccucuccuggcucaagucccgccucaagguccucaccgaggucuccuccgagaacgaggcccagaagcagggcgacgagcucgccaagcucuccuccuccuucaaggcccucgucacccuccucuccgaggucgagaagaugcucuccaacuucggcgacugcguccaguacaaggagaucgucaagaacucccucgaggagcucaucuccggcuccaaggagguccaggagcaggccgagaagauccucgacaccgagaaccucuucgaggcccagcagcuccuccuccaccaccagcagaagaccaagcgcaucuccgccaagaagcgcgacguccagcagcagaucgcccaggcccagcagggcgagggcggccuccccgaccgcggccacgaggagcuccgcaagcucgaguccacccucgacggccucgagcgcucccgcgagcgccaggagcgccgcauccaggucacccuccgcaagugggagcgcuucgagaccaacaaggagaccgucguccgcuaccucuuccagaccggcuccucccacgagcgcuuccucuccuucuccucccucgagucccucuccuccgagcucgagcagaccaaggaguucuccaagcgcaccgaguccaucgccguccaggccgagaaccucgucaaggaggccuccgagaucccccucggcccccagaacaagcagcuccuccagcagcaggccaaguccaucaaggagcaggucaagaagcucgaggacacccucgaggaggacaucaagaccauggagauggucaagaccaagugggaccacuucggcuccaacuucgagacccucuccgucuggaucaccgagaaggagaaggagcucaacgcccucgagaccuccuccuccgccauggacaugcagaucucccagaucaaggucaccauccaggagaucgaguccaagcucuccuccaucgucggccucgaggaggaggcccaguccuucgcccaguucgucaccaccggcgaguccgcccgcaucaaggccaagcucacccagauccgccgcuacggcgaggagcuccgcgagcacgcccagugccucgagggcaccauccucggccaccucucccagcagcagaaguucgaggagaaccuccgcaagauccagcaguccgucuccgaguucgaggacaagcucgccguccccaucaagaucugcuccuccgccaccgagaccuacaagguccuccaggagcacauggaccucugccaggcccucgagucccucuccuccgccaucaccgccuucuccgccuccgcccgcaaggucgucaaccgcgacuccugcguccaggaggccgccgcccuccagcagcaguacgaggacauccuccgccgcgccaaggagcgccagaccgcccucgagaaccuccucgcccacuggcagcgccucgagaaggagcucuccuccuuccucaccuggcucgagcgcggcgaggccaaggccuccucccccgagauggacaucuccgccgaccgcgucaaggucgagggcgagcuccagcucauccaggcccuccagaacgaggucgucucccaggccuccuucuacuccaagcuccuccagcucaaggagucccucuucuccgucgccuccaaggacgacgucaagaugaugaagcuccaccucgagcagcucgacgagcgcuggcgcgaccucccccagaucaucaacaagcgcaucaacuuccuccaguccgucgucgccgagcaccagcaguucgacgagcuccuccucuccuucuccgucuggaucaagcucuuccucuccgagcuccagaccaccuccgagaucuccaucauggaccaccaggucgcccucacccgccacaaggaccacgccgccgaggucgaguccaagaagggcgagcuccagucccuccagggccaccucgccaagcucggcucccucggccgcgccgaggaccuccaccuccuccagggcaaggccgaggacugcuuccagcucuucgaggaggccucccaggucgucgagcgccgccagcucgcccucucccaccucgccgaguuccuccagucccacgccucccucuccggcauccuccgccagcuccgccagaccgucgaggccaccaacuccaugaacaagaacgaguccgaccucaucgagaaggaccucaacgacgcccuccagaacgccaaggcccucgaguccgccgccgucucccucgacggcauccucuccaaggcccaguaccaccucaagaucggcuccuccgagcagcgcaccuccugccgcgccaccgccgaccagcucugcggcgaggucgagcgcauccagaaccuccucggcaccaagcaguccgaggccgacgcccucgccguccucaagaaggccuuccaggaccagaaggaggagcuccucaaguccaucgaggacaucgaggagcgcaccgacaaggagcgccucaaggagcccacccgccaggcccuccagcagcgccuccgcgucuucaaccagcucgaggacgagcucaacucccacgagcacgagcucugcuggcucaaggacaaggccaagcagaucgcccagaaggacgucgccuucgcccccgaggucgaccgcgagaucaaccgccucgaggucaccugggacgacaccaagcgccucauccacgagaaccagggccagugcugcggccucaucgaccucaugcgcgaguaccagaaccucaaguccgccgucuccaagguccucgagaacgccuccuccgucaucgucacccgcaccaccaucaaggaccaggaggaccucaagugggccuucuccaagcacgagaccgccaagaacaagaugaacuacaagcagaaggaccucgacaacuucaccuccaagggcaagcaccuccucuccgagcucaagaagauccacuccuccgacuucucccucgucaagaccgacauggaguccaccgucgacaaguggcucgacgucuccgagaagcucgaggagaacauggaccgccuccgcgucucccucuccaucugggacgacguccucuccacccgcgacgagaucgagggcugguccaacaacugcgucccccagauggccgagaacaucuccaaccucgacaaccaccuccgcgccgaggagcuccucaaggaguucgaguccgaggucaagaacaaggcccuccgccucgaggagcuccacuccaaggucaacgaccucaaggagcucaccaagaaccucgagaccccccccgaccuccaguucaucgaggccgaccucaugcagaagcucgagcacgccaaggagaucaccgaggucgccaagggcacccucaaggacuucaccgcccaguccacccaggucgagaaguucaucaacgacaucaccaccugguucaccaaggucgaggagucccucaugaacugcgcccagaacgagaccugcgaggcccucaagaaggucaaggacauccagaaggagcuccagucccagcaguccaacaucuccuccacccaggagaaccucaacucccucugccgcaaguaccacuccgccgagcucgagucccucggccgcgccaugaccggccucaucaagaagcacgaggccgucucccagcucugcuccaagacccaggccucccuccaggagucccucgagaagcacuucuccgaguccaugcaggaguuccaggagugguuccucggcgccaaggccgccgccaaggaguccuccgaccgcaccggcgacuccaagguccucgaggccaagcuccacgaccuccagaacauccucgacuccgucuccgacggccaguccaagcucgacgccgucacccaggagggccagacccucuacgcccaccucuccaagcagaucgucuccuccauccaggagcagaucaccaaggccaacgaggaguuccaggccuuccucaagcagugccucaaggacaagcaggcccuccaggacugcgccuccgagcucggcuccuucgaggaccagcaccgcaagcucaaccucuggauccacgagauggaggagcgcuucaacaccgagaaccucggcgaguccaagcagcacauccccgagaagaagaacgagguccacaaggucgagauguuccucggcgagcuccucgccgcccgcgagucccucgacaagcucucccagcgcggccagcuccucuccgaggagggccacggcgccggccaggagggccgccucugcucccagcuccucaccucccaccagaaccuccuccgcaugaccaaggagaagcuccgcuccugccaggucgcccuccaggagcacgaggcccucgaggaggcccuccaguccaugugguucugggucaaggccauccaggaccgccucgccugcgccgaguccacccucggcuccaaggacacccucgagaagcgccucucccagauccaggacauccuccucaugaagggcgagggcgaggucaagcucaacauggccaucggcaagggcgagcaggcccuccgcuccuccaacaaggagggccagcgcgucauccagacccagcucgagacccucaaggaggucugggccgacaucauguccuccuccguccacgcccaguccacccucgaguccgucaucucccaguggaacgacuacgucgagcgcaagaaccagcucgagcaguggauggaguccgucgaccagaagaucgagcacccccuccagccccagcccggccucaaggagaaguucguccuccucgaccaccuccaguccauccucuccgaggccgaggaccacacccgcgcccuccaccgccucaucgccaagucccgcgagcucuacgagaagaccgaggacgaguccuucaaggacaccgcccaggaggagcucaagacccaguucaacgacaucaugaccgucgccaaggagaagaugcgcaaggucgaggagaucgucaaggaccaccucauguaccucgacgccguccacgaguucaccgacuggcuccacuccgccaaggaggagcuccaccgcugguccgacauguccggcgacuccuccgccacccagaagaagcucuccaagaucaaggagcucaucgacucccgcgagaucggcgccucccgccucucccgcgucgagucccucgcccccgaggucaagcagaacaccaccgccuccggcugcgagcucaugcacaccgagaugcaggcccuccgcgccgacuggaagcagugggaggacuccgucuuccagacccaguccugccucgagaaccucgucucccagauggcccucuccgagcaggaguucuccggccaggucgcccagcucgagcaggcccucgagcaguucuccgcccuccucaagaccugggcccagcagcucacccuccucgagggcaagaacaccgacgaggagaucgucgagugcuggcacaagggccaggagauccucgacgcccuccagaaggccgagccccgcaccgaggaccucaagucccagcucaacgagcucugccgcuucucccgcgaccucuccaccuacuccggcaaggucuccggccucaucaaggaguacaacugccucugccuccaggccuccaagggcugccagaacaaggagcagauccuccagcagcgcuuccgcaaggccuuccgcgacuuccagcaguggcucgucaacgccaagaucaccaccgccaagugcuucgacaucccccagaacaucuccgaggucuccaccucccuccagaagauccaggaguuccucuccgaguccgagaacggccagcacaagcucaacaugaugcucuccaagggcgagcuccucuccacccuccucaccaaggagaaggccaagggcauccaggccaaggucaccgccgccaaggaggacuggaagaacuuccacuccaaccuccaccagaaggaguccgcccucgagaaccucaagauccagaugaaggacuucgaggucuccgccgagcccauccaggacuggcucuccaagaccgagaagaugguccacgaguccuccaaccgccucuacgaccuccccgccaagcgccgcgagcagcagaagcuccaguccguccucgaggagauccacugcuacgagccccagcucaaccgccucaaggagaaggcccagcagcucugggagggccaggccgccuccaaguccuuccgccaccgcgucucccagcucuccucccaguaccucgcccucuccaaccucaccaaggagaaggucucccgccucgaccgcaucgucgccgagcacaaccaguucucccucggcaucaaggagcuccaggacuggaugaccgacgccauccacaugcucgacuccuacugccaccccaccuccgacaaguccguccucgacucccgcacccucaagcucgaggcccuccucuccgucaagcaggagaaggagauccagaugaagaugaucgucacccgcggcgaguccguccuccagaacaccucccccgagggcauccccaccauccagcagcagcuccaguccgucaaggacaugugggccucccuccucuccgccggcauccgcugcaagucccagcucgagggcgcccucuccaaguggaccuccuaccaggacggcguccgccaguucuccggcuggauggacuccauggaggccaaccucaacgaguccgagcgccagcacgccgagcuccgcgacaagaccaccaugcucggcaaggccaagcuccucaacgaggagguccucuccuacuccucccuccucgagaccaucgaggucaagggcgccggcaugaccgagcacuacgucacccagcucgagcuccaggaccuccaggagcgcuaccgcgccauccaggagcgcgccaaggaggccgucaccaaguccgagaagcucguccgccuccaccaggaguaccagcgcgaccucaaggccuucgaggucuggcucggccaggagcaggagaagcucgaccaguacuccguccucgagggcgacgcccacacccacgagaccacccuccgcgaccuccaggagcuccagguccacugcgccgagggccaggcccuccucaacuccguccuccacacccgcgaggacgucauccccuccggcaucccccaggccgaggaccgcgcccucgagucccuccgccaggacuggcaggccuaccagcaccgccucuccgagacccgcacccaguucaacaacgucgucaacaagcuccgccucauggagcagaaguuccagcaggucgacgaguggcucaagaccgccgaggagaagaaguggcacgaggaggucaccgccuaccgcgacgaggucgaggaggucggcgcccgcgcccaggagauccucgacgagucccacgucaacucccgcaugggcugccaggccacccagcucaccucccgcuaccaggcccuccuccuccagguccucgagcagaucaaguuccucgaggaggagauccagucccucgaggaguccgaguccucccucuccuccuacuccgacugguacggcuccacccacaagaacuucaagaacgucgccaccaagaucgacaaggucgacaccgucaugaugggcaagaagcucaagacccucgagguccuccucaaggacauggagaagggccacucccuccucaaguccgcccgcgagaagggcgagcgcgccgucaaguaccucgaggagggcgaggccgagcgccuccgcaaggagauccacgaccacauggagcagcucaaggagcucaccuccaccguccgcaaggagcacaugacccucgagaagggccuccaccucgccaaggaguucuccgacaagugcaaggcccucacccaguggaucgccgaguaccaggagauccuccacguccccgaggagcccaagauggagcucuacgagaagaaggcccagcucuccaaguacaagucccuccagcagaccguccucucccacgagcccuccgucaaguccguccgcgagaagggcgaggcccuccucgagcucguccaggacgucacccucaaggacaagaucgaccagcuccaguccgacuaccaggaccucugcuccaucggcaaggccaugauggaggagaucgccggcuucgaggaccgccucaacaaccuccagaugaagggcgacacccucaucggccagugcgccgaccaccuccaggccaagcucaagcagaacguccacgcccaccuccagggcaccaaggacuccuacuccgccaucugcuccaccgcccagcgcauguaccagucccucgagcacgagcuccagaagcacgucucccgccaggacacccuccagcagugccaggccuggcucuccgccguccagcccgaccucgagcccuccccccagcccccccucucccgcgccgaggccaucaagcaggucaagcacuuccgcgcccuccaggagcaggcccgcaccuaccucgaccuccucugcuccaugugcgaccucuccaacgccuccgucaagaccaccgccaaggacauccagcagaccgagcagaccaucgagcagaagcucguccaggcccagaaccucacccagggcugggaggagaucaagcaccucaaguccgagcucuggaucuaccuccaggacgccgaccagcagcuccagaacaugaagcgccgccacuccgagcucgagcucaacaucgcccagaacauggucucccaggucaaggacuucgucaagaagcuccaguccaagcaggccuccgucaacaccaucaucgagaaggucaacaagcucaccaagaaggaggagucccccgagcacaaggagaucaaccaccucaacgaccaguggcucgaccucugccgccaguccaacaaccucugccuccagcgcgaggaggaccuccagcgcacccgcgacuaccacgacugcaugaacgucgucgaggucuuccucgagaaguucaccaccgagugggacaaccucgcccgcuccgacgccgaguccaccgccguccaccucgaggcccucaagaagcucgcccucgcccuccaggagcgcaaguacgccaucgaggaccucaaggaccagaagcagaagaugaucgagcaccucaaccucgacgacaaggagcucgucaaggagcagaccucccaccucgagcagcgcugguuccagcucgaggaccucaucaagcgcaagauccaggucuccgucaccaaccucgaggagcucaacgucguccagucccgcuuccaggagcucauggagugggccgaggagcagcagcccaacaucgccgaggcccucaagcagucccccccccccgacauggcccagaaccuccucauggaccaccucgccaucugcuccgagcucgaggccaagcagaugcuccucaagucccucaucaaggacgccgaccgcgucauggccgaccucggccucaacgagcgccaggucauccagaaggcccucuccgacgcccagucccacgucaacugccucuccgaccucgucggccagcgccgcaaguaccucaacaaggcccucuccgagaagacccaguuccucauggccgucuuccaggccaccucccagauccagcagcacgagcgcaagaucauguuccgcgagcacaucugccuccuccccgacgacgucuccaagcaggucaagaccugcaaguccgcccaggccucccucaagaccuaccagaacgaggucaccggccucugggcccagggccgcgagcucaugaaggaggucaccgagcaggagaaguccgagguccucggcaagcuccaggagcuccaguccgucuacgacuccguccuccagaagugcucccaccgccuccaggagcucgagaagaaccucgucucccgcaagcacuucaaggaggacuucgacaaggccugccacuggcucaagcaggccgacaucgucaccuuccccgagaucaaccucaugaacgaguccuccgagcuccacacccagcucgccaaguaccagaacauccucgagcagucccccgaguacgagaaccuccuccucacccuccagcgcaccggccagaccauccuccccucccucaacgaggucgaccacuccuaccucuccgagaagcucaacgcccucccccgccaguucaacgucaucgucgcccucgccaaggacaaguucuacaagguccaggaggccauccucgcccgcaaggaguacgccucccucaucgagcucaccacccagucccucuccgagcucgaggcccaguuccuccgcauguccaagguccccaccgaccucgccgucgaggaggcccucucccuccaggacggcugccgcgccauccucgacgaggucgccggccucggcgaggccgucgacgagcucaaccagaagaaggagggcuuccgcuccaccggccagcccuggcagcccgacaagaugcuccaccucgucacccucuaccaccgccucaagcgccagaccgagcagcgcgucucccuccucgaggacaccaccuccgccuaccaggagcacgagaagaugugccagcagcucgagcgccagcucaaguccgucaaggaggagcaguccaaggucaacgaggagacccuccccgccgaggagaagcucaagauguaccacucccucgccggcucccuccaggacuccggcaucguccucaagcgcgucaccauccaccucgaggaccucgccccccaccucgacccccucgccuacgagaaggcccgccaccagauccaguccuggcagggcgagcucaagcuccucaccuccgccaucggcgagaccgucaccgagugcgagucccgcaugguccaguccaucgacuuccagaccgagaugucccgcucccucgacuggcuccgccgcgucaaggccgagcucuccggccccgucuaccucgaccucaaccuccaggacauccaggaggagauccgcaagauccagauccaccaggaggagguccaguccucccuccgcaucaugaacgcccucucccacaaggagaaggagaaguucaccaaggccaaggagcucaucuccgccgaccucgagcacucccucgccgagcucuccgagcucgacggcgacauccaggaggcccuccgcacccgccaggccacccucaccgagaucuacucccagugccagcgcuacuaccaggucuuccaggccgccaacgacuggcucgaggacgcccaggagcuccuccagcucgccggcaacggccucgacgucgaguccgccgaggagaaccucaagucccacauggaguucuucuccaccgaggaccaguuccacuccaaccucgaggagcuccacucccucgucgccacccucgacccccucaucaagcccaccggcaaggaggaccucgagcagaaggucgccucccucgagcuccgcucccagcgcaugucccgcgacuccggcgcccaggucgaccuccuccagcgcugcaccgcccaguggcacgacuaccagaaggcccgcgaggaggucaucgagcucaugaacgacaccgagaagaagcucuccgaguucucccuccucaagaccuccuccucccacgaggccgaggagaagcucuccgagcacaaggcccucgucuccgucgucaacuccuuccacgagaagaucgucgcccucgaggagaaggccucccagcucgagaagaccggcaacgacgccuccaaggccacccucucccgcuccaugaccaccgucuggcagcgcuggacccgccuccgcgccgucgcccaggaccaggagaagauccucgaggacgccgucgacgaguggaccggcuucaacaacaaggucaagaaggccaccgagaugaucgaccagcuccaggacaagcuccccggcuccuccgccgagaaggccuccaaggccgagcuccucacccuccucgaguaccacgacaccuucguccucgagcucgagcagcagcaguccgcccucggcaugcuccgccagcagacccucuccaugcuccaggacggcgccgcccccacccccggcgaggagcccccccucaugcaggagaucaccgccaugcaggaccgcugccucaacaugcaggagaaggucaagaccaacggcaagcucgucaagcaggagcucaaggaccgcgagauggucgagacccagaucaacuccgucaagugcuggguccaggagaccaaggaguaccucggcaaccccaccaucgagaucgacgcccagcucgaggagcuccagauccuccucaccgaggccaccaaccaccgccagaacaucgagaagauggccgaggagcagaaggagaaguaccucggccucuacaccauccuccccuccgagcucucccuccagcucgccgaggucgcccucgaccucaagauccgcgaccagauccaggacaagaucaaggaggucgagcaguccaaggccaccucccaggagcucucccgccagauccagaagcucgccaaggaccucaccaccauccucaccaagcucaaggccaagaccgacaacgucguccaggccaagaccgaccagaagguccucggcgaggagcucgacggcugcaacuccaagcucauggagcucgacgccgccguccagaaguuccucgagcagaacggccagcucggcaagccccucgccaagaagaucggcaagcucaccgagcuccaccagcagaccauccgccaggccgagaaccgccucuccaagcucaaccaggccgccucccaccucgaggaguacaacgagaugcucgagcucauccucaaguggaucgagaaggccaagguccucgcccacggcaccaucgccuggaacuccgccucccagcuccgcgagcaguacauccuccaccagacccuccucgaggaguccaaggagaucgacuccgagcucgaggccaugaccgagaagcuccaguaccucaccuccgucuacugcaccgagaagaugucccagcaggucgccgagcucggccgcgagaccgaggagcuccgccagaugaucaagauccgccuccagaaccuccaggacgccgccaaggacaugaagaaguucgaggccgagcucaagaagcuccaggccgcccucgagcaggcccaggccacccucaccucccccgaggucggccgccucucccucaaggagcagcucucccaccgccagcaccuccucuccgagauggagucccucaagcccaagguccaggccguccagcucugccaguccgcccuccgcauccccgaggacgucgucgccucccucccccucugccacgccgcccuccgccuccaggaggaggccucccgccuccagcacaccgccauccagcagugcaacaucaugcaggccgccgucguccaguacgagcaguacgagcaggagaugaagcaccuccagcagcucaucgagggcgcccaccgcgagaucgaggacaagcccgucgccaccuccaacauccaggagcuccaggcccagaucucccgccacgaggagcucgcccagaagaucaagggcuaccaggagcagaucgccucccucaacuccaagugcaagaugcucaccaugaaggccaagcacgccaccaugcuccucaccgucaccgaggucgagggccucgccgagggcaccgaggaccucgacggcgagcuccuccccacccccuccgcccaccccuccgucgucaugaugaccgccggccgcugccacacccuccucucccccgucaccgaggaguccggcgaggagggcaccaacuccgagaucuccuccccccccgccugccgcucccccucccccgucgccaacaccgacgccuccgucaaccaggacaucgccuacuaccaggcccucuccgccgagcgccuccagaccgacgccgccaagauccaccccuccaccuccgccucccaggaguucuacgagcccggccucgagcccuccgccaccgccaagcucggcgaccuccagcgcuccugggagacccucaagaacgucaucuccgagaagcagcgcacccucuacgaggcccucgagcgccagcagaaguaccaggacucccuccaguccaucuccaccaagauggaggccaucgagcucaagcucuccgagucccccgagcccggccgcucccccgagucccagauggccgagcaccaggcccucauggacgagauccucaugcuccaggacgagaucaacgagcuccaguccucccucgccgaggagcucgucuccgaguccugcgaggccgaccccgccgagcagcucgcccuccaguccacccucaccguccucgccgagcgcauguccaccauccgcaugaaggccuccggcaagcgccagcuccucgaggagaagcucaacgaccagcucgaggagcagcgccaggagcaggcccuccagcgcuaccgcugcgaggccgacgagcucgacuccuggcuccucuccaccaaggccacccucgacaccgcccucuccccccccaaggagcccauggacauggaggcccagcucauggacugccagaacaugcucgucgagaucgagcagaaggucgucgcccucuccgagcucuccguccacaacgagaaccuccuccucgagggcaaggcccacaccaaggacgaggccgagcagcucgccggcaagcuccgccgccucaagggcucccuccucgagcuccagcgcgcccuccacgacaagcagcucaacaugcagggcaccgcccaggagaaggaggaguccgacgucgaccucaccgccacccagucccccggcguccaggaguggcucgcccaggcccgcaccaccuggacccagcagcgccaguccucccuccagcagcagaaggagcucgagcaggagcucgccgagcagaagucccuccuccgcuccgucgccucccgcggcgaggagauccucauccagcacuccgccgccgagaccuccggcgacgccggcgagaagcccgacguccucucccaggagcucggcauggagggcgagaaguccuccgccgaggaccagaugcgcaugaagugggagucccuccaccaggaguucuccaccaagcagaagcuccuccagaacguccucgagcaggagcaggagcagguccucuacucccgccccaaccgccuccucuccggcgucccccucuacaagggcgacguccccacccaggacaaguccgccgucaccucccuccucgacggccucaaccaggccuucgaggaggucuccucccaguccggcggcgccaagcgccaguccauccaccucgagcagaagcucuacgacggcgucuccgccaccuccaccuggcucgacgacgucgaggagcgccucuucgucgccaccgcccuccuccccgaggagaccgagaccugccucuucaaccaggagauccucgccaaggacaucaaggagauguccgaggagauggacaagaacaagaaccucuucucccaggccuuccccgagaacggcgacaaccgcgacgucaucgaggacacccucggcugccuccucggccgccucucccuccucgacuccgucgucaaccagcgcugccaccagaugaaggagcgccuccagcagauccucaacuuccagaacgaccucaagguccucuucaccucccucgccgacaacaaguacaucauccuccagaagcucgccaacgucuucgagcagcccgucgccgagcagaucgaggccauccagcaggccgaggacggccucaaggaguucgacgccggcaucaucgagcucaagcgccgcggcgacaagcuccaggucgagcagcccuccaugcaggagcucuccaagcuccaggacauguacgacgagcucaugaugaucaucggcucccgccgcuccggccucaaccagaaccucacccucaagucccaguacgagcgcgcccuccaggaccucgccgaccuccucgagaccggccaggagaagauggccggcgaccagaagaucaucgucuccuccaaggaggagauccagcagcuccucgacaagcacaaggaguacuuccagggccucgagucccacaugauccucaccgagacccucuuccgcaagaucaucuccuucgccguccagaaggagacccaguuccacaccgagcucauggcccaggccuccgccguccucaagcgcgcccacaagcgcggcgucgagcucgaguacauccucgagaccuggucccaccucgacgaggaccagcaggagcucucccgccagcucgaggucgucgaguccuccauccccuccgucggccucgucgaggagaacgaggaccgccucaucgaccgcaucacccucuaccagcaccucaaguccucccucaacgaguaccagcccaagcucuaccagguccucgacgacggcaagcgccuccucaucuccaucuccugcuccgaccucgagucccagcucaaccagcucggcgagugcuggcucuccaacaccaacaagauguccaaggagcuccaccgccucgagaccauccucaagcacuggacccgcuaccaguccgaguccgccgaccucauccacuggcuccaguccgccaaggaccgccucgaguucuggacccagcaguccgucaccgucccccaggagcucgagaugguccgcgaccaccucaacgccuuccucgaguucuccaaggaggucgacgcccaguccucccucaaguccuccguccucuccaccggcaaccagcuccuccgccucaagaaggucgacaccgccacccuccgcuccgagcucucccgcaucgacucccaguggaccgaccuccucaccaacauccccgccguccaggagaagcuccaccagcuccagauggacaagcuccccucccgccacgccaucuccgaggucauguccuggaucucccucauggagaacgucauccagaaggacgaggacaacaucaagaacuccaucggcuacaaggccauccacgaguaccuccagaaguacaagggcuucaagaucgacaucaacugcaagcagcucaccgucgacuucgucaaccaguccguccuccagaucuccucccaggacgucgaguccaagcgcuccgacaagaccgacuucgccgagcagcucggcgccaugaacaaguccuggcagauccuccagggccucgucaccgagaagauccagcuccucgagggccuccucgaguccugguccgaguacgagaacaacguccagugccucaagaccugguucgagacccaggagaagcgccucaagcagcagcaccgcaucggcgaccaggccuccguccagaacgcccucaaggacugccaggaccucgaggaccucaucaaggccaaggagaaggaggucgagaagaucgagcagaacggccucgcccucauccagaacaagaaggaggacgucuccuccaucgucauguccacccuccgcgagcucggccagaccugggccaaccucgaccacauggucggccagcucaagauccuccucaaguccguccucgaccagugguccucccacaaggucgccuucgacaagaucaacuccuaccucauggaggcccgcuacucccucucccgcuuccgccuccucaccggcucccucgaggccguccagguccaggucgacaaccuccagaaccuccaggacgaccucgagaagcaggagcgcucccuccagaaguucggcuccaucaccaaccagcuccucaaggagugccacccccccgucaccgagacccucaccaacacccucaaggaggucaacaugcgcuggaacaaccuccucgaggagaucgccgagcagcuccaguccuccaaggcccuccuccagcucuggcagcgcuacaaggacuacuccaagcagugcgccuccaccguccagcagcaggaggaccgcaccaacgagcuccucaaggccgccaccaacaaggacaucgccgacgacgaggucgccaccuggauccaggacugcaacgaccuccucaagggccucggcaccgucaaggacucccucuucuuccuccacgagcucggcgagcagcucaagcagcaggucgacgccuccgccgccuccgccauccaguccgaccagcucucccucucccagcaccucugcgcccucgagcaggcccucugcaagcagcagaccucccuccaggccggcguccucgacuacgagaccuucgccaagucccucgaggcccucgaggccuggaucgucgaggccgaggagauccuccagggccaggaccccucccacuccuccgaccucuccaccauccaggagcgcauggaggagcucaagggccagaugcucaaguucuccuccauggcccccgaccucgaccgccucaacgagcucggcuaccgccucccccucaacgacaaggagaucaagcgcaugcagaaccucaaccgccacuggucccucaucuccucccagaccaccgagcgcuucuccaagcuccaguccuuccuccuccagcaccagaccuuccucgagaagugcgagaccuggauggaguuccucguccagaccgagcagaagcucgccgucgagaucuccggcaacuaccagcaccuccucgagcagcagcgcgcccacgagcucuuccaggccgagauguucucccgccagcagauccuccacuccaucaucaucgacggccagcgccuccucgagcagggccaggucgacgaccgcgacgaguucaaccucaagcucacccuccucuccaaccaguggcagggcgucauccgccgcgcccagcagcgccgcggcaucaucgacucccagauccgccaguggcagcgcuaccgcgagauggccgagaagcuccgcaaguggcucgucgaggucuccuaccuccccauguccggccucggcuccguccccaucccccuccagcaggcccgcacccucuucgacgagguccaguucaaggagaaggucuuccuccgccagcagggcuccuacauccucaccgucgaggccggcaagcagcuccuccucuccgccgacuccggcgccgaggccgcccuccaggccgagcucgccgagauccaggagaaguggaaguccgccuccaugcgccucgaggagcagaagaagaagcucgccuuccuccucaaggacugggagaagugcgagaagggcaucgccgacucccucgagaagcuccgcaccuucaagaagaagcucucccagucccuccccgaccaccacgaggagcuccacgccgagcagaugcgcugcaaggagcucgagaacgccgucggcuccuggaccgacgaccucacccagcucucccuccucaaggacacccucuccgccuacaucuccgccgacgacaucuccauccucaacgagcgcgucgagcuccuccagcgccagugggaggagcucugccaccagcucucccuccgccgccagcagaucggcgagcgccucaacgagugggccgucuucuccgagaagaacaaggagcucugcgaguggcucacccagauggaguccaaggucucccagaacggcgacauccucaucgaggagaugaucgagaagcucaagaaggacuaccaggaggagaucgccaucgcccaggagaacaagauccagcuccagcagaugggcgagcgccucgccaaggccucccacgaguccaaggccuccgagaucgaguacaagcucggcaaggucaacgaccgcuggcagcaccuccucgaccucaucgccgcccgcgucaagaagcucaaggagacccucgucgccguccagcagcucgacaagaacauguccucccuccgcaccuggcucgcccacaucgaguccgagcucgccaagcccaucgucuacgacuccugcaacuccgaggagauccagcgcaagcucaacgagcagcaggagcuccagcgcgacaucgagaagcacuccaccggcgucgccuccguccucaaccucugcgagguccuccuccacgacugcgacgccugcgccaccgacgccgagugcgacuccauccagcaggccacccgcaaccucgaccgccgcuggcgcaacaucugcgccauguccauggagcgccgccucaagaucgaggagaccuggcgccucuggcagaaguuccucgacgacuacucccgcuucgaggacuggcucaaguccuccgagcgcaccgccgccuuccccuccuccuccggcgucaucuacaccgucgccaaggaggagcucaagaaguucgaggccuuccagcgccagguccacgagugccucacccagcucgagcucaucaacaagcaguaccgccgccucgcccgcgagaaccgcaccgacuccgccugcucccucaagcagaugguccacgagggcaaccagcgcugggacaaccuccagaagcgcgucaccuccauccuccgccgccucaagcacuucaucggccagcgcgaggaguucgagaccgcccgcgacuccauccucgucuggcucaccgagauggaccuccagcucaccaacaucgagcacuucuccgagugcgacguccaggccaagaucaagcagcucaaggccuuccagcaggagaucucccucaaccacaacaagaucgagcagaucaucgcccagggcgagcagcucaucgagaaguccgagccccucgacgccgccaucaucgaggaggagcucgacgagcuccgccgcuacugccaggaggucuucggccgcgucgagcgcuaccacaagaagcucauccgccucccccuccccgacgacgagcacgaccucuccgaccgcgagcucgagcucgaggacuccgccgcccucuccgaccuccacuggcacgaccgcuccgccgacucccuccucuccccccagcccuccuccaaccucucccucucccucgcccagccccuccgcuccgagcgcuccggccgcgacacccccgccuccgucgacuccaucccccucgagugggaccacgacuacgaccucucccgcgaccucgaguccgccaugucccgcgcccuccccuccgaggacgaggagggccaggacgacaaggacuucuaccuccgcggcgccgucggccucuccgacgucaugauccccgagucccccgaggccuacgucaagcucaccgagaacgccaucaagaacaccuccggcgaccacuccgcccucgagucccagauccgccagcucggcaaggcccucgacgacucccgcuuccagauccagcagaccgagaacaucauccgcuccaagacccccaccggccccgagcucgacaccuccuacaagggcuacaugaagcuccucggcgagugcuccuccuccaucgacuccgucaagcgccucgagcacaagcucaaggaggaggaggagucccuccccggcuucgucaaccuccacuccaccgagacccagaccgccggcgucaucgaccgcugggagcuccuccaggcccaggcccucuccaaggagcuccgcaugaagcagaaccuccagaaguggcagcaguucaacuccgaccucaacuccaucugggccuggcucggcgacaccgaggaggagcucgagcagcuccagcgccucgagcucuccaccgacauccagaccaucgagcuccagaucaagaagcucaaggagcuccagaaggccgucgaccaccgcaaggccaucauccucuccaucaaccucugcucccccgaguucacccaggccgacuccaaggagucccgcgaccuccaggaccgccucucccagaugaacggccgcugggaccgcgucugcucccuccucgaggaguggcgcggccuccuccaggacgcccucaugcagugccagggcuuccacgagaugucccacggccuccuccucaugcucgagaacaucgaccgccgcaagaacgagaucguccccaucgacuccaaccucgacgccgagauccuccaggaccaccacaagcagcucaugcagaucaagcacgagcuccucgagucccagcuccgcgucgccucccuccaggacauguccugccagcuccucgucaacgccgagggcaccgacugccucgaggccaaggagaagguccacgucaucggcaaccgccucaagcuccuccucaaggaggucucccgccacaucaaggagcucgagaagcuccucgacgucuccuccucccagcaggaccucuccuccugguccuccgccgacgagcucgacaccuccggcuccgucucccccaccuccggccgcuccacccccaaccgccagaagaccccccgcggcaagugcucccucucccagcccggccccuccgucuccuccccccacucccgcuccaccaagggcggcuccgacuccucccucuccgagcccggccccggccgcuccggccgcggcuuccucuuccgcguccuccgcgccgcccucccccuccagcuccuccuccuccuccucaucggccucgccugccucguccccauguccgaggaggacuacuccugcgcccucuccaacaacuucgcccgcuccuuccaccccaugcuccgcuacaccaacggcccccccccccucuga

SEQ ID NO: 50399 - RNA, 20658 nt, Artificial Sequence
  derived and/or modified sequence opt2 from SYNE2__Homo_sapiens__NP_055995
auggccuccucccccgagcuccccaccgaggacgagcagggcuccuggggcaucgacgaccuccacaucucccuccaggccgagcaggaggacacccagaagaaggccuucaccugcuggaucaacucccagcucgcccgccacaccucccccuccgucaucuccgaccucuucaccgacaucaagaagggccacguccuccucgaccuccucgagguccucuccggccagcagcucccccgcgacaagggcuccaacaccuuccagugccgcaucaacaucgagcacgcccucaccuuccuccgcaaccgcuccaucaagcucaucaacauccacgucaccgacaucaucgacggcaaccccuccaucauccucggccucaucuggaccaucauccuccacuuccacaucgagaagcucgcccagacccucuccugcaacuacaaccagcccucccucgacgacgucuccgucgucgacuccucccccgccuccuccccccccgccaagaagugcuccaagguccaggcccgcuggcagauguccgcccgcaaggcccuccuccucugggcccaggagcagugcgccaccuacgaguccgucaacgucaccgacuucaaguccuccuggcgcaacggcauggccuuccucgccaucauccacgcccuccgccccgaccucaucgacaugaaguccgucaagcaccgcuccaacaaggacaaccuccgcgaggccuuccgcaucgccgagcaggagcucaagaucccccgccuccucgagcccgaggacgucgacgucgucgaccccgacgagaaguccaucaugaccuacgucgcccaguuccuccaguacuccaaggacgcccccggcaccggcgaggaggcccagggcaaggucaaggacgccaugggcuggcucacccuccagaaggagaagcuccagaagcuccucaaggacuccgagaacgacaccuacuucaagaaguacaacucccuccucuccuucauggaguccuucaacgaggagaagaaguccuuccucgacguccucuccaucaagcgcgaccucgacgagcucgacaaggaccaccuccagcuccgcgaggccugggacggccucgaccaccagaucaacgccuggaagaucaagcucaacuacgcccucccccccccccuccaccagaccgaggccuggcuccaggaggucgaggagcucauggacgaggaccucuccgccucccaggaccacucccaggccgucacccucauccaggagaagaugacccucuucaagucccucauggaccgcuucgagcaccacuccaacauccuccucaccuucgagaacaaggacgagaaccaccucccccucgucccccccaacaagcucgaggagaugaagcgccgcaucaacaacauccucgagaagaaguucauccuccuccucgaguuccacuacuacaagugccucguccucggccucgucgacgaggucaaguccaagcucgacaucuggaacaucaaguacggcucccgcgaguccgucgagcuccuccucgaggacuggcacaaguucaucgaggagaaggaguuccucgcccgccucgacaccuccuuccagaagugcggcgagaucuacaagaaccucgccggcgagugccagaacaucaacaagcaguacaugauggucaaguccgacgucugcauguaccgcaagaacaucuacaacgucaaguccacccuccagaagguccucgccugcugggccaccuacgucgagaaccuccgccuccuccgcgccugcuucgaggagaccaagaaggaggagaucaaggagguccccuucgagacccucgcccaguggaaccucgagcacgccacccucaacgaggccggcaacuuccucgucgaggucuccaacgacgucgucggcuccuccaucuccaaggagcuccgccgccucaacaagcgcuggcgcaagcucgucuccaagacccagcucgagaugaaccucccccucaugaucaagaagcaggaccagcccaccuucgacaacuccggcaacauccucuccaaggaggagaaggccaccgucgaguucuccaccgacauguccgucgagcuccccgagaacuacaaccagaacaucaaggccggcgagaagcacgagaaggagaacgaggaguucaccggccagcucaaggucgccaaggacgucgagaagcucaucggccaggucgagaucugggaggccgaggccaaguccguccucgaccaggacgacgucgacaccuccauggaggagucccucaagcaccucaucgccaagggcuccauguucgacgagcucauggcccgcuccgaggacaugcuccagauggacauccagaacaucuccucccaggaguccuuccagcacguccucaccaccggccuccaggccaagauccaggaggccaaggagaagguccagaucaacgucgucaagcucaucgccgcccucaagaaccucaccgacgucucccccgaccucgacauccgccucaagauggaggagucccagaaggagcucgaguccuacaugaugcgcgcccagcagcuccucggccagcgcgagucccccggcgagcucaucuccaagcacaaggaggcccucaucaucuccaacaccaagucccucgccaaguaccucaaggccgucgaggagcucaagaacaacgucaccgaggacaucaagaugucccucgaggagaagucccgcgacgucugcgccaagugggagucccuccaccacgagcucucccucuacguccagcagcucaagaucgacaucgagaagggcaagcucuccgacaacauccucaagcucgagaagcagaucaacaaggagaagaagcucauccgccgcggccgcaccaagggccucaucaaggagcacgaggccugcuucuccgaggagggcugccucuaccagcucaaccaccacauggagguccuccgcgagcucugcgaggagcuccccucccagaagucccagcaggaggucaagcgccuccucaaggacuacgagcagaagaucgagcgccuccucaagugcgccuccgagauccacaugacccuccagcccaccgccggcggcaccuccaagaacgagggcaccaucaccaccuccgagaaccgcggcggcgacccccacuccgaggcccccuucgccaaguccgacaaccagcccuccaccgagaaggccauggagcccaccaugaaguucucccucgccuccguccuccgcccccuccaggaggaguccaucauggagaaggacuacuccgccuccaucaacucccuccucgagcgcuacgacaccuaccgcgacauccucgagcaccaccuccagaacaacaaguuccgcaucaccuccgacuucuccuccgaggaggaccgcuccuccuccugccuccaggccaagcucaccgaccuccaggucaucaagaacgagaccgacgcccgcuggaaggaguucgagaucaucucccucaagcucgagaaccacgucaacgacaucaagaagcccuucgucaucaaggagcgcgacacccucaaggagcgcgagcgcgagcuccagaugacccucaacacccgcauggagucccucgagaccgcccuccgccucguccuccccgucgagaaggccucccuccuccucugcggcuccgaccucccccuccacaagauggccauccagggcuuccaccucaucgacgccgaccgcaucuaccagcaccuccgcaacauccaggacuccaucgccaagcagaucgagaucugcaaccgccucgaggagcccggcaacuucguccucaaggagcuccaccccuucgaccuccacgccaugcagaacaucauccucaaguacaagacccaguucgagggcaugaaccaccgcguccagcgcuccgaggacacccucaaggcccucgaggacuuccucgccucccuccgcaccgccaagcucuccgccgagcccgucaccgaccucuccgccuccgacacccaggucgcccaggagaacacccucaccgucaagaacaaggagggcgagauccaccucaugaaggacaaggccaagcaccucgacaagugccucaagaugcucgacauguccuucaaggacgccgagcgcggcgacgacaccuccugcgagaaccuccucgacgccuucuccaucaagcucuccgagacccacggcuacggcguccaggaggaguucaccgaggagaacaagcuccucgaggccugcaucuucaagaacaacgagcuccucaagaacauccaggacguccagucccagaucuccaagaucggccucaaggaccccaccguccccgccgucaagcaccgcaagaagucccucauccgccucgacaagguccucgacgaguacgaggaggagaagcgccaccuccaggagauggccaacucccucccccacuucaaggacggccgcgagaagaccgucaaccagcagugccagaacaccgucguccucugggagaacaccaaggcccucgucaccgagugccucgagcagugcggccgcguccucgagcuccucaagcaguaccagaacuucaaguccauccucaccacccucauccagaaggaggaguccgucaucucccuccaggccuccuacaugggcaaggagaaccucaagaagcgcaucgccgagaucgagaucgucaaggaggaguucaacgagcaccucgaggucgucgacaagaucaaccaggucugcaagaaccuccaguucuaccucaacaagaugaagaccuucgaggagccccccuucgagaaggaggccaacaucaucgucgaccgcuggcucgacaucaacgagaagaccgaggacuacuacgagaaccucggccgcgcccucgcccucugggacaagcucuucaaccucaagaacgucaucgacgaguggaccgagaaggcccuccagaagauggagcuccaccagcucaccgaggaggaccgcgagcgccucaaggaggagcuccagguccacgagcagaagaccuccgaguucucccgccgcgucgccgagauccaguuccuccuccaguccuccgagaucccccucgagcuccaggucauggaguccuccauccucaacaagauggagcacguccagaagugccucaccggcgaguccaacugccacgcccucuccggcuccaccgccgagcuccgcgaggaccucgaccaggccaagacccagaucggcaugaccgagucccuccucaaggcccucucccccuccgacucccucgagaucuucaccaagcucgaggagauccagcagcagauccuccagcagaagcacuccaugauccuccucgagaaccagaucggcugccucacccccgagcucuccgagcucaagaagcaguacgaguccgucuccgaccucuucaacaccaagaaguccguccuccaggaccacuucuccaagcuccucaacgaccagugcaagaacuucaacgacugguucuccaacaucaaggucaaccucaaggagugcuucgaguccuccgagaccaagaaguccgucgagcagaagcuccagaagcucuccgacuuccucacccucgagggccgcaacuccaagaucaagcaggucgacuccguccucaagcacgucaagaagcaccuccccaaggcccacgucaaggagcucaucuccuggcucgucggccaggaguucgagcucgagaagauggaguccaucugccaggcccgcgccaaggagcucgaggacucccuccagcagcuccuccgccuccaggacgaccaccgcaaccuccgcaaguggcucaccaaccaggaggagaaguggaagggcauggaggagcccggcgagaagaccgagcucuucugccaggcccucgcccgcaagcgcgagcaguucgaguccgucgcccagcucaacaacucccucaaggaguacggcuucaccgaggaggaggagaucaucauggaggccaccugccucauggaccgcuaccagacccuccuccgccagcucuccgagaucgaggaggaggacaagcuccuccccaccgaggaccaguccuucaacgaccucgcccacgacgucauccacuggaucaaggagaucaaggagucccucaugguccucaacuccuccgagggcaagaugccccucgaggagcgcauccagaagaucaaggagaucauccuccucaagcccgagggcgacgcccgcaucgagaccaucaugaagcaggccgaguccuccgaggccccccucguccagaagacccucaccgacaucuccaaccagugggacaacacccuccaccucgccuccaccuaccucucccaccaggagaagcuccuccucgagggcgagaaguaccuccaguccaaggaggaccuccgccucaugcucaucgagcucaagaagaagcaggaggccggcuucgcccuccagcacggccuccaggagaagaaggcccagcucaagaucuacaagaaguuccucaagaaggcccaggaccucaccucccuccucaaggagcucaagucccagggcaacuaccuccucgagugcaccaagaaccccuccuucuccgaggagcccuggcucgagaucaagcaccuccacgagucccuccuccagcagcuccaggacuccguccagaaccucgacggccacguccgcgagcacgacuccuaccaggucugcgucaccgaccucaacaccacccucgacaacuucuccaaggaguucgucuccuucuccgacaagcccgucgaccagaucgccgucgaggagaagcuccagaagcuccaggagcucgagaaccgccucucccuccaggacggcacccucaagaagauccucgcccucgccaaguccgucaagcagaacaccuccuccgucggccagaagaucaucaaggacgacaucaagucccuccagugcaagcagaaggaccucgagaaccgccucgccuccgccaagcaggagauggagugcugccucaacuccauccucaaguccaagcgcuccaccgagaagaagggcaaguucacccuccccggccgcgagaagcaggccaccuccgacguccaggaguccacccaggaguccgccgccgucgagaagcucgaggaggacugggagaucaacaaggacuccgccgucgagauggccauguccaagcagcucucccucaacgcccaggaguccaugaagaacaccgaggacgagcgcaaggucaacgagcuccagaaccagccccucgagcucgacaccaugcuccgcaacgagcagcucgaggagaucgagaagcucuacacccagcucgaggccaagaaggccgccaucaagccccucgagcagaccgagugccucaacaagaccgagaccggcgcccucguccuccacaacaucggcuacuccgcccagcaccucgacaaccuccuccaggcccucaucacccucaagaagaacaaggagucccaguacugcguccuccgcgacuuccaggaguaccucgccgccgucgaguccuccaugaaggcccuccucaccgacaaggagucccucaaggucggcccccucgacuccgucaccuaccucgacaagaucaagaaguucaucgccuccaucgagaaggagaaggacucccucggcaaccucaagaucaagugggagaaccucuccaaccacgucaccgacauggacaagaagcuccucgagucccagaucaagcagcucgagcacggcugggagcaggucgagcagcagauccagaagaaguacucccagcaggucgucgaguacgacgaguucaccacccucaugaacaagguccaggacaccgagaucucccuccagcagcagcagcagcaccuccagcuccgccucaagucccccgaggagcgcgccggcaaccaguccaugaucgcccucaccaccgaccuccaggccaccaagcacggcuucuccguccucaagggccaggccgagcuccagaugaagcgcaucuggggcgagaaggagaagaagaaccucgaggacggcaucaacaaccucaagaagcagugggagacccucgagccccuccaccucgaggccgagaaccagaucaagaagugcgacauccgcaacaagaugaaggagaccauccucugggccaagaaccuccucggcgagcucaaccccuccaucccccuccuccccgacgacauccucucccagauccgcaagugcaaggucacccacgacggcauccucgcccgccagcaguccgucgagucccucgccgaggaggucaaggacaagguccccucccucaccaccuacgagggcuccgaccucaacaacacccucgaggaccuccgcaaccaguaccagaugcucguccucaaguccacccagcgcucccagcagcucgaguucaagcucgaggagcgcuccaacuucuucgccaucauccgcaaguuccagcucaugguccaggaguccgagacccucaucaucccccgcgucgagaccgccgccaccgaggccgagcucaagcaccaccacgucacccucgaggccucccagaaggagcuccaggagaucgacuccggcaucuccacccaccuccaggagcucaccaacaucuacgaggagcucaacgucuucgagcgccucuuccucgaggaccagcucaagaaccucaagauccgcaccaaccgcauccagcgcuucauccagaacaccugcaacgaggucgagcacaagaucaaguucugccgccaguuccacgagaagaccuccgcccuccaggaggaggccgacuccauccagcgcaacgagcuccuccucaaccaggaggucaacaagggcgucaaggaggagaucuacaaccucaaggaccgccucaccgccaucaagugcugcauccuccagguccucaagcucaagaaggucuucgacuacaucggccucaacugggacuucucccagcucgaccagcuccagacccaggucuucgagaaggagaaggagcucgaggagaagaucaagcagcucgacaccuucgaggaggagcacggcaaguaccaggcccuccucuccaagaugcgcgccaucgaccuccagaucaagaagaugaccgaggucguccucaaggcccccgacuccucccccgagucccgccgccucaacgcccagauccucucccagcgcaucgagaaggccaagugccucugcgacgagaucaucaagaagcucaacgagaacaagaccuucgacgacuccuucaaggagaaggagauccuccagaucaagcucaacgccgaggagaacgacaagcucuacaagguccuccagaacaugguccucgagcucucccccaaggagcucgacgagaagaacugccaggacaagcucgagaccucccuccacguccucaaccagaucaagucccagcuccagcagccccuccucaucaaccucgagaucaagcacauccagaacgagaaggacaacugcgaggccuuccaggagcaggucugggccgagaugugcuccaucaaggccgucaccgccaucgagaagcagcgcgaggagaacuccuccgaggccuccgacgucgagaccaagcuccgcgaguucgaggaccuccagaugcagcucaacaccuccaucgaccuccgcaccaacguccucaacgacgccuacgagaaccucacccgcuacaaggaggccgucacccgcgccgucgaguccaucaccucccucgaggccaucaucauccccuaccgcgucgacgucggcaaccccgaggagucccucgagaugccccuccgcaagcaggaggagcucgaguccaccgucgcccacauccaggaccucaccgagaagcucggcaugaucuccucccccgaggccaagcuccagcuccaguacacccuccaggagcucgucuccaagaacuccgccaugaaggaggccuucaaggcccaggagaccgaggccgagcgcuaccucgagaacuacaagugcuaccgcaagauggaggaggacaucuacaccaaccucuccaagauggagaccguccucggccaguccauguccucccucccccucuccuaccgcgaggcccucgagcgccucgagcaguccaaggcccucgucuccaaccucaucuccaccaaggaggagcucaugaagcuccgccagauccuccgccuccuccgccuccgcugcaccgagaacgacggcaucugccuccucaagaucgucuccgcccucugggagaaguggcucucccuccucgaggccgccaaggagugggagauguggugcgaggagcucaagcaggaguggaaguucgucuccgaggagaucgagcgcgaggccaucauccucgacaaccuccaggaggagcuccccgagaucuccaagaccaaggaggccgccaccaccgaggagcucuccgagcuccucgacugccucugccaguacggcgagaacgucgagaagcagcagcuccuccucacccuccuccuccagcgcauccgcuccauccagaacguccccgaguccuccggcgccgucgagaccguccccgccuuccaggagaucaccuccaugaaggagcgcugcaacaagcuccuccagaagguccagaagaacaaggagcucguccagaccgagauccaggagcgccacuccuucaccaaggagaucaucgcccucaagaacuucuuccagcagaccaccaccuccuuccagaacauggccuuccaggaccaccccgagaaguccgagcaguucgaggagcuccaguccauccucaagaagggcaagcucaccuucgagaacaucauggagaagcuccgcaucaaguacuccgagauguacaccaucguccccgccgagaucgagucccaggucgaggagugccgcaaggcccucgaggacaucgacgagaagaucuccaacgagguccucaaguccucccccuccuacgccaugcgccgcaagaucgaggagaucaacaacggccuccacaacgucgagaagaugcuccagcagaaguccaagaacaucgagaaggcccaggagauccagaagaagaugugggacgagcucgaccucuggcacuccaagcucaacgagcucgacuccgagguccaggacaucgucgagcaggaccccggccaggcccaggaguggauggacaaccucaugauccccuuccagcaguaccagcaggucucccagcgcgccgagugccgcaccucccagcucaacaaggccaccgucaagauggaggaguacuccgaccuccucaaguccaccgaggccuggaucgagaacaccucccaccuccucgccaaccccgccgacuacgacucccuccgcacccucucccaccacgccuccaccguccagauggcccucgaggacuccgagcagaagcacaaccuccuccacuccaucuucauggaccucgaggaccucuccaucaucuucgagaccgacgagcucacccaguccauccaggagcucuccaaccaggucaccgcccuccagcagaagaucauggagucccucccccagauccagcgcauggccgacgacgucgucgccaucgaguccgaggucaaguccauggagaagcgcgucuccaagaucaagaccauccuccucuccaaggagaucuucgacuucucccccgaggagcaccucaagcacggcgaggucauccucgagaacauccgccccaugaagaagaccaucgccgagaucgucuccuaccaggucgagcuccgccucccccagaccggcaugaagccccuccccgucuuccagcgcaccaaccagcuccuccaggacaucaagcuccucgagaacgucacccaggagcagaacgagcuccucaaggucgucaucaagcagaccaacgagugggacgaggagaucgagaaccucaagcagauccucaacaacuacuccgcccaguucucccucgagcacaugucccccgaccaggccgacaagcucccccagcuccagggcgagaucgagcgcauggagaagcagauccucucccucaaccagcgcaaggaggaccuccucgucgaccucaaggccaccguccucaaccuccaccagcaccucaagcaggagcaggagggcgucgagcgcgaccgccuccccgccgucaccuccgaggagggcggcgucgccgagcgcgacgccuccgagcgcaagcucaaccgccgcggcuccauguccuaccucgccgccgucgaggaggaggucgaggaguccuccgucaaguccgacaacggcgacgagaaggccgagcccuccccccaguccugguccucccucuggaagcacgacaaggacauggaggaggaccgcgccuccuccuccuccggcaccaucguccaggaggccuacggcaagaucuccaccuccgacaacuccauggcccagauccucacccccgacucccucaacaccgagcagggccccgagugcucccuccgccccaaccagaccgaggagggcaccaccccccccaucgaggccgacacccucgacuccuccgacgcccagggcggccucgagccccgcgucgagaagacccgccccgagcccaccgagguccuccacgccugcaagacccaggucgccgagcucgagcucuggcuccagcaggccaacgucgccgucgagcccgagacccucaacgccgacaugcagcagguccucgagcagcagcucgucggcugccaggccaugcucaccgagaucgagcacaaggucgccuuccuccucgagaccugcaaggaccagggccucggcgacaacggcgccacccagcacgaggccgaggcccucucccucaagcucaagaccgucaagugcaaccucgagaagguccagaugaugcuccaggagaagcacuccgaggaccagcaccccaccauccucaagaaguccuccgagcccgagcaccaggaggcccuccagcccgucaaccucuccgagcucgaguccaucgucaccgagcgcccccaguucucccgccagaaggacuuccagcagcagcagguccucgagcucaagcccauggagcagaaggacuucaucaaguucaucgaguucaacgccaagaagauguggccccaguacugccagcacgacaacgacaccacccaggaguccuccgccuccaaccaggccuccucccccgagaacgacguccccgacuccauccucuccccccagggccagaacggcgacaaguggcaguaccuccaccacgagcucuccuccaagaucaagcucccccucccccagcucgucgagccccaggucuccaccaacaugggcauccuccccuccgucaccauguacaacuuccgcuaccccaccaccgaggagcucaagaccuacaccacccagcucgaggaccuccgccaggaggccuccaaccuccagacccaggagaacaugaccgaggaggccuacaucaaccucgacaagaagcucuucgagcucuuccucacccucucccagugccucuccuccgucgaggagaugcucgagaugccccgccucuaccgcgaggacggcuccggccagcagguccacuacgagacccucgcccucgagcucaagaagcucuaccucgcccucuccgacaagaagggcgaccuccucaaggccaugaccuggcccggcgagaacaccaaccuccuccucgagugcuucgacaaccuccaggucugccucgagcacacccaggccgccgccgucugccgcuccaagucccucaaggccggccucgacuacaaccgcuccuaccagaacgagaucaagcgccucuaccaccagcucaucaaguccaagaccucccuccagcagucccucaacgagaucuccggccaguccgucgccgagcagcuccagaaggccgacgccuacaccgucgagcucgagaacgccgagucccgcgucgccaagcuccgcgacgagggcgagcgccuccaccuccccuacgcccuccuccaggaggucuacaagcucgaggacguccucgacuccauguggggcaugcuccgcgcccgcuacaccgagcucuccucccccuucgucaccgagucccagcaggacgcccuccuccagggcauggucgagcucgucaagaucggcaaggagaagcucgcccacggccaccucaagcagaccaaguccaaggucgcccuccaggcccagaucgagaaccacaaggucuucuuccagaagcucgucgccgacaugcuccucauccaggccuacuccgccaagauccuccccucccuccuccagaaccgcgagaccuucugggccgagcaggucaccgaggucaagauccucgaggagaagucccgccagugcggcaugaagcuccagucccuccuccagaagugggaggaguucgacgagaacuacgccucccucgagaaggaccucgagauccucaucuccacccuccccuccgucucccucgucgaggagaccgaggagcgccucgucgagcgcaucuccuucuaccagcagaucaagcgcaacaucggcggcaagcacgcccgccucuaccagacccucaacgagggcaagcagcucgucgccuccgucuccugccccgagcucgagggccagaucgccaagcucgaggagcaguggcucucccucaacaagaagaucgaccacgagcuccaccgccuccaggcccuccucaagcaccuccucuccuacaaccgcgacuccgaccagcucaccaaguggcucgaguccucccagcacacccucaacuacuggaaggagcagucccucaacgucucccaggaccucgacaccauccgcuccaacaucaacaacuucuucgaguucuccaaggaggucgacgagaaguccucccucaagaccgccgucaucuccaucggcaaccagcuccuccaccucaaggagaccgacaccgccacccuccgcgccucccucgcccaguucgagcagaaguggaccaugcucaucacccagcuccccgacauccaggagaagcuccaccagcuccagauggagaagcuccccucccgcaaggccaucaccgagaugaucuccuggaugaacaacgucgagcaccagaccuccgacgaggacuccguccacucccccuccuccgccucccaggucaagcaccuccuccagaagcacaaggaguuccgcauggagauggacuacaagcaguggaucgucgacuucgucaaccagucccuccuccagcucuccaccugcgacgucgaguccaagcgcuacgagcgcaccgaguucgccgagcaccucggcgagaugaaccgccaguggcaccgcguccacggcaugcucaaccgcaagauccagcaccucgagcagcuccucgaguccaucaccgaguccgagaacaagauccagauccucaacaacuggcucgaggcccaggaggagcgccucaagacccuccagaagcccgaguccgucaucuccguccagaagcuccuccucgacugccaggacaucgagaaccagcucgccaucaaguccaaggcccucgacgagcucaagcaguccuaccucacccucgaguccggcgccgucccccuccucgaggacaccgccucccgcaucgacgagcucuuccagaagcgcuccuccguccucacccaggucaaccagcucaagaccuccaugcaguccguccuccaggaguggaagaucuacgaccagcucuacgacgaggucaacaugaugaccauccgcuucugguacugcauggagcacuccaagcccgucguccucucccucgagacccuccgcugccaggucgagaaccuccagucccuccaggacgaggccgaguccuccgagggcuccugggagaagcuccaggaggucaucggcaagcucaagggccucugccccuccgucgccgagaucaucgaggagaagugccagaacacccacaagcgcuggacccaggucaaccaggccaucgccgaccagcuccagaaggcccagucccuccuccagcucuggaaggccuacuccaacgcccacggcgaggccgccgcccgccucaagcagcaggaggccaaguuccagcagcucgccaacaucuccauguccggcaacaaccucgccgagauccucccccccgcccuccaggacaucaaggagcuccagcacgacguccagaagaccaaggaggccuuccuccagaacuccuccguccucgaccgccucccccagcccgccgaguccuccacccacaugcuccuccccggcccccuccacucccuccagcgcgccgccuaccucgagaagaugcuccucgucaaggccaacgaguucgaguucguccucucccaguucaaggacuucggcguccgccucgagucccucaagggccucaucaugcacgaggaggagaaccucgaccgccuccaccagcaggagaaggagaaccccgacuccuuccucaaccacguccucgcccucaccgcccagucccccgacaucgagcaccucaacgaggucucccucaagcucccccucuccgacgucgccgucaagacccuccagaacaugaaccgccaguggauccgcgccaccgccaccgcccucgagcgcugcuccgagcuccagggcaucggccucaacgagaaguuccucuacugcugcgagaaguggauccagcuccucgagaagaucgaggaggcccucaaggucgacgucgccaacucccuccccgagcuccucgagcagcagaagaccuacaagaugcucgaggccgaggucuccaucaaccagaccaucgccgacuccuacgucacccagucccuccagcuccucgacaccaccgagaucgagaaccgccccgaguucaucaccgaguucuccaagcucaccgaccgcuggcagaacgccguccagggcguccgccagcgcaagggcgacgucgacggccucguccgccaguggcaggacuucaccaccuccgucgagaaccucuuccgcuuccucaccgacaccucccaccuccucuccgccgucaagggccaggagcgcuucucccucuaccagacccgcucccucauccacgagcucaagaacaaggagauccacuuccagcgccgccgcaccaccugcgcccucacccucgaggccggcgagaagcuccuccucaccaccgaccucaagaccaaggaguccgucggccgccgcaucucccagcuccaggacuccuggaaggacauggagccccagcucgccgagaugaucaagcaguuccaguccaccgucgagaccugggaccagugcgagaagaagaucaaggagcucaagucccgccuccagguccucaaggcccaguccgaggacccccuccccgagcuccacgaggaccuccacaacgagaaggagcucaucaaggagcucgagcagucccucgccuccuggacccagaaccucaaggagcuccagaccaugaaggccgaccucacccgccacguccucgucgaggacgucaugguccucaaggagcagaucgagcaccuccaccgccagugggaggaccucugccuccgcgucgccauccgcaagcaggagaucgaggaccgccucaacaccugggucgucuucaacgagaagaacaaggagcucugcgccuggcucguccagauggagaacaagguccuccagaccgccgacaucuccaucgaggagaugaucgagaagcuccagaaggacugcauggaggagaucaaccucuucuccgagaacaagcuccagcucaagcagaugggcgaccagcucaucaaggccuccaacaagucccgcgccgccgagaucgacgacaagcucaacaagaucaacgaccgcuggcagcaccucuucgacgucaucggcucccgcgucaagaagcucaaggagaccuucgccuucauccagcagcucgacaagaacauguccaaccuccgcaccuggcucgcccgcaucgaguccgagcucuccaagcccgucgucuacgacgucugcgacgaccaggagauccagaagcgccucgccgagcagcaggaccuccagcgcgacaucgagcagcacuccgccggcgucgaguccgucuucaacaucugcgacguccuccuccacgacuccgacgccugcgccaacgagaccgagugcgacuccauccagcagaccacccgcucccucgaccgccgcuggcgcaacaucugcgccauguccauggagcgccgcaugaagaucgaggagaccuggcgccucuggcagaaguuccucgacgacuacucccgcuucgaggacuggcucaaguccgccgagcgcaccgccgccugccccaacuccuccgagguccucuacaccuccgccaaggaggagcucaagcgcuucgaggccuuccagcgccagauccacgagcgccucacccagcucgagcucaucaacaagcaguaccgccgccucgcccgcgagaaccgcaccgacaccgccucccgccucaagcagaugguccacgagggcaaccagcgcugggacaaccuccagcgccgcgucaccgccguccuccgccgccuccgccacuucaccaaccagcgcgaggaguucgagggcacccgcgaguccauccucgucuggcucaccgagauggaccuccagcucaccaacgucgagcacuucuccgaguccgacgccgacgacaagaugcgccagcucaacggcuuccagcaggagaucacccucaacaccaacaagaucgaccagcucaucgucuucggcgagcagcucauccagaaguccgagccccucgacgccguccucaucgaggacgagcucgaggagcuccaccgcuacugccaggaggucuucggccgcgucucccgcuuccaccgccgccucaccuccugcacccccggccucgaggacgagaaggaggccuccgagaacgagaccgacauggaggacccccgcgagauccagaccgacuccuggcgcaagcgcggcgaguccgaggagcccuccuccccccagucccucugccaccucgucgcccccggccacgagcgcuccggcugcgagacccccgucuccgucgacuccaucccccucgagugggaccacaccggcgacgucggcggcuccuccucccacgaggaggacgaggagggccccuacuacuccgcccucuccggcaaguccaucuccgacggccacuccuggcacguccccgacucccccuccugccccgagcaccacuacaagcagauggagggcgaccgcaacgucccccccgucccccccgccuccuccacccccuacaagccccccuacggcaagcuccuccucccccccggcaccgacggcggcaaggagggcccccgcguccucaacggcaacccccagcaggaggacggcggccucgccggcaucaccgagcagcaguccggcgccuucgaccgcugggagaugauccaggcccaggagcuccacaacaagcucaagaucaagcagaaccuccagcagcucaacuccgacaucuccgccaucaccaccuggcucaagaagaccgaggccgagcucgagaugcucaagauggccaagccccccuccgacauccaggagaucgagcuccgcgucaagcgccuccaggagauccucaaggccuucgacaccuacaaggcccucgucgucuccgucaacgucuccuccaaggaguuccuccagaccgagucccccgaguccaccgagcuccagucccgccuccgccagcucucccuccucugggaggccgcccagggcgccgucgacuccuggcgcggcggccuccgccagucccucaugcagugccaggacuuccaccagcucucccagaaccuccuccucuggcucgccuccgccaagaaccgccgccagaaggcccacgucaccgaccccaaggccgacccccgcgcccuccucgagugccgccgcgagcucaugcagcucgagaaggagcucgucgagcgccagccccaggucgacaugcuccaggagaucuccaacucccuccucaucaagggccacggcgaggacugcaucgaggccgaggagaagguccacgucaucgagaagaagcucaagcagcuccgcgagcaggucucccaggaccucauggcccuccagggcacccagaaccccgccuccccccuccccuccuucgacgaggucgacuccggcgaccagccccccgccaccuccguccccgccccccgcgccaagcaguuccgcgccguccgcaccaccgagggcgaggaggagaccgagucccgcguccccggcuccacccgcccccagcgcuccuuccucucccgcgucguccgcgccgcccucccccuccagcuccuccuccuccuccuccuccuccucgccugccuccuccccuccuccgaggaggacuacuccugcacccaggccaacaacuucgcccgcuccuucuaccccaugcuccgcuacaccaacggccccccccccaccuga

SEQ ID NO: 50400 - RNA, 1215 nt, Artificial Sequence
  derived and/or modified sequence opt2 from SYNE4__Homo_sapiens__NP_001034965
auggcccucucccucccccucggcccccgccucggcuccgagccccucaaccacccccccggcgccccccgcgaggccgacaucgucggcugcaccgucugccccgccuccggcgaggaguccaccucccccgagcaggcccagacccucggccaggacucccucggcccccccgagcacuuccagggcggcccccgcggcaacgagcccgccgcccaccccccccgcugguccacccccuccuccuacgaggaccccgccggcggcaagcacugcgagcaccccaucuccggccucgagguccucgaggccgagcagaacucccuccaccucugccuccucggccucggccgccgccuccaggaccucgagcagggccucggccacugggcccucgcccaguccggcaugguccagcuccaggcccuccaggucgaccuccgcggcgccgccgagcgcgucgaggcccuccucgccuucggcgagggccucgcccagcgcuccgagccccgcgccugggccgcccucgagcagauccuccgcgcccucggcgccuaccgcgacuccaucuuccgccgccucuggcagcuccaggcccagcucgucuccuacucccucgucuucgaggaggccaacacccucgaccaggaccucgaggucgagggcgacuccgacuggcccggccccggcggcgucuggggccccugggcccccuccucccuccccaccuccaccgagcucgagugggaccccgccggcgacaucggcggccucggcccccucggccagaagaccgcccgcacccucggcguccccugcgagcucugcggccagcgcggcccccagggccgcggccagggccucgaggaggccgacaccucccacucccgccaggacaugcucgaguccggccucggccaccagaagcgccucgcccgccaccagcgccacucccuccuccgcaagccccaggacaagaagcgccaggccuccccccaccuccaggacguccgccucgagggcaaccccggcgcccccgaccccgccucccgccagccccucaccuuccuccucauccucuuccuccucuuccuccuccucgucggcgccauguuccuccuccccgccuccggcggccccugcugcucccacgcccgcaucccccgcacccccuaccucguccucuccuacgucaacggccucccccccgucuga

SEQ ID NO: 50401 - RNA, 4032 nt, Artificial Sequence
  derived and/or modified sequence opt2 from SYNGAP1__Homo_sapiens__NP_006763
augucccgcucccgcgccuccauccaccgcggcuccauccccgccauguccuacgcccccuuccgcgacguccgcggccccuccaugcaccgcacccaguacguccacucccccuacgaccgccccggcuggaacccccgcuucugcaucaucuccggcaaccagcuccucaugcucgacgaggacgagauccacccccuccucauccgcgaccgccgcuccgaguccucccgcaacaagcuccuccgccgcaccgucuccguccccgucgagggccgcccccacggcgagcacgaguaccaccucggccgcucccgccgcaaguccguccccggcggcaagcaguacuccauggagggcgcccccgccgcccccuuccgccccucccagggcuuccucucccgccgccucaaguccuccaucaagcgcaccaagucccagcccaagcucgaccgcaccuccuccuuccgccagauccucccccgcuuccgcuccgccgaccacgaccgcgcccgccucaugcaguccuucaaggagucccacucccacgagucccuccucucccccuccuccgccgccgaggcccucgagcucaaccucgacgaggacuccaucaucaagcccguccacuccuccauccucggccaggaguucugcuucgaggucaccaccuccuccggcaccaagugcuucgccugccgcuccgccgccgagcgcgacaaguggaucgagaaccuccagcgcgccgucaagcccaacaaggacaacucccgccgcgucgacaacguccucaagcucuggaucaucgaggcccgcgagcucccccccaagaagcgcuacuacugcgagcucugccucgacgacaugcucuacgcccgcaccaccuccaagccccgcuccgccuccggcgacaccgucuucuggggcgagcacuucgaguucaacaaccuccccgccguccgcgcccuccgccuccaccucuaccgcgacuccgacaagaagcgcaagaaggacaaggccggcuacgucggccucgucaccguccccgucgccacccucgccggccgccacuucaccgagcagugguaccccgucacccuccccaccggcuccggcggcuccggcggcaugggcuccggcggcggcggcggcuccggcggcggcuccggcggcaagggcaagggcggcugccccgccguccgccucaaggcccgcuaccagaccauguccauccuccccauggagcucuacaaggaguucgccgaguacgucaccaaccacuaccgcaugcucugcgccguccucgagcccgcccucaacgucaagggcaaggaggaggucgccuccgcccucguccacauccuccaguccaccggcaaggccaaggacuuccucuccgacauggccauguccgaggucgaccgcuucauggagcgcgagcaccucaucuuccgcgagaacacccucgccaccaaggccaucgaggaguacaugcgccucaucggccagaaguaccucaaggacgccaucggcgaguucauccgcgcccucuacgaguccgaggagaacugcgaggucgaccccaucaagugcaccgccuccucccucgccgagcaccaggccaaccuccgcaugugcugcgagcucgcccucugcaaggucgucaacucccacugcgucuucccccgcgagcucaaggaggucuucgccuccuggcgccuccgcugcgccgagcgcggccgcgaggacaucgccgaccgccucaucuccgccucccucuuccuccgcuuccucugccccgccaucaugucccccucccucuucggccucaugcaggaguaccccgacgagcagaccucccgcacccucacccucaucgccaaggucauccagaaccucgccaacuucuccaaguucaccuccaaggaggacuuccucggcuucaugaacgaguuccucgagcucgaguggggcuccaugcagcaguuccucuacgagaucuccaaccucgacacccucaccaacuccuccuccuucgagggcuacaucgaccucggccgcgagcucuccacccuccacgcccuccucugggagguccucccccagcucuccaaggaggcccuccucaagcucggcccccucccccgccuccucaacgacaucuccaccgcccuccgcaaccccaacauccagcgccagcccucccgccaguccgagcgcccccgcccccagcccgucguccuccgcggccccuccgccgagaugcagggcuacaugaugcgcgaccucaacuccuccaucgaccuccaguccuucauggcccgcggccucaacuccuccauggacauggcccgccuccccucccccaccaaggagaagccccccccccccccccccggcggcggcaaggaccucuucuacgucucccgccccccccucgcccgcuccucccccgccuacugcaccuccuccuccgacaucaccgagcccgagcagaagaugcucuccgucaacaaguccgucuccaugcucgaccuccagggcgacggccccggcggccgccucaacuccuccuccgucuccaaccucgccgccgucggcgaccuccuccacuccucccaggccucccucaccgccgcccucggccuccgccccgcccccgccggccgccucucccagggcuccggcuccuccaucaccgccgccggcaugcgccucucccagaugggcgucaccaccgacggcguccccgcccagcagcuccgcaucccccucuccuuccagaacccccucuuccacauggccgccgacggccccggcccccccggcggccacggcggcggcggcggccacggcccccccuccucccaccaccaccaccaccaccaccaccaccaccgcggcggcgagccccccggcgacaccuucgcccccuuccacggcuacuccaaguccgaggaccucuccuccggcguccccaagccccccgccgccuccauccuccacucccacuccuacuccgacgaguucggccccuccggcaccgacuucacccgccgccagcucucccuccaggacaaccuccagcacaugcucucccccccccagaucaccaucggcccccagcgccccgcccccuccggccccggcggcggcuccggcggcggcuccggcggcggcggcggcggccagccccccccccuccagcgcggcaagucccagcagcucaccgucuccgccgcccagaagccccgccccuccuccggcaaccuccuccagucccccgagcccuccuacggccccgcccgcccccgccagcagucccucuccaaggagggcuccaucggcggcuccggcggcuccggcggcggcggcggcggcggccucaagcccuccaucaccaagcagcacucccagacccccuccacccucaaccccaccaugcccgccuccgagcgcaccgucgccugggucuccaacaugccccaccucuccgccgacaucgaguccgcccacaucgagcgcgaggaguacaagcucaaggaguacuccaaguccauggacgagucccgccucgaccgcgucaaggaguacgaggaggagauccacucccucaaggagcgccuccacauguccaaccgcaagcucgaggaguacgagcgccgccuccucucccaggaggagcagaccuccaagauccucaugcaguaccaggcccgccucgagcaguccgagaagcgccuccgccagcagcaggccgagaaggacucccagaucaaguccaucaucggccgccucaugcucgucgaggaggagcuccgccgcgaccaccccgccauggccgagccccuccccgagcccaagaagcgccuccucgacgcccaggagcgccagcuccccccccucggccccaccaacccccgcgucacccucgccccccccuggaacggccucgccccccccgccccccccccccccccccgccuccagaucaccgagaacggcgaguuccgcaacaccgccgaccacuga

SEQ ID NO: 50402 - RNA, 702 nt, Artificial Sequence
  derived and/or modified sequence opt2 from SYNGR1__Homo_sapiens__NP_004702
auggagggcggcgccuacggcgccggcaaggccggcggcgccuucgaccccuacacccucguccgccagccccacaccauccuccgcgucgucuccuggcucuucuccaucgucgucuucggcuccaucgucaacgagggcuaccucaacuccgccuccgagggcgaggaguucugcaucuacaaccgcaaccccaacgccugcuccuacggcgucgccgucggcguccucgccuuccucaccugccuccucuaccucgcccucgacgucuacuucccccagaucuccuccgucaaggaccgcaagaaggccguccucuccgacaucggcgucuccgccuucugggccuuccucugguucgucggcuucugcuaccucgccaaccaguggcaggucuccaagcccaaggacaacccccucaacgagggcaccgacgccgcccgcgccgccaucgccuucuccuucuucuccaucuucaccugggccggccaggccguccucgccuuccagcgcuaccagaucggcgccgacuccgcccucuucucccaggacuacauggaccccucccaggacuccuccaugcccuacgcccccuacgucgagcccaccggccccgaccccgccggcaugggcggcaccuaccagcagcccgccaacaccuucgacaccgagccccagggcuaccagucccagggcuacuga

SEQ ID NO: 50403 - RNA, 675 nt, Artificial Sequence
  derived and/or modified sequence opt2 from SYNGR2__Homo_sapiens__NP_004701
auggaguccggcgccuacggcgccgccaaggccggcggcuccuucgaccuccgccgcuuccucacccagccccaggucgucgcccgcgccgucugccucgucuucgcccucaucgucuucuccugcaucuacggcgagggcuacuccaacgcccacgaguccaagcagauguacugcgucuucaaccgcaacgaggacgccugccgcuacggcuccgccaucggcguccucgccuuccucgccuccgccuucuuccucgucgucgacgccuacuucccccagaucuccaacgccaccgaccgcaaguaccucgucaucggcgaccuccucuucuccgcccucuggaccuuccucugguucgucggcuucugcuuccucaccaaccagugggccgucaccaaccccaaggacguccucgucggcgccgacuccguccgcgccgccaucaccuucuccuucuucuccaucuucuccuggggcguccucgccucccucgccuaccagcgcuacaaggccggcgucgacgacuucauccagaacuacgucgaccccacccccgaccccaacaccgccuacgccuccuaccccggcgccuccgucgacaacuaccagcagccccccuucacccagaacgccgagaccaccgagggcuaccagcccccccccgucuacuga

SEQ ID NO: 50404 - RNA, 3888 nt, Artificial Sequence
  derived and/or modified sequence opt2 from SYNJ1__Homo_sapiens__NP_001153774
auggccuucuccaagggcuuccgcaucuaccacaagcucgaccccccccccuucucccucaucgucgagacccgccacaaggaggagugccucauguucgaguccggcgccgucgccguccucuccuccgccgagaaggaggccaucaagggcaccuacuccaagguccucgacgccuacggccuccucggcguccuccgccucaaccucggcgacaccaugcuccacuaccucguccucgucaccggcugcauguccgucggcaagauccaggaguccgaggucuuccgcgucaccuccaccgaguucaucucccuccgcaucgacuccuccgacgaggaccgcaucuccgagguccgcaagguccucaacuccggcaacuucuacuucgccugguccgccuccggcaucucccucgaccucucccucaacgcccaccgcuccaugcaggagcagaccaccgacaaccgcuucuucuggaaccagucccuccaccuccaccucaagcacuacggcgucaacugcgacgacuggcuccuccgccucaugugcggcggcgucgagauccgcaccaucuacgccgcccacaagcaggccaaggccugccucaucucccgccucuccugcgagcgcgccggcacccgcuucaacguccgcggcaccaacgacgacggccacgucgccaacuucgucgagaccgagcaggucgucuaccucgacgacuccgucuccuccuucauccagauccgcggcuccgucccccucuucugggagcagcccggccuccaggucggcucccaccgcguccgcaugucccgcggcuucgaggccaacgcccccgccuucgaccgccacuuccgcacccucaagaaccucuacggcaagcagaucaucgucaaccuccucggcuccaaggagggcgagcacaugcucuccaaggccuuccagucccaccucaaggccuccgagcacgccgccgacauccagauggucaacuucgacuaccaccagauggucaagggcggcaaggccgagaagcuccacuccguccucaagccccagguccagaaguuccucgacuacggcuucuucuacuucaacggcuccgagguccagcgcugccaguccggcaccguccgcaccaacugccucgacugccucgaccgcaccaacuccguccaggccuuccucggccucgagaugcucgccaagcagcucgaggcccucggccucgccgagaagccccagcucgucacccgcuuccaggaggucuuccgcuccaugugguccgucaacggcgacuccaucuccaagaucuacgccggcaccggcgcccucgagggcaaggccaagcucaaggacggcgcccgcuccgucacccgcaccauccagaacaacuucuucgacuccuccaagcaggaggccaucgacguccuccuccucggcaacacccucaacuccgaccucgccgacaaggcccgcgcccuccucaccaccggcucccuccgcgucuccgagcagacccuccaguccgccuccuccaagguccucaaguccaugugcgagaacuucuacaaguacuccaagcccaagaagauccgcgucugcgucggcaccuggaacgucaacggcggcaagcaguuccgcuccaucgccuucaagaaccagacccucaccgacuggcuccucgacgcccccaagcucgccggcauccaggaguuccaggacaagcgcuccaagcccaccgacaucuucgccaucggcuucgaggagauggucgagcucaacgccggcaacaucgucuccgccuccaccaccaaccagaagcucugggccgucgagcuccagaagaccaucucccgcgacaacaaguacguccuccucgccuccgagcagcucgucggcgucugccucuucgucuucauccgcccccagcacgcccccuucauccgcgacgucgccgucgacaccgucaagaccggcaugggcggcgccaccggcaacaagggcgccgucgccauccgcaugcucuuccacaccaccucccucugcuucgucugcucccacuucgccgccggccagucccaggucaaggagcgcaacgaggacuucaucgagaucgcccgcaagcucuccuuccccaugggccgcaugcucuucucccacgacuacgucuucuggugcggcgacuucaacuaccgcaucgaccuccccaacgaggaggucaaggagcucauccgccagcagaacugggacucccucaucgccggcgaccagcucaucaaccagaagaacgccggccaggucuuccgcggcuuccucgagggcaaggucaccuucgcccccaccuacaaguacgaccucuucuccgacgacuacgacaccuccgagaagugccgcacccccgccuggaccgaccgcguccucuggcgccgccgcaaguggcccuucgaccgcuccgccgaggaccucgaccuccucaacgccuccuuccaggacgaguccaagauccucuacaccuggacccccggcacccuccuccacuacggccgcgccgagcucaagaccuccgaccaccgccccgucgucgcccucaucgacaucgacaucuucgaggucgaggccgaggagcgccagaacaucuacaaggaggucaucgccguccagggcccccccgacggcaccguccucgucuccaucaaguccucccuccccgagaacaacuucuucgacgacgcccucaucgacgagcuccuccagcaguucgccuccuucggcgaggucauccucauccgcuucgucgaggacaagaugugggucaccuuccucgagggcuccuccgcccucaacguccucucccucaacggcaaggagcuccucaaccgcaccaucaccaucgcccucaagucccccgacuggaucaagaaccucgaggaggagaugucccucgagaagaucuccaucgcccuccccuccuccaccuccuccacccuccucggcgaggacgccgaggucgccgccgacuucgacauggagggcgacgucgacgacuacuccgccgaggucgaggagcuccucccccagcaccuccagcccuccuccuccuccggccucggcaccucccccuccuccuccccccgcaccucccccugccagucccccaccaucuccgagggccccguccccucccuccccauccgccccucccgcgcccccucccgcacccccggcccccccuccgcccaguccucccccaucgacgcccagcccgccaccccccucccccagaaggaccccgcccagccccucgagcccaagcgccccccccccccccgccccgucgccccccccacccgccccgcccccccccagcgcccccccccccccuccggcgcccgcucccccgcccccacccgcaaggaguucggcgcccccaagucccccggcaccacccgcaaggacaacaucggccgcucccagcccuccccccaggccggccucgccggccccggccccgccggcuacuccaccgcccgccccaccauccccccccgcgccggcgucaucuccgccccccagucccacgcccgcgccuccgccggccgccucacccccgagucccaguccaagaccuccgagaccuccaagggcuccaccuuccuccccgagccccucaagccccaggccgccuuccccccccaguccucccuccccccccccgcccagcgccuccaggagccccucguccccgucgccgcccccaugccccaguccggcccccagcccaaccucgagacccccccccagccccccccccgcucccgcuccucccacucccuccccuccgaggccuccucccagccccagcaggagcagcccuccggcuga

SEQ ID NO: 50405 - RNA, 438 nt, Artificial Sequence
  derived and/or modified sequence opt2 from SYNJ2BP__Homo_sapiens__NP_060843
augaacggccgcgucgacuaccucgucaccgaggaggagaucaaccucacccgcggccccuccggccucggcuucaacaucgucggcggcaccgaccagcaguacgucuccaacgacuccggcaucuacgucucccgcaucaaggagaacggcgccgccgcccucgacggccgccuccaggagggcgacaagauccucuccgucaacggccaggaccucaagaaccuccuccaccaggacgccgucgaccucuuccgcaacgccggcuacgccgucucccuccgcguccagcaccgccuccagguccagaacggccccaucggccaccgcggcgagggcgaccccuccggcauccccaucuucaugguccucguccccgucuucgcccucaccauggucgccgccugggccuucaugcgcuaccgccagcagcucuga

SEQ ID NO: 50406 - RNA, 3780 nt, Artificial Sequence
  derived and/or modified sequence opt2 from SYNJ2__Homo_sapiens__NP_001171559
augaucuacauggacgacggcgucuccuccuucguccagauccgcggcuccgucccccucuucugggagcagcccggccuccaggucggcucccaccaccuccgccuccaccgcggccucgaggccaacgcccccgccuucgaccgccacaugguccuccucaaggagcaguacggccagcaggucgucgucaaccuccucggcucccgcggcggcgaggagguccucaaccgcgccuucaagaagcuccucugggccuccugccacgccggcgacacccccaugaucaacuucgacuuccaccaguucgccaagggcggcaagcucgagaagcucgagacccuccuccgcccccagcucaagcuccacugggaggacuucgacgucuucaccaagggcgagaacgucuccccccgcuuccagaagggcacccuccgcaugaacugccucgacugccucgaccgcaccaacaccguccaguccuucaucgcccucgagguccuccaccuccagcucaagacccucggccucuccuccaagcccaucgucgaccgcuucgucgaguccuucaaggccauguggucccucaacggccacucccucuccaaggucuucaccggcucccgcgcccucgagggcaaggccaaggucggcaagcucaaggacggcgcccgcuccaugucccgcaccauccaguccaacuucuucgacggcgucaagcaggaggccaucaagcuccuccucgucggcgacgucuacggcgaggaggucgccgacaagggcggcaugcuccucgacuccaccgcccuccucgucaccccccgcauccucaaggccaugaccgagcgccaguccgaguucaccaacuucaagcgcauccgcaucgccaugggcaccuggaacgucaacggcggcaagcaguuccgcuccaacguccuccgcaccgccgagcucaccgacuggcuccucgacuccccccagcucuccggcgccaccgacucccaggacgacuccucccccgccgacaucuucgccgucggcuucgaggagauggucgagcucuccgccggcaacaucgucaacgccuccaccaccaacaagaagauguggggcgagcagcuccagaaggccaucucccgcucccaccgcuacauccuccucaccuccgcccagcucgucggcgucugccucuacaucuucguccgccccuaccacguccccuucauccgcgacgucgccaucgacaccgucaagaccggcaugggcggcaaggccggcaacaagggcgccgucggcauccgcuuccaguuccacuccaccuccuucugcuucaucugcucccaccucaccgccggccagucccaggucaaggagcgcaacgaggacuacaaggagaucacccagaagcucugcuuccccaugggccgcaacgucuucucccacgacuacgucuucuggugcggcgacuucaacuaccgcaucgaccucaccuacgaggaggucuucuacuucgucaagcgccaggacuggaagaagcuccucgaguucgaccagcuccagcuccagaaguccuccggcaagaucuucaaggacuuccacgagggcgccaucaacuucggccccaccuacaaguacgacgucggcuccgccgccuacgacaccuccgacaagugccgcacccccgccuggaccgaccgcguccucugguggcgcaagaagcaccccuucgacaagaccgccggcgagcucaaccuccucgacuccgaccucgacgucgacaccaagguccgccacaccuggucccccggcgcccuccaguacuacggccgcgccgagcuccaggccuccgaccaccgccccguccucgccaucgucgaggucgagguccaggaggucgacgucggcgcccgcgagcgcgucuuccaggaggucuccuccuuccagggcccccucgacgccaccgucgucgucaaccuccagucccccacccucgaggagaagaacgaguuccccgaggaccuccgcaccgagcucaugcagacccucggcuccuacggcaccaucguccucguccgcaucaaccagggccagaugcucgucaccuucgccgacucccacuccgcccucuccguccucgacgucgacggcaugaaggucaagggccgcgccgucaagauccgccccaagaccaaggacuggcucaagggccuccgcgaggagaucauccgcaagcgcgacuccauggcccccgucucccccaccgccaacuccugccuccucgaggagaacuucgacuucaccucccucgacuacgaguccgagggcgacauccucgaggacgacgaggacuaccucgucgacgaguucaaccagcccggcgucuccgacuccgagcucggcggcgacgaccucuccgacguccccggccccaccgcccucgccccccccuccaagucccccgcccucaccaagaagaagcagcaccccaccuacaaggacgacgccgaccucgucgagcucaagcgcgagcucgaggccgucggcgaguuccgccaccgcucccccucccgcucccucuccguccccaaccgcccccgccccccccagcccccccagcgcccccccccccccaccggccucauggucaagaaguccgccuccgacgccuccaucuccuccggcacccacggccaguacuccauccuccagaccgcccgccuccuccccggcgccccccagcagccccccaaggcccgcaccggcaucuccaagcccuacaacgucaagcagaucaagaccaccaacgcccaggaggccgaggccgccauccgcugccuccucgaggcccgcggcggcgccuccgaggaggcccucuccgccgucgccccccgcgaccucgaggccuccuccgagcccgagcccacccccggcgccgccaagcccgagaccccccaggcccccccccuccucccccgccgcccccccccccgcguccccgccaucaagaagcccacccuccgccgcaccggcaagccccucucccccgaggagcaguucgagcagcagaccguccacuucaccaucggcccccccgagaccuccgucgaggccccccccgucgucaccgccccccgcgucccccccguccccaagccccgcaccuuccagcccggcaaggccgccgagcgccccucccaccgcaagcccgccuccgacgaggccccccccggcgccggcgccuccgucccccccccccucgaggcccccccccucguccccaagguccccccccgccgcaagaaguccgcccccgccgccuuccaccuccagguccuccaguccaacucccagcuccuccagggccucaccuacaacuccuccgacucccccuccggccacccccccgccgccggcaccgucuucccccagggcgacuuccucuccaccuccuccgccaccucccccgacuccgacggcaccaaggccaugaagcccgaggccgccccccuccucggcgacuaccaggaccccuucuggaaccuccuccaccaccccaagcuccucaacaacaccuggcucuccaaguccuccgacccccucgacuccggcacccgcucccccaagcgcgaccccaucgaccccgucuccgccggcgccuccgccgccaaggccgagcucccccccgaccacgagcacaagacccucggccacugggucaccaucuccgaccaggagaagcgcaccgcccuccaggucuucgacccccucgccaagaccuga

SEQ ID NO: 50407 - RNA, 3762 nt, Artificial Sequence
  derived and/or modified sequence opt2 from SYNM__Homo_sapiens__NP_056101
augcucuccuggcgccuccagaccggccccgagaaggccgagcuccaggagcucaacgcccgccucuacgacuacgucugccgcguccgcgagcucgagcgcgagaaccuccuccucgaggaggagcuccgcggccgccgcggccgcgagggccucugggccgagggccaggcccgcugcgccgaggaggcccgcucccuccgccagcagcucgacgagcucuccugggccaccgcccucgccgagggcgagcgcgacgcccuccgccgcgagcuccgcgagcuccagcgccucgacgccgaggagcgcgccgcccgcggccgccucgacgccgagcucggcgcccagcagcgcgagcuccaggaggcccucggcgcccgcgccgcccucgaggcccuccucggccgccuccaggccgagcgccgcggccucgacgccgcccacgagcgcgacguccgcgagcuccgcgcccgcgccgccucccucaccaugcacuuccgcgcccgcgccaccggccccgccgccccccccccccgccuccgcgagguccacgacuccuacgcccuccucgucgccgaguccuggcgcgagaccguccagcucuacgaggacgagguccgcgagcucgaggaggcccuccgccgcggccaggagucccgccuccaggccgaggaggagacccgccucugcgcccaggaggccgaggcccuccgccgcgaggcccucggccucgagcagcuccgcgcccgccucgaggacgcccuccuccgcaugcgcgaggaguacggcauccaggccgaggagcgccagcgcgucaucgacugccucgaggacgagaaggccacccucacccucgccauggccgacuggcuccgcgacuaccaggaccuccuccaggucaagaccggccucucccucgaggucgccaccuaccgcgcccuccucgagggcgaguccaaccccgagaucgucaucugggccgagcacgucgagaacaugcccuccgaguuccgcaacaaguccuaccacuacaccgacucccuccuccagcgcgagaacgagcgcaaccucuucucccgccagaaggccccccucgccuccuucaaccacuccuccgcccucuacuccaaccucuccggccaccgcggcucccagaccggcaccuccaucggcggcgacgcccgccgcggcuuccucggcuccggcuacuccuccuccgccaccacccagcaggagaacuccuacggcaaggccgucuccucccagaccaacguccgcaccuucucccccaccuacggccuccuccgcaacaccgaggcccaggucaagaccuuccccgaccgccccaaggccggcgacacccgcgagguccccgucuacaucggcgaggacuccaccaucgcccgcgaguccuaccgcgaccgccgcgacaaggucgccgccggcgccuccgaguccacccgcuccaacgagcgcaccgucauccucggcaagaagaccgaggucaaggccacccgcgagcaggagcgcaaccgccccgagaccauccgcaccaagcccgaggagaagauguucgacuccaaggagaaggccuccgaggagcgcaaccuccgcugggaggagcucaccaagcucgacaaggaggcccgccagcgcgagucccagcagaugaaggagaaggccaaggagaaggacucccccaaggagaaguccguccgcgagcgcgagguccccaucucccucgaggucucccaggaccgccgcgccgaggucucccccaagggccuccagacccccgucaaggacgccggcggcggcaccggccgcgaggccgaggcccgcgagcuccgcuuccgccucggcaccuccgacgccaccggcucccuccagggcgacuccaugaccgagaccgucgccgagaacaucgucaccuccauccucaagcaguucacccagucccccgagaccgaggccuccgccgacuccuuccccgacaccaaggucaccuacgucgaccgcaaggagcuccccggcgagcgcaagaccaagaccgagaucgucgucgaguccaagcucaccgaggacgucgacgucuccgacgaggccggccucgacuaccuccucuccaaggacaucaaggaggucggccucaagggcaaguccgccgagcagaugaucggcgacaucaucaaccucggccucaagggccgcgagggccgcgccaaggucgucaacgucgagaucgucgaggagcccgucuccuacgucuccggcgagaagcccgaggaguucuccguccccuucaaggucgaggaggucgaggacgucucccccggccccuggggccucgucaaggaggaggagggcuacggcgaguccgacgucaccuucuccgucaaccagcaccgccgcaccaagcagccccaggagaacaccacccacgucgaggaggucaccgaggccggcgacuccgagggcgagcaguccuacuucgucuccacccccgacgagcaccccggcggccacgaccgcgacgacggcuccgucuacggccagauccacaucgaggaggaguccaccauccgcuacuccuggcaggacgagaucguccagggcacccgccgccgcacccagaaggacggcgccgucggcgagaaggucgucaagccccucgacguccccgcccccucccucgagggcgaccucggcuccacccacuggaaggagcaggcccgcuccggcgaguuccacgccgagcccaccgucaucgagaaggagaucaagaucccccacgaguuccacaccuccaugaagggcaucuccuccaaggagccccgccagcagcucgucgaggucaucggccagcucgaggagacccuccccgagcgcaugcgcgaggagcucuccgcccucacccgcgagggccagggcggccccggcuccgucuccgucgacgucaagaagguccagggcgccggcggcuccuccgucacccucgucgccgaggucaacgucucccagaccgucgacgccgaccgccucgaccucgaggagcucuccaaggacgaggccuccgagauggagaaggccgucgaguccgucguccgcgagucccucucccgccagcgcucccccgcccccggcucccccgacgaggagggcggcgccgaggcccccgccgccggcauccgcuuccgccgcugggccacccgcgagcucuacauccccuccggcgaguccgaggucgccggcggcgccucccacuccuccggccagcgcaccccccagggccccgucuccgccaccgucgaggucuccucccccaccggcuucgcccagucccagguccucgaggacgucucccaggccgcccgccacaucaagcucggccccuccgaggucuggcgcaccgagcgcauguccuacgagggccccaccgccgaggucgucgagauggacgucuccaacgucgaggccauccgcucccgcacccaggaggccggcgcccucggcgucuccgaccgcggcuccuggcgcgacgccgacucccgcaacgaccaggccgucggcgucuccuucaaggccuccgccggcgagggcgaccaggcccaccgcgagcagggcaaggagcaggccauguucgacaagaagguccagcuccagcgcauggucgaccagcgcuccgucaucuccgacgagaagaaggucgcccuccucuaccucgacaacgaggaggaggagaacgacggccacugguucuga

SEQ ID NO: 50408 - RNA, 3282 nt, Artificial Sequence
  derived and/or modified sequence opt2 from SYNPO2__Homo_sapiens__NP_001122405
augggcaccggcgacuucaucugcaucuccaugaccggcggcgcccccuggggcuuccgccuccagggcggcaaggagcagaagcagccccuccaggucgccaagauccgcaaccaguccaaggccuccggcuccggccucugcgagggcgacgaggucgucuccaucaacggcaaccccugcgccgaccucaccuaccccgaggucaucaagcucauggaguccaucaccgacucccuccagaugcucaucaagcgccccuccuccggcaucuccgaggcccucaucuccgagaacgagaacaagaaccucgagcaccucacccacggcggcuacgucgaguccaccacccuccagauccgccccgccaccaagacccagugcaccgaguucuuccucgcccccgucaagaccgaggucccccucgccgagaaccagcgcuccggccccgacugcgccggcucccucaaggaggagaccggccccuccuaccagcgcgccccccagaugcccgacucccagcgcggccgcgucgccgaggagcucauccuccgcgagaaggucgaggccguccagcccggccccgucgucgagcuccagcucucccucucccaggagcgccacaagggcgccuccggcccccucgucgcccuccccggcgccgagaaguccaagucccccgaccccgaccccaaccucucccacgaccgcaucguccacaucaacuccauccccaccaacgagaaggccgaccccuuccuccgcuccuccaagaucauccagaucuccuccggccgcgagcuccgcgucauccaggaguccgaggccggcgacgccggccucccccgcgucgaggucauccucgacugcuccgaccgccagaagaccgagggcugccgccuccaggccggcaaggagugcgucgacucccccgucgagggcggccaguccgaggccccccccucccucgucuccuucgccgucuccuccgagggcaccgagcagggcgaggacccccgcuccgagaaggaccacucccgcccccacaagcaccgcgcccgccacgcccgccuccgccgcuccgagucccucuccgagaagcaggucaaggaggccaaguccaagugcaaguccaucgcccuccuccucaccgacgcccccaaccccaacuccaagggcguccucauguucaagaagcgccgccgccgcgcccgcaaguacacccucgucuccuacggcaccggcgagcucgagcgcgaggccgacgaggaggaggagggcgacaaggaggacaccugcgaggucgccuuccucggcgccuccgaguccgaggucgacgaggagcuccucuccgacgucgacgacaacacccaggucgucaacuucgacugggacuccggccucgucgacaucgagaagaagcucaaccgcggcgacaagauggagaugcuccccgacaccaccggcaagggcgcccucauguucgccaagcgccgcgagcgcauggaccagaucaccgcccagaaggaggaggacaaggucggcggcacccccucccgcgagcaggacgccgcccagaccgacggccuccgcaccaccaccuccuaccagcgcaaggaggaggaguccguccgcacccaguccuccgucuccaaguccuacaucgaggucucccacggccucggccacgucccccagcagaacggcuucuccggcaccuccgagaccgccaacauccagcgcaugguccccaugaaccgcaccgccaagcccuuccccggcuccgucaaccagcccgccacccccuucucccccacccgcaacaugaccucccccaucgccgacuuccccgcccccccccccuacuccgccgucacccccccccccgacgccuucucccgcggcgucuccucccccaucgccggccccgcccagcccccccccuggccccagcccgcccccuggucccagcccgccuucuacgacuccuccgagcgcaucgccucccgcgacgagcgcaucuccguccccgccaagcgcaccggcauccuccaggaggccaagcgccgcuccaccaccaagcccauguucaccuucaaggagcccaaggucucccccaaccccgagcuccucucccuccuccagaacuccgagggcaagcgcggcaccggcgccggcggcgacuccggccccgaggaggacuaccucucccucggcgccgaggccugcaacuucaugcaguccuccuccgccaagcagaagacccccccccccgucgcccccaagcccgccgucaaguccuccuccucccagcccgucacccccgucucccccgucuggucccccggcgucgcccccacccagccccccgccuuccccaccuccaaccccuccaagggcaccgucgucuccuccaucaagaucgcccagcccuccuacccccccgcccgccccgccuccacccucaacgucgccggccccuucaagggcccccaggccgccgucgccucccagaacuacacccccaagcccaccgucuccacccccaccgucaacgccguccagcccggcgccgucggccccuccaacgagcuccccggcauguccggccgcggcgcccagcucuucgccaagcgccagucccgcauggagaaguacgucgucgacuccgacaccguccaggcccacgccgcccgcgcccagucccccacccccucccuccccgccuccuggaaguacuccuccaacguccgcgcccccccccccgucgccuacaaccccauccacucccccuccuacccccucgccgcccucaagucccagcccuccgccgcccagcccuccaagaugggcaagaagaagggcaagaagccccucaacgcccucgacgucaugaagcaccagcccuaccagcucaacgccucccucuucaccuuccagccccccgacgccaaggacggccucccccagaaguccuccgucaaggucaacuccgcccucgccaugaagcaggcccuccccccccgccccgucaacgccgccucccccaccaacguccaggccuccuccgucuacuccguccccgccuacaccuccccccccuccuucuucgccgaggccuccucccccgucuccgccucccccguccccgucggcauccccaccucccccaagcaggaguccgccuccuccuccuacuucgucgccccccgccccaaguucuccgccaagaaguccggcgucaccauccaggucuggaagcccuccgucgucgaggaguga

SEQ ID NO: 50409 - RNA, 2058 nt, Artificial Sequence
  derived and/or modified sequence opt2 from SYNPO__Homo_sapiens__NP_001103444
auggagggcuacuccgaggaggccucccuccuccgccaccucgagaaggucgccuccgaggaggaggaggucccccucgucgucuaccucaaggagaacgccgcccuccucaccgccaacggccuccaccucucccagaaccgcgaggcccagcaguccucccccgcccccccccccgccgagguccacucccccgccgccgacgucaaccagaaccucgccucccccuccgccacccucaccacccccaccuccaacuccucccacaacccccccgccaccgacgucaaccagaacccccccgccaccgucgucccccagucccucccccucuccuccauccagcagaacuccuccgaggcccagcuccccuccaacggcaccggccccgccuccaagcccuccacccucugcgccgacggccagccccaggcccccgccgaggagguccgcugcuccacccuccucaucgacaaggucuccacccccgccaccaccaccuccaccuucucccgcgaggccacccucauccccuccucccgcccccccgccuccgacuucauguccuccucccuccucaucgacauccagcccaacacccucgucgucuccgccgaccaggagauguccggccgcgccgccgccaccacccccaccaaggucuacuccgagguccacuucacccucgccaagccccccuccgucgucaaccgcaccgcccgccccuucggcauccaggcccccggcggcaccucccagauggagcgcucccccaugcucgagcgccgccacuucggcgagaaggcccccgccccccagccccccucccuccccgaccgcuccccccgcccccagcgccacaucaugucccgcucccccauggucgagcgccgcaugaugggccagcgcucccccgccuccgagcgccgcccccucggcaacuucaccgccccccccaccuacaccgagacccucuccaccgccccccucgccuccuggguccgcuccccccccuccuacuccguccucuaccccuccuccgaccccaaguccucccaccucaagggccaggccguccccgccuccaagaccggcauccucgaggaguccauggcccgccgcggcucccgcaaguccauguucaccuucgucgagaagcccaaggucacccccaaccccgaccuccucgaccucguccagaccgccgacgagaagcgccgccagcgcgaccagggcgaggucggcgucgaggaggagcccuucgcccucggcgccgaggccuccaacuuccagcaggagcccgccccccgcgaccgcgccucccccgccgccgccgaggaggucguccccgagugggccuccugccucaaguccccccgcauccaggccaagcccaagcccaagcccaaccagaaccucuccgaggccuccggcaagggcgccgagcucuacgcccgccgccagucccgcauggagaaguacgucaucgaguccuccucccacacccccgagcucgcccgcugccccucccccaccaugucccuccccuccuccuggaaguaccccaccaacgcccccggcgccuuccgcgucgccucccgcucccccgcccgcaccccccccgccucccucuaccacggcuaccuccccgagaacggcguccuccgccccgagcccaccaagcagccccccuaccagcuccgccccucccucuucguccucucccccaucaaggagcccgccaaggucuccccccgcgccgccucccccgccaagcccuccucccucgaccucguccccaaccuccccaagggcgcccucccccccucccccgcccucccccgccccucccgcuccucccccggccucuacaccucccccggccaggacucccuccagcccaccgccgucuccccccccuacggcggcgacaucucccccgucucccccucccgcgccugguccccccgcgccaagcaggccccccgccccuccuucuccacccgcaacgccggcaucgaggcccaggucuggaagcccuccuucugcuucaaguga

SEQ ID NO: 50410 - RNA, 858 nt, Artificial Sequence
  derived and/or modified sequence opt2 from SYNPR__Homo_sapiens__NP_001123475
auggaccccgucucccagcucgccuccgccggcaccuuccgcguccucaaggagccccucgccuuccuccgcgcccucgagcuccucuucgccaucuucgccuucgccaccugcggcggcuacuccggcggccuccgccucuccgucgacugcgucaacaagaccgaguccaaccucuccaucgacaucgccuucgccuaccccuuccgccuccaccaggucaccuucgagguccccaccugcgagggcaaggagcgccagaagcucgcccucaucggcgacuccuccuccuccgccgaguucuucgucaccgucgccgucuucgccuuccucuacucccucgccgccaccgucgucuacaucuucuuccagaacaaguaccgcgagaacaaccgcggcccccucaucgacuucaucgucaccgucgucuucuccuuccucuggcucgucggcuccuccgccugggccaagggccucuccgacgucaaggucgccaccgaccccaaggagguccuccuccucauguccgccugcaagcagcccuccaacaagugcauggccauccacucccccgucauguccucccucaacaccuccgucgucuucggcuuccucaacuucauccucugggccggcaacaucugguucgucuucaaggagaccggcuggcacuccuccggccagcgcuaccucuccgaccccauggagaagcacuccuccuccuacaaccagggcggcuacaaccaggacuccuacggcuccuccuccggcuacucccagcaggccucccucggccccaccuccgacgaguucggccagcagcccaccggccccaccuccuucaccaaccagaucuga

SEQ ID NO: 50411 - RNA, 942 nt, Artificial Sequence
  derived and/or modified sequence opt2 from SYP__Homo_sapiens__NP_003170
augcuccuccucgccgacauggacgucgucaaccagcucgucgccggcggccaguuccgcgucgucaaggagccccucggcuucgucaagguccuccagugggucuucgccaucuucgccuucgccaccugcggcuccuacuccggcgagcuccagcucuccgucgacugcgccaacaagaccgaguccgaccucuccaucgaggucgaguucgaguaccccuuccgccuccaccaggucuacuucgacgcccccaccugccgcggcggcaccaccaaggucuuccucgucggcgacuacuccuccuccgccgaguucuucgucaccgucgccgucuucgccuuccucuacuccaugggcgcccucgccaccuacaucuuccuccagaacaaguaccgcgagaacaacaagggccccaugcucgacuuccucgccaccgccgucuucgccuucauguggcucgucuccuccuccgccugggccaagggccucuccgacgucaagauggccaccgaccccgagaacaucaucaaggagaugcccgucugccgccagaccggcaacaccugcaaggagcuccgcgaccccgucaccuccggccucaacaccuccgucgucuucggcuuccucaaccucguccucugggucggcaaccucugguucgucuucaaggagaccggcugggccgcccccuuccuccgcgccccccccggcgcccccgagaagcagcccgcccccggcgacgccuacggcgacgccggcuacggccagggccccggcggcuacggcccccaggacuccuacggcccccagggcggcuaccagcccgacuacggccagcccgccggcuccggcggcuccggcuacggcccccagggcgacuacggccagcagggcuacggcccccagggcgcccccaccuccuucuccaaccagauguga

SEQ ID NO: 50412 - RNA, 780 nt, Artificial Sequence
  derived and/or modified sequence opt2 from SYPL1__Homo_sapiens__NP_006745
auggcccccaacaucuaccucguccgccagcgcaucucccgccucggccagcgcauguccggcuuccagaucaaccucaacccccucaaggagccccucggcuucaucaagguccucgaguggaucgccuccaucuucgccuucgccaccugcggcggcuucaagggccagaccgagauccaggucaacugcccccccgccgucaccgagaacaagaccgucaccgccaccuucggcuaccccuuccgccucaacgaggccuccuuccagcccccccccggcgucaacaucugcgacgucaacuggaaggacuacguccucaucggcgacuacuccuccuccgcccaguucuacgucaccuucgccgucuucgucuuccucuacugcaucgccgcccuccuccucuacgucggcuacaccucccucuaccucgacucccgcaagcuccccaugaucgacuucgucgucacccucgucgccaccuuccucuggcucgucuccaccuccgccugggccaaggcccucaccgacaucaagaucgccaccggccacaacaucaucgacgagcucccccccugcaagaagaaggccguccucugcuacuucggcuccgucaccuccaugggcucccucaacgucuccgucaucuucggcuuccucaacaugauccucuggggcggcaacgccugguucgucuacaaggagaccucccuccacucccccuccaacaccuccgccccccacucccagggcggcauccccccccccaccggcaucuga

SEQ ID NO: 50413 - RNA, 831 nt, Artificial Sequence
  derived and/or modified sequence opt2 from SYPL2__Homo_sapiens__XP_011539585
auguccuccaccgaguccgccggccgcaccgccgacaaguccccccgccagcaggucgaccgccuccucgucggccuccgcuggcgccgccucgaggagccccucggcuucaucaagguccuccaguggcucuucgccaucuucgccuucggcuccugcggcuccuacuccggcgagaccggcgccaugguccgcugcaacaacgaggccaaggacgucuccuccaucaucgucgccuucggcuaccccuuccgccuccaccgcauccaguacgagaugccccucugcgacgaggaguccuccuccaagaccaugcaccucaugggcgacuucuccgcccccgccgaguucuucgucacccucggcaucuucuccuucuucuacaccauggccgcccucgucaucuaccuccgcuuccacaaccucuacaccgagaacaagcgcuucccccucgucgacuucugcgucaccgucuccuucaccuucuucuggcucgucgccgccgccgccuggggcaagggccucaccgacgucaagggcgccacccgccccuccucccucaccgccgccauguccgucugccacggcgaggaggccgucugcuccgccggcgccacccccuccaugggccucgccaacaucuccguccucuucggcuucaucaacuucuuccucugggccggcaacugcugguucgucuucaaggagacccccuggcacggccagggccagggccaggaccaggaccaggaccaggaccagggccagggccccucccaggaguccgccgccgagcagggcgccgucgagaagcagauccaccacgucuga

SEQ ID NO: 50414 - RNA, 1296 nt, Artificial Sequence
  derived and/or modified sequence opt2 from SYT11__Homo_sapiens__NP_689493
auggccgagaucaccaacauccgccccuccuucgacgucucccccgucgucgccggccucaucggcgccuccguccucgucgucugcgucuccgucaccgucuucgucugguccugcugccaccagcaggccgagaagaagcagaagaacccccccuacaaguucauccacaugcucaagggcaucuccaucuaccccgagacccucuccaacaagaagaagaucaucaagguccgccgcgacaaggacggccccggccgcgagggcggccgccgcaaccuccucgucgacgccgccgaggccggccuccucucccgcgacaaggacccccgcggccccuccuccggcuccugcaucgaccagcuccccaucaagauggacuacggcgaggagcuccgcucccccaucaccucccucacccccggcgaguccaagaccaccucccccuccucccccgaggaggacgucaugcucggcucccucaccuucuccgucgacuacaacuuccccaagaaggcccucgucgucaccauccaggaggcccacggccuccccgucauggacgaccagacccagggcuccgaccccuacaucaagaugaccauccuccccgacaagcgccaccgcgucaagacccgcguccuccgcaagacccucgaccccgucuucgacgagaccuucaccuucuacggcauccccuacucccagcuccaggaccucguccuccacuuccucguccucuccuucgaccgcuucucccgcgacgacgucaucggcgaggucauggucccccucgccggcgucgaccccuccaccggcaagguccagcucacccgcgacaucaucaagcgcaacauccagaagugcaucucccgcggcgagcuccaggucucccucuccuaccagcccgucgcccagcgcaugaccgucgucguccucaaggcccgccaccuccccaagauggacaucaccggccucuccggcaaccccuacgucaaggucaacgucuacuacggccgcaagcgcaucgccaagaagaagacccacgucaagaagugcacccucaaccccaucuucaacgaguccuucaucuacgacauccccaccgaccuccuccccgacaucuccaucgaguuccucgucaucgacuucgaccgcaccaccaagaacgaggucgucggccgccucauccucggcgcccacuccgucaccgccuccggcgccgagcacuggcgcgaggucugcgaguccccccgcaagcccgucgccaaguggcacucccucuccgaguacuga

SEQ ID NO: 50415 - RNA, 1266 nt, Artificial Sequence
  derived and/or modified sequence opt2 from SYT12__Homo_sapiens__NP_001171351
auggccgucgacgucgccgaguaccaccucuccgucaucaaguccccccccggcugggaggucggcgucuacgccgccggcgcccucgcccuccucggcaucgccgccgucucccucuggaagcucuggaccuccggcuccuuccccucccccucccccuuccccaacuacgacuaccgcuaccuccagcagaaguacggcgaguccugcgccgaggcccgcgagaagcgcguccccgccuggaacgcccagcgcgccuccacccgcggcccccccucccgcaagggcucccucuccaucgaggacaccuucgaguccaucuccgagcucggcccccucgagcucaugggccgcgagcucgaccucgcccccuacggcacccuccgcaagucccaguccgccgacucccucaacuccaucuccuccgucuccaacaccuucggccaggacuucacccucggccaggucgaggucuccauggaguacgacaccgccucccacacccucaacgucgccgucaugcagggcaaggaccuccucgagcgcgaggaggccuccuucgaguccugcuucaugcgcgucucccuccuccccgacgagcagaucgucggcaucucccgcauccagcgcaacgccuacuccaucuucuucgacgagaaguucuccaucccccucgaccccaccgcccucgaggagaagucccuccgcuucuccgucuucggcaucgacgaggacgagcgcaacgucuccaccggcgucgucgagcucaagcucuccguccucgaccucccccuccagcccuucuccggcuggcucuaccuccaggaccagaacaaggccgccgacgccgucggcgagauccuccucucccucuccuaccuccccaccgccgagcgccucaccgucgucgucgucaaggccaagaaccucaucuggaccaacgacaagaccaccgccgaccccuucgucaaggucuaccuccuccaggacggccgcaagauguccaagaagaagaccgccgucaagcgcgacgaccccaaccccgucuucaacgaggccaugaucuucuccguccccgccaucguccuccaggaccucucccuccgcgucaccgucgccgaguccuccuccgacggccgcggcgacaacgucggccacgucaucaucggccccuccgccuccggcaugggcaccacccacuggaaccagaugcucgccacccuccgccgccccgucuccauguggcacgccguccgccgcaacuga

SEQ ID NO: 50416 - RNA, 1281 nt, Artificial Sequence
  derived and/or modified sequence opt2 from SYT13__Homo_sapiens__NP_065877
augguccucuccguccccgucaucgcccucggcgccacccucggcaccgccaccuccauccucgcccucugcggcgucaccugccucugccgccacaugcaccccaagaagggccuccucccccgcgaccaggaccccgaccucgagaaggccaagcccucccuccucggcuccgcccagcaguucaacgucaagaaguccaccgagcccguccagccccgcgcccuccucaaguuccccgacaucuacggcccccgccccgccgucaccgcccccgaggucaucaacuacgccgacuacucccuccgcuccaccgaggagcccaccgcccccgccuccccccagccccccaacgacucccgccucaagcgccaggucaccgaggagcucuucauccucccccagaacggcgucgucgaggacgucugcgucauggagaccuggaaccccgagaaggccgccuccuggaaccaggcccccaagcuccacuacugccucgacuacgacugccagaaggccgagcucuucgucacccgccucgaggccgucaccuccaaccacgacggcggcugcgacugcuacguccagggcuccgucgccaaccgcaccggcuccgucgaggcccagaccgcccucaagaagcgccagcuccacaccaccugggaggagggccucguccucccccucgccgaggaggagcuccccaccgccacccucacccucacccuccgcaccugcgaccgcuucucccgccacuccgucgccggcgagcuccgccucggccucgacggcaccuccgucccccucggcgccgcccaguggggcgagcucaagaccuccgccaaggagcccuccgccggcgccggcgagguccuccucuccaucuccuaccuccccgccgccaaccgccuccucgucguccucaucaaggccaagaaccuccacuccaaccaguccaaggagcuccucggcaaggacgucuccgucaaggucacccucaagcaccaggcccgcaagcucaagaagaagcagaccaagcgcgccaagcacaagaucaaccccgucuggaacgagaugaucauguucgagcuccccgacgaccuccuccaggccuccuccgucgagcucgagguccucggccaggacgacuccggccaguccugcgcccucggccacugcucccucggccuccacaccuccggcuccgagcgcucccacugggaggagaugcucaagaacccccgccgccagaucgccauguggcaccagcuccaccucuga

SEQ ID NO: 50417 - RNA, 1860 nt, Artificial Sequence
  derived and/or modified sequence opt2 from SYT14__Homo_sapiens__NP_001139733
auggccuccgccuccuggcgccucaaggucgagcgcgagcccgucgaguacaugaaccucuccguccucgagaagaucggcuacuucuccgucgcccgccucgaguacuccggcaccauccucgcccacugcaacuuccgccuccucggcuccaacgacuccuccgccuccgccucccaggucaccggcaccaccgucucccccgaggccgucggcuuccucuccgccgucggcgucuucaucauccucaugcuccuccucuuccucuacaucaacaagaaguucugcuucgagaacgucggcggcuuccccgaccucggcuccgaguacuccacccgcaagaacucccaggacaagaucuacaacuccuacauggacaaggacgagcacggcuccuccuccgaguccgaggacgaggcccucggcaaguaccacgaggcccucucccgcacccacaacucccgccucccccucgccgacucccgccagcgcaacuacgccugggagacccgccagaaguacuccccccucuccgccgaguacgacggcuacuccuccgaggccuccaucgacgagggcaacugcauccagcgcaugcgccgcacccccccccucgacgagcuccagcccccccccuaccaggacgacuccggcuccccccaccucuccugcacccccuccgagaucggcgacuccaagugcgaguucucccacugcuccaacuccccccgcugcuccuacaacaagugccccuccgagggcuccaccggccacgagaucgaguccuuccacaacaagggcuacgaggaggacguccccuccgacuccaccgccguccucucccccgaggacauguccgcccagggcuccuccucccagcuccccaagcccuucgaccccgagcccgaggccaaguacggcacccucgacgucaccuucgacuacgacucccaggagcagaagcuccucgucaccgucaccgccgucaccgacauccccaccuacaaccgcaccggcggcaacuccuggcagguccaccucguccuccuccccaucaagaagcagcgcgccaagaccuccauccagcgcggccccugccccgucuucaccgagaccuucaaguucaaccacgucgaguccgagaugaucggcaacuacgccguccgcuuccgccucuacggcguccaccgcaugaagaaggagaagaucgucggcgagaagaucuucuaccucaccaagcucaaccuccagggcaagaugucccuccccgucauccucgagcccuccuacaaccacuccggcugcgacucccagauguccgucuccgagauguccugcuccgaguccaccuccuccugccagucccucgagcacggcuccguccccgagauccucaucggccuccucuacaacgccaccaccggccgccucuccgccgaggucaucaagggcucccacuucaagaaccucgccgccaaccgcccccccaacggccucuucugcugccucaagcaccucaucggcggccaggucuacaucauccgcgacaccuacgucaagcucacccuccucaacuccaugggccaggagauguccaagugcaagaccuccauccgccgcggccagcccaaccccgucuacaaggagaccuucgucuuccaggucgcccucuuccagcucuccgacgucacccucauccucuccgucuacaacaagcgcuccaugaagcgcaaggagaugaucggcuggaucucccucggccucaacuccuccggcgaggaggagcucaaccacuggaccgagaugaaggaguccaagggccagcaggucugccgcuggcacgcccuccucgaguccuga

SEQ ID NO: 50418 - RNA, 1260 nt, Artificial Sequence
  derived and/or modified sequence opt2 from SYT1__Homo_sapiens__NP_001278830
auggucuccgagucccaccacgaggcccucgccgccccccccgucaccaccgucgccaccguccuccccuccaacgccaccgagcccgccucccccggcgagggcaaggaggacgccuucuccaagcucaaggagaaguucaugaacgagcuccacaagaucccccucccccccugggcccucaucgccaucgccaucgucgccguccuccucguccucaccugcugcuucugcaucugcaagaagugccucuucaagaagaagaacaagaagaagggcaaggagaagggcggcaagaacgccaucaacaugaaggacgucaaggaccucggcaagaccaugaaggaccaggacgacgacgccgagaccggccucaccgacggcgaggagaaggaggagcccaaggaggaggagaagcucggcaagcuccaguacucccucgacuacgacuuccagaacaaccagcuccucgucggcaucauccaggccgccgagcuccccgcccucgacaugggcggcaccuccgaccccuacgucaaggucuuccuccuccccgacaagaagaagaaguucgagaccaagguccaccgcaagacccucaaccccgucuucaacgagcaguucaccuucaagguccccuacuccgagcucggcggcaagacccucgucauggccgucuacgacuucgaccgcuucuccaagcacgacaucaucggcgaguucaagguccccaugaacaccgucgacuucggccacgucaccgaggaguggcgcgaccuccaguccgccgagaaggaggagcaggagaagcucggcgacaucugcuucucccuccgcuacguccccaccgccggcaagcucaccgucgucauccucgaggccaagaaccucaagaagauggacgucggcggccucuccgaccccuacgucaagauccaccucaugcagaacggcaagcgccucaagaagaagaagaccaccaucaagaagaacacccucaaccccuacuacaacgaguccuucuccuucgagguccccuucgagcagauccagaagguccaggucgucgucaccguccucgacuacgacaagaucggcaagaacgacgccaucggcaaggucuucgucggcuacaacuccaccggcgccgagcuccgccacugguccgacaugcucgccaacccccgccgccccaucgcccaguggcacacccuccaggucgaggaggaggucgacgccaugcucgccgucaagaaguga

SEQ ID NO: 50419 - RNA, 1278 nt, Artificial Sequence
  derived and/or modified sequence opt2 from SYT4__Homo_sapiens__NP_065834
auggcccccaucaccaccucccgcgaggaguucgacgagauccccaccgucgucggcaucuucuccgccuucggccucgucuucaccgucucccucuucgccuggaucugcugccagcgcaaguccuccaaguccaacaagaccccccccuacaaguucguccacguccucaagggcgucgacaucuaccccgagaaccucaacuccaagaagaaguucggcgccgacgacaagaacgaggucaagaacaagcccgccguccccaagaacucccuccaccucgaccucgagaagcgcgaccucaacggcaacuuccccaagaccaaccucaagcccggcucccccuccgaccucgagaacgccacccccaagcucuuccucgagggcgagaaggaguccgucucccccgagucccucaaguccuccaccucccucaccuccgaggagaagcaggagaagcucggcacccucuucuucucccucgaguacaacuucgagcgcaaggccuucgucgucaacaucaaggaggcccgcggccuccccgccauggacgagcaguccaugaccuccgaccccuacaucaagaugaccauccuccccgagaagaagcacaaggucaagacccgcguccuccgcaagacccucgaccccgccuucgacgagaccuucaccuucuacggcauccccuacacccagauccaggagcucgcccuccacuucaccauccucuccuucgaccgcuucucccgcgacgacaucaucggcgagguccucaucccccucuccggcaucgagcucuccgagggcaagaugcucaugaaccgcgagaucaucaagcgcaacguccgcaaguccuccggccgcggcgagcuccucaucucccucugcuaccaguccaccaccaacacccucaccgucgucguccucaaggcccgccaccuccccaaguccgacgucuccggccucuccgaccccuacgucaaggucaaccucuaccacgccaagaagcgcaucuccaagaagaagacccacgucaagaagugcacccccaacgccgucuucaacgagcucuucgucuucgacauccccugcgagggccucgaggacaucuccgucgaguuccucguccucgacuccgagcgcggcucccgcaacgaggucaucggccagcucguccucggcgccgccgccgagggcaccggcggcgagcacuggaaggagaucugcgacuacccccgccgccagaucgccaaguggcacguccucugcgacggcuga

SEQ ID NO: 50420 - RNA, 900 nt, Artificial Sequence
  derived and/or modified sequence opt2 from SYT6__Homo_sapiens__XP_011539054
augcccuggcgcaacaaggaggccuccucccccuccuccgccaaccccccccucgaggcccuccagucccccuccuuccgcggcaacauggccgacaagcucaaggaccccuccacccucggcuuccucgaggccgccgucaagaucucccacaccucccccgacauccccgccgagguccagauguccgucaaggagcacaucaugcgccacacccgccuccagcgccagaccaccgagcccgccuccuccacccgccacaccuccuucaagcgccaccucccccgccagaugcacgucuccuccgucgacuacggcaacgagcucccccccgccgccgagcagcccaccuccaucggccgcaucaagcccgagcucuacaagcagaaguccgucgacggcgaggacgccaaguccgaggccaccaaguccugcggcaagaucaacuucucccuccgcuacgacuacgagaccgagacccucaucguccgcauccucaaggccuucgaccuccccgccaaggacuucugcggcuccuccgaccccuacgucaagaucuaccuccuccccgaccgcaagugcaagcuccagacccgcguccaccgcaagacccucaaccccaccuucgacgagaacuuccacuuccccguccccuacgaggagcucgccgaccgcaagcuccaccucuccgucuucgacuucgaccgcuucucccgccacgacaugaucggcgaggucauccucgacaaccucuucgaggccuccgaccucucccgcgagaccuccaucuggaaggacauccaguacgccaccucccucgacuggggccucugcuccacccuccuccccggcgaccccucccagcagcgccuccaccucgacaccggcccccacuccuga

SEQ ID NO: 50421 - RNA, 1476 nt, Artificial Sequence
  derived and/or modified sequence opt2 from SYT9__Homo_sapiens__NP_783860
augcccggcgcccgcgacgcccucugccaccaggcccuccagcuccucgccgagcucugcgcccgcggcgcccucgagcacgacuccugccaggacuucaucuaccaccuccgcgaccgcgcccgcccccgccuccgcgaccccgacaucuccgucucccuccucacccucgucgucaccgccugcggccucgcccucuucggcgucucccucuucgucuccuggaagcucugcuggguccccuggcgcgagcgcggccuccccuccggcuccaaggacaacaaccaggagccccucaacuacauggacaccgagaccaacgagcaggagaacuccgaggacuuccucgacccccccacccccugccccgacuccuccaugaagaucucccacaccucccccgacaucccccucuccacccagaccggcauccaggagaacugcgcccacggcguccgcguccagcgccaggucaccgagcccaccuccuccgcccgccacaacuccauccgccgccagcucaaccucuccaaccccgacuucaacauccagcagcuccagaagcaggagcagcucaccggcaucggccgcaucaagcccgagcucuacaagcagcgcucccucgacaacgacgacggccgccgcuccaacuccaaggccugcggcaagcucaacuucauccucaaguacgacugcgaccucgagcagcucaucgucaagauccacaaggccgucaaccuccccgccaaggacuucuccggcaccuccgaccccuacgucaagaucuaccuccuccccgaccgcaagaccaagcaccagaccaagguccaccgcaagacccucaaccccgucuucgacgaggucuuccucuuccccguccccuacaacgaccucgaggcccgcaagcuccacuucuccgucuacgacuucgaccgcuucucccgccacgaccucaucggccaggucgucgucgaccacuuccucgaccucgccgacuucccccgcgagugcauccucuggaaggacaucgaguacgucaccaacgacaacgucgaccucggcgagcucauguucucccucugcuaccuccccaccgccggccgccucaccaucaccaucaucaaggcccgcaaccucaaggccauggacaucaccggcgccuccgaccccuacgucaaggucucccucaugugcgacggccgccgccucaagaagcgcaagaccuccaccaagcgcaacacccucaaccccgucuacaacgaggccaucgucuucgacgucccccccgagaacaucgaccagauccaccucuccaucgccgucauggacuacgaccgcgucggccacaacgagaucaucggcgucugccaggucggcaacgaggccgagcgccucggccgcgaccacugguccgagaugcucuccuacccccgcaagcccaucgcccacuggcacucccucgucgagaagcgcuga

SEQ ID NO: 50422 - RNA, 954 nt, Artificial Sequence
  derived and/or modified sequence opt2 from SYTL1__Homo_sapiens__XP_011540618
augcgcccccuccgccgcggcuccggccgccuccgccuccagauccuccgccgccgcccccgcccccgcaagauccucgccaaggagaccaaccgcuccgucccccgccgccucacccgcuccugguccccccgccgcggcgagucccgcucccgcggccccuccaagcccuccuacgucaaguccuaccuccuccccgacaagcaguccaagcgcaagaccgccgucaagaagcgcaaccucaaccccgucuucaacgagacccuccgcuacuccgucccccaggccgagcuccagggccgcguccucucccucuccgucuggcaccgcgagucccucggccgcaacaucuuccucggcgaggucgaggucccccucgacaccugggacuggggcuccgagcccaccuggcucccccuccagccccgcgucccccccucccccgacgaccuccccucccgcggccuccucgcccucucccucaaguacguccccgccggcuccgagggcgccggccucccccccuccggcgagcuccacuucugggucaaggaggcccgcgaccuccucccccuccgcgccggcucccucgacaccuacguccagugcuucguccuccccgacgacucccaggccucccgccagcgcacccgcgucguccgccgcucccucucccccgucuucaaccacaccauggucuacgacggcuucggccccgccgaccuccgccaggccugcgccgagcucucccucugggaccacggcgcccucgccaaccgccagcucggcggcacccgccucucccucggcaccggcuccuccuacggccuccagguccccuggauggacuccacccccgaggagaagcagcucuggcaggcccuccucgagcagcccugcgagugggucgacggccuccucccccuccgcaccaaccucgccccccgcaccuga

SEQ ID NO: 50423 - RNA, 2805 nt, Artificial Sequence
  derived and/or modified sequence opt2 from SYTL2__Homo_sapiens__NP_001156423
augaucgaccucuccuuccucaccgaggaggagcaggaggccaucaugaagguccuccagcgcgacgccgcccucaagcgcgccgaggaggagcgcguccgccaccuccccgagaagaucaaggacgaccagcagcucaagaacauguccggccagugguucuacgaggccaaggccaagcgccaccgcgacaagauccacggcgccgacaucauccgcgccuccaugcgcaagaagcgcccccagaucgccgccgagcaguccaaggaccgcgagaacggcgccaaggaguccugggucaacaacgucaacaaggacgccuuccucccccccgagcucgccggcgucgucgaggagcccgaggaggacgccgcccccgccucccccuccuccuccgucgucaaccccgccuccuccgucaucgacaugucccaggagaacacccgcaagcccaacgucucccccgagaagcgcaagaaccccuucaacuccuccaagcuccccgagggccacuccucccagcagaccaagaacgagcaguccaagaacggccgcaccggccucuuccagaccuccaaggaggacgagcucuccgaguccaaggagaaguccaccgucgccgacaccuccauccagaagcucgagaaguccaagcagacccuccccggccucuccaacggcucccagaucaaggcccccauccccaaggcccgcaagaugaucuacaaguccaccgaccucaacaaggacgacaaccaguccuucccccgccagcgcaccgacucccucaaggcccgcggcgccccccgcggcauccucaagcgcaacuccuccuccuccuccaccgacuccgagacccuccgcuacaaccacaacuucgagcccaaguccaagaucgucucccccggccucaccauccacgagcgcaucuccgagaaggagcacucccucgaggacaacuccucccccaacucccucgagccccucaagcacguccgcuucuccgccgucaaggacgagcucccccagucccccggccucauccacggccgcgaggucggcgaguucuccguccucgaguccgaccgccucaagaacggcauggaggacgccggcgacaccgaggaguuccaguccgaccccaagcccucccaguaccgcaagcccucccucuuccaccaguccaccuccucccccuacgucuccaaguccgagacccaccagcccaugaccuccggcuccuuccccaucaacggccuccacucccacuccgagguccucaccgcccgcccccaguccauggagaacucccccaccaucaacgagcccaaggacaaguccuccgagcucacccgccucgaguccguccucccccgcucccccgccgacgagcucucccacugcgucgagcccgagcccucccagguccccggcggcuccucccgcgaccgccagcagggcuccgaggaggagcccucccccguccucaagacccucgagcgcuccgccgcccgcaagaugcccuccaagucccucgaggacaucuccuccgacuccuccaaccaggccaaggucgacaaccagcccgaggagcucguccgcuccgccgaggacgucuccaccguccccacccagcccgacaaccccuucucccaccccgacaagcucaagcgcauguccaaguccguccccgccuuccuccaggacgaguccgacgaccgcgagaccgacaccgccuccgaguccuccuaccagcucucccgccacaagaagucccccuccucccucaccaaccucuccuccuccuccggcaugaccucccucuccuccgucuccggcuccgucauguccgucuacuccggcgacuucggcaaccucgaggucaagggcaacauccaguucgccaucgaguacgucgagucccucaaggagcuccacgucuucgucgcccagugcaaggaccucgccgccgccgacgucaagaagcagcgcuccgaccccuacgucaaggccuaccuccuccccgacaagggcaagaugggcaagaagaagacccucgucgucaagaagacccucaaccccgucuacaacgagauccuccgcuacaagaucgagaagcagauccucaagacccagaagcucaaccucuccaucuggcaccgcgacaccuucaagcgcaacuccuuccucggcgaggucgagcucgaccucgagaccugggacugggacaacaagcagaacaagcagcuccgcugguacccccucaagcgcaagaccgcccccgucgcccucgaggccgagaaccgcggcgagaugaagcucgcccuccaguacguccccgagcccguccccggcaagaagcuccccaccaccggcgagguccacaucugggucaaggagugccucgaccucccccuccuccgcggcucccaccucaacuccuucgucaagugcaccauccuccccgacaccucccgcaagucccgccagaagacccgcgccgucggcaagaccaccaaccccaucuucaaccacaccauggucuacgacggcuuccgccccgaggaccucauggaggccugcgucgagcucaccgucugggaccacuacaagcucaccaaccaguuccucggcggccuccgcaucggcuucggcaccggcaaguccuacggcaccgaggucgacuggauggacuccaccuccgaggaggucgcccucugggagaagauggucaacucccccaacaccuggaucgaggccacccucccccuccgcaugcuccucaucgccaagaucuccaaguga

SEQ ID NO: 50424 - RNA, 2259 nt, Artificial Sequence
  derived and/or modified sequence opt2 from SYTL5__Homo_sapiens__NP_001156806
auguccaagaacuccgaguucaucaaccucuccuuccuccucgaccacgagaaggagaugauccucggcguccucaagcgcgacgaguaccucaagaaggucgaggacaagcgcauccgcaagcucaagaacgagcuccucgaggccaagcgccgcuccggcaagacccagcaggaggccucccgcgucugcguccacugccaccgcaaccucggccucaucuucgaccgcggcgaccccugccaggccugcucccuccgcgucugccgcgagugccgcgucgccggccccaacggcuccuggaagugcaccgucugcgacaagaucgcccagcuccgcaucaucaccggcgagugguucuucgaggagaaggccaagcgcuucaagcaggucaacguccucggcaccgacgucguccgccaguccauccuccgccgcucccccggcgccgaggagguccagucccaggagcagacccgccaggacgccgagaaguccgacaccucccccgucgccggcaagaaggccucccacgacggccccaagcgcaagggcuuccuccucuccaaguuccgcuccgccacccgcggcgagaucaucacccccaagaccgacaccggccgcuccuacucccucgaccucgacggccagcacuuccgcucccucaaguccccccccggcuccgaccgcggcuccaccggcuccuccgaccucaacgaccaggagcccggcccccgcacccccaaguccucccgcuccaacggcgucacccccggcacccaguccucccccgcccccuccacccgcaccgucaccuccgucaucucccgcgaguacggcuucgagaacuccauggaccucgccgccaucgagggcaccucccaggagcucaccaagucccaccgccgcaacaccuccggcacccccuccaucgccgucuccggcaccucccucuccuccgaccagucccgcuccgagcucgaccucuccgaguccuucaccgaggacuccgaggacaccgucuccauccgcuccaaguccguccccggcgcccucgacaaggacucccucgaggagaccgaggaguccaucgacgcccucgucuccucccagcucuccaccaacacccaccgccucgccuccggccucuccaccuccucccaggccggcuccgaccgcaaguggaccuaccucaacguccccgacgccgacuccgacaccaccucccucaacuccaugauguccgucuacuccgagaccggcgacuacggcaacgucaaggucuccggcgagauccuccuccacaucuccuacugcuacaagaccggcggccucuacaucuucgucaagaacugccgcaaccucgccaucggcgacgagaagaagcagcgcaccgacgccuacgucaaguccuaccuccuccccgacaagucccgcaacaacaagcgcaagaccaagauccgcaccggcaccaaccccgaguucaacgagacccucaaguacaccaucucccacacccagcucgagacccgcacccuccagcucuccgucuggcacuacgaccgcuucggccgcaacuccuuccucggcgaggucgagauccccuucgacuccuggaacuucgagaaccccaccgacgagugguucguccuccagcccaaggucgaguucgcccccgacaucggccuccaguacaagggcgagcucaccgucguccuccgcuacaucccccccgaggagaaccucaugcucccccccgagcagcuccagggcaacaagaccuucaagaagggcaagaagaaggagucccccgucaucuccggcggcauccucgaggucuucaucaaggaggccaagaaccucaccgccgucaaguccggcggcaccuccgacuccuucgucaagggcuaccuccuccccgacgacuccaaggccaccaagcacaagacccucgucaucaagaaguccgucaacccccaguggaaccacaccuucauguucuccggcauccacccccaggacaucaagaacgucugccucgagcucaccaucugggacaaggaggccuucuccuccaacaucuuccucggcggcguccgccucaacuccggcuccggcgucucccacggcaagaacgucgacuggauggacucccagggcgaggagcagcgccucuggcagaagauggccaacaaccccggcacccccuucgagggcguccucaugcuccgcuccuccaugggcaagugccgccucuga

SEQ ID NO: 50425 - RNA, 1851 nt, Artificial Sequence
  derived and/or modified sequence opt2 from SYVN1__Homo_sapiens__NP_115807
auguuccgcaccgccgucaugauggccgccucccucgcccucaccggcgccgucgucgcccacgccuacuaccucaagcaccaguucuaccccaccgucgucuaccucaccaaguccucccccuccauggccguccucuacauccaggccuucguccucgucuuccuccucggcaaggucaugggcaaggucuucuucggccagcuccgcgccgccgagauggagcaccuccucgagcgcuccugguacgccgucaccgagaccugccucgccuucaccgucuuccgcgacgacuucuccccccgcuucgucgcccucuucacccuccuccucuuccucaagugcuuccacuggcucgccgaggaccgcgucgacuucauggagcgcucccccaacaucuccuggcucuuccacugccgcaucgucucccucauguuccuccucggcauccucgacuuccucuucgucucccacgccuaccacuccauccucacccgcggcgccuccguccagcucgucuucggcuucgaguacgccauccucaugaccaugguccucaccaucuucaucaaguacguccuccacuccgucgaccuccaguccgagaaccccugggacaacaaggccgucuacaugcucuacaccgagcucuucaccggcuucaucaagguccuccucuacauggccuucaugaccaucaugaucaagguccacaccuucccccucuucgccauccgccccauguaccucgccaugcgccaguucaagaaggccgucaccgacgccaucaugucccgccgcgccauccgcaacaugaacacccucuaccccgacgccacccccgaggagcuccaggccauggacaacgucugcaucaucugccgcgaggagauggucaccggcgccaagcgccuccccugcaaccacaucuuccacaccuccugccuccgcuccugguuccagcgccagcagaccugccccaccugccgcauggacguccuccgcgccucccuccccgcccaguccccccccccccccgagcccgccgaccagggccccccccccgccccccacccccccccccuccucccccagccccccaacuucccccagggccuccucccccccuucccccccggcauguucccccucuggccccccaugggccccuucccccccgucccccccccccccuccuccggcgaggccgucgccccccccuccaccuccgccgcccucucccgccccuccggcgccgccaccaccaccgccgccggcaccuccgccaccgccgccuccgccaccgccuccggccccggcuccggcuccgcccccgaggccggccccgcccccggcuuccccuuccccccccccuggaugggcaugccccuccccccccccuucgccuucccccccaugcccgucccccccgccggcuucgccggccucacccccgaggagcuccgcgcccucgagggccacgagcgccagcaccucgaggcccgccuccagucccuccgcaacauccacacccuccucgacgccgccaugcuccagaucaaccaguaccucaccguccucgccucccucggccccccccgccccgccaccuccgucaacuccaccgaggagaccgccaccaccgucgucgccgccgccuccuccaccuccauccccuccuccgaggccaccacccccacccccggcgccuccccccccgcccccgagauggagcgcccccccgcccccgaguccgucggcaccgaggagaugcccgaggacggcgagcccgacgccgccgagcuccgccgccgccgccuccagaagcucgagucccccgucgcccacuga

SEQ ID NO: 50426 - RNA, 1020 nt, Artificial Sequence
  derived and/or modified sequence opt2 from TAAR1__Homo_sapiens__NP_612200
augaugcccuucugccacaacaucaucaacaucuccugcgucaagaacaacugguccaacgacguccgcgccucccucuacucccucaugguccucaucauccucaccacccucgucggcaaccucaucgucaucgucuccaucucccacuucaagcagcuccacacccccaccaacuggcucauccacuccauggccaccgucgacuuccuccucggcugccucgucaugcccuacuccaugguccgcuccgccgagcacugcugguacuucggcgaggucuucugcaagauccacaccuccaccgacaucaugcucuccuccgccuccaucuuccaccucuccuucaucuccaucgaccgcuacuacgccgucugcgacccccuccgcuacaaggccaagaugaacauccucgucaucugcgucaugaucuucaucuccugguccguccccgccgucuucgccuucggcaugaucuuccucgagcucaacuucaagggcgccgaggagaucuacuacaagcacguccacugccgcggcggcugcuccgucuucuucuccaagaucuccggcguccucaccuucaugaccuccuucuacauccccggcuccaucaugcucugcgucuacuaccgcaucuaccucaucgccaaggagcaggcccgccucaucuccgacgccaaccagaagcuccagaucggccucgagaugaagaacggcaucucccaguccaaggagcgcaaggccgucaagacccucggcaucgucaugggcgucuuccucaucugcuggugccccuucuucaucugcaccgucauggaccccuuccuccacuacaucaucccccccacccucaacgacguccucaucugguucggcuaccucaacuccaccuucaaccccauggucuacgccuucuucuaccccugguuccgcaaggcccucaagaugaugcucuucggcaagaucuuccagaaggacuccucccgcugcaagcucuuccucgagcucuccuccuga

SEQ ID NO: 50427 - RNA, 1056 nt, Artificial Sequence
  derived and/or modified sequence opt2 from TAAR2__Homo_sapiens__NP_001028252
auggccgucuccuccgagcagcacgagcucucccacuucaagcgcacccagaccaagaaggagaaguucaacugcuccgaguacggcaaccgcuccugccccgagaacgagcgcucccucggcguccgcgucgccauguacuccuucauggccggcuccaucuucaucaccaucuucggcaaccucgccaugaucaucuccaucuccuacuucaagcagcuccacacccccaccaacuuccucauccucuccauggccaucaccgacuuccuccucggcuucaccaucaugcccuacuccaugauccgcuccgucgagaacugcugguacuucggccucaccuucugcaagaucuacuacuccuucgaccucaugcucuccaucaccuccaucuuccaccucugcuccgucgccaucgaccgcuucuacgccaucugcuacccccuccucuacuccaccaagaucaccauccccgucaucaagcgccuccuccuccucugcugguccguccccggcgccuucgccuucggcgucgucuucuccgaggccuacgccgacggcaucgagggcuacgacauccucgucgccugcuccuccuccugccccgucauguucaacaagcucuggggcaccacccucuucauggccggcuucuucacccccggcuccaugauggucggcaucuacggcaagaucuucgccgucucccgcaagcacgcccacgccaucaacaaccuccgcgagaaccagaacaaccaggucaagaaggacaagaaggccgccaagacccucggcaucgucaucggcgucuuccuccucugcugguuccccugcuucuucaccauccuccucgaccccuuccucaacuucuccacccccgucguccucuucgacgcccucaccugguucggcuacuucaacuccaccugcaacccccucaucuacggcuucuucuaccccugguuccgccgcgcccucaaguacauccuccucggcaagaucuucuccuccugcuuccacaacaccauccucugcaugcagaaggaguccgaguga

SEQ ID NO: 50428 - RNA, 1014 nt, Artificial Sequence
  derived and/or modified sequence opt2 from TAAR5__Homo_sapiens__NP_003958
augcgcgccgucuucauccagggcgccgaggagcaccccgccgccuucugcuaccaggucaacggcuccugcccccgcaccguccacacccucggcauccagcucgucaucuaccucgccugcgccgccggcaugcucaucaucguccucggcaacgucuucgucgccuucgccgucuccuacuucaaggcccuccacacccccaccaacuuccuccuccucucccucgcccucgccgacauguuccucggccuccucguccucccccucuccaccauccgcuccgucgaguccugcugguucuucggcgacuuccucugccgccuccacaccuaccucgacacccucuucugccucaccuccaucuuccaccucugcuucaucuccaucgaccgccacugcgccaucugcgacccccuccucuaccccuccaaguucaccguccgcgucgcccuccgcuacauccucgccggcuggggcguccccgccgccuacaccucccucuuccucuacaccgacgucgucgagacccgccucucccaguggcucgaggagaugcccugcgucggcuccugccagcuccuccucaacaaguucuggggcuggcucaacuucccccucuucuucguccccugccucaucaugaucucccucuacgucaagaucuucgucgucgccacccgccaggcccagcagaucaccacccucuccaagucccucgccggcgccgccaagcacgagcgcaaggccgccaagacccucggcaucgccgucggcaucuaccuccucugcuggcuccccuucaccaucgacaccauggucgacucccuccuccacuucaucacccccccccucgucuucgacaucuucaucugguucgccuacuucaacuccgccugcaaccccaucaucuacgucuucuccuaccagugguuccgcaaggcccucaagcucacccucucccagaaggucuucuccccccagacccgcaccgucgaccucuaccaggaguga

SEQ ID NO: 50429 - RNA, 1038 nt, Artificial Sequence
  derived and/or modified sequence opt2 from TAAR6__Homo_sapiens__NP_778237
auguccuccaacuccucccuccucgucgccguccagcucugcuacgccaacgucaacggcuccugcgucaagauccccuucucccccggcucccgcgucauccucuacaucgucuucggcuucggcgccguccucgccgucuucggcaaccuccucgucaugaucuccauccuccacuucaagcagcuccacucccccaccaacuuccucgucgccucccucgccugcgccgacuuccucgucggcgucaccgucaugcccuucuccaugguccgcaccgucgaguccugcugguacuucggccgcuccuucugcaccuuccacaccugcugcgacgucgccuucugcuacuccucccucuuccaccucugcuucaucuccaucgaccgcuacaucgccgucaccgacccccucgucuaccccaccaaguucaccgucuccgucuccggcaucugcaucuccgucuccuggauccucccccucauguacuccggcgccgucuucuacaccggcgucuacgacgacggccucgaggagcucuccgacgcccucaacugcaucggcggcugccagaccgucgucaaccagaacuggguccucaccgacuuccucuccuucuucauccccaccuucaucaugaucauccucuacggcaacaucuuccucgucgcccgccgccaggccaagaagaucgagaacaccggcuccaagaccgaguccuccuccgaguccuacaaggcccgcgucgcccgccgcgagcgcaaggccgccaagacccucggcgucaccgucgucgccuucaugaucuccuggcuccccuacuccaucgacucccucaucgacgccuucaugggcuucaucacccccgccugcaucuacgagaucugcugcuggugcgccuacuacaacuccgccaugaacccccucaucuacgcccucuucuaccccugguuccgcaaggccaucaaggucaucgucaccggccagguccucaagaacuccuccgccaccaugaaccucuucuccgagcacaucuga

SEQ ID NO: 50430 - RNA, 1515 nt, Artificial Sequence
  derived and/or modified sequence opt2 from TAB1__Homo_sapiens__NP_006107
auggccgcccagcgccgcucccuccuccaguccgagcagcagcccuccuggaccgacgaccucccccucugccaccucuccggcgucggcuccgccuccaaccgcuccuacuccgccgacggcaagggcaccgagucccacccccccgaggacuccuggcucaaguuccgcuccgagaacaacugcuuccucuacggcgucuucaacggcuacgacggcaaccgcgucaccaacuucgucgcccagcgccucuccgccgagcuccuccucggccagcucaacgccgagcacgccgaggccgacguccgccgcguccuccuccaggccuucgacgucgucgagcgcuccuuccucgaguccaucgacgacgcccucgccgagaaggccucccuccagucccagcuccccgagggcgucccccagcaccagcuccccccccaguaccagaagauccucgagcgccucaagacccucgagcgcgagaucuccggcggcgccauggccgucgucgccguccuccucaacaacaagcucuacgucgccaacgucggcaccaaccgcgcccuccucugcaaguccaccgucgacggccuccaggucacccagcucaacgucgaccacaccaccgagaacgaggacgagcucuuccgccucucccagcucggccucgacgccggcaagaucaagcaggucggcaucaucugcggccaggaguccacccgccgcaucggcgacuacaaggucaaguacggcuacaccgacaucgaccuccucuccgccgccaaguccaagcccaucaucgccgagcccgagauccacggcgcccagccccucgacggcgucaccggcuuccucguccucauguccgagggccucuacaaggcccucgaggccgcccacggccccggccaggccaaccaggagaucgccgccaugaucgacaccgaguucgccaagcagaccucccucgacgccgucgcccaggccgucgucgaccgcgucaagcgcauccacuccgacaccuucgccuccggcggcgagcgcgcccgcuucugcccccgccacgaggacaugacccuccucguccgcaacuucggcuacccccucggcgagaugucccagcccacccccucccccgcccccgccgccggcggccgcgucuaccccgucuccguccccuacuccuccgcccaguccaccuccaagaccuccgucacccucucccucgucaugcccucccagggccagauggucaacggcgcccacuccgccuccacccucgacgaggccacccccacccucaccaaccagucccccacccucacccuccaguccaccaacacccacacccaguccuccuccuccuccuccgacggcggccucuuccgcucccgccccgcccacucccucccccccggcgaggacggccgcgucgagcccuacgucgacuucgccgaguucuaccgccucugguccgucgaccacggcgagcaguccgucgucaccgcccccuga

SEQ ID NO: 50431 - RNA, 1986 nt, Artificial Sequence
  derived and/or modified sequence opt2 from TAB2__Homo_sapiens__NP_001278964
augcagaacaacaacaaccucgacgccugcugcgccguccucucccaggaguccacccgcuaccucuacggcgagggcgaccucaacuucuccgacgacuccggcaucuccggccuccgcaaccacaugaccucccucaaccucgaccuccagucccagaacaucuaccaccacggccgcgagggcucccgcaugaacggcucccgcacccucacccacuccaucuccgacggccagcuccagggcggccaguccaacuccgagcucuuccagcaggagccccagaccgcccccgcccaggucccccagggcuucaacgucuucggcauguccuccuccuccggcgccuccaacuccgccccccaccucggcuuccaccucggcuccaagggcaccuccucccucucccagcagaccccccgcuucaaccccaucauggucacccucgcccccaacauccagaccggccgcaacacccccaccucccuccacauccacggcguccccccccccguccucaacuccccccagggcaacuccaucuacauccgccccuacaucaccacccccggcggcaccacccgccagacccagcagcacuccggcugggucucccaguucaaccccaugaacccccagcaggucuaccagcccucccagcccggccccuggaccaccugccccgccuccaacccccucucccacaccuccucccagcagcccaaccagcagggccaccagaccucccacgucuacaugcccaucuccucccccaccaccucccagccccccaccauccacuccuccggcuccucccaguccuccgcccacucccaguacaacauccagaacaucuccaccggcccccgcaagaaccagaucgagaucaagcucgagcccccccagcgcaacaacuccuccaagcuccgcuccuccggcccccgcaccuccuccaccuccuccuccgucaacucccagacccucaaccgcaaccagcccaccgucuacaucgccgccuccccccccaacaccgacgagcucaugucccgcucccagcccaaggucuacaucuccgccaacgccgccaccggcgacgagcaggucaugcgcaaccagcccacccucuucaucuccaccaacuccggcgccuccgccgccucccgcaacauguccggccaggucuccaugggccccgccuucauccaccaccacccccccaagucccgcgccaucggcaacaacuccgccaccuccccccgcgucgucgucacccagcccaacaccaaguacaccuucaagaucaccgucucccccaacaagccccccgccgucucccccggcgucgucucccccaccuucgagcucaccaaccuccucaaccaccccgaccacuacgucgagaccgagaacauccagcaccucaccgaccccacccucgcccacgucgaccgcaucuccgagacccgcaagcucuccaugggcuccgacgacgccgccuacacccaggcccuccucguccaccagaaggcccgcauggagcgccuccagcgcgagcucgagauccagaagaagaagcucgacaagcucaaguccgaggucaacgagauggagaacaaccucacccgccgccgccucaagcgcuccaacuccaucucccagauccccucccucgaggagaugcagcagcuccgcuccugcaaccgccagcuccagaucgacaucgacugccucaccaaggagaucgaccucuuccaggcccgcggcccccacuucaaccccuccgccauccacaacuucuacgacaacaucggcuucgucggccccgucccccccaagcccaaggaccagcgcuccaucaucaagacccccaagacccaggacaccgaggacgacgagggcgcccaguggaacugcaccgccugcaccuuccucaaccaccccgcccucauccgcugcgagcagugcgagaugccccgccacuucuga

SEQ ID NO: 50432 - RNA, 2139 nt, Artificial Sequence
  derived and/or modified sequence opt2 from TAB3__Homo_sapiens__XP_005274539
auggcccaguccuccccccagcucgacauccagguccuccacgaccuccgccagcgcuuccccgagauccccgagggcgucgucucccagugcaugcuccagaacaacaacaaccucgaggccugcugccgcgcccucucccaggaguccuccaaguaccucuacauggaguaccacucccccgacgacaaccgcaugaaccgcaaccgccuccuccacaucaaccucggcauccacucccccuccuccuaccaccccggcgacggcgcccagcucaacggcggccgcacccucguccacuccuccuccgacggccacaucgacccccagcacgccgccggcaagcagcucaucugccucguccaggagccccacuccgcccccgccgucgucgccgccacccccaacuacaaccccuucuucaugaacgagcagaaccgcuccgccgccaccccccccucccagcccccccagcagcccuccuccaugcagaccggcaugaaccccuccgccaugcagggccccuccccccccccccccccccccuccuacaugcacaucccccgcuacuccaccaaccccaucaccgucaccgucucccagaaccuccccuccggccagaccgucccccgcgcccuccagauccucccccagauccccuccaaccucuacggcucccccggcuccaucuacauccgccagaccucccaguccuccuccggccgccagaccccccaguccacccccuggcaguccuccccccagggccccgucccccacuacucccagcgcccccuccccgucuacccccaccagcagaacuaccagcccucccaguacucccccaagcagcagcagaucccccaguccgccuaccacucccccccccccucccagugccccucccccuucuccuccccccagcaccagguccagcccucccagcucggccacaucuucaugccccccucccccuccaccacccccccccaccccuaccagcagggcccccccuccuaccagaagcagggcucccacuccgucgccuaccuccccuacaccgccuccucccucuccaagggcuccaugaagaagaucgagaucaccgucgagcccucccagcgccccggcaccgccaucaaccgcucccccucccccaucuccaaccagcccuccccccgcaaccagcacucccucuacaccgccaccaccccccccuccuccucccccucccgcggcaucuccucccagcccaagccccccuucuccgucaaccccgucuacaucaccuacacccagcccaccggccccuccugcacccccucccccuccccccgcgucauccccaaccccaccaccgucuucaagaucaccgucggccgcgccaccaccgagaaccuccucaaccucgucgaccaggaggagcgcuccgccgcccccgagcccauccagcccaucuccgucauccccggcuccggcggcgagaagggcucccacaaguaccagcgcuccuccuccuccggcuccgacgacuacgccuacacccaggcccuccuccuccaccagcgcgcccgcauggagcgccucgccaagcagcucaagcucgagaaggaggagcucgagcgccucaaguccgaggucaacggcauggagcacgaccucaugcagcgccgccuccgccgcgucuccugcaccaccgccauccccacccccgaggagaugacccgccuccgcuccaugaaccgccagcuccagaucaacgucgacugcacccucaaggaggucgaccuccuccagucccgcggcaacuucgaccccaaggccaugaacaacuucuacgacaacaucgagcccggccccgucgucccccccaagcccuccaagaaggacuccuccgaccccugcaccaucgagcgcaaggcccgccgcaucuccgucaccuccaagguccaggccgacauccacgacacccaggccgccgccgccgacgagcaccgcaccggcuccacccaguccccccgcacccagccccgcgacgaggacuacgagggcgcccccuggaacugcgacuccugcaccuuccucaaccaccccgcccucaaccgcugcgagcagugcgagaugccccgcuacaccuga

SEQ ID NO: 50433 - RNA, 390 nt, Artificial Sequence
  derived and/or modified sequence opt2 from TAC1__Homo_sapiens__NP_003173
augaagauccucgucgcccucgccgucuucuuccucgucuccacccagcucuucgccgaggagaucggcgccaacgacgaccucaacuacugguccgacugguacgacuccgaccagaucaaggaggagcuccccgagcccuucgagcaccuccuccagcgcaucgcccgccgccccaagccccagcaguucuucggccucaugggcaagcgcgacgccgacuccuccaucgagaagcaggucgcccuccucaaggcccucuacggccacggccagaucucccacaagcgccacaagaccgacuccuucgucggccucaugggcaagcgcgcccucaacuccgucgccuacgagcgcuccgccaugcagaacuacgagcgccgccgcuga

SEQ ID NO: 50434 - RNA, 312 nt, Artificial Sequence
  derived and/or modified sequence opt2 from TAC3__Homo_sapiens__NP_001171525
augcgcaucaugcuccucuucaccgccauccucgccuucucccucgcccaguccuucggcgccgucugcaaggagccccaggaggaggucguccccggcggcggccgcuccaagcgcgaccccgaccucuaccagcuccuccagcgccucuucaagucccacuccucccucgagggccuccucaaggcccucucccaggccuccaccgaccccaaggaguccaccucccccgagaagcacucccccaccgacgucaaccaggagaacguccccuccuucggcauccucaaguaccccccccgcgccgaguga

SEQ ID NO: 50435 - RNA, 291 nt, Artificial Sequence
  derived and/or modified sequence opt2 from TAC4__Homo_sapiens__NP_001070971
augcuccccugccucgcccuccuccuccucauggagcucuccgucugcaccgucgccggcgacggcggcgaggagcagacccucuccaccgaggccgagaccugggagggcgccggccccuccauccagcuccagcuccaggaggucaagaccggcaaggccucccaguucuucggccucaugggcaagcgcgucggcgccuaccagcucgagcacaccuuccagggccuccucggcaagcgcucccucuucaccgagggccgcgaggacgaggcccagggcuccgaguga

SEQ ID NO: 50436 - RNA, 1188 nt, Artificial Sequence
  derived and/or modified sequence opt2 from TACC1__Homo_sapiens__NP_001116296
auggccuucucccccuggcagauccucucccccguccagugggccaaguggaccugguccgccguccgcggcggcgccgccggcgaggacgaggccggcggccccgagggcgaccccgaggaggaggacucccaggccgagaccaagucccucuccuuccgcuccggcugcaaggucaagaagcacgagacccagucccucgcccucgacgccugcucccgcgacgagggcgccgucaucucccagaucuccgacaucuccaaccgcgacggccacgccaccgacgaggagaagcucgccuccaccuccugcggccagaaguccgccggcgccgaggucaagggcgagcccgaggaggaccucgaguacuucgagugcuccaacguccccgucuccaccaucaaccacgccuucuccuccuccgaggccggcaucgagaaggagaccugccagaagauggaggaggacggcuccaccguccucggccuccucgaguccuccgccgagaaggcccccgucuccgucuccugcggcggcgaguccccccucgacggcaucugccucuccgaguccgacaagaccgccguccucacccucauccgcgaggagaucaucaccaaggagaucgaggccaacgaguggaagaagaaguacgaggagacccgccaggagguccucgagaugcgcaagaucgucgccgaguacgagaagaccaucgcccagaugaucgaggacgagcagcgcaccuccaugaccucccagaaguccuuccagcagcucaccauggagaaggagcaggcccucgccgaccucaacuccgucgagcgcucccucuccgaccucuuccgccgcuacgagaaccucaagggcguccucgagggcuucaagaagaacgaggaggcccucaagaagugcgcccaggacuaccucgcccgcgucaagcaggaggagcagcgcuaccaggcccucaagauccacgccgaggagaagcucgacaaggccaacgaggagaucgcccagguccgcaccaaggccaaggccgaguccgccgcccuccacgccggccuccgcaaggagcagaugaaggucgagucccucgagcgcgcccuccagcagaagaaccaggagaucgaggagcucaccaagaucugcgacgagcucaucgccaagcucggcaagaccgacuga

SEQ ID NO: 50437 - RNA, 8481 nt, Artificial Sequence
  derived and/or modified sequence opt2 from TACC2__Homo_sapiens__NP_001278805
augggcaacgagaacuccaccuccgacaaccagcgcacccucuccgcccagaccccccgcuccgcccagccccccggcaacucccagaacaucaagcgcaagcagcaggacacccccggcucccccgaccaccgcgacgccuccuccaucggcuccgucggccucggcggcuucugcaccgccuccgaguccuccgccucccucgaccccugccucgucucccccgaggucaccgagccccgcaaggacccccagggcgcccgcggccccgagggcucccuccuccccucccccccccccucccaggagcgcgagcaccccuccuccuccaugcccuucgccgagugcccccccgagggcugccucgccucccccgccgccgcccccgaggacggcccccagacccaguccccccgccgcgagcccgcccccaacgcccccggcgacaucgccgccgccuuccccgccgagcgcgacuccuccacccccuaccaggagaucgccgccguccccuccgccggccgcgagcgccagcccaaggaggagggccagaaguccuccuucuccuucuccuccggcaucgaccagucccccggcaugucccccgucccccuccgcgagcccaugaaggccccccucugcggcgagggcgaccagcccggcggcuucgagucccaggagaaggaggccgccggcggcuucccccccgccgagucccgccagggcgucgccuccguccaggucacccccgaggcccccgccgccgcccagcagggcaccgaguccuccgccguccucgagaaguccccccucaagcccauggcccccaucccccaggaccccgccccccgcgccuccgaccgcgagcgcggccagggcgaggcccccccccaguaccucaccgacgaccucgaguuccuccgcgccugccaccucccccgcuccaacuccggcgccgcccccgaggccgaggucaacgccgccucccaggaguccugccagcagcccgucggcgccuaccucccccacgccgagcuccccuggggccuccccucccccgcccucguccccgaggccggcggcuccggcaaggaggcccucgacaccaucgacguccagggccacccccagaccggcaugcgcggcaccaagcccaaccaggucgucugcgucgccgccggcggccagcccgagggcggccuccccgucucccccgagcccucccuccucacccccaccgaggaggcccaccccgccuccucccucgccuccuuccccgccgcccagauccccaucgccgucgaggagcccggcuccuccucccgcgaguccgucuccaaggccggcaugcccgucuccgccgacgccgccaaggaggucgucgacgccggccucgucggccucgagcgccaggucuccgaccucggcuccaagggcgagcaccccgagggcgaccccggcgagguccccgcccccuccccccaggagcgcggcgagcaccucaacaccgagcagucccacgagguccagcccggcguccccccccccccccuccccaaggagcagucccacgagguccagcccggcgcccccccccccccccuccccaaggcccccuccgaguccgcccgcggcccccccggccccaccgacggcgccaagguccacgaggacuccaccucccccgccgucgccaaggagggcucccgcucccccggcgacucccccggcggcaaggaggaggcccccgagccccccgacggcggcgaccccggcaaccuccagggcgaggacucccaggccuucuccuccaagcgcgaccccgaggucggcaaggacgagcucuccaagcccuccuccgacgccgagucccgcgaccaccccuccucccacuccgcccagcccccccgcaagggcggcgccggccacaccgacggcccccacucccagaccgccgaggccgacgccuccggccucccccacaagcucggcgaggaggaccccguccucccccccguccccgacggcgccggcgagcccaccguccccgagggcgccaucugggagggcuccggccuccagcccaagugccccgacacccuccagucccgcgagggccucggccgcauggaguccuuccucacccucgaguccgagaaguccgacuucccccccacccccgucgccgaggucgcccccaaggcccaggagggcgaguccacccucgagauccgcaagaugggcuccugcgacggcgagggccuccucaccucccccgaccagccccgcggccccgccugcgacgccucccgccaggaguuccacgccggcgucccccaccccccccagggcgagaaccucgccgccgaccucggccucaccgcccucauccucgaccaggaccagcagggcauccccuccugccccggcgagggcuggauccgcggcgccgccuccgaguggccccuccucuccuccgagaagcaccuccagcccucccaggcccagcccgagaccuccaucuucgacguccucaaggagcaggcccagccccccgagaacggcaaggagaccucccccucccaccccggcuucaaggaccagggcgccgacuccucccagauccacguccccgucgagccccaggaggacaacaaccuccccacccacggcggccaggagcaggcccucggcuccgagcuccagucccagcuccccaagggcacccucuccgacacccccaccuccucccccaccgacauggucugggaguccucccucaccgaggaguccgagcucuccgcccccacccgccagaagcuccccgcccucggcgagaagcgccccgagggcgccugcggcgacggccaguccucccgcgucuccccccccgccgccgacguccucaaggacuucucccucgccggcaacuucucccgcaaggagaccugcugcaccggccagggccccaacaagucccagcaggcccucgccgacgcccucgaggagggcucccagcacgaggaggccugccagcgccaccccggcgccuccgaggccgccgacggcugcuccccccucuggggccucuccaagcgcgagauggccuccggcaacaccggcgaggccccccccugccagcccgacuccgucgcccuccucgacgccguccccugccuccccgcccucgcccccgccucccccggcgucacccccacccaggacgcccccgagaccgaggccugcgacgagacccaggagggccgccagcagcccguccccgccccccagcagaagauggagugccgcgccaccuccgacgccgagucccccaagcuccucgccuccuuccccuccgccggcgagcagggcggcgaggccggcgccgccgagaccggcggcuccgccggcgccggcgaccccggcaagcagcaggcccccgagaagcccggcgaggccacccucuccugcggccuccuccagaccgagcacugccucaccuccggcgaggaggccuccaccuccgcccuccgcgaguccugccaggccgagcaccccauggccuccugccaggacgcccuccuccccgcccgcgagcucggcggcaucccccgcuccaccauggacuucuccacccaccaggccguccccgaccccaaggagcuccuccucuccggcccccccgaggucgccgcccccgacacccccuaccuccacgucgacuccgccgcccagcgcggcgccgaggacuccggcgucaaggccgucuccuccgccgacccccgcgcccccggcgagucccccugccccgucggcgagcccccccucgcccucgagaacgccgccucccucaagcucuucgccggcucccucgccccccuccuccagcccggcgccgccggcggcgagauccccgccguccaggccuccuccggcucccccaaggcccgcaccaccgagggccccgucgacuccaugcccugccucgaccgcaugccccuccucgccaagggcaagcaggccaccggcgaggagaaggccgccaccgcccccggcgccggcgccaaggccuccggcgagggcauggccggcgacgccgccggcgagaccgagggcuccauggagcgcaugggcgagcccucccaggaccccaagcagggcaccuccggcggcgucgacaccuccuccgagcagaucgccacccucaccggcuuccccgacuuccgcgagcacaucgccaagaucuucgagaagcccguccucggcgcccucgccacccccggcgagaaggccggcgccggccgcuccgccgucggcaaggaccucacccgcccccucggccccgagaagcuccucgacggcccccccggcgucgacgucacccuccuccccgccccccccgcccgccuccaggucgagaagaagcagcagcucgccggcgaggccgagaucucccaccucgcccuccaggaccccgccuccgacaagcuccucggccccgccggccucaccugggagcgcaaccuccccggcgccggcgucggcaaggagauggccggcgucccccccacccuccgcgaggacgagcgccccgagggccccggcgccgccuggcccggccucgagggccaggccuacucccagcucgagcgcucccgccaggagcucgccuccggccuccccucccccgccgccacccaggagcuccccgucgagcgcgccgccgccuuccaggucgccccccacucccacggcgaggaggccgucgcccaggaccgcauccccuccggcaagcagcaccaggagaccuccgccugcgacuccccccacggcgaggacggccccggcgacuucgcccacaccggcguccccggccacgucccccgcuccaccugcgcccccuccccccagcgcgagguccucaccguccccgaggccaacuccgagcccuggacccucgacacccucggcggcgagcgccgccccggcgucaccgccggcauccucgagaugcgcaacgcccucggcaaccaguccacccccgccccccccaccggcgaggucgccgacaccccccucgagcccggcaaggucgccggcgccgccggcgaggccgagggcgacaucacccucuccaccgccgagacccaggccugcgccuccggcgaccuccccgaggccggcaccacccgcaccuucuccgucgucgccggcgaccucguccuccccggcuccugccaggaccccgccugcuccgacaaggcccccggcauggagggcaccgccgcccuccacggcgacucccccgcccgcccccagcaggccaaggagcagcccggccccgagcgccccauccccgccggcgacggcaaggucugcgucuccuccccccccgagcccgacgagacccacgaccccaagcuccagcaccucgcccccgaggagcuccacaccgaccgcgaguccccccgccccggccccuccaugcuccccuccguccccaagaaggacgccccccgcgucauggacaaggucaccuccgacgagacccgcggcgccgagggcaccgaguccucccccgucgccgacgacaucauccagcccgccgcccccgccgaccucgagucccccacccucgccgccuccuccuaccacggcgacgucgucggccaggucuccaccgaccucaucgcccagcgcuccuccgacuccgaggaggccuucgagacccccgaguccaccacccccgucaaggccccccccgccccccccccccccccccccgaggucauccccgagcccgaggucuccacccagcccccccccgaggagcccggcugcggcuccgagaccguccccguccccgacggcccccgcuccgacuccgucgagggcucccccuuccgcccccccucccacuccuucuccgccgucuucgacgaggacaagcccaucgccuccuccggcaccuacaaccucgacuucgacaacaucgagcucgucgacaccuuccagacccucgagccccgcgccuccgacgccaagaaccaggagggcaaggucaacacccgccgcaaguccaccgacuccguccccaucuccaaguccacccucucccgcucccucucccuccaggccuccgacuucgacggcgccuccuccuccggcaaccccgaggccgucgcccucgcccccgacgccuacuccaccggcuccuccuccgccuccuccacccucaagcgcaccaagaagccccgcccccccucccucaagaagaagcagaccaccaagaagcccaccgagaccccccccgucaaggagacccagcaggagcccgacgaggagucccucguccccuccggcgagaaccucgccuccgagaccaagaccgaguccgccaagaccgagggccccucccccgcccuccucgaggagaccccccucgagcccgccgucggccccaaggccgccugcccccucgacuccgaguccgccgagggcgucgucccccccgccuccggcggcggccgcguccagaacuccccccccgucggccgcaagacccucccccucaccaccgcccccgaggccggcgaggucacccccuccgacuccggcggccaggaggacucccccgccaagggccucuccguccgccucgaguucgacuacuccgaggacaaguccuccugggacaaccagcaggagaaccccccccccaccaagaagaucggcaagaagcccgucgccaagaugccccuccgccgccccaagaugaagaagacccccgagaagcucgacaacacccccgccucccccccccgcucccccgccgagcccaacgacauccccaucgccaagggcaccuacaccuucgacaucgacaagugggacgaccccaacuucaaccccuucuccuccaccuccaagaugcaggagucccccaagcucccccagcaguccuacaacuucgaccccgacaccugcgacgaguccgucgaccccuucaagaccuccuccaagacccccuccucccccuccaagucccccgccuccuucgagauccccgccuccgccauggaggccaacggcgucgacggcgacggccucaacaagcccgccaagaagaagaagaccccccucaagaccgacaccuuccgcgucaagaagucccccaagcgcuccccccucuccgacccccccucccaggaccccacccccgccgccacccccgagaccccccccgucaucuccgccgucguccacgccaccgacgaggagaagcucgccgucaccaaccagaaguggaccugcaugaccgucgaccucgaggccgacaagcaggacuacccccagcccuccgaccucuccaccuucgucaacgagaccaaguucuccucccccaccgaggagcucgacuaccgcaacuccuacgagaucgaguacauggagaagaucggcuccucccucccccaggacgacgacgcccccaagaagcaggcccucuaccucauguucgacaccucccaggagucccccgucaaguccucccccguccgcauguccgagucccccacccccugcuccggcuccuccuucgaggagaccgaggcccucgucaacaccgccgccaagaaccagcaccccgucccccgcggccucgcccccaaccaggagucccaccuccagguccccgagaaguccucccagaaggagcucgaggccaugggccucggcacccccuccgaggccaucgagauccgcgaggccgcccaccccaccgacgucuccaucuccaagaccgcccucuacucccgcaucggcaccgccgaggucgagaagcccgccggccuccucuuccagcagcccgaccucgacuccgcccuccagaucgcccgcgccgagaucaucaccaaggagcgcgaggucuccgaguggaaggacaaguacgaggagucccgccgcgaggucauggagaugcgcaagaucgucgccgaguacgagaagaccaucgcccagaugaucgaggacgagcagcgcgagaaguccgucucccaccagaccguccagcagcucguccucgagaaggagcaggcccucgccgaccucaacuccgucgagaagucccucgccgaccucuuccgccgcuacgagaagaugaaggagguccucgagggcuuccgcaagaacgaggagguccucaagcgcugcgcccaggaguaccucucccgcgucaagaaggaggagcagcgcuaccaggcccucaagguccacgccgaggagaagcucgaccgcgccaacgccgagaucgcccagguccgcggcaaggcccagcaggagcaggccgcccaccaggccucccuccgcaaggagcagcuccgcgucgacgcccucgagcgcacccucgagcagaagaacaaggagaucgaggagcucaccaagaucugcgacgagcucaucgccaagaugggcaaguccuga

SEQ ID NO: 50438 - RNA, 2517 nt, Artificial Sequence
  derived and/or modified sequence opt2 from TACC3__Homo_sapiens__NP_006333
augucccuccagguccucaacgacaagaacgucuccaacgagaagaacaccgagaacugcgacuuccucuucuccccccccgaggucaccggccgcuccuccguccuccgcgucucccagaaggagaacgucccccccaagaaccucgccaaggccaugaaggucaccuuccagaccccccuccgcgacccccagacccaccgcauccucucccccuccauggccuccaagcucgaggcccccuucacccaggacgacacccucggccucgagaacucccaccccgucuggacccagaaggagaaccagcagcucaucaaggaggucgacgccaagaccacccacggcauccuccagaagcccgucgaggccgacaccgaccuccucggcgacgccucccccgccuucggcuccggcuccuccuccgaguccggccccggcgcccucgccgaccucgacugcuccuccuccucccagucccccggcuccuccgagaaccagauggucucccccggcaaggucuccggcucccccgagcaggccgucgaggagaaccucuccuccuacucccucgaccgccgcgucacccccgccuccgagacccucgaggaccccugccgcaccgagucccagcacaaggccgagaccccccacggcgccgaggaggagugcaaggccgagaccccccacggcgccgaggaggagugccgccacggcggcgucugcgcccccgccgccgucgccaccuccccccccggcgccauccccaaggaggccugcggcggcgccccccuccagggccuccccggcgaggcccucggcugccccgccggcgucggcacccccguccccgccgacggcacccagacccucaccugcgcccacaccuccgcccccgaguccaccgcccccaccaaccaccucgucgccggccgcgccaugacccucuccccccaggaggaggucgccgccggccagauggccuccuccucccgcuccggccccgucaagcucgaguucgacgucuccgacggcgccaccuccaagcgcgccccccccccccgccgccucggcgagcgcuccggccucaagcccccccuccgcaaggccgccguccgccagcagaaggccccccaggaggucgaggaggacgacggccgcuccggcgccggcgaggacccccccaugcccgccucccgcggcuccuaccaccucgacugggacaagauggacgaccccaacuucauccccuucggcggcgacaccaaguccggcugcuccgaggcccagccccccgagucccccgagacccgccucggccagcccgccgccgagcagcuccacgccggccccgccaccgaggagcccggccccugccucucccagcagcuccacuccgccuccgccgaggacacccccgucguccagcucgccgccgagacccccaccgccgaguccaaggagcgcgcccucaacuccgccuccaccucccuccccaccuccugccccggcuccgagcccguccccacccaccagcagggccagcccgcccucgagcucaaggaggaguccuuccgcgaccccgccgagguccucggcaccggcgccgaggucgacuaccucgagcaguucggcaccuccuccuucaaggaguccgcccuccgcaagcagucccucuaccucaaguucgacccccuccuccgcgacucccccggccgccccguccccgucgccaccgagaccuccuccaugcacggcgccaacgagacccccuccggccgcccccgcgaggccaagcucgucgaguucgacuuccucggcgcccucgacauccccguccccggccccccccccggcguccccgcccccggcggccccccccucuccaccggccccaucgucgaccuccuccaguacucccagaaggaccucgacgccgucgucaaggccacccaggaggagaaccgcgagcuccgcucccgcugcgaggagcuccacggcaagaaccucgagcucggcaagaucauggaccgcuucgaggaggucgucuaccaggccauggaggagguccagaagcagaaggagcucuccaaggccgagauccagaagguccucaaggagaaggaccagcucaccaccgaccucaacuccauggagaaguccuucuccgaccucuucaagcgcuucgagaagcagaaggaggucaucgagggcuaccgcaagaacgaggagucccucaagaagugcgucgaggacuaccucgcccgcaucacccaggagggccagcgcuaccaggcccucaaggcccacgccgaggagaagcuccagcucgccaacgaggagaucgcccagguccgcuccaaggcccaggccgaggcccucgcccuccaggccucccuccgcaaggagcagaugcgcauccagucccucgagaagaccgucgagcagaagaccaaggagaacgaggagcucacccgcaucugcgacgaccucaucuccaagauggagaagaucuga

SEQ ID NO: 50439 - RNA, 894 nt, Artificial Sequence
  derived and/or modified sequence opt2 from TACO1__Homo_sapiens__NP_057444
auguccgccugggccgccgccucccucucccgcgccgccgcccgcugccuccucgcccgcggccccggcguccgcgccgcccccccccgcgacccccgccccucccaccccgagccccgcggcugcggcgccgcccccggccgcacccuccacuucaccgccgccguccccgccggccacaacaagugguccaagguccgccacaucaagggccccaaggacgucgagcgcucccgcaucuucuccaagcucugccucaacauccgccucgccgucaaggagggcggccccaaccccgagcacaacuccaaccucgccaacauccucgaggucugccgcuccaagcacaugcccaaguccaccaucgagaccgcccucaagauggagaaguccaaggacaccuaccuccucuacgagggccgcggccccggcggcuccucccuccucaucgaggcccucuccaacuccucccacaagugccaggccgacauccgccacauccucaacaagaacggcggcgucauggccgucggcgcccgccacuccuucgacaagaagggcgucaucgucgucgaggucgaggaccgcgagaagaaggccgucaaccucgagcgcgcccucgagauggccaucgaggccggcgccgaggacgucaaggagaccgaggacgaggaggagcgcaacgucuucaaguucaucugcgacgccuccucccuccaccagguccgcaagaagcucgacucccucggccucugcuccgucuccugcgcccucgaguucauccccaacuccaagguccagcucgccgagcccgaccucgagcaggccgcccaccucauccaggcccucuccaaccacgaggacgucauccacgucuacgacaacaucgaguga

SEQ ID NO: 50440 - RNA, 1224 nt, Artificial Sequence
  derived and/or modified sequence opt2 from TACR1__Homo_sapiens__NP_001049
auggacaacguccuccccgucgacuccgaccucucccccaacaucuccaccaacaccuccgagcccaaccaguucguccagcccgccuggcagaucguccucugggccgccgccuacaccgucaucgucgucaccuccgucgucggcaacgucgucgucauguggaucauccucgcccacaagcgcaugcgcaccgucaccaacuacuuccucgucaaccucgccuucgccgaggccuccauggccgccuucaacaccgucgucaacuucaccuacgccguccacaacgagugguacuacggccucuucuacugcaaguuccacaacuucuuccccaucgccgccgucuucgccuccaucuacuccaugaccgccgucgccuucgaccgcuacauggccaucauccacccccuccagccccgccucuccgccaccgccaccaaggucgucaucugcgucaucuggguccucgcccuccuccucgccuucccccagggcuacuacuccaccaccgagaccaugcccucccgcgucgucugcaugaucgaguggcccgagcaccccaacaagaucuacgagaaggucuaccacaucugcgucaccguccucaucuacuuccucccccuccucgucaucggcuacgccuacaccgucgucggcaucacccucugggccuccgagauccccggcgacuccuccgaccgcuaccacgagcaggucuccgccaagcgcaaggucgucaagaugaugaucgucgucgucugcaccuucgccaucugcuggcuccccuuccacaucuucuuccuccuccccuacaucaaccccgaccucuaccucaagaaguucauccagcaggucuaccucgccaucauguggcucgccauguccuccaccauguacaaccccaucaucuacugcugccucaacgaccgcuuccgccucggcuucaagcacgccuuccgcugcugccccuucaucuccgccggcgacuacgagggccucgagaugaaguccacccgcuaccuccagacccagggcuccgucuacaaggucucccgccucgagaccaccaucuccaccgucgucggcgcccacgaggaggagcccgaggacggccccaaggccacccccuccucccucgaccucaccuccaacugcuccucccgcuccgacuccaagaccaugaccgaguccuucuccuucuccuccaacguccucuccuga

SEQ ID NO: 50441 - RNA, 1197 nt, Artificial Sequence
  derived and/or modified sequence opt2 from TACR2__Homo_sapiens__NP_001048
augggcaccugcgacaucgucaccgaggccaacaucuccuccggccccgaguccaacaccaccggcaucaccgccuucuccaugcccuccuggcagcucgcccucugggccaccgccuaccucgcccucguccucgucgccgucaccggcaacgccaucgucaucuggaucauccucgcccaccgccgcaugcgcaccgucaccaacuacuucaucgucaaccucgcccucgccgaccucugcauggccgccuucaacgccgccuucaacuucgucuacgccucccacaacaucugguacuucggccgcgccuucugcuacuuccagaaccucuuccccaucaccgccauguucgucuccaucuacuccaugaccgccaucgccgccgaccgcuacauggccaucguccaccccuuccagccccgccucuccgcccccuccaccaaggccgucaucgccggcaucuggcucgucgcccucgcccucgccuccccccagugcuucuacuccaccgucaccauggaccagggcgccaccaagugcgucgucgccuggcccgaggacuccggcggcaagacccuccuccucuaccaccucgucgucaucgcccucaucuacuuccucccccucgccgucauguucgucgccuacuccgucaucggccucacccucuggcgccgcgccguccccggccaccaggcccacggcgccaaccuccgccaccuccaggccaugaagaaguucgucaagaccaugguccucgucguccucaccuucgccaucugcuggcuccccuaccaccucuacuucauccucggcuccuuccaggaggacaucuacugccacaaguucauccagcaggucuaccucgcccucuucuggcucgccauguccuccaccauguacaaccccaucaucuacugcugccucaaccaccgcuuccgcuccggcuuccgccucgccuuccgcugcugccccugggucacccccaccaaggaggacaagcucgagcucacccccaccaccucccucuccacccgcgucaaccgcugccacaccaaggagacccucuucauggccggcgacaccgcccccuccgaggccaccuccggcgaggccggccgcccccaggacggcuccggccucugguucggcuacggccuccucgcccccaccaagacccacgucgagaucuga

SEQ ID NO: 50442 - RNA, 1398 nt, Artificial Sequence
  derived and/or modified sequence opt2 from TACR3__Homo_sapiens__NP_001050
auggccacccuccccgccgccgagaccuggaucgacggcggcggcggcgucggcgccgacgccgucaaccucaccgccucccucgccgccggcgccgccaccggcgccgucgagaccggcuggcuccagcuccucgaccaggccggcaaccucuccuccucccccuccgcccucggccuccccgucgccucccccgcccccucccagcccugggccaaccucaccaaccaguucguccagcccuccuggcgcaucgcccucuggucccucgccuacggcgucgucgucgccgucgccguccucggcaaccucaucgucaucuggaucauccucgcccacaagcgcaugcgcaccgucaccaacuacuuccucgucaaccucgccuucuccgacgccuccauggccgccuucaacacccucgucaacuucaucuacgcccuccacuccgagugguacuucggcgccaacuacugccgcuuccagaacuucuuccccaucaccgccgucuucgccuccaucuacuccaugaccgccaucgccgucgaccgcuacauggccaucaucgacccccucaagccccgccucuccgccaccgccaccaagaucgucaucggcuccaucuggauccucgccuuccuccucgccuucccccagugccucuacuccaagaccaaggucaugcccggccgcacccucugcuucguccaguggcccgagggccccaagcagcacuucaccuaccacaucaucgucaucauccucgucuacugcuucccccuccucaucaugggcaucaccuacaccaucgucggcaucacccucuggggcggcgagauccccggcgacaccugcgacaaguaccacgagcagcucaaggccaagcgcaaggucgucaagaugaugaucaucgucgucaugaccuucgccaucugcuggcuccccuaccacaucuacuucauccucaccgccaucuaccagcagcucaaccgcuggaaguacauccagcaggucuaccucgccuccuucuggcucgccauguccuccaccauguacaaccccaucaucuacugcugccucaacaagcgcuuccgcgccggcuucaagcgcgccuuccgcuggugccccuucaucaaggucuccuccuacgacgagcucgagcucaagaccacccgcuuccaccccaaccgccaguccuccauguacaccgucacccgcauggaguccaugaccgucgucuucgaccccaacgacgccgacaccacccgcuccucccgcaagaagcgcgccaccccccgcgaccccuccuucaacggcugcucccgccgcaacuccaaguccgccuccgccaccuccuccuucaucuccucccccuacaccuccgucgacgaguacuccuga

SEQ ID NO: 50443 - RNA, 1008 nt, Artificial Sequence
  derived and/or modified sequence opt2 from TADA1__Homo_sapiens__NP_444281
auggccaccuucgucuccgagcucgaggccgccaagaagaaccucuccgaggcccucggcgacaacgucaagcaguacugggccaaccucaagcucugguucaagcagaagaucuccaaggaggaguucgaccucgaggcccaccgccuccucacccaggacaacguccacucccacaacgacuuccuccucgccauccucacccgcugccagauccucgucuccacccccgacggcgccggcucccuccccuggcccggcggcuccgccgccaagcccggcaagcccaagggcaagaagaagcucuccuccguccgccagaaguucgaccaccgcuuccagccccagaacccccucuccggcgcccagcaguucgucgccaaggacccccaggacgacgacgaccucaagcucugcucccacaccaugaugcuccccacccgcggccagcucgagggccgcaugaucgucaccgccuacgagcacggccucgacaacgucaccgaggaggccgucuccgccgucgucuacgccgucgagaaccaccucaaggacauccucaccuccgucgucucccgccgcaaggccuaccgccuccgcgacggccacuucaaguacgccuucggcuccaacgucaccccccagcccuaccucaagaacuccgucgucgccuacaacaaccucaucgaguccccccccgccuucaccgcccccugcgccggccagaaccccgccucccaccccccccccgacgacgccgagcagcaggccgcccuccuccucgccugcuccggcgacacccuccccgccucccucccccccgucaacauguacgaccucuucgaggcccuccagguccaccgcgaggucauccccacccacaccgucuacgcccucaacaucgagcgcaucaucaccaagcucuggcaccccaaccacgaggagcuccagcaggacaagguccaccgccagcgccucgccgccaaggagggccuccuccucugcuga

SEQ ID NO: 50444 - RNA, 1332 nt, Artificial Sequence
  derived and/or modified sequence opt2 from TADA2A__Homo_sapiens__NP_001159577
auggaccgccucggcuccuucuccaacgaccccuccgacaagccccccugccgcggcugcuccuccuaccucauggagcccuacaucaagugcgccgagugcggccccccccccuucuuccucugccuccagugcuucacccgcggcuucgaguacaagaagcaccaguccgaccacaccuacgagaucaugaccuccgacuuccccguccucgaccccuccuggaccgcccaggaggagauggcccuccucgaggccgucauggacugcggcuucggcaacuggcaggacgucgccaaccagaugugcaccaagaccaaggaggagugcgagaagcacuacaugaagcacuucaucaacaacccccucuucgccuccacccuccucaaccucaagcaggccgaggaggccaagaccgccgacaccgccauccccuuccacuccaccgacgaccccccccgccccaccuucgacucccuccucucccgcgacauggccggcuacaugcccgcccgcgccgacuucaucgaggaguucgacaacuacgccgagugggaccuccgcgacaucgacuucgucgaggacgacuccgacauccuccacgcccucaagauggccgucgucgacaucuaccacucccgccucaaggagcgccagcgccgcaagaagaucauccgcgaccacggccucaucaaccuccgcaaguuccagcucauggagcgccgcuaccccaaggagguccaggaccucuacgagaccaugcgccgcuucgcccgcaucgucggccccgucgagcacgacaaguucaucgagucccacgcccucgaguucgagcuccgccgcgagaucaagcgccuccaggaguaccgcaccgccggcaucaccaacuucugcuccgcccgcaccuacgaccaccucaagaagacccgcgaggaggagcgccucaagcgcaccaugcucuccgagguccuccaguacauccaggacuccuccgccugccagcaguggcuccgccgccaggccgacaucgacuccggccucucccccuccauccccauggccuccaacuccggccgccgcuccgcccccccccucaaccucaccggccuccccggcaccgagaagcucaacgagaaggagaaggagcucugccagaugguccgccucguccccggcgccuaccucgaguacaaguccgcccuccucaacgagugcaacaagcagggcggccuccgccucgcccaggcccgcgcccucaucaagaucgacgucaacaagacccgcaagaucuacgacuuccucauccgcgagggcuacaucaccaagggcuga

SEQ ID NO: 50445 - RNA, 1299 nt, Artificial Sequence
  derived and/or modified sequence opt2 from TADA3__Homo_sapiens__NP_006345
auguccgagcucaaggacugcccccuccaguuccacgacuucaaguccgucgaccaccucaaggucugcccccgcuacaccgccguccucgcccgcuccgaggacgacggcaucggcaucgaggagcucgacacccuccagcucgagcucgagacccuccucuccuccgccucccgccgccuccgcguccucgaggccgagacccagauccucaccgacuggcaggacaagaagggcgaccgccgcuuccucaagcucggccgcgaccacgagcucggcgccccccccaagcacggcaagcccaagaagcagaagcucgagggcaaggccggccacggccccggccccggccccggccgccccaaguccaagaaccuccagcccaagauccaggaguacgaguucaccgacgaccccaucgacgucccccgcauccccaagaacgacgcccccaaccgcuucugggccuccgucgagcccuacugcgccgacaucaccuccgaggagguccgcacccucgaggagcuccucaagccccccgaggacgaggccgagcacuacaagauccccccccucggcaagcacuacucccagcgcugggcccaggaggaccuccucgaggagcagaaggacggcgcccgcgccgccgccgucgccgacaagaagaagggccucaugggcccccucaccgagcucgacaccaaggacgucgacgcccuccucaagaaguccgaggcccagcacgagcagcccgaggacggcugccccuucggcgcccucacccagcgccuccuccaggcccucgucgaggagaacaucaucucccccauggaggacucccccauccccgacauguccggcaaggaguccggcgccgacggcgccuccaccuccccccgcaaccagaacaagcccuucuccgucccccacaccaagucccucgagucccgcaucaaggaggagcucaucgcccagggccuccucgaguccgaggaccgccccgccgaggacuccgaggacgagguccucgccgagcuccgcaagcgccaggccgagcucaaggcccucuccgcccacaaccgcaccaagaagcacgaccuccuccgccucgccaaggaggaggucucccgccaggagcuccgccagcgcguccgcauggccgacaacgaggucauggacgccuuccgcaagaucauggccgcccgccagaagaagcgcacccccaccaagaaggagaaggaccaggccuggaagacccucaaggagcgcgaguccauccucaagcuccucgacggcuga

SEQ ID NO: 50446 - RNA, 1779 nt, Artificial Sequence
  derived and/or modified sequence opt2 from TAF15__Homo_sapiens__NP_631961
auguccgacuccggcuccuacggccaguccggcggcgagcagcaguccuacuccaccuacggcaaccccggcucccagggcuacggccaggccucccaguccuacuccggcuacggccagaccaccgacuccuccuacggccagaacuacuccggcuacuccuccuacggccagucccaguccggcuacucccaguccuacggcggcuacgagaaccagaagcaguccuccuacucccagcagcccuacaacaaccagggccagcagcagaacauggaguccuccggcucccagggcggccgcgcccccuccuacgaccagcccgacuacggccagcaggacuccuacgaccagcaguccggcuacgaccagcaccagggcuccuacgacgagcaguccaacuacgaccagcagcacgacuccuacucccagaaccagcaguccuaccacucccagcgcgagaacuacucccaccacacccaggacgaccgccgcgacgucucccgcuacggcgaggacaaccgcggcuacggcggcucccagggcggcggccgcggccgcggcggcuacgacaaggacggccgcggccccaugaccggcuccuccggcggcgaccgcggcggcuucaagaacuucggcggccaccgcgacuacggcccccgcaccgacgccgacuccgaguccgacaacuccgacaacaacaccaucuucguccagggccucggcgagggcgucuccaccgaccaggucggcgaguucuucaagcagaucggcaucaucaagaccaacaagaagaccggcaagcccaugaucaaccucuacaccgacaaggacaccggcaagcccaagggcgaggccaccgucuccuucgacgacccccccuccgccaaggccgccaucgacugguucgacggcaaggaguuccacggcaacaucaucaaggucuccuucgccacccgccgccccgaguucaugcgcggcggcggcuccggcggcggccgccgcggccgcggcggcuaccgcggccgcggcggcuuccagggccgcggcggcgaccccaaguccggcgacugggucugccccaaccccuccugcggcaacaugaacuucgcccgccgcaacuccugcaaccagugcaacgagccccgccccgaggacucccgccccuccggcggcgacuuccgcggccgcggcuacggcggcgagcgcggcuaccgcggccgcggcggccgcggcggcgaccgcggcggcuacggcggcgaccgcuccggcggcggcuacggcggcgaccgcuccuccggcggcggcuacuccggcgaccgcuccggcggcggcuacggcggcgaccgcuccggcggcggcuacggcggcgaccgcggcggcggcuacggcggcgaccgcggcggcggcuacggcggcgaccgcggcggcggcuacggcggcgaccgcggcggcuacggcggcgaccgcggcggcggcuacggcggcgaccgcggcggcuacggcggcgaccgcggcggcuacggcggcgaccgcggcggcuacggcggcgaccgcggcggcuacggcggcgaccgcucccgcggcggcuacggcggcgaccgcggcggcggcuccggcuacggcggcgaccgcuccggcggcuacggcggcgaccgcuccggcggcggcuacggcggcgaccgcggcggcggcuacggcggcgaccgcggcggcuacggcggcaagaugggcggccgcaacgacuaccgcaacgaccagcgcaaccgccccuacuga

SEQ ID NO: 50447 - RNA, 1767 nt, Artificial Sequence
  derived and/or modified sequence opt2 from TAF1B__Homo_sapiens__NP_005671
auggaccucgaggaggccgaggaguucaaggagcgcugcacccagugcgccgccgucuccuggggccucaccgacgagggcaaguacuacugcaccuccugccacaacgucaccgagcgcuaccaggaggucaccaacaccgaccucauccccaacacccagaucaaggcccucaaccgcggccucaagaagaagaacaacaccgagaagggcugggacugguacgucugcgagggcuuccaguacauccucuaccagcaggccgaggcccucaagaaccucggcgucggccccgagcucaagaacgacguccuccacaacuucuggaagcgcuaccuccagaaguccaagcaggccuacugcaagaaccccgucuacaccaccggccgcaagcccaccguccucgaggacaaccucucccacuccgacugggccuccgagcccgagcuccucuccgacgucuccugcccccccuuccucgaguccggcgccgagucccaguccgacauccacacccgcaagcccuuccccgucuccaaggccucccaguccgagaccuccgucugcuccggcucccucgacggcgucgaguacucccagcgcaaggagaagggcaucgucaagaugaccaugccccagacccucgccuucugcuaccucucccuccucuggcagcgcgaggccaucacccucuccgaccuccuccgcuucgucgaggaggaccacauccccuacaucaacgccuuccagcacuuccccgagcagaugaagcucuacggccgcgaccgcggcaucuucggcaucgaguccuggcccgacuacgaggacaucuacaagaagaccaucgaggucggcaccuuccucgaccucccccgcuuccccgacaucaccgaggacugcuaccuccaccccaacauccucugcaugaaguaccucauggaggucaaccuccccgacgagaugcacucccucaccugccacgucgucaagaugaccggcaugggcgaggucgacuuccucaccuucgaccccaucgccaagauggccaagaccgucaaguacgacguccaggccgucgccaucaucgucgucguccucaagcuccucuuccuccucgacgacuccuucgaguggucccucuccaaccucgccgagaagcacaacgagaagaacaagaaggacaagcccugguucgacuuccgcaagugguaccagaucaugaagaaggccuucgacgagaagaagcagaagugggaggaggcccgcgccaaguaccucuggaaguccgagaagccccucuacuacuccuucgucgacaagcccgucgccuacaagaagcgcgagauggucgucaaccuccagaagcaguucuccacccucgucgaguccaccgccaccgccggcaagaagucccccuccuccuuccaguucaacuggaccgaggaggacaccgaccgcaccugcuuccacggccacucccuccagggcguccucaaggagaagggccagucccuccucaccaagaacucccucuacuggcucuccacccagaaguucugccgcugcuacugcacccacgucaccaccuacgaggaguccaacuacucccucuccuaccaguucauccucaaccucuucuccuuccuccuccgcaucaagaccucccuccuccacgaggaggucucccucgucgagaagaagcucuucgagaagaaguacuccgucaagcgcaagaagucccgcuccaagaagguccgccgccacuga

SEQ ID NO: 50448 - RNA, 1179 nt, Artificial Sequence
  derived and/or modified sequence opt2 from TAF1C__Homo_sapiens__NP_001230089
augcucaaguggaaccacggccuccccuccccccuccuccucgcccgccuccucccccccccccgccccuccugcguccagccccuccuccucggcggccagggcggccagcuccagcuccuccaccucgccgagggcgccuccgucccccgccucgccggccccccccagucccuccccucccgcaucgacucccuccccgccuucccccuccucgagcccaagauccaguggcgccuccaggagcgccucaaggcccccaccaucggccucgccgccgucguccccccccuccccuccgcccccacccccggccucguccucuuccagcucuccgccgccggcgacgucuucuaccagcagcuccgcccccaggucgacuccucccuccgccgcgacgccggcccccccggcgacacccagcccgacugccacgcccccaccgccuccuggaccucccaggacaccgccggcugcucccaguggcucaaggcccuccucaaggucccccucgccccccccgucuggaccgcccccaccuucacccaccgccagaugcucggcuccaccgagcuccgccgcgaggaggaggagggccagcgccucggcguccuccgcaaggccauggcccgcggccagcuccuccuccagcgcgaccucggcucccuccccgccgccgagcccccccccgcccccgaguccggccucgaggacaagcucuccgagcgccucggcgaggccugggccggccgcggcgccgccuggugggagcgccagcagggccgcaccuccgagcccggccgccagacccgccgccccaagcgccgcacccagcucuccuccuccuucucccucuccggccacgucgaccccuccgaggacaccuccuccccccacucccccgaguggccccccgccgacgcccucccccucccccccaccaccccccccucccaggagcucacccccgacgccugcgcccagggcguccccuccgagcagcgccagaugcuccgcgacuacauggccaagcuccccccccagcgcgacacccccggcugcgccaccacccccccccacucccaggccuccuccguccgcgccacccgcucccagcagcacacccccguccucuccuccucccagccccuccgcaagaagccccgcaugggcuucuga

SEQ ID NO: 50449 - RNA, 837 nt, Artificial Sequence
  derived and/or modified sequence opt2 from TAF1D__Homo_sapiens__NP_077021
auggacaaguccggcaucgacucccucgaccacgucaccuccgacgccgucgagcucgccaaccgcuccgacaacuccuccgacuccucccucuucaagacccagugcauccccuacucccccaagggcgagaagcgcaaccccauccgcaaguucguccgcacccccgaguccguccacgccuccgacuccuccuccgacuccuccuucgagcccaucccccucaccaucaaggccaucuucgagcgcuucaagaaccgcaagaagcgcuacaagaagaagaagaagcgccgcuaccagcccaccggccgcccccgcggccgccccgagggccgccgcaaccccaucuacucccucaucgacaagaagaagcaguuccgcucccgcggcuccggcuuccccuuccucgaguccgagaacgagaagaacgcccccuggcgcaagauccucaccuucgagcaggccgucgcccgcggcuucuucaacuacaucgagaagcucaaguacgagcaccaccucaaggagucccucaagcagaugaacgucggcgaggaccucgagaacgaggacuucgacucccgccgcuacaaguuccucgacgacgacggcuccaucucccccaucgaggaguccaccgccgaggacgaggacgccacccaccucgaggacaacgagugcgacaucaagcucgccggcgacuccuucaucgucuccuccgaguuccccguccgccucuccgucuaccucgaggaggaggacaucaccgaggaggccgcccucuccaagaagcgcgccaccaaggccaagaacaccggccagcgcggccucaagauguga

SEQ ID NO: 50450 - RNA, 5688 nt, Artificial Sequence
  derived and/or modified sequence opt2 from TAF1__Homo_sapiens__NP_001273003
augggccccggcugcgaccuccuccuccgcaccgccgccaccaucaccgccgccgccaucauguccgacaccgacuccgacgaggacuccgccggcggcggccccuucucccucgccggcuuccucuucggcaacaucaacggcgccggccagcucgagggcgaguccguccucgacgacgagugcaagaagcaccucgccggccucggcgcccucggccucggcucccucaucaccgagcucaccgccaacgaggagcucaccggcaccgacggcgcccucgucaacgacgagggcuggguccgcuccaccgaggacgccgucgacuacuccgacaucaacgaggucgccgaggacgagucccgccgcuaccagcagaccaugggcucccuccagccccucugccacuccgacuacgacgaggacgacuacgacgccgacugcgaggacaucgacugcaagcucaugcccccccccccccccccccccggccccaugaagaaggacaaggaccaggacuccaucaccggcgucuccgagaacggcgagggcaucauccuccccuccaucaucgcccccuccucccucgccuccgagaaggucgacuucuccuccuccuccgacuccgaguccgagaugggcccccaggaggccacccaggccgaguccgaggacggcaagcucacccucccccucgccggcaucaugcagcacgacgccaccaagcuccuccccuccgucaccgagcucuuccccgaguuccgccccggcaagguccuccgcuuccuccgccucuucggccccggcaagaacguccccuccgucuggcgcuccgcccgccgcaagcgcaagaagaagcaccgcgagcucauccaggaggagcagauccaggaggucgagugcuccgucgaguccgaggucucccagaagucccucuggaacuacgacuacgcccccccccccccccccgagcagugccucuccgacgacgagaucaccaugauggcccccgucgaguccaaguucucccaguccaccggcgacaucgacaaggucaccgacaccaagccccgcgucgccgaguggcgcuacggccccgcccgccucugguacgacaugcucggcguccccgaggacggcuccggcuucgacuacggcuucaagcuccgcaagaccgagcacgagcccgucaucaagucccgcaugaucgaggaguuccgcaagcucgaggagaacaacggcaccgaccuccucgccgacgagaacuuccucauggucacccagcuccacugggaggacgacaucaucugggacggcgaggacgucaagcacaagggcaccaagccccagcgcgccucccucgccggcuggcuccccuccuccaugacccgcaacgccauggccuacaacguccagcagggcuucgccgccacccucgacgacgacaagcccugguacuccaucuuccccaucgacaacgaggaccucgucuacggccgcugggaggacaacaucaucugggacgcccaggccaugccccgccuccucgagccccccguccucacccucgaccccaacgacgagaaccucauccucgagauccccgacgagaaggaggaggccaccuccaacucccccuccaaggaguccaagaaggaguccucccucaagaagucccgcauccuccucggcaagaccggcgucaucaaggaggagccccagcagaacaugucccagcccgaggucaaggaccccuggaaccucuccaacgacgaguacuacuaccccaagcagcagggccuccgcggcaccuucggcggcaacaucauccagcacuccauccccgccgucgagcuccgccagcccuucuuccccacccacaugggccccaucaagcuccgccaguuccaccgccccccccucaagaaguacuccuucggcgcccucucccagcccggcccccacuccguccagccccuccucaagcacaucaagaagaaggccaagaugcgcgagcaggagcgccaggccuccggcggcggcgagauguucuucaugcgcaccccccaggaccucaccggcaaggacggcgaccucauccucgccgaguacuccgaggagaacggcccccucaugaugcaggucggcauggccaccaagaucaagaacuacuacaagcgcaagcccggcaaggaccccggcgcccccgacugcaaguacggcgagaccgucuacugccacaccucccccuuccucggcucccuccaccccggccagcuccuccaggccuucgagaacaaccucuuccgcgcccccaucuaccuccacaagaugcccgagaccgacuuccucaucauccgcacccgccagggcuacuacauccgcgagcucgucgacaucuucgucgucggccagcagugcccccucuucgagguccccggccccaacuccaagcgcgccaacacccacauccgcgacuuccuccaggucuucaucuaccgccucuucuggaaguccaaggaccgcccccgccgcauccgcauggaggacaucaagaaggccuuccccucccacuccgaguccuccauccgcaagcgccucaagcucugcgccgacuucaagcgcaccggcauggacuccaacugguggguccucaaguccgacuuccgccuccccaccgaggaggagauccgcgccauggucucccccgagcagugcugcgccuacuacuccaugaucgccgccgagcagcgccucaaggacgccggcuacggcgagaaguccuucuucgcccccgaggaggagaacgaggaggacuuccagaugaagaucgacgacgagguccgcaccgcccccuggaacaccacccgcgccuucaucgccgccaugaagggcaagugccuccucgaggucaccggcgucgccgaccccaccggcugcggcgagggcuucuccuacgucaagauccccaacaagcccacccagcagaaggacgacaaggagccccagcccgucaagaagaccgucaccggcaccgacgccgaccuccgccgccucucccucaagaacgccaagcagcuccuccgcaaguucggcguccccgaggaggagaucaagaagcucucccgcugggaggucaucgacgucguccgcaccauguccaccgagcaggcccgcuccggcgagggccccauguccaaguucgcccgcggcucccgcuucuccgucgccgagcaccaggagcgcuacaaggaggagugccagcgcaucuucgaccuccagaacaagguccucuccuccaccgagguccucuccaccgacaccgacuccuccuccgccgaggacuccgacuucgaggagaugggcaagaacaucgagaacaugcuccagaacaagaagaccuccucccagcucucccgcgagcgcgaggagcaggagcgcaaggagcuccagcgcaugcuccucgccgccggcuccgccgccuccggcaacaaccaccgcgacgacgacaccgccuccgucaccucccucaacuccuccgccaccggccgcugccucaagaucuaccgcaccuuccgcgacgaggagggcaaggaguacguccgcugcgagaccguccgcaagcccgccgucaucgacgccuacguccgcauccgcaccaccaaggacgaggaguucauccgcaaguucgcccucuucgacgagcagcaccgcgaggagaugcgcaaggagcgccgccgcauccaggagcagcuccgccgccucaagcgcaaccaggagaaggagaagcucaagggcccccccgagaagaagcccaagaagaugaaggagcgccccgaccucaagcucaagugcggcgccugcggcgccaucggccacaugcgcaccaacaaguucugcccccucuacuaccagaccaacgccccccccuccaaccccgucgccaugaccgaggagcaggaggaggagcucgagaagaccgucauccacaacgacaacgaggagcucaucaaggucgagggcaccaagaucguccucggcaagcagcucaucgaguccgccgacgagguccgccgcaagucccucguccucaaguuccccaagcagcagcucccccccaagaagaagcgccgcgucggcaccaccguccacugcgacuaccucaaccgcccccacaaguccauccaccgccgccgcaccgaccccauggucacccucuccuccauccucgaguccaucaucaacgacaugcgcgaccuccccaacaccuaccccuuccacacccccgucaacgccaaggucgucaaggacuacuacaagaucaucacccgccccauggaccuccagacccuccgcgagaacguccgcaagcgccucuaccccucccgcgaggaguuccgcgagcaccucgagcucaucgucaagaacuccgccaccuacaacggccccaagcacucccucacccagaucucccaguccaugcucgaccucugcgacgagaagcucaaggagaaggaggacaagcucgcccgccucgagaaggccaucaacccccuccucgacgacgacgaccaggucgccuucuccuucauccucgacaacaucgucacccagaagaugauggccguccccgacuccuggcccuuccaccaccccgucaacaagaaguucguccccgacuacuacaaggucaucgucaaccccauggaccucgagaccauccgcaagaacaucuccaagcacaaguaccagucccgcgaguccuuccucgacgacgucaaccucauccucgccaacuccgucaaguacaacggccccgagucccaguacaccaagaccgcccaggagaucgucaacgucugcuaccagacccucaccgaguacgacgagcaccucacccagcucgagaaggacaucugcaccgccaaggaggccgcccucgaggaggccgagcucgagucccucgaccccaugacccccggccccuacaccccccaggccaagccccccgaccucuacgacaccaacaccucccucuccaugucccgcgacgccuccgucuuccaggacgaguccaacauguccguccucgacauccccuccgccacccccgagaagcaggucacccaggagggcgaggacggcgacggcgaccucgccgacgaggaggagggcaccguccagcagccccaggccuccguccucuacgaggaccuccucauguccgagggcgaggacgacgaggaggacgccggcuccgacgaggagggcgacaaccccuucuccgccauccagcucuccgaguccggcuccgacuccgacgucggcuccggcggcauccgccccaagcagccccgcaugcuccaggagaacacccgcauggacauggagaacgaggaguccaugauguccuacgagggcgacggcggcgaggccucccacggccucgaggacuccaacaucuccuacggcuccuacgaggagcccgaccccaaguccaacacccaggacaccuccuucuccuccaucggcggcuacgaggucuccgaggaggaggaggacgaggaggaggaggagcagcgcuccggccccuccguccucucccagguccaccucuccgaggacgaggaggacuccgaggacuuccacuccaucgccggcgacuccgaccucgacuccgacgaguga

SEQ ID NO: 50451 - RNA, 3600 nt, Artificial Sequence
  derived and/or modified sequence opt2 from TAF2__Homo_sapiens__NP_003175
augccccucaccggcgucgagcccgcccgcaugaaccgcaagaagggcgacaagggcuucgaguccccccgccccuacaagcucacccaccaggucgucugcaucaacaacaucaacuuccagcgcaaguccgucgucggcuucgucgagcucaccaucuuccccaccgucgccaaccucaaccgcaucaagcucaacuccaagcagugccgcaucuaccgcguccgcaucaacgaccucgaggccgccuucaucuacaacgaccccacccucgaggucugccacuccgaguccaagcagcgcaaccucaacuacuucuccaacgccuacgccgccgccgucuccgccgucgaccccgacgccggcaacggcgagcucugcaucaagguccccuccgagcucuggaagcacgucgacgagcucaagguccucaagauccacaucaacuucucccucgaccagcccaagggcggccuccacuucgucguccccuccgucgagggcuccauggccgagcgcggcgcccacgucuucuccugcggcuaccagaacuccacccgcuucugguuccccugcgucgacuccuacuccgagcucugcaccuggaagcucgaguucaccgucgacgccgccauggucgccgucuccaacggcgaccucgucgagaccgucuacacccacgacaugcgcaagaagaccuuccacuacaugcucaccauccccaccgccgccuccaacaucucccucgccaucggccccuucgagauccucgucgaccccuacaugcacgaggucacccacuucugccucccccagcuccucccccuccucaagcacaccaccuccuaccuccacgaggucuucgaguucuacgaggagauccucaccugccgcuaccccuacuccugcuucaagaccgucuucaucgacgaggccuacgucgaggucgccgccuacgccuccauguccaucuucuccaccaaccuccuccacuccgccaugaucaucgacgagaccccccucacccgccgcugccucgcccagucccucgcccagcaguucuucggcugcuucaucucccgcauguccugguccgacgaguggguccucaagggcaucuccggcuacaucuacggccucuggaugaagaagaccuucggcgucaacgaguaccgccacuggaucaaggaggagcucgacaagaucgucgccuacgagcucaagaccggcggcguccuccuccaccccaucuucggcggcggcaaggagaaggacaaccccgccucccaccuccacuucuccaucaagcacccccacacccucuccugggaguacuacaccauguuccagugcaaggcccaccucgucaugcgccucaucgagaaccgcaucuccauggaguucaugcuccaggucuucaacaagcuccucucccucgccuccaccgccuccucccagaaguuccagucccacauguggucccagaugcucgucuccaccuccggcuuccucaaguccaucuccaacgucuccggcaaggacauccagccccucaucaagcagugggucgaccaguccggcgucgucaaguucuacggcuccuucgccuucaaccgcaagcgcaacguccucgagcucgagaucaagcaggacuacaccucccccggcacccagaaguacgucggcccccucaaggucaccguccaggagcucgacggcuccuucaaccacacccuccagaucgaggagaacucccucaagcacgacauccccugccacuccaagucccgccgcaacaagaagaagaagaucccccucaugaacggcgaggaggucgacauggaccucuccgccauggacgccgacuccccccuccucuggauccgcaucgaccccgacauguccguccuccgcaaggucgaguucgagcaggccgacuucauguggcaguaccagcuccgcuacgagcgcgacgucgucgcccagcaggaguccauccucgcccucgagaaguuccccacccccgccucccgccucgcccucaccgacauccucgagcaggagcagugcuucuaccgcguccgcauguccgccugcuucugccucgccaagaucgccaacuccauggucuccaccuggaccggcccccccgccaugaagucccucuucacccgcauguucugcugcaaguccugccccaacaucgucaagaccaacaacuucauguccuuccaguccuacuuccuccagaagaccaugcccgucgccauggcccuccuccgcgacguccacaaccucugccccaaggagguccucaccuucauccucgaccucaucaaguacaacgacaaccgcaagaacaaguucuccgacaacuacuaccgcgccgagaugaucgacgcccucgccaacuccgucacccccgccgucuccgucaacaacgagguccgcacccucgacaaccucaaccccgacguccgccucauccucgaggagaucacccgcuuccucaacauggagaagcuccuccccuccuaccgccacaccaucaccgucuccugccuccgcgccauccgcguccuccagaagaacggccacguccccuccgaccccgcccucuucaaguccuacgccgaguacggccacuucgucgacauccgcaucgccgcccucgaggccgucgucgacuacaccaaggucgaccgcuccuacgaggagcuccaguggcuccucaacaugauccagaacgaccccguccccuacguccgccacaagauccucaacaugcucaccaagaacccccccuucaccaagaacauggaguccccccucugcaacgaggcccucgucgaccagcucuggaagcucaugaacuccggcaccucccacgacuggcgccuccgcugcggcgccgucgaccucuacuucacccucuucggccucucccgccccuccugccucccccuccccgagcucggccucguccucaaccucaaggagaagaaggccguccucaaccccaccaucauccccgaguccgucgccggcaaccaggaggccgccaacaaccccuccucccacccccagcucgucggcuuccagaaccccuucuccuccucccaggacgaggaggagaucgacauggacaccguccacgacucccaggccuucaucucccaccaccucaacaugcucgagcgccccuccacccccggccucuccaaguaccgccccgccuccucccgcuccgcccucaucccccagcacuccgccggcugcgacuccacccccaccaccaagccccaguggucccucgagcucgcccgcaagggcaccggcaaggagcaggccccccucgagauguccaugcaccccgccgccuccgccccccucuccgucuucaccaaggaguccaccgccuccaagcacuccgaccaccaccaccaccaccaccacgagcacaagaagaagaagaagaagcacaagcacaagcacaagcacaagcacaagcacgacuccaaggagaaggacaaggagcccuucaccuucuccucccccgccuccggccgcuccauccgcucccccucccucuccgacuga

SEQ ID NO: 50452 - RNA, 2790 nt, Artificial Sequence
  derived and/or modified sequence opt2 from TAF3__Homo_sapiens__NP_114129
augugcgaguccuacucccgcucccuccuccgcgucuccgucgcccagaucugccaggcccucggcugggacuccguccagcucuccgccugccaccuccucaccgacguccuccagcgcuaccuccagcagcucggccgcggcugccaccgcuacuccgagcucuacggccgcaccgaccccauccucgacgacgucggcgaggccuuccagcucaugggcgucucccuccacgagcucgaggacuacauccacaacaucgagcccgucaccuucccccaccagauccccuccuuccccgucuccaagaacaacguccuccaguucccccagcccggcuccaaggacgccgaggagcgcaaggaguacauccccgacuaccucccccccaucgucuccucccaggaggaggaggaggaggagcagguccccaccgacggcggcaccuccgccgaggccaugcaggucccccucgaggaggacgacgagcucgaggaggaggagaucaucaacgacgagaacuuccucggcaagcgcccccucgacucccccgaggccgaggagcuccccgccaugaagcgcccccgccuccucuccaccaagggcgacacccucgacgucguccuccucgaggcccgcgagccccucuccuccaucaacacccagaagaucccccccaugcucucccccguccacguccaggacuccaccgaccucgccccccccucccccgagccccccaugcucgcccccgucgccaagucccagaugcccaccgccaagccccucgagaccaaguccuucacccccaagaccaagaccaagaccuccucccccggccagaagaccaagucccccaagaccgcccagucccccgccauggucggcucccccauccgcucccccaagaccgucuccaaggagaagaagucccccggccgcuccaagucccccaagucccccaagucccccaaggucaccacccacaucccccagacccccguccgccccgagacccccaaccgcacccccuccgccacccucuccgagaagaucuccaaggagaccauccaggucaagcagauccagaccccccccgacgccggcaagcucaacuccgagaaccagcccaagaaggccgucgucgccgacaagaccaucgaggccuccaucgacgccgucaucgcccgcgccugcgccgagcgcgagcccgaccccuucgaguucuccuccggcuccgaguccgagggcgacaucuucaccucccccaagcgcaucuccggccccgagugcaccacccccaaggccuccaccuccgccaacaacuucaccaaguccggcuccaccccccucccccucuccggcggcaccuccuccuccgacaacuccuggaccauggacgccuccaucgacgaggucguccgcaaggccaagcucggcacccccuccaacaugccccccaacuuccccuacaucuccucccccuccgucuccccccccacccccgagccccuccacaaggucuacgaggagaagaccaagcuccccuccuccgucgaggucaagaagaagcucaagaaggagcucaagaccaagaugaagaagaaggagaagcagcgcgaccgcgagcgcgagaaggacaagaacaaggacaaguccaaggagaaggacaaggucaaggagaaggagaaggacaaggagaccggccgcgagaccaaguaccccuggaaggaguuccucaaggaggaggaggccgaccccuacaaguucaagaucaaggaguucgaggacgucgaccccaaggucaagcucaaggacggccucguccgcaaggagaaggagaagcacaaggacaagaagaaggaccgcgagaagggcaagaaggacaaggacaagcgcgagaaggagaaggucaaggacaagggccgcgaggacaagaugaaggcccccgcccccccccucguccucccccccaaggagcucgcccucccccucuucucccccgccaccgccucccgcguccccgccaugcuccccucccuccuccccguccuccccgagaagcucuucgaggagaaggagaaggucaaggagaaggagaagaagaaggacaagaaggagaagaagaagaagaaggagaaggagaaggagaagaaggagaaggagcgcgagaaggagaagcgcgagcgcgagaagcgcgagaaggagaaggagaagcacaagcacgagaagaucaaggucgagcccgucgcccucgcccccucccccgucaucccccgccucacccuccgcgucggcgccggccaggacaagaucgucaucuccaaggucguccccgcccccgaggccaagcccgcccccucccagaaccgccccaagacccccccccccgcccccgcccccgcccccggccccaugcucgucucccccgcccccgucccccucccccuccucgcccaggccgccgccggccccgcccuccuccccucccccggccccgccgccuccggcgccuccgccaaggcccccguccgcuccgucgucaccgagaccgucuccaccuacgucauccgcgacgaguggggcaaccagaucuggaucugccccggcugcaacaagcccgacgacggcucccccaugaucggcugcgacgacugcgacgacugguaccacuggcccugcgucggcaucaugaccgccccccccgaggagaugcagugguucugccccaagugcgccaacaagaagaaggacaagaagcacaagaagcgcaagcaccgcgcccacuga

SEQ ID NO: 50453 - RNA, 2604 nt, Artificial Sequence
  derived and/or modified sequence opt2 from TAF4B__Homo_sapiens__NP_001280654
augcccgccggccucaccgagcccgccggcgccgccccccccgccgccgucuccgccuccggcaccgucaccauggcccccgccggcgcccuccccguccgcgucgaguccacccccgucgcccucggcgccgucaccaaggcccccgucuccgucugcgucgagcccaccgccucccagccccuccgcucccccgucggcacccucgucaccaaggucgcccccgucuccgccccccccaaggucuccuccggcccccgccuccccgccccccagaucgucgccgucaaggcccccaacaccaccaccauccaguuccccgccaaccuccagcucccccccggcaccguccucaucaaguccaacuccggcccccucaugcucgucuccccccagcagaccgucacccgcgccgagaccaccuccaacaucaccucccgccccgccguccccgccaacccccagaccgucaagaucugcaccguccccaacuccuccucccagcucaucaagaaggucgccgucacccccgucaagaagcucgcccagaucggcaccaccgucgucaccaccguccccaagcccuccuccguccaguccgucgccguccccaccuccgucgucaccgucacccccggcaagccccucaacaccgucaccacccucaagcccuccucccucggcgccuccuccacccccuccaacgagcccaaccucaaggccgagaacuccgccgccguccagaucaaccucucccccaccaugcucgagaacgucaagaagugcaagaacuuccucgccaugcucaucaagcucgccugcuccggcucccagucccccgagaugggccagaacgucaagaagcucgucgagcagcuccucgacgccaagaucgaggccgaggaguucacccgcaagcucuacgucgagcucaaguccuccccccagccccaccucguccccuuccucaagaaguccgucgucgcccuccgccagcuccuccccaacucccaguccuucauccagcagugcguccagcagaccuccuccgacauggucaucgccaccugcaccaccaccgucaccaccucccccgucgucaccaccaccgucuccuccucccaguccgagaaguccaucaucgucuccggcgccaccgccccccgcaccgucuccguccagacccucaacccccucgccggccccgucggcgccaaggccggcgucgucacccuccacuccgucggccccaccgccgccaccggcggcaccaccgccggcaccggccuccuccagaccuccaagccccucgucaccuccgucgccaacaccgucaccaccgucucccuccagcccgagaagcccgucgucuccggcaccgccgucacccucucccuccccgccgucaccuucggcgagaccuccggcgccgccaucugccuccccuccgucaagcccgucgucuccuccgccggcaccaccuccgacaagcccgucaucggcacccccguccagaucaagcucgcccagcccggccccguccucucccagcccgccggcaucccccaggccguccaggucaagcagcucuucucccucuuccaggucguccagcagcccuccggcggcaacgagaagcaggucaccaccaucucccacuccuccacccucaccauccagaagugcggccagaagaccaugcccgucaacaccaucauccccaccucccaguucccccccgccuccauccucaagcagaucacccuccccggcaacaagauccucucccuccaggccucccccacccagaagaaccgcaucaaggagaacgucaccuccugcuuccgcgacgaggacgacaucaacgacgucaccuccauggccggcgucaaccucaacgaggagaacgccugcauccucgccaccaacuccgagcucgucggcacccucauccaguccugcaaggacgagcccuuccucuucaucggcgcccuccagaagcgcauccucgacaucggcaagaagcacgacaucaccgagcucaacuccgacgccgucaaccucaucucccaggccacccaggagcgccuccgcggccuccucgagaagcucaccgccaucgcccagcaccgcaugaccaccuacaaggccuccgagaacuacauccucugcuccgacacccgcucccagcucaaguuccucgagaagcucgaccagcucgagaagcagcgcaaggaccucgaggagcgcgagaugcuccucaaggccgccaagucccgcuccaacaaggaggaccccgagcagcuccgccucaagcagaaggccaaggagcuccagcagcucgagcucgcccagauccagcaccgcgacgccaaccucaccgcccucgccgccaucggcccccgcaagaagcgcccccucgaguccggcaucgagggccucaaggacaaccuccucgccuccggcaccuccucccucaccgccaccaagcagcuccaccgcccccgcaucacccgcaucugccuccgcgaccucaucuucugcauggagcaggagcgcgagaugaaguacucccgcgcccucuaccucgcccuccucaaguga

SEQ ID NO: 50454 - RNA, 3258 nt, Artificial Sequence
  derived and/or modified sequence opt2 from TAF4__Homo_sapiens__NP_003176
auggccgccggcuccgaccuccucgacgaggucuucuucaacuccgaggucgacgagaaggucgucuccgaccucgucggcucccucgagucccagcucgccgccuccgccgcccaccaccaccaccucgccccccgcacccccgagguccgcgccgccgccgccggcgcccucggcaaccacgucgucuccggcucccccgccggcgccgccggcgccggccccgccgcccccgccgagggcgcccccggcgccgcccccgagcccccccccgccggccgcgcccgccccggcggcggcggcccccagcgccccggcccccccuccccccgccgcccccucguccccgccggccccgccccccccgccgccaagcuccgccccccccccgagggcuccgccggcuccugcgcccccguccccgccgccgccgccgucgccgccggccccgagcccgcccccgccggccccgccaagcccgccggccccgccgcccucgccgcccgcgccggccccggccccggccccggccccggccccggccccggccccggccccggcaagcccgccggccccggcgccgcccagacccucaacggcuccgccgcccuccucaacucccaccacgccgccgcccccgccgucucccucgucaacaacggccccgccgcccuccucccccuccccaagcccgccgcccccggcaccgucauccagaccccccccuucgucggcgccgccgccccccccgcccccgccgcccccuccccccccgccgcccccgcccccgccgcccccgccgccgccccccccccccccccccccgcccccgccacccucgcccgcccccccggccaccccgccggcccccccaccgccgcccccgccguccccccccccgccgccgcccagaacggcggcuccgccggcgccgcccccgcccccgcccccgccgccggcggccccgccggcgucuccggccagcccggccccggcgccgccgccgccgcccccgcccccggcgucaaggccgagucccccaagcgcgucguccaggccgccccccccgccgcccagacccucgccgccuccggccccgccuccaccgccgccuccauggucaucggccccaccaugcagggcgcccuccccucccccgccgccguccccccccccgcccccggcacccccaccggccuccccaagggcgccgccggcgccgucacccagucccucucccgcacccccaccgccaccaccuccggcauccgcgccacccucacccccaccguccucgccccccgccucccccagcccccccagaaccccaccaacauccagaacuuccagcucccccccggcaugguccucguccgcuccgagaacggccagcuccucaugaucccccagcaggcccucgcccagaugcaggcccaggcccacgcccagccccagaccaccauggccccccgccccgccacccccaccuccgccccccccguccagaucuccaccguccaggcccccggcacccccaucaucgcccgccaggucacccccaccaccaucaucaagcaggucucccaggcccagaccaccguccagcccuccgccacccuccagcgcucccccggcguccagccccagcucguccucggcggcgccgcccagaccgccucccucggcaccgccaccgccguccagaccggcaccccccagcgcaccguccccggcgccaccaccaccuccuccgccgccaccgagaccauggagaacgucaagaagugcaagaacuuccucuccacccucaucaagcucgccuccuccggcaagcaguccaccgagaccgccgccaacgucaaggagcucguccagaaccuccucgacggcaagaucgaggccgaggacuucaccucccgccucuaccgcgagcucaacuccuccccccagcccuaccucguccccuuccucaagcgcucccuccccgcccuccgccagcucacccccgacuccgccgccuucauccagcagucccagcagcagccccccccccccaccucccaggccaccaccgcccucaccgccgucguccucuccuccuccguccagcgcaccgccggcaagaccgccgccaccgucaccuccgcccuccagccccccguccucucccucacccagcccacccaggucggcgucggcaagcagggccagcccaccccccucgucauccagcagccccccaagcccggcgcccucauccgccccccccaggucacccucacccagacccccauggucgcccuccgccagccccacaaccgcaucaugcucaccaccccccagcagauccagcucaacccccuccagcccguccccgucgucaagcccgccguccuccccggcaccaaggcccucuccgccgucuccgcccaggccgccgccgcccagaagaacaagcucaaggagcccggcggcggcuccuuccgcgacgacgacgacaucaacgacgucgccuccauggccggcgucaaccucuccgaggaguccgcccgcauccucgccaccaacuccgagcucgucggcacccucacccgcuccugcaaggacgagaccuuccuccuccaggccccccuccagcgccgcauccucgagaucggcaagaagcacggcaucaccgagcuccaccccgacgucgucuccuacgucucccacgccacccagcagcgccuccagaaccucgucgagaagaucuccgagaccgcccagcagaagaacuucuccuacaaggacgacgaccgcuacgagcaggccuccgacguccgcgcccagcucaaguucuucgagcagcucgaccagaucgagaagcagcgcaaggacgagcaggagcgcgagauccucaugcgcgccgccaagucccgcucccgccaggaggaccccgagcagcuccgccucaagcagaaggccaaggagaugcagcagcaggagcucgcccagaugcgccagcgcgacgccaaccucaccgcccucgccgccaucggcccccgcaagaagcgcaaggucgacugccccggccccggcuccggcgccgagggcuccggccccggcuccgucguccccggcuccuccggcgucggcaccccccgccaguucacccgccagcgcaucacccgcgucaaccuccgcgaccucaucuucugccucgagaacgagcgcgagaccucccacucccuccuccucuacaaggccuuccucaaguga

SEQ ID NO: 50455 - RNA, 978 nt, Artificial Sequence
  derived and/or modified sequence opt2 from TAF5L__Homo_sapiens__NP_001020418
augaagcgcguccgcaccgagcagauccagauggccgucuccugcuaccucaagcgccgccaguacgucgacuccgacggcccccucaagcagggccuccgccucucccagaccgccgaggagauggccgccaaccucaccguccaguccgaguccggcugcgccaacaucgucuccgccgcccccugccaggccgagccccagcaguacgagguccaguucggccgccuccgcaacuuccucaccgacuccgacucccagcacucccacgaggucaugccccuccucuacccccucuucgucuaccuccaccucaaccucguccagaacucccccaaguccaccgucgaguccuucuacucccgcuuccacggcauguuccuccagaacgccucccagaaggacgucaucgagcagcuccagaccacccagaccauccaggacauccucuccaacuucaagcuccgcgccuuccucgacaacaaguacgucguccgccuccaggaggacuccuacaacuaccucauccgcuaccuccaguccgacaacaacaccgcccucugcaagguccucacccuccacauccaccucgacguccagcccgccaagcgcaccgacuaccagcucuacgccuccggcuccuccucccgcuccgagaacaacggccucgagccccccgacaugcccucccccauccuccagaacgaggccgcccucgagguccuccaggaguccaucaagcgcgucaaggacggcccccccucccucaccaccaucugcuucuacgccuucuacaacaccgagcagcuccucaacaccgccgagaucucccccgacuccaagcuccucgccgccggcuucgacaacuccugcaucaagcucuggucccuccgcuccaagaagcucaaguccgagccccaccaggucgacgucucccgcauccaccucgccugcgacauccucgaggaggaggucuga

SEQ ID NO: 50456 - RNA, 2145 nt, Artificial Sequence
  derived and/or modified sequence opt2 from TAF6__Homo_sapiens__NP_001177344
augaccaagcgccgccuccagaccaucaccgccugccuccagcuccgcgagggcucccccucccuccaccgcggccuccaccccucccgcgaggagaagcgcgacucccgcauggccgaggagaagaagcucaagcucuccaacaccguccuccccuccgaguccaugaaggucgucgccgaguccaugggcaucgcccagauccaggaggagaccugccagcuccucaccgacgaggucuccuaccgcaucaaggagaucgcccaggacgcccucaaguucaugcacaugggcaagcgccagaagcucaccaccuccgacaucgacuacgcccucaagcucaagaacgucgagccccucuacggcuuccacgcccaggaguucauccccuuccgcuucgccuccggcggcggccgcgagcucuacuucuacgaggagaaggaggucgaccucuccgacaucaucaacaccccccucccccgcgucccccucgacgucugccucaaggcccacuggcucuccaucgagggcugccagcccgccauccccgagaaccccccccccgcccccaaggagcagcagaaggccgaggccaccgagccccucaaguccgccaagcccggccaggaggaggacggcccccucaagggcaagggccagggcgccaccaccgccgacggcaagggcaaggagaagaaggcccccccccuccucgagggcgccccccuccgccucaagccccgcuccauccacgagcucuccgucgagcagcagcucuacuacaaggagaucaccgaggccugcgucggcuccugcgaggccaagcgcgccgaggcccuccaguccaucgccaccgaccccggccucuaccagaugcucccccgcuucuccaccuucaucuccgagggcguccgcgucaacgucguccagaacaaccucgcccuccucaucuaccucaugcgcauggucaaggcccucauggacaaccccacccucuaccucgagaaguacguccacgagcucauccccgccgucaugaccugcaucgucucccgccagcucugccuccgccccgacgucgacaaccacugggcccuccgcgacuucgccgcccgccucgucgcccagaucugcaagcacuucuccaccaccaccaacaacauccagucccgcaucaccaagaccuucaccaaguccugggucgacgagaagacccccuggaccacccgcuacggcuccaucgccggccucgccgagcucggccacgacgucaucaagacccucauccucccccgccuccagcaggagggcgagcgcauccgcuccguccucgacggccccguccucuccaacaucgaccgcaucggcgccgaccacguccagucccuccuccucaagcacugcgcccccguccucgccaagcuccgccccccccccgacaaccaggacgccuaccgcgccgaguucggcucccucggcccccuccucugcucccaggucgucaaggcccgcgcccaggccgcccuccaggcccagcaggucaaccgcaccacccucaccaucacccagccccgccccacccucacccucucccaggccccccagcccggcccccgcacccccggccuccucaagguccccggcuccaucgcccuccccguccagacccucgucuccgcccgcgccgccgcccccccccagcccucccccccccccaccaaguucaucgucauguccuccuccuccuccgcccccuccacccagcagguccucucccucuccaccuccgcccccggcuccggcuccaccaccaccucccccgucaccaccaccguccccuccguccagcccaucgucaagcucgucuccaccgccaccaccgccccccccuccaccgcccccuccggccccggcuccguccagaaguacaucgucgucucccucccccccaccggcgagggcaagggcggccccaccucccaccccucccccguccccccccccgccuccucccccuccccccucuccggcuccgcccucugcggcggcaagcaggaggccggcgacucccccccccccgcccccggcacccccaaggccaacggcucccagcccaacuccggcuccccccagcccgcccccuga

SEQ ID NO: 50457 - RNA, 1050 nt, Artificial Sequence
  derived and/or modified sequence opt2 from TAF7__Homo_sapiens__NP_005633
auguccaaguccaaggacgacgccccccacgagcucgagucccaguucauccuccgccucccccccgaguacgccuccaccguccgccgcgccguccaguccggccacgucaaccucaaggaccgccucaccaucgagcuccaccccgacggccgccacggcaucguccgcgucgaccgcgucccccucgccuccaagcucgucgaccuccccugcgucauggagucccucaagaccaucgacaagaagaccuucuacaagaccgccgacaucugccagaugcucgucuccaccgucgacggcgaccucuacccccccgucgaggagcccgucgccuccaccgaccccaaggccuccaagaagaaggacaaggacaaggagaagaaguucaucuggaaccacggcaucacccucccccucaagaacguccgcaagcgccgcuuccgcaagaccgccaagaagaaguacaucgagucccccgacgucgagaaggaggucaagcgccuccucuccaccgacgccgaggccgucuccacccgcugggagaucaucgccgaggacgagaccaaggaggccgagaaccagggccucgacaucuccucccccggcauguccggccaccgccagggccacgacucccucgagcacgacgagcuccgcgagaucuucaacgaccucuccuccuccuccgaggacgaggacgagacccagcaccaggacgaggaggacaucaacaucaucgacaccgaggaggaccucgagcgccagcuccaggacaagcucaacgaguccgacgagcagcaccaggagaacgagggcaccaaccagcucgucaugggcauccagaagcagaucgacaacaugaagggcaagcuccaggagacccaggaccgcgccaagcgccaggaggaccucaucaugaaggucgagaaccucgcccucaagaaccgcuuccaggccguccucgacgagcucaagcagaaggaggaccgcgagaaggagcagcucuccucccuccaggaggagcucgagucccuccucgagaaguga

SEQ ID NO: 50458 - RNA, 1131 nt, Artificial Sequence
  derived and/or modified sequence opt2 from TAF7L__Homo_sapiens__NP_001161946
auguccgagucccaggacgagguccccgacgaggucgagaaccaguucauccuccgccucccccucgagcacgccugcaccguccgcaaccucgcccgcucccaguccgucaagaugaaggacaagcucaagaucgaccuccuccccgacggccgccacgccgucgucgaggucgaggacgucccccucgccgccaagcucgucgaccuccccugcgucaucgagucccuccgcacccucgacaagaagaccuucuacaagaccgccgacaucucccagaugcucgucugcaccgccgacggcgacauccaccucucccccgaggagcccgccgccuccaccgaccccaacaucguccgcaagaaggagcgcggccgcgaggagaagugcgucuggaagcacggcaucacccccccccucaagaacguccgcaagaagcgcuuccgcaagacccagaagaagguccccgacgucaaggagauggagaaguccuccuucaccgaguacaucgagucccccgacgucgagaacgaggucaagcgccuccuccgcuccgacgccgaggccgucuccacccgcugggaggucaucgccgaggacggcaccaaggagaucgagucccagggcuccauccccggcuuccucaucuccuccggcauguccucccacaagcagggccacaccuccuccgaguacgacaugcuccgcgagauguucuccgacucccgcuccaacaacgacgacgacgaggacgaggacgacgaggacgaggacgaggacgaggacgaggacgaggacgaggacaaggaggaggaggaggaggacugcuccgaggaguaccucgagcgccagcuccaggccgaguucaucgaguccggccaguaccgcgccaacgagggcaccuccuccaucgucauggagauccagaagcagaucgagaagaaggagaagaagcuccacaagauccagaacaaggcccagcgccagaaggaccucaucaugaaggucgagaaccucacccucaagaaccacuuccaguccguccucgagcagcucgagcuccaggagaagcagaagaacgagaagcucaucucccuccaggagcagcuccagcgcuuccucaagaaguga

SEQ ID NO: 50459 - RNA, 933 nt, Artificial Sequence
  derived and/or modified sequence opt2 from TAF8__Homo_sapiens__NP_612639
auggccgacgccgccgccaccgccggcgccggcggcuccggcacccgcuccggcuccaagcaguccaccaaccccgccgacaacuaccaccucgcccgccgccgcacccuccaggucgucgucuccucccuccucaccgaggccggcuucgaguccgccgagaaggccuccgucgagacccucaccgagaugcuccaguccuacaucuccgagaucggccgcuccgccaaguccuacugcgagcacaccgcccgcacccagcccacccucuccgacaucgucgucacccucgucgagaugggcuucaacgucgacacccuccccgccuacgccaagcgcucccagcgcauggucaucaccgccccccccgucaccaaccagcccgucacccccaaggcccucaccgccggccagaaccgcccccaccccccccacauccccucccacuuccccgaguuccccgacccccacaccuacaucaagacccccaccuaccgcgagcccgucuccgacuaccagguccuccgcgagaaggccgccucccagcgccgcgacgucgagcgcgcccucacccgcuucauggccaagaccggcgagacccagucccucuucaaggacgacgucuccaccuucccccucaucgccgcccgccccuucaccauccccuaccucaccgcccuccuccccuccgagcucgagaugcagcagauggaggagaccgacuccuccgagcaggacgagcagaccgacaccgagaaccucgcccuccacaucuccauggaggacuccggcgccgagaaggagaacaccuccguccuccagcagaaccccucccucuccggcucccgcaacggcgaggagaacaucaucgacaaccccuaccuccgccccgucaagaagcccaagauccgccgcaagaagucccucuccuga

SEQ ID NO: 50460 - RNA, 795 nt, Artificial Sequence
  derived and/or modified sequence opt2 from TAF9__Homo_sapiens__NP_003178
auggaguccggcaagaccgccucccccaaguccaugcccaaggacgcccagaugauggcccagauccucaaggacaugggcaucaccgaguacgagccccgcgucaucaaccagaugcucgaguucgccuuccgcuacgucaccaccauccucgacgacgccaagaucuacuccucccacgccaagaaggccaccgucgacgccgacgacguccgccucgccauccagugccgcgccgaccaguccuucaccuccccccccccccgcgacuuccuccucgacaucgcccgccagcgcaaccagaccccccucccccucaucaagcccuacuccggcccccgccucccccccgaccgcuacugccucaccgcccccaacuaccgccucaagucccuccagaagaaggccuccaccuccgccggccgcaucaccgucccccgccucuccgucggcuccgucaccucccgccccuccacccccacccucggcacccccaccccccagaccauguccgucuccaccaaggucggcacccccaugucccucaccggccagcgcuucaccguccagaugcccaccucccagucccccgccgucaaggccuccauccccgccaccuccgccguccagaacguccucaucaaccccucccucaucggcuccaagaacauccucaucaccaccaacaugauguccucccagaacaccgccaacgaguccuccaacgcccucaagcgcaagcgcgaggacgacgacgacgacgacgacgacgacgacgacuacgacaaccucuga

SEQ ID NO: 50461 - RNA, 2007 nt, Artificial Sequence
  derived and/or modified sequence opt2 from TAGAP__Homo_sapiens__NP_001265662
augcgccgccucucccccgccuccgacuucuccggcgcccucgagaccgaccucaaggccucccucuucgaccagccccucuccaucaucugcggcgacuccgacacccucccccgccccauccaggacauccucaccauccucugccucaagggccccuccaccgagggcaucuuccgccgcgccgccaacgagaaggcccgcaaggagcucaaggaggagcucaacuccggcgacgccgucgaccucgagcgccuccccguccaccuccucgccgucgucuucaaggacuuccuccgcuccaucccccgcaagcuccucuccuccgaccucuucgaggaguggaugggcgcccucgagaugcaggacgaggaggaccgcaucgaggcccucaagcaggucgccgacaagcucccccgccccaaccuccuccuccucaagcaccucgucuacguccuccaccucaucuccaagaacuccgaggucaaccgcauggacuccuccaaccucgccaucugcaucggccccaacaugcucacccucgagaacgaccagucccucuccuucgaggcccagaaggaccucaacaacaaggucaagacccucgucgaguuccucaucgacaacugcuucgagaucuucggcgagaacauccccguccacuccuccaucaccuccgacgacucccucgagcacaccgacuccuccgacgucuccacccuccagaacgacuccgccuacgacuccaacgaccccgacgucgaguccaacuccuccuccggcaucuccucccccucccgccagccccagguccccauggccaccgccgccggccucgacuccgccggcccccaggacgcccgcgaggucucccccgagcccaucgucuccaccgucgcccgccucaaguccucccucgcccagcccgaccgccgcuacuccgagcccuccaugcccuccucccaggagugccucgagucccgcgucaccaaccagacccucaccaaguccgagggcgacuuccccgucccccgcgucggcucccgccucgaguccgaggaggccgaggaccccuuccccgaggaggucuuccccgccguccagggcaagaccaagcgccccgucgaccucaagaucaagaaccucgcccccggcuccguccucccccgcgcccucguccucaaggccuucuccuccuccucccucgacgccuccuccgacuccucccccgucgccucccccuccucccccaagcgcaacuucuucucccgccaccaguccuucaccaccaagaccgagaagggcaagcccucccgcgagaucaagaagcacuccauguccuucaccuucgccccccacaagaagguccucaccaagaaccucuccgccggcuccggcaagucccaggacuucacccgcgaccacgucccccgcggcguccgcaaggagucccagcucgccggccgcaucguccaggagaacggcugcgagacccacaaccagaccgcccgcggcuucugccuccgcccccacgcccucuccgucgacgacgucuuccagggcgccgacugggagcgccccggcuccccccccuccuacgaggaggccaugcagggccccgccgcccgccucgucgccuccgagucccagaccgucggcuccaugaccgucggcuccaugcgcgcccgcaugcucgaggcccacugccuccuccccccccucccccccgcccaccacgucgaggacucccgccaccgcggcuccaaggagccccuccccggccacggccucuccccccuccccgagcgcuggaagcagucccgcaccguccacgccuccggcgacucccucggccacgucuccggccccggccgccccgagcuccucccccuccgcaccgucuccgaguccguccagcgcaacaagcgcgacugccucguccgccgcugcucccagcccgucuucgaggccgaccaguuccaguacgccaaggaguccuacaucuga

SEQ ID NO: 50462 - RNA, 663 nt, Artificial Sequence
  derived and/or modified sequence opt2 from TAGLN2__Homo_sapiens__NP_001264153
auguccgccuucucccucgcccucgcccucgucuccuccccccagccccccccccccaucggcauggccaaccgcggccccgccuacggccucucccgcgagguccagcagaagaucgagaagcaguacgacgccgaccucgagcagauccucauccaguggaucaccacccagugccgcaaggacgucggccgcccccagcccggccgcgagaacuuccagaacuggcucaaggacggcaccguccucugcgagcucaucaacgcccucuaccccgagggccaggcccccgucaagaagauccaggccuccaccauggccuucaagcagauggagcagaucucccaguuccuccaggccgccgagcgcuacggcaucaacaccaccgacaucuuccagaccgucgaccucugggagggcaagaacauggccugcguccagcgcacccucaugaaccucggcggccucgccgucgcccgcgacgacggccucuucuccggcgaccccaacugguuccccaagaaguccaaggagaacccccgcaacuucuccgacaaccagcuccaggagggcaagaacgucaucggccuccagaugggcaccaaccgcggcgccucccaggccggcaugaccggcuacggcaugccccgccagauccucuga

SEQ ID NO: 50463 - RNA, 606 nt, Artificial Sequence
  derived and/or modified sequence opt2 from TAGLN__Homo_sapiens__NP_001001522
auggccaacaagggccccuccuacggcaugucccgcgagguccaguccaagaucgagaagaaguacgacgaggagcucgaggagcgccucgucgaguggaucaucguccagugcggccccgacgucggccgccccgaccgcggccgccucggcuuccaggucuggcucaagaacggcgucauccucuccaagcucgucaacucccucuaccccgacggcuccaagcccgucaagguccccgagaacccccccuccauggucuucaagcagauggagcaggucgcccaguuccucaaggccgccgaggacuacggcgucaucaagaccgacauguuccagaccgucgaccucuucgagggcaaggacauggccgccguccagcgcacccucauggcccucggcucccucgccgucaccaagaacgacggccacuaccgcggcgaccccaacugguucaugaagaaggcccaggagcacaagcgcgaguucaccgagucccagcuccaggagggcaagcacgucaucggccuccagaugggcuccaaccgcggcgccucccaggccggcaugaccggcuacggccgcccccgccagaucaucuccuga

SEQ ID NO: 50464 - RNA, 996 nt, Artificial Sequence
  derived and/or modified sequence opt2 from TAL1__Homo_sapiens__NP_001277334
augaccgagcgcccccccuccgaggccgcccgcuccgacccccagcucgagggccgcgacgccgccgaggccuccauggcccccccccaccucguccuccucaacggcgucgccaaggagaccucccgcgccgccgccgccgagccccccgucaucgagcucggcgcccgcggcggccccggcggcggccccgccggcggcggcggcgccgcccgcgaccucaagggccgcgacgccgccaccgccgaggcccgccaccgcguccccaccaccgagcucugccgcccccccggccccgcccccgcccccgcccccgccuccgucaccgccgagcuccccggcgacggccgcaugguccagcucuccccccccgcccucgccgcccccgccgcccccggccgcgcccuccucuacucccucucccagccccucgccucccucggcuccggcuucuucggcgagcccgacgccuuccccauguucaccaccaacaaccgcgucaagcgccgccccucccccuacgagauggagaucaccgacggcccccacaccaaggucguccgccgcaucuucaccaacucccgcgagcgcuggcgccagcagaacgucaacggcgccuucgccgagcuccgcaagcucauccccacccacccccccgacaagaagcucuccaagaacgagauccuccgccucgccaugaaguacaucaacuuccucgccaagcuccucaacgaccaggaggaggagggcacccagcgcgccaagaccggcaaggaccccgucgucggcgccggcggcggcggcggcggcggcggcggcggcgccccccccgacgaccuccuccaggacguccucucccccaacuccuccugcggcuccucccucgacggcgccgccucccccgacuccuacaccgaggagcccgcccccaagcacaccgcccgcucccuccaccccgccaugcuccccgccgccgacggcgccggcccccgcuga

SEQ ID NO: 50465 - RNA, 327 nt, Artificial Sequence
  derived and/or modified sequence opt2 from TAL2__Homo_sapiens__NP_005412
augacccgcaagaucuucaccaacacccgcgagcgcuggcgccagcagaacgucaacuccgccuucgccaagcuccgcaagcucauccccacccacccccccgacaagaagcucuccaagaacgagacccuccgccucgccaugcgcuacaucaacuuccucgucaagguccucggcgagcagucccuccagcagaccggcgucgccgcccagggcaacauccucggccucuucccccagggcccccaccuccccggccucgaggaccgcacccuccucgagaacuaccagguccccucccccggccccucccaccacauccccuga

SEQ ID NO: 50466 - RNA, 1014 nt, Artificial Sequence
  derived and/or modified sequence opt2 from TALDO1__Homo_sapiens__NP_006746
auguccuccucccccgucaagcgccagcgcauggaguccgcccucgaccagcucaagcaguucaccaccgucgucgccgacaccggcgacuuccacgccaucgacgaguacaagccccaggacgccaccaccaaccccucccucauccucgccgccgcccagaugcccgccuaccaggagcucgucgaggaggccaucgccuacggccgcaagcucggcggcucccaggaggaccagaucaagaacgccaucgacaagcucuucguccucuucggcgccgagauccucaagaagauccccggccgcgucuccaccgaggucgacgcccgccucuccuucgacaaggacgccauggucgcccgcgcccgccgccucaucgagcucuacaaggaggccggcaucuccaaggaccgcauccucaucaagcucuccuccaccugggagggcauccaggccggcaaggagcucgaggagcagcacggcauccacugcaacaugacccuccucuucuccuucgcccaggccgucgccugcgccgaggccggcgucacccucaucucccccuucgucggccgcauccucgacuggcacgucgccaacaccgacaagaaguccuacgagccccucgaggaccccggcgucaaguccgucaccaagaucuacaacuacuacaagaaguucuccuacaagaccaucgucaugggcgccuccuuccgcaacaccggcgagaucaaggcccucgccggcugcgacuuccucaccaucucccccaagcuccucggcgagcuccuccaggacaacgccaagcucguccccguccucuccgccaaggccgcccaggccuccgaccucgagaagauccaccucgacgagaaguccuuccgcuggcuccacaacgaggaccagauggccgucgagaagcucuccgacggcauccgcaaguucgccgccgacgccgucaagcucgagcgcaugcucaccgagcgcauguucaacgccgagaacggcaaguga

SEQ ID NO: 50467 - RNA, 951 nt, Artificial Sequence
  derived and/or modified sequence opt2 from TAMM41__Homo_sapiens__NP_620162
auggcccuccagacccuccaguccuccugggucaccuuccgcaagauccucucccacuuccccgaggagcucucccucgccuucgucuacggcuccggcgucuaccgccaggccggccccuccuccgaccagaagaacgccaugcucgacuucgucuucaccgucgacgaccccgucgccuggcacuccaagaaccucaagaagaacuggucccacuacuccuuccucaagguccucggccccaagaucaucaccuccauccagaacaacuacggcgccggcgucuacuacaacucccucaucaugugcaacggccgccucaucaaguacggcgucaucuccaccaacguccucaucgaggaccuccucaacuggaacaaccucuacaucgccggccgccuccagaagcccgucaagaucaucuccgucaacgaggacgucacccuccgcuccgcccucgaccgcaaccucaaguccgccgucaccgccgccuuccucaugcuccccgaguccuucuccgaggaggaccucuucaucgagaucgccggccucuccuacuccggcgacuuccgcauggucgucggcgaggacaagaccaagguccucaacaucgucaagcccaacaucgcccacuuccgcgagcucuacggcuccauccuccaggagaacccccaggucgucuacaagucccagcagggcuggcucgagaucgacaagucccccgagggccaguucacccagcucaugacccuccccaagacccuccagcagcagaucaaccacaucauggacccccccggcaagaaccgcgacgucgaggagacccucuuccaggucgcccacgaccccgacugcggcgacgucguccgccucggccucaagaaguccgucaucuacuccucccucaagcuccacaagauguggaagggcuggcuccgcaagaccuccuga

SEQ ID NO: 50468 - RNA, 5586 nt, Artificial Sequence
  derived and/or modified sequence opt2 from TANC1__Homo_sapiens__NP_203752
augcucaaggccguccucaagaagucccgcgagggcggcaagggcggcaagaaggaggccggcuccgacuucggccccgagaccucccccguccuccaccucgaccacuccgccgacucccccgucuccucccuccccaccgccgaggacaccuaccgcgucucccucgccaagggcgucuccaugucccuccccuccuccccccuccucccccgccagucccaccucguccagucccgcgucaacaagaagucccccggccccguccgcaagcccaaguacgucgaguccccccgcguccccggcgacgccgucaucaugcccuuccgcgaggucgccaagcccaccgagcccgacgagcacgaggccaaggccgacaacgagcccuccugcucccccgccgcccaggagcuccucacccgccucggcuuccuccucggcgagggcauccccuccgccacccacaucaccaucgaggacaagaacgagaccaugugcaccgcccucucccagggcaucucccccugcuccacccucaccuccuccaccgccucccccuccaccgacucccccugcuccacccucaacuccugcgucuccaagaccgccgccaacaagucccccugcgagaccaucuccucccccuccuccacccucgaguccaaggacuccggcaucaucgccaccaucaccuccuccuccgagaacgacgaccgcuccggcuccucccucgaguggaacaaggacggcaaccuccgccucggcguccagaagggcguccuccacgaccgccgcgccgacaacugcucccccgucgccgaggaggagaccaccggcuccgccgaguccacccuccccaaggccgaguccuccgccggcgacggccccguccccuacucccagggcuccuccucccucaucaugccccgccccaacuccgucgccgccaccuccuccaccaagcucgaggaccucuccuaccucgacggccagcgcaacgccccccuccgcaccuccauccgccuccccuggcacaacaccgccggcggccgcgcccaggaggucaaggcccgcuucgcccccuacaagccccaggacauccuccucaagccccuccucuucgagguccccuccaucaccaccgacuccgucuucgucggccgcgacuggcucuuccaccagaucgaggagaaccuccgcaacaccgagcucgccgagaaccgcggcgccgucgucgucggcaacgucggcuucggcaagaccgccaucaucuccaagcucgucgcccucuccugccacggcucccgcaugcgccagaucgccuccaacucccccggcuccucccccaagaccuccgaccccacccaggaccuccacuucaccccccuccucucccccuccuccuccaccuccgccuccuccaccgccaagaccccccucggcuccaucuccgccgagaaccagcgcccccgcgaggacgccgucaaguaccucgccuccaaggucgucgccuaccacuacugccaggccgacaacaccuacaccugccucguccccgaguucguccacuccaucgccgcccuccucugccgcucccaccagcucgccgccuaccgcgaccuccucaucaaggagccccagcuccaguccaugcucucccuccgcuccugcguccaggaccccgucgccgccuucaagcgcggcguccucgagccccucaccaaccuccgcaacgagcagaagauccccgaggaggaguacaucauccucaucgacggccucaacgaggccgaguuccacaagcccgacuacggcgacacccucuccuccuucaucaccaagaucaucuccaaguuccccgccuggcucaagcucaucgucaccguccgcgccaacuuccaggagaucaucuccgcccuccccuucgucaagcucucccucgacgacuuccccgacaacaaggacauccacuccgaccuccacgccuacguccagcaccgcguccacuccucccaggacauccucuccaacaucucccucaacggcaaggccgacgccacccucaucggcaaggucuccucccaccucguccuccgcucccucggcuccuaccucuaccucaagcucacccucgaccucuuccagcgcggccaccucgucaucaaguccgccuccuacaaggucguccccgucucccucuccgagcucuaccuccuccagugcaacaugaaguucaugacccaguccgccuucgagcgcgcccuccccauccucaacgucgcccucgccucccuccaccccaugaccgacgagcagaucuuccaggccaucaacgccggccacauccagggcgagcagggcugggaggacuuccagcagcgcauggacgcccucuccugcuuccucaucaagcgccgcgacaagacccgcauguucugccaccccuccuuccgcgaguggcucgucuggcgcgccgacggcgagaacaccgccuuccucugcgagccccgcaacggccacgcccuccucgccuucauguucucccgccaggagggcaagcucaaccgccagcagaccauggagcucggccaccacauccucaaggcccacaucuucaagggccucuccaagaagaccggcaucuccuccucccaccuccaggcccucuggaucggcuacuccaccgagggccucuccgccgcccucgccucccuccgcaaccucuacacccccaacgucaaggucucccgccuccucauccucggcggcgccaacgucaacuaccgcaccgagguccucaacaacgcccccauccucugcguccagucccaccucggccacgaggaggucgucacccuccuccucgaguucggcgccugccucgacggcaccuccgagaacggcaugaccgcccucugcuacgccgccgccgccggccacaugaagcucgucugccuccucaccaagaagggcguccgcgucgaccaccucgacaagaagggccagugcgcccucguccacuccgcccuccgcggccacggcgacauccuccaguaccuccucaccugcgaguggucccccggccccccccagcccggcacccuccgcaagucccacgcccuccagcaggcccucaccgccgccgccuccaugggccacuccuccgucguccagugccuccucggcauggagaaggagcacgaggucgaggucaacggcaccgacacccucuggggcgagaccgcccucaccgccgccgccggccgcggcaagcucgaggucugcgagcuccuccucggccacggcgccgccgucucccgcaccaaccgccgcggcguccccccccucuucugcgccgcccgccagggccacuggcagaucguccgccuccuccucgagcgcggcugcgacgucaaccucuccgacaagcagggccgcaccccccucauggucgccgccugcgagggccaccucuccaccgucgaguuccuccucuccaagggcgccgcccucuccucccucgacaaggagggccucuccgcccucuccugggccugccucaagggccaccgcgccgucguccaguaccucgucgaggagggcgccgccaucgaccagaccgacaagaacggccgcaccccccucgaccucgccgccuucuacggcgacgccgagaccguccucuaccucgucgagaagggcgccgucaucgagcacgucgaccacuccggcaugcgcccccucgaccgcgccaucggcugccgcaacaccuccgucgucgucgcccuccuccgcaagggcgccaagcucggcaacgccgccugggccauggccaccuccaagcccgacauccucaucauccuccuccagaagcucauggaggagggcaacgucauguacaagaagggcaagaugaaggaggccgcccagcgcuaccaguacgcccuccgcaaguucccccgcgagggcuucggcgaggacaugcgccccuucaacgagcuccgcgucucccucuaccucaaccucucccgcugccgccgcaagaccaacgacuucggcauggccgaggaguucgccuccaaggcccucgagcucaagcccaaguccuacgaggccuucuacgcccgcgcccgcgccaagcgcaacucccgccaguucgucgccgcccucgccgaccuccaggaggccgucaagcucugccccaccaaccaggaggucaagcgccuccucgcccgcgucgaggaggagugcaagcagcuccagcgcucccagcagcagaagcagcagggcccccuccccgccccccucaacgacuccgagaacgaggaggacacccccacccccggccucuccgaccacuuccacuccgaggagaccgaggaggaggagaccuccccccaggaggaguccgucucccccaccccccgcucccagcccuccuccuccguccccuccuccuacauccgcaaccuccaggagggccuccaguccaagggccgccccgucuccccccagucccgcgccggcaucggcaagucccuccgcgagcccgucgcccagcccggccuccuccuccagcccuccaagcaggcccagaucgucaagaccucccagcaccucggcuccggccaguccgccguccgcaacggcuccaugaagguccagaucuccucccagaaccccccccccucccccaugcccggccgcaucgccgccacccccgccggcucccgcacccagcaccucgagggcaccggcaccuucaccacccgcgccggcugcggccacuucggcgaccgccucggccccucccagaacguccgccuccagugcggcgagaacggccccgcccacccccuccccuccaagaccaagaccaccgagcgccuccucucccacuccuccgucgccgucgacgccgccccccccaaccagggcggccucgccaccugcuccgacguccgccaccccgccucccucaccuccuccggcuccuccggcucccccuccuccuccaucaagauguccuccuccaccuccucccucaccuccuccuccuccuucuccgacggcuucaagguccagggccccgacacccgcaucaaggacaaggucgucacccacguccaguccggcaccgccgagcaccgcccccgcaacacccccuucaugggcaucauggacaagaccgcccgcuuccagcagcaguccaacccccccucccgcuccuggcacugccccgcccccgagggccuccucaccaacaccuccuccgccgccggccuccaguccgccaacaccgagaagcccucccucaugcaggucggcggcuacaacaaccaggccaagaccugcuccgucuccacccucuccgccuccguccacaacggcgcccaggucaaggagcucgaggaguccaagugccagauccccguccacucccaggagaaccgcaucaccaagaccgucucccaccucuaccaggaguccaucuccaagcagcagccccacaucuccaacgaggcccaccgcucccaccucaccgccgccaagcccaagcgcuccuucaucgaguccaacgucuga

SEQ ID NO: 50469 - RNA, 5973 nt, Artificial Sequence
  derived and/or modified sequence opt2 from TANC2__Homo_sapiens__XP_005257260
auguuccgcaacucccucaagaugcuccucaccggcggcaaguccucccgcaagaaccgcuccuccgacggcggcuccgaggagccccccgaccgccgccaguccuccgucgacucccgccagucccgcuccggccagggcggcaucuccaccgaguccgacugcgccuucgagcccgacuacgccguccccccccuccccgucuccgagggcgacgccgagcaggagcucggccccccccccuccgucgacgaggccgccaacacccucaugacccgccucggcuuccuccucggcgagaaggucaccgagguccagcccggcgaccaguacuccauggagguccaggacgagaaccagaccuccgccaucacccagcgcaucucccccugcuccacccucaccuccuccaccgccuccccccccgccuccucccccugcuccacccucccccccaucuccaccaacgccaccgccaaggacugcuccuacggcgccgucaccucccccaccuccacccucgagucccgcgacuccggcaucaucgccacccucaccuccuacuccgagaacgucgagcgcaccaaguacgccggcgaguccuccaaggagcucggcuccggcggcaacaucaagcccuggcagucccagaaguccuccauggacuccugccucuaccgcgucgacgagaacaugaccgccuccaccuacucccucaacaagauccccgagcgcaaccucgagaccguccucucccaguccguccaguccaucccccucuaccucaugccccgccccaacuccgucgccgccaccuccuccgcccaccucgaggaccucgccuaccucgacgagcagcgccacaccccccuccgcaccucccuccgcaugccccgccaguccaugggcggcgcccgcacccagcaggaccuccgcguccgcuucgcccccuaccgcccccccgacaucucccucaagccccuccucuucgagguccccuccaucaccaccgaguccgucuucgucggccgcgacugggucuuccacgagaucgacgcccagcuccaguccuccaacgccuccgucaaccagggcgucgucaucgucggcaacaucggcuucggcaagaccgccaucaucucccgccucgucgcccucuccugccacggcacccgcaugcgccagaucgccuccgacuccccccacgccucccccaagcacgucgacgccaaccgcgagcucccccucacccagccccccuccgcccacuccuccaucaccuccggcuccugccccggcacccccgagaugcgccgccgccaggaggaggccaugcgccgccucgccucccaggucgucgccuaccacuacugccaggccgacaacgccuacaccugccucguccccgaguucguccacaacgucgccgcccuccucugccgcuccccccagcucaccgccuaccgcgagcagcuccuccgcgagccccaccuccaguccaugcucucccuccgcuccugcguccaggaccccauggccuccuuccgccgcggcguccucgagccccucgagaaccuccacaaggagcgcaagauccccgacgaggacuucaucauccucaucgacggccucaacgaggccgaguuccacaagcccgacuacggcgacaccaucgucuccuuccucuccaagaugaucggcaaguuccccuccuggcucaagcucaucgucaccguccgcaccucccuccaggagaucaccaagcuccuccccuuccaccgcaucuuccucgaccgccucgaggagaacgaggccaucgaccaggaccuccaggccuacauccuccaccgcauccacuccuccuccgagauccagaacaacaucucccucaacggcaagauggacaacaccaccuucggcaagcucuccucccaccucaagacccucucccagggcuccuaccucuaccucaagcucaccuucgaccucaucgagaagggcuaccucguccucaaguccuccuccuacaaggucguccccgucucccucuccgaggucuaccuccuccagugcaacaugaaguuccccacccaguccuccuucgaccgcgucaugccccuccucaacgucgccgucgccucccuccacccccucaccgacgagcacaucuuccaggccaucaacgccggcuccaucgagggcacccucgagugggaggacuuccagcagcgcauggagaaccucuccauguuccucaucaagcgccgcgacaugacccgcauguucguccaccccuccuuccgcgaguggcucaucuggcgcgaggagggcgagaagaccaaguuccucugcgacccccgcuccggccacacccuccucgccuucugguucucccgccaggagggcaagcucaaccgccagcagaccaucgagcucggccaccacauccucaaggcccacaucuucaagggccucuccaagaaggucggcgucuccuccuccauccuccagggccucuggaucuccuacuccaccgagggccucuccauggcccucgccucccuccgcaaccucuacacccccaacaucaaggucucccgccuccucauccucggcggcgccaacaucaacuaccgcaccgagguccucaacaacgcccccauccucugcguccagucccaccucggcuacaccgagauggucgcccuccuccucgaguucggcgccaacgucgacgccuccuccgaguccggccucaccccccucggcuacgccgccgccgccggcuaccucuccaucgucguccuccucugcaagaagcgcgccaaggucgaccaccucgacaagaacggccagugcgcccucguccacgccgcccuccgcggccaccucgaggucgucaaguuccucauccagugcgacuggaccauggccggccagcagcagggcgucuucaagaagucccacgccauccagcaggcccucaucgccgccgccuccaugggcuacaccgagaucgucuccuaccuccucgaccuccccgagaaggacgaggaggaggucgagcgcgcccagaucaacuccuucgacucccucuggggcgagaccgcccucaccgccgccgccggccgcggcaagcucgaggucugccgccuccuccucgagcagggcgccgccgucgcccagcccaaccgccgcggcgccgucccccucuucuccaccguccgccagggccacuggcagaucgucgaccuccuccucacccacggcgccgacgucaacauggccgacaagcagggccgcaccccccucaugauggccgccuccgagggccaccucggcaccgucgacuuccuccucgcccagggcgccuccaucgcccucauggacaaggagggccucaccgcccucuccugggccugccucaagggccaccucuccgucguccgcucccucgucgacaacggcgccgccaccgaccacgccgacaagaacggccgcaccccccucgaccucgccgccuucuacggcgacgccgaggucguccaguuccucgucgaccacggcgccaugaucgagcacgucgacuacuccggcaugcgcccccucgaccgcgccgucggcugccgcaacaccuccgucgucgucacccuccucaagaagggcgccaagaucggccccgccaccugggccauggccaccuccaagcccgacaucaugaucauccuccucuccaagcucauggaggagggcgacauguucuacaagaagggcaaggucaaggaggccgcccagcgcuaccaguacgcccucaagaaguucccccgcgagggcuucggcgaggaccucaagaccuuccgcgagcucaaggucucccuccuccucaaccucucccgcugccgccgcaagaugaacgacuucggcauggccgaggaguucgccaccaaggcccucgagcucaagcccaaguccuacgaggccuacuacgcccgcgcccgcgccaagcgcuccucccgccaguucgccgccgcccucgaggaccucaacgaggccaucaagcucugccccaacaaccgcgagauccagcgccuccuccuccgcgucgaggaggagugccgccagaugcagcagccccagcagccccccccccccccccagccccagcagcagcuccccgaggaggccgagcccgagccccagcacgaggacaucuacuccguccaggacaucuucgaggaggaguaccucgagcaggacgucgagaacgucuccaucggccuccagaccgaggcccgccccucccagggccuccccgucauccaguccccccccuccucccccccccaccgcgacuccgccuacaucuccuccuccccccucggcucccaccaggucuucgacuuccgcuccuccuccuccgucggcucccccacccgccagaccuaccaguccaccucccccgcccucucccccacccaccagaacucccacuaccgccccucccccccccacaccucccccgcccaccagggcggcuccuaccgcuucucccccccccccgucggcggccagggcaaggaguaccccucccccccccccuccccccuccgccgcggcccccaguaccgcgccuccccccccgccgaguccauguccgucuaccgcucccaguccggcucccccguccgcuaccagcaggagaccuccgucucccagcuccccggccgccccaaguccccccucuccaagauggcccagcgccccuaccagaugccccagcuccccgucgccgucccccagcagggccuccgccuccagcccgccaaggcccagaucguccgcuccaaccagcccucccccgccguccacuccuccaccgucauccccaccggcgccuacggccaggucgcccacuccauggccuccaaguaccaguccucccagggcgacaucggcgucucccagucccgccucgucuaccagggcuccaucggcggcaucgucggcgacggccgccccguccagcacguccaggccucccucuccgccggcgccaucugccagcacggcggccucaccaaggaggaccucccccagcgccccuccuccgccuaccgcggcggcguccgcuacucccagaccccccagaucggccgcucccaguccgccuccuacuaccccgucugccacuccaagcucgaccucgagcgcuccuccucccagcucggcucccccgacgucucccaccucauccgccgccccaucuccgucaaccccaacgagaucaagccccacccccccaccccccgcccccuccuccacucccaguccgucggccuccgcuucucccccuccuccaacuccaucuccuccaccuccaaccucacccccaccuuccgccccuccuccuccauccagcagauggagaucccccucaagcccgccuacgagcgcuccugcgacgagcucucccccgucucccccacccagggcggcuaccccuccgagcccacccgcucccgcaccacccccuucaugggcaucaucgacaagaccgcccgcacccagcaguacccccaccuccaccagcagaaccgcaccugggccgucuccuccgucgacaccguccucucccccaccucccccggcaaccucccccagcccgaguccuucuccccccccuccuccaucuccaacaucgccuucuacaacaagaccaacaacgcccagaacggccaccuccucgaggacgacuacuacuccccccacggcaugcucgccaacggcucccgcggcgaccuccucgagcgcgucucccaggccuccuccuaccccgacgucaaggucgcccgcacccuccccgucgcccaggccuaccaggacaaccucuaccgccagcucucccgcgacucccgccagggccagaccucccccaucaagcccaagcgccccuucgucgaguccaacgucuga

SEQ ID NO: 50470 - RNA, 831 nt, Artificial Sequence
  derived and/or modified sequence opt2 from TANGO2__Homo_sapiens__NP_001270045
augugcaucaucuucuucaaguucgacccccgccccgucuccaagaacgccuaccgccucauccucgccgccaaccgcgacgaguucuacucccgccccuccaagcucgccgacuucuggggcaacaacaacgagauccucuccggccucgacauggaggagggcaaggagggcggcaccuggcucggcaucuccacccgcggcaagcucgccgcccucaccaacuaccuccagccccagcucgacuggcaggcccgcggccgcggcgagcucgucacccacuuccucaccaccgacgucgacucccucuccuaccucaagaaggucuccauggagggccaccucuacaacggcuucaaccucaucgccgccgaccucuccaccgccaagggcgacgucaucugcuacuacggcaaccgcggcgagcccgaccccaucguccucacccccggcaccuacggccucuccaacgcccuccucgagacccccuggcgcaagcucugcuucggcaagcagcucuuccucgaggccgucgagcgcucccaggcccuccccaaggacguccucaucgccucccuccucgacguccucaacaacgaggaggcccagcuccccgaccccgccaucgaggaccagggcggcgaguacguccagcccaugcucuccaaguacgccgccgucugcguccgcugccccggcuacggcacccgcaccaacaccaucauccucgucgacgccgacggccacgucaccuucaccgagcgcuccaugauggacaaggaccucucccacugggagacccgcaccuacgaguucacccuccaguccuga

SEQ ID NO: 50471 - RNA, 1278 nt, Artificial Sequence
  derived and/or modified sequence opt2 from TANK__Homo_sapiens__NP_004171
auggacaagaacaucggcgagcagcucaacaaggccuacgaggccuuccgccaggccugcauggaccgcgacuccgccgucaaggagcuccagcagaagaccgagaacuacgagcagcgcauccgcgagcagcaggagcagcucucccuccagcagaccaucaucgacaagcucaagucccagcuccuccucgucaacuccacccaggacaacaacuacggcugcgucccccuccucgaggacuccgagacccgcaagaacaaccucacccucgaccagccccaggacaaggucaucuccggcaucgcccgcgagaagcuccccaagguccgccgccaggaggucuccuccccccgcaaggagaccuccgcccgcucccucggcuccccccuccuccacgagcgcggcaacaucgagaagaccuucugggaccucaaggaggaguuccacaagaucugcaugcucgccaaggcccagaaggaccaccucuccaagcucaacauccccgacaccgccaccgagacccagugcuccguccccauccagugcaccgacaagaccgacaagcaggaggcccucuucaagccccaggccaaggacgacaucaaccgcggcgcccccuccaucaccuccgucaccccccgcggccucugccgcgacgaggaggacaccuccuucgagucccucuccaaguucaacgucaaguucccccccauggacaacgacuccaccuuccuccacuccacccccgagcgccccggcauccucucccccgccaccuccgaggccgucugccaggagaaguucaacauggaguuccgcgacaaccccggcaacuucgucaagaccgaggagacccucuucgagauccagggcaucgaccccaucgccuccgccauccagaaccucaagaccaccgacaagaccaagcccuccaaccucgucaacaccugcauccgcaccacccucgaccgcgccgccugccucccccccggcgaccacaacgcccucuacgucaacuccuucccccuccucgaccccuccgacgcccccuuccccucccucgacucccccggcaaggccauccgcggcccccagcagcccaucuggaagcccuuccccaaccaggacuccgacuccgucguccucuccggcaccgacuccgagcuccacaucccccgcgucugcgaguucugccaggccgucuucccccccuccaucaccucccgcggcgacuuccuccgccaccucaacucccacuucaacggcgagaccuga

SEQ ID NO: 50472 - RNA, 2562 nt, Artificial Sequence
  derived and/or modified sequence opt2 from TAOK1__Homo_sapiens__NP_079418
augcccuccaccaaccgcgccggcucccucaaggaccccgagaucgccgagcucuucuucaaggaggaccccgagaagcucuucaccgaccuccgcgagaucggccacggcuccuucggcgccgucuacuucgcccgcgacguccgcaccaacgaggucgucgccaucaagaagauguccuacuccggcaagcaguccaccgagaaguggcaggacaucaucaaggaggucaaguuccuccagcgcaucaagcaccccaacuccaucgaguacaagggcugcuaccuccgcgagcacaccgccuggcucgucauggaguacugccucggcuccgccuccgaccuccucgagguccacaagaagccccuccaggaggucgagaucgccgccaucacccacggcgcccuccagggccucgccuaccuccacucccacaccaugauccaccgcgacaucaaggccggcaacauccuccucaccgagcccggccaggucaagcucgccgacuucggcuccgccuccauggccucccccgccaacuccuucgucggcacccccuacuggauggcccccgaggucauccucgccauggacgagggccaguacgacggcaaggucgacgucuggucccucggcaucaccugcaucgagcucgccgagcgcaagcccccccucuucaacaugaacgccauguccgcccucuaccacaucgcccagaacgagucccccacccuccaguccaacgagugguccgacuacuuccgcaacuucgucgacuccugccuccagaagaucccccaggaccgccccaccuccgaggagcuccucaagcacaucuucguccuccgcgagcgccccgagaccguccucaucgaccucauccagcgcaccaaggacgccguccgcgagcucgacaaccuccaguaccgcaagaugaagaagcuccucuuccaggaggcccacaacggccccgccgucgaggcccaggaggaggaggaggagcaggaccacggcgucggccgcaccggcaccgucaacuccgucggcuccaaccaguccauccccuccauguccaucuccgccuccucccaguccuccuccgucaacucccuccccgacgucuccgacgacaaguccgagcucgacaugauggagggcgaccacaccgucauguccaacuccuccgucauccaccucaagcccgaggaggagaacuaccgcgaggagggcgacccccgcacccgcgccuccgacccccagucccccccccaggucucccgccacaagucccacuaccgcaaccgcgagcacuucgccaccauccgcaccgccucccucgucacccgccagaugcaggagcacgagcaggacuccgagcuccgcgagcagauguccggcuacaagcgcaugcgccgccagcaccagaagcagcucaugacccucgagaacaagcucaaggccgagauggacgagcaccgccuccgccucgacaaggaccucgagacccagcgcaacaacuucgccgccgagauggagaagcucaucaagaagcaccaggccgccauggagaaggaggccaaggucauguccaacgaggagaagaaguuccagcagcacauccaggcccagcagaagaaggagcucaacuccuuccucgagucccagaagcgcgaguacaagcuccgcaaggagcagcucaaggaguccaaggagcuccagaucaagaagcaguuccaggacaccugcaagauccagacccgccaguacaaggcccuccgcaaccaccuccucgagaccacccccaaguccgagcacaaggccguccucaagcgccucaaggaggagcagacccgcaagcucgccauccucgccgagcaguacgaccacuccaucaacgagaugcucuccacccaggcccuccgccucgacgaggcccaggaggccgagugccagguccucaagaugcagcuccagcaggagcucgagcuccucaacgccuaccaguccaagaucaagaugcaggccgaggcccagcacgaccgcgagcuccgcgagcucgagcagcgcgucucccuccgccgcgcccuccucgagcagaagaucgaggaggagaugcucgcccuccagaacgagcgcaccgagcgcauccgcucccuccucgagcgccaggcccgcgagaucgaggccuucgacuccgaguccaugcgccucggcuucuccaacaugguccucuccaaccucucccccgaggccuucucccacuccuaccccggcgccuccggcuggucccacaaccccaccggcggccccggcccccacuggggccaccccaugggcggccccccccaggccuggggccaccccaugcagggcggcccccagcccuggggccaccccuccggccccaugcagggcgucccccgcggcuccuccaugggcguccgcaacuccccccaggcccuccgccgcaccgccuccggcggccgcaccgagcagggcaugucccgcuccaccuccgucaccucccagaucuccaacggcucccacauguccuacaccuga

SEQ ID NO: 50473 - RNA, 3369 nt, Artificial Sequence
  derived and/or modified sequence opt2 from TAOK2__Homo_sapiens__NP_001238972
augcccgccggcggccgcgccggcucccucaaggaccccgacgucgccgagcucuucuucaaggacgaccccgagaagcucuucuccgaccuccgcgagaucggccacggcuccuucggcgccgucuacuucgcccgcgacguccgcaacuccgaggucgucgccaucaagaagauguccuacuccggcaagcaguccaacgagaaguggcaggacaucaucaaggagguccgcuuccuccagaagcuccgccaccccaacaccauccaguaccgcggcugcuaccuccgcgagcacaccgccuggcucgucauggaguacugccucggcuccgccuccgaccuccucgagguccacaagaagccccuccaggaggucgagaucgccgccgucacccacggcgcccuccagggccucgccuaccuccacucccacaacaugauccaccgcgacgucaaggccggcaacauccuccucuccgagcccggccucgucaagcucggcgacuucggcuccgccuccaucauggcccccgccaacuccuucgucggcacccccuacuggauggcccccgaggucauccucgccauggacgagggccaguacgacggcaaggucgacgucuggucccucggcaucaccugcaucgagcucgccgagcgcaagcccccccucuucaacaugaacgccauguccgcccucuaccacaucgcccagaacgagucccccguccuccaguccggccacugguccgaguacuuccgcaacuucgucgacuccugccuccagaagaucccccaggaccgccccaccuccgagguccuccucaagcaccgcuucguccuccgcgagcgcccccccaccgucaucauggaccucauccagcgcaccaaggacgccguccgcgagcucgacaaccuccaguaccgcaagaugaagaagauccucuuccaggaggcccccaacggccccggcgccgaggcccccgaggaggaggaggaggccgagcccuacaugcaccgcgccggcacccucaccucccucgaguccucccacuccguccccuccauguccaucuccgccuccucccaguccuccuccgucaacucccucgccgacgccuccgacaacgaggaggaggaggaggaggaggaggaggaggaggaggaggaggagggccccgaggcccgcgagauggccaugaugcaggagggcgagcacaccgucaccucccacuccuccaucauccaccgccuccccggcuccgacaaccucuacgacgaccccuaccagcccgagaucacccccuccccccuccagccccccgccgcccccgcccccaccuccaccaccuccuccgcccgccgccgcgccuacugccgcaaccgcgaccacuucgccaccauccgcaccgccucccucgucucccgccagauccaggagcacgagcaggacuccgcccuccgcgagcagcucuccggcuacaagcgcaugcgccgccagcaccagaagcagcuccucgcccucgagucccgccuccgcggcgagcgcgaggagcacuccgcccgccuccagcgcgagcucgaggcccagcgcgccggcuucggcgccgaggccgagaagcucgcccgccgccaccaggccaucggcgagaaggaggcccgcgccgcccaggccgaggagcgcaaguuccagcagcacauccucggccagcagaagaaggagcucgccgcccuccucgaggcccagaagcgcaccuacaagcuccgcaaggagcagcucaaggaggagcuccaggagaaccccuccacccccaagcgcgagaaggccgaguggcuccuccgccagaaggagcagcuccagcagugccaggccgaggaggaggccggccuccuccgccgccagcgccaguacuucgagcuccagugccgccaguacaagcgcaagaugcuccucgcccgccacucccucgaccaggaccuccuccgcgaggaccucaacaagaagcagacccagaaggaccucgagugcgcccuccuccuccgccagcacgaggccacccgcgagcucgagcuccgccagcuccaggccguccagcgcacccgcgccgagcucacccgccuccagcaccagaccgagcucggcaaccagcucgaguacaacaagcgccgcgagcaggagcuccgccagaagcacgccgcccagguccgccagcagcccaagucccucaaggagcgcuccaucgucggccaggaggaggccggcaccuggucccucuggggcaaggaggacgagucccuccucgacgaggaguucgagcucggcuggguccagggccccgcccucacccccguccccgaggaggaggaggaggaggaggagggcgcccccaucggcaccccccgcgaccccggcgacggcugccccucccccgacaucccccccgagcccccccccacccaccuccgccccugccccgccucccagcuccccggccuccucucccacggccuccucgccggccucuccuucgccgucggcuccuccuccggccuccucccccuccuccuccuccuccuccucccccuccucgccgcccagggcggcggcggccuccaggccgcccuccucgcccucgaggucggccucgucggccucggcgccuccuaccuccuccucugcaccgcccuccaccuccccuccucccucuuccuccuccucgcccagggcaccgcccucggcgccguccucggccucuccuggcgccgcggccucaugggcgucccccucggccucggcgccgccuggcuccucgccuggcccggccucgcccucccccucgucgccauggccgccggcggccgcuggguccgccagcagggcccccgcguccgccgcggcaucucccgccucuggcuccgcguccuccuccgccucucccccauggccuuccgcgcccuccagggcugcggcgccgucggcgaccgcggccucuucgcccucuaccccaagaccaacaaggacggcuuccgcucccgccuccccguccccggcccccgccgccgcaacccccgcaccacccagcacccccucgcccuccucgcccgcgucuggguccucugcaagggcuggaacuggcgccucgcccgcgccucccagggccucgccucccaccucccccccugggccauccacacccucgccuccuggggccuccuccgcggcgagcgccccacccgcaucccccgccuccucccccgcucccagcgccagcucggcccccccgccucccgccagccccuccccggcacccucgccggccgccgcucccgcacccgccagucccgcgcccucccccccuggcgcuga

SEQ ID NO: 50474 - RNA, 2697 nt, Artificial Sequence
  derived and/or modified sequence opt2 from TAOK3__Homo_sapiens__NP_057365
augcgcaagggcguccucaaggaccccgagaucgccgaccucuucuacaaggacgaccccgaggagcucuucaucggccuccacgagaucggccacggcuccuucggcgccgucuacuucgccaccaacgcccacaccuccgaggucgucgccaucaagaagauguccuacuccggcaagcagacccacgagaaguggcaggacauccucaaggaggucaaguuccuccgccagcucaagcaccccaacaccaucgaguacaagggcugcuaccucaaggagcacaccgccuggcucgucauggaguacugccucggcuccgccuccgaccuccucgagguccacaagaagccccuccaggaggucgagaucgccgccaucacccacggcgcccuccacggccucgccuaccuccacucccacgcccucauccaccgcgacaucaaggccggcaacauccuccucaccgagcccggccaggucaagcucgccgacuucggcuccgccuccauggccucccccgccaacuccuucgucggcacccccuacuggauggcccccgaggucauccucgccauggacgagggccaguacgacggcaaggucgacaucuggucccucggcaucaccugcaucgagcucgccgagcgcaagcccccccucuucaacaugaacgccauguccgcccucuaccacaucgcccagaacgacucccccacccuccaguccaacgaguggaccgacuccuuccgccgcuucgucgacuacugccuccagaagaucccccaggagcgccccaccuccgccgagcuccuccgccacgacuucguccgccgcgaccgcccccuccgcguccucaucgaccucauccagcgcaccaaggacgccguccgcgagcucgacaaccuccaguaccgcaagaugaagaagauccucuuccaggagacccgcaacggcccccucaacgagucccaggaggacgaggaggacuccgagcacggcaccucccucaaccgcgagauggacucccucggcuccaaccacuccauccccuccauguccgucuccaccggcucccaguccuccuccgucaacuccaugcaggaggucauggacgaguccuccuccgagcucgucaugaugcacgacgacgaguccaccaucaacuccuccuccuccgucguccacaagaaggaccacgucuucauccgcgacgaggccggccacggcgacccccgccccgagccccgccccacccaguccguccagucccaggcccuccacuaccgcaaccgcgagcgcuucgccaccaucaaguccgccucccucgucacccgccagauccacgagcacgagcaggagaacgagcuccgcgagcagauguccggcuacaagcgcaugcgccgccagcaccagaagcagcucaucgcccucgagaacaagcucaaggccgagauggacgagcaccgccucaagcuccagaaggaggucgagacccacgccaacaacuccuccaucgagcucgagaagcucgccaagaagcaggucgccaucaucgagaaggaggccaaggucgccgccgccgacgagaagaaguuccagcagcagauccucgcccagcagaagaaggaccucaccaccuuccucgagucccagaagaagcaguacaagaucugcaaggagaagaucaaggaggagaugaacgaggaccacuccacccccaagaaggagaagcaggagcgcaucuccaagcacaaggagaaccuccagcacacccaggccgaggaggaggcccaccuccucacccagcagcgccucuacuacgacaagaacugccgcuucuucaagcgcaagaucaugaucaagcgccacgaggucgagcagcagaacauccgcgaggagcucaacaagaagcgcacccagaaggagauggagcacgccaugcucauccgccacgacgaguccacccgcgagcucgaguaccgccagcuccacacccuccagaagcuccgcauggaccucauccgccuccagcaccagaccgagcucgagaaccagcucgaguacaacaagcgccgcgagcgcgagcuccaccgcaagcacgucauggagcuccgccagcagcccaagaaccucaaggccauggagaugcagaucaagaagcaguuccaggacaccugcaagguccagaccaagcaguacaaggcccucaagaaccaccagcucgaggucacccccaagaacgagcacaagaccauccucaagacccucaaggacgagcagacccgcaagcucgccauccucgccgagcaguacgagcaguccaucaacgagaugauggccucccaggcccuccgccucgacgaggcccaggaggccgagugccaggcccuccgccuccagcuccagcaggagauggagcuccucaacgccuaccaguccaagaucaagaugcagaccgaggcccagcacgagcgcgagcuccagaagcucgagcagcgcgucucccuccgccgcgcccaccucgagcagaagaucgaggaggagcucgccgcccuccagaaggagcgcuccgagcgcaucaagaaccuccucgagcgccaggagcgcgagaucgagaccuucgacauggagucccuccgcaugggcuucggcaaccucgucacccucgacuuccccaaggaggacuaccgcuga

SEQ ID NO: 50475 - RNA, 2427 nt, Artificial Sequence
  derived and/or modified sequence opt2 from TAP1__Homo_sapiens__NP_000584
auggccgagcuccucgccuccgccggcuccgccugcuccugggacuucccccgcgccccccccuccuuccccccccccgccgccucccgcggcggccucggcggcacccgcuccuuccgcccccaccgcggcgccgaguccccccgccccggccgcgaccgcgacggcguccgcguccccauggccuccucccgcugccccgccccccgcggcugccgcugccuccccggcgccucccucgccuggcucggcaccguccuccuccuccucgccgacuggguccuccuccgcaccgcccucccccgcaucuucucccuccucguccccaccgcccucccccuccuccgcgucugggccgucggccucucccgcugggccguccucuggcucggcgccugcggcguccuccgcgccaccgucggcuccaaguccgagaacgccggcgcccagggcuggcucgccgcccucaagccccucgccgccgcccucggccucgcccuccccggccucgcccucuuccgcgagcucaucuccuggggcgcccccggcuccgccgacuccacccgccuccuccacuggggcucccaccccaccgccuucgucgucuccuacgccgccgcccuccccgccgccgcccucuggcacaagcucggcucccucuggguccccggcggccagggcggcuccggcaaccccguccgccgccuccucggcugccucggcuccgagacccgccgccucucccucuuccucguccucgucguccucuccucccucggcgagauggccauccccuucuucaccggccgccucaccgacuggauccuccaggacggcuccgccgacaccuucacccgcaaccucacccucauguccauccucaccaucgccuccgccguccucgaguucgucggcgacggcaucuacaacaacaccaugggccacguccacucccaccuccagggcgaggucuucggcgccguccuccgccaggagaccgaguucuuccagcagaaccagaccggcaacaucaugucccgcgucaccgaggacaccuccacccucuccgacucccucuccgagaaccucucccucuuccucugguaccucguccgcggccucugccuccucggcaucaugcucuggggcuccgucucccucaccauggucacccucaucacccucccccuccucuuccuccuccccaagaaggucggcaagugguaccagcuccucgagguccagguccgcgagucccucgccaaguccucccaggucgccaucgaggcccucuccgccaugcccaccguccgcuccuucgccaacgaggagggcgaggcccagaaguuccgcgagaagcuccaggagaucaagacccucaaccagaaggaggccgucgccuacgccgucaacuccuggaccaccuccaucuccggcaugcuccucaaggucggcauccucuacaucggcggccagcucgucaccuccggcgccgucuccuccggcaaccucgucaccuucguccucuaccagaugcaguucacccaggccgucgagguccuccucuccaucuacccccgcguccagaaggccgucggcuccuccgagaagaucuucgaguaccucgaccgcaccccccgcugcccccccuccggccuccucaccccccuccaccucgagggccucguccaguuccaggacgucuccuucgccuaccccaaccgccccgacguccucguccuccagggccucaccuucacccuccgccccggcgaggucaccgcccucgucggccccaacggcuccggcaaguccaccgucgccgcccuccuccagaaccucuaccagcccaccggcggccagcuccuccucgacggcaagccccucccccaguacgagcaccgcuaccuccaccgccaggucgccgccgucggccaggagccccaggucuucggccgcucccuccaggagaacaucgccuacggccucacccagaagcccaccauggaggagaucaccgccgccgccgucaaguccggcgcccacuccuucaucuccggccucccccagggcuacgacaccgaggucgacgaggccggcucccagcucuccggcggccagcgccaggccgucgcccucgcccgcgcccucauccgcaagcccugcguccucauccucgacgacgccaccuccgcccucgacgccaacucccagcuccaggucgagcagcuccucuacgagucccccgagcgcuacucccgcuccguccuccucaucacccagcaccucucccucgucgagcaggccgaccacauccucuuccucgagggcggcgccauccgcgagggcggcacccaccagcagcucauggagaagaagggcugcuacugggccaugguccaggcccccgccgacgcccccgaguga

SEQ ID NO: 50476 - RNA, 2112 nt, Artificial Sequence
  derived and/or modified sequence opt2 from TAP2__Homo_sapiens__NP_000535
augcgccuccccgaccuccgccccuggaccucccuccuccucgucgacgccgcccuccucuggcuccuccagggcccccucggcacccuccucccccagggccuccccggccucuggcucgagggcacccuccgccucggcggccucuggggccuccucaagcuccgcggccuccucggcuucgucggcacccuccuccucccccucugccucgccaccccccucaccgucucccuccgcgcccucgucgccggcgccucccgcgccccccccgcccgcgucgccuccgcccccugguccuggcuccucgucggcuacggcgccgccggccucuccuggucccucugggccguccucuccccccccggcgcccaggagaaggagcaggaccaggucaacaacaagguccucauguggcgccuccucaagcucucccgccccgaccucccccuccucgucgccgccuucuucuuccucguccucgccguccucggcgagacccucaucccccacuacuccggccgcgucaucgacauccucggcggcgacuucgacccccacgccuucgccuccgccaucuucuucaugugccucuucuccuucggcuccucccucuccgccggcugccgcggcggcugcuucaccuacaccaugucccgcaucaaccuccgcauccgcgagcagcucuucuccucccuccuccgccaggaccucggcuucuuccaggagaccaagaccggcgagcucaacucccgccucuccuccgacaccacccucauguccaacuggcucccccucaacgccaacguccuccuccgcucccucgucaaggucgucggccucuacggcuucaugcucuccaucuccccccgccucacccuccucucccuccuccacaugcccuucaccaucgccgccgagaaggucuacaacacccgccaccaggagguccuccgcgagauccaggacgccgucgcccgcgccggccaggucguccgcgaggccgucggcggccuccagaccguccgcuccuucggcgccgaggagcacgaggucugccgcuacaaggaggcccucgagcagugccgccagcucuacuggcgccgcgaccucgagcgcgcccucuaccuccucguccgccgcguccuccaccucggcguccagaugcucaugcucuccugcggccuccagcagaugcaggacggcgagcucacccagggcucccuccucuccuucaugaucuaccaggaguccgucggcuccuacguccagacccucgucuacaucuacggcgacaugcucuccaacgucggcgccgccgagaaggucuucuccuacauggaccgccagcccaaccuccccucccccggcacccucgcccccaccacccuccagggcgucgucaaguuccaggacgucuccuucgccuaccccaaccgccccgaccgccccguccucaagggccucaccuucacccuccgccccggcgaggucaccgcccucgucggccccaacggcuccggcaaguccaccgucgccgcccuccuccagaaccucuaccagcccaccggcggccagguccuccucgacgagaagcccaucucccaguacgagcacugcuaccuccacucccaggucgucuccgucggccaggagcccguccucuucuccggcuccguccgcaacaacaucgccuacggccuccaguccugcgaggacgacaaggucauggccgccgcccaggccgcccacgccgacgacuucauccaggagauggagcacggcaucuacaccgacgucggcgagaagggcucccagcucgccgccggccagaagcagcgccucgccaucgcccgcgcccucguccgcgacccccgcguccucauccucgacgaggccaccuccgcccucgacguccagugcgagcaggcccuccaggacuggaacucccgcggcgaccgcaccguccucgucaucgcccaccgccuccaggccguccagcgcgcccaccagauccucguccuccaggagggcaagcuccagaagcucgcccagcuccaggagggccaggaccucuacucccgccucguccagcagcgccucauggacuga

SEQ ID NO: 50477 - RNA, 1347 nt, Artificial Sequence
  derived and/or modified sequence opt2 from TAPBP__Homo_sapiens__NP_003181
augaagucccucucccuccuccucgccgucgcccucggccucgccaccgccgucuccgccggccccgccgucaucgagugcugguucgucgaggacgccuccggcaagggccucgccaagcgccccggcgcccuccuccuccgccagggccccggcgagccccccccccgccccgaccucgaccccgagcucuaccucuccguccacgaccccgccggcgcccuccaggccgccuuccgccgcuacccccgcggcgcccccgccccccacugcgagaugucccgcuucgucccccuccccgccuccgccaagugggccuccggccucacccccgcccagaacugcccccgcgcccucgacggcgccuggcucauggucuccaucuccucccccguccucucccucuccucccuccuccgcccccagcccgagccccagcaggagcccguccucaucaccauggccaccgucguccucaccguccucacccacacccccgccccccgcguccgccucggccaggacgcccuccucgaccucuccuucgccuacaugccccccaccuccgaggccgccuccucccucgcccccggccccccccccuucggccucgaguggcgccgccagcaccucggcaagggccaccuccuccucgccgccacccccggccucaacggccagaugcccgccgcccaggagggcgccgucgccuucgccgccugggacgacgacgagcccuggggccccuggaccggcaacggcaccuucuggcuccccaccguccagcccuuccaggagggcaccuaccucgccaccauccaccuccccuaccuccagggccaggucacccucgagcucgccgucuacaagccccccaaggucucccucaugcccgccacccucgcccgcgccgcccccggcgaggccccccccgagcuccucugccucgucucccacuucuaccccuccggcggccucgaggucgagugggagcuccgcggcggccccggcggccgcucccagaaggccgagggccagcgcuggcucuccgcccuccgccaccacuccgacggcuccgucucccucuccggccaccuccagcccccccccgucaccaccgagcagcacggcgcccgcuacgccugccgcauccaccaccccucccuccccgccuccggccgcuccgccgaggucacccucgaggucgccggccucuccggccccucccucgaggacuccgucggccucuuccucuccgccuuccuccuccucggccucuucaaggcccucggcugggccgccgucuaccucuccaccugcaaggacuccaagaagaaggccgaguga

SEQ ID NO: 50478 - RNA, 1407 nt, Artificial Sequence
  derived and/or modified sequence opt2 from TAPBPL__Homo_sapiens__NP_060479
augggcacccaggagggcuggugccuccuccucugccucgcccucuccggcgccgccgagaccaagccccaccccgccgagggccaguggcgcgccgucgacgucguccucgacugcuuccucgccaaggacggcgcccaccgcggcgcccucgccuccuccgaggaccgcgcccgcgccucccucguccucaagcagguccccguccucgacgacggcucccucgaggacuucaccgacuuccagggcggcacccucgcccaggacgacccccccaucaucuucgaggccuccgucgaccucguccagaucccccaggccgaggcccuccuccacgccgacugcuccggcaaggaggucaccugcgagaucucccgcuacuuccuccagaugaccgagaccaccgucaagaccgccgccugguucauggccaacaugcaggucuccggcggcggccccuccaucucccucgucaugaagaccccccgcgucaccaagaacgaggcccucuggcaccccacccucaaccucccccucuccccccagggcaccguccgcaccgccgucgaguuccaggucaugacccagacccagucccucuccuuccuccucggcuccuccgccucccucgacugcggcuucuccauggcccccggccucgaccucaucuccgucgaguggcgccuccagcacaagggccgcggccagcucgucuacuccuggaccgccggccagggccaggccguccgcaagggcgccacccucgagcccgcccagcucggcauggcccgcgacgccucccucacccuccccggccucaccauccaggacgagggcaccuacaucugccagaucaccaccucccucuaccgcgcccagcagaucauccagcucaacauccaggccucccccaagguccgccucucccucgccaacgaggcccuccuccccacccucaucugcgacaucgccggcuacuacccccucgacgucgucgucaccuggacccgcgaggagcucggcggcucccccgcccaggucuccggcgccuccuucuccucccuccgccaguccgucgccggcaccuacuccaucuccuccucccucaccgccgagcccggcuccgccggcgccaccuacaccugccaggucacccacaucucccucgaggagccccucggcgccuccacccaggucgucccccccgagcgccgcaccgcccucggcgucaucuucgccuccucccucuuccuccucgcccucauguuccucggccuccagcgccgccaggcccccaccggccucggccuccuccaggccgagcgcugggagaccaccuccugcgccgacacccaguccucccaccuccacgaggaccgcaccgcccgcgucucccagcccuccuga

SEQ ID NO: 50479 - RNA, 4866 nt, Artificial Sequence
  derived and/or modified sequence opt2 from TARBP1__Homo_sapiens__NP_005637
auggaguggguccucgccgaggcccuccucucccagucccgcgacccccgcgcccuccucggcgcccucugccagggcgaggccuccgccgagcgcgucgagacccuccgcuuccuccuccagcgccucgaggacgaggaggcccgcggcuccggcggcgccggcgcccuccccgaggccgcccgcgaggucgccgccggcuaccucgucccccuccuccgcucccuccgcggccgccccgccggcggccccgaccccucccuccagccccgccaccgccgccgcguccuccgcgccgccggcgccgcccuccgcuccugcguccgccucgccggccgcccccagcucgccgccgcccucgccgaggaggcccuccgcgaccuccucgccggcuggcgcgcccccggcgccgaggccgccgucgagguccucgccgccgucggccccugccuccgcccccgcgaggacggcccccuccucgagcgcgucgccggcaccgccgucgcccucgcccucggcggcggcggcgacggcgacgaggccggccccgccgaggacgccgccgcccucgucgccggccgccuccuccccguccucguccagugcggcggcgccgcccuccgcgccgucuggggcggccucgccgcccccggcgccucccucggcuccggccgcgucgaggagaagcuccucguccucuccgcccucgccgagaagcuccuccccgagcccggcggcgaccgcgcccgcggcgcccgcgaggccggccccgacgcccgccgcugcuggcgcuucuggcgcaccguccaggccggccucggccaggccgacgcccucacccgcaagcgcgcccgcuaccuccuccagcgcgccgucgaggucuccgccgagcucggcgccgacugcaccugcggcccccaggagggcaacggccccucccucuucuggugguccgagcgcaagaaggacgagcuccucaaguucugggagaacuacauccucaucauggagacccucgagggcaaccagauccacgucaucaagcccguccuccccaagcucaacaaccucuucgaguacgccgucuccgaggagaacggcugcuggcucuuccaccccuccuggcacaugugcaucuacaagcgcauguucgaguccgagaacaagauccucuccaaggagggcgucauccacuuccucgagcucuacgagaccaagauccuccccuucucccccgaguucuccgaguucaucaucggcccccucauggacgcccucuccgaguccucccucuacucccgcucccccggccagcccaucggcuccugcuccccccucggccucaagcuccagaaguuccucgucaccuacaucucccuccuccccgaggagaucaaguccuccuuccuccucaaguucauccgcaagaugaccucccgccacuggugcgccguccccauccucuuccucuccaaggcccucgccaacgucccccgccacaaggcccucggcaucgacggccuccucgcccuccgcgacgucauccacugcaccaugaucacccaccagauccuccuccgcggcgccgcccagugcuaccuccuccagaccgccaugaaccuccucgacgucgagaaggucucccucuccgacgucuccaccuuccucaugucccuccgccaggaggagucccucggccgcggcaccucccucuggaccgagcucugcgacuggcuccgcgucaacgaguccuacuucaagcccucccccaccugcuccuccaucggccuccacaagaccucccucaacgccuacgucaaguccaucguccaggaguacgucaaguccuccgccugggagaccggcgagaacugcuucaugcccgacugguucgaggccaagcucgucucccucaugguccuccucgccgucgacgucgagggcaugaagacccaguacuccggcaagcagcgcaccgagaacguccuccgcaucuuccucgacccccuccucgacguccucaugaaguucuccaccaacgccuacaugccccuccucaagaccgaccgcugccuccagcuccuccucaagcuccucaacaccugccgccucaagggcuccuccgcccaggacgacgaggucuccaccguccuccagaacuucuucauguccaccaccgaguccaucuccgaguucauccuccgccgccucaccaugaacgagcucaacuccgucuccgaccucgaccgcugccaccucuaccucaugguccucaccgagcucaucaaccuccaccucaaggucggcuggaagcgcggcaaccccaucuggcgcgucaucucccuccucaagaacgccuccauccagcaccuccaggagauggacuccggccaggagcccaccgucggcucccagauccagcgcgucgucuccauggccgcccucgccauggucugcgaggccaucgaccagaagcccgagcuccagcucgacucccuccacgccggcccccucgaguccuuccucuccucccuccagcucaaccagacccuccagaagccccacgccgaggagcaguccuccuacgcccacccccucgagugcuccuccguccucgaggaguccuccuccucccagggcuggggcaagaucgucgcccaguacauccacgaccagugggucugccucuccuuccuccucaagaaguaccacacccucauccccaccaccggcuccgagauccucgagcccuuccuccccgccguccagaugcccauccgcacccuccaguccgcccucgaggcccucaccguccucuccuccgaccagguccuccccgucuuccacugccucaagguccucguccccaagcuccucaccuccuccgagucccucugcaucgaguccuucgacauggccuggaagaucaucuccucccucuccaacacccagcucaucuucugggccaaccucaaggccuucguccaguucgucuucgacaacaagguccucaccaucgccgccaagaucaagggccaggccuacuucaagaucaaggagaucauguacaagaucaucgagauguccgccaucaagaccggcgucuucaacacccucaucuccuacugcugccaguccuggaucgucuccgccuccaacgucucccagggcucccucuccuccgccaagaacuacuccgagcucauccucgaggccugcaucuucggcaccgucuuccgccgcgaccagcgccucguccaggacguccagaccuucaucgagaaccucggccacgacugcgccgccaacaucgucauggagaacaccaagcgcgaggaccacuacguccgcaucugcgccgucaaguuccucugccuccucgacggcuccaacaugucccacaagcucuucaucgaggaccucgccaucaagcuccucgacaaggacgagcucgucuccaaguccaagaagcgcuacuacgucaacucccuccagcaccgcgucaagaaccgcgucuggcagacccuccucguccucuucccccgccucgaccagaacuuccucaacggcaucaucgaccgcaucuuccaggccggcuucaccaacaaccaggccuccaucaaguacuucaucgaguggaucaucauccucauccuccacaaguucccccaguuccuccccaaguucugggacugcuucuccuacggcgaggagaaccucaagaccuccaucugcaccuuccucgccguccucucccaccucgacaucaucacccagaacauccccgagaagaagcucauccucaagcaggcccucaucgucguccuccaguggugcuucaaccacaacuucuccguccgccucuacgcccucgucgcccucaagaagcucuggaccgucugcaagguccucuccgucgaggaguucgacgcccucacccccgucaucgaguccucccuccaccaggucgaguccaugcacggcgccggcaacgccaagaagaacuggcagcgcauccaggagcacuucuucuucgccaccuuccacccccucaaggacuacugccucgagaccaucuucuacauccucccccgccucuccggccucaucgaggacgaguggaucaccaucgacaaguucacccgcuucaccgacgucccccucgccgccggcuuccagugguaccucucccagacccagcucuccaagcucaagcccggcgacuggucccagcaggacaucggcaccaaccucgucgaggccgacaaccaggccgaguggaccgacguccagaagaagaucauccccuggaacucccgcgucuccgaccucgaccucgagcuccucuuccaggaccgcgccgcccgccucggcaaguccaucucccgccucaucgucgucgccucccucaucgacaagcccaccaaccucggcggccucugccgcaccugcgaggucuucggcgccuccguccucgucgucggcucccuccagugcaucuccgacaagcaguuccagcaccucuccgucuccgccgagcaguggcucccccucgucgaggucaagcccccccagcucaucgacuaccuccagcagaagaagaccgagggcuacaccaucaucggcgucgagcagaccgccaagucccucgaccucacccaguacugcuuccccgagaagucccuccuccuccucggcaacgagcgcgagggcauccccgccaaccucauccagcagcucgacgucugcgucgagaucccccagcagggcaucauccgcucccucaacguccacgucuccggcgcccuccucaucugggaguacacccgccagcagcuccucucccacggcgacaccaagcccuga

SEQ ID NO: 50480 - RNA, 1101 nt, Artificial Sequence
  derived and/or modified sequence opt2 from TARBP2__Homo_sapiens__NP_599150
auguccgaggaggagcagggcuccggcaccaccaccggcugcggccuccccuccaucgagcagaugcucgccgccaaccccggcaagacccccaucucccuccuccaggaguacggcacccgcaucggcaagacccccgucuacgaccuccucaaggccgagggccaggcccaccagcccaacuucaccuuccgcgucaccgucggcgacaccuccugcaccggccagggccccuccaagaaggccgccaagcacaaggccgccgaggucgcccucaagcaccucaagggcggcuccaugcucgagcccgcccucgaggacuccuccuccuucuccccccucgacuccucccuccccgaggacauccccgucuucaccgccgccgccgccgccacccccguccccuccgucguccucacccgcuccccccccauggagcuccagccccccgucuccccccagcaguccgagugcaaccccgucggcgcccuccaggagcucgucguccagaagggcuggcgccuccccgaguacaccgucacccaggaguccggccccgcccaccgcaaggaguucaccaugaccugccgcgucgagcgcuucaucgagaucggcuccggcaccuccaagaagcucgccaagcgcaacgccgccgccaagaugcuccuccgcguccacaccgucccccucgacgcccgcgacggcaacgaggucgagcccgacgacgaccacuucuccaucggcgucggcucccgccucgacggccuccgcaaccgcggccccggcugcaccugggacucccuccgcaacuccgucggcgagaagauccucucccuccgcuccugcucccucggcucccucggcgcccucggccccgccugcugccgcguccucuccgagcucuccgaggagcaggccuuccacgucuccuaccucgacaucgaggagcucucccucuccggccucugccagugccucgucgagcucuccacccagcccgccaccgucugccacggcuccgccaccacccgcgaggccgcccgcggcgaggccgcccgccgcgcccuccaguaccucaagaucauggccggcuccaaguga

SEQ ID NO: 50481 - RNA, 924 nt, Artificial Sequence
  derived and/or modified sequence opt2 from TARP__Homo_sapiens__XP_011513708
auguucaucggcaacuccccccuccuccucaccgucggccucggccucuccaaggucgagcaguuccagcucuccaucuccaccgaggucaagaaguccaucgacauccccugcaagaucuccuccacccgcuucgagaccgacgucauccacugguaccgccagaagcccaaccaggcccucgagcaccucaucuacaucgucuccaccaaguccgccgcccgccgcuccaugggcaagaccuccaacaaggucgaggcccgcaagaacucccagacccucaccuccauccucaccaucaaguccgucgagaaggaggacauggccgucuacuacugcgccgccugggacuucggccacuacaagaagcucuucggcuccggcaccacccucgucgucaccgacaagcagcucgacgccgacgucucccccaagcccaccaucuuccuccccuccaucgccgagaccaagcuccagaaggccggcaccuaccucugccuccucgagaaguucuuccccgacgucaucaagauccacuggcaggagaagaaguccaacaccauccucggcucccaggagggcaacaccaugaagaccaacgacaccuacaugaaguucuccuggcucaccguccccgagaagucccucgacaaggagcaccgcugcaucguccgccacgagaacaacaagaacggcgucgaccaggagaucaucuucccccccaucaagaccgacgucaucaccauggaccccaaggacaacugcuccaaggacgccaacgacacccuccuccuccagcucaccaacaccuccgccuacuacauguaccuccuccuccuccucaaguccgucgucuacuucgccaucaucaccugcugccuccuccgccgcaccgccuucugcugcaacggcgagaaguccuga

SEQ ID NO: 50482 - RNA, 2172 nt, Artificial Sequence
  derived and/or modified sequence opt2 from TARS__Homo_sapiens__NP_001245366
auguucgaggagaaggccuccucccccuccggcaagaugggcggcgaggagaagcccaucggcgccggcgaggagaagcagaaggagggcggcaagaagaagaacaaggagggcuccggcgacggcggccgcgccgagcucaaccccuggcccgaguacaucuacacccgccucgagauguacaacauccucaaggccgagcacgacuccauccucgccgagaaggccgagaaggacuccaagcccaucaaggucacccuccccgacggcaagcaggucgacgccgaguccuggaagaccacccccuaccagaucgccugcggcaucucccagggccucgccgacaacaccgucaucgccaaggucaacaacgucgucugggaccucgaccgcccccucgaggaggacugcacccucgagcuccucaaguucgaggacgaggaggcccaggccgucuacuggcacuccuccgcccacaucaugggcgaggccauggagcgcgucuacggcggcugccucugcuacggcccccccaucgagaacggcuucuacuacgacauguaccucgaggagggcggcgucuccuccaacgacuucuccucccucgaggcccucugcaagaagaucaucaaggagaagcaggccuucgagcgccucgaggucaagaaggagacccuccucgccauguucaaguacaacaaguucaagugccgcauccucaacgagaaggucaacacccccaccaccaccgucuaccgcugcggcccccucaucgaccucugccgcggcccccacguccgccacaccggcaagaucaaggcccucaagauccacaagaacuccuccaccuacugggagggcaaggccgacauggagacccuccagcgcaucuacggcaucuccuuccccgaccccaagaugcucaaggagugggagaaguuccaggaggaggccaagaaccgcgaccaccgcaagaucggccgcgaccaggagcucuacuucuuccacgagcucucccccggcuccugcuucuuccuccccaagggcgccuacaucuacaacgcccucaucgaguucauccgcuccgaguaccgcaagcgcggcuuccaggaggucgucacccccaacaucuucaacucccgccucuggaugaccuccggccacuggcagcacuacuccgagaacauguucuccuucgaggucgagaaggagcucuucgcccucaagcccaugaacugccccggccacugccucauguucgaccaccgcccccgcuccuggcgcgagcucccccuccgccucgccgacuucggcguccuccaccgcaacgagcucuccggcgcccucaccggccucacccgcguccgccgcuuccagcaggacgacgcccacaucuucugcgccauggagcagaucgaggacgagaucaagggcugccucgacuuccuccgcaccgucuacuccgucuucggcuucuccuucaagcucaaccucuccacccgccccgagaaguuccucggcgacaucgaggucugggaccaggccgagaagcagcucgagaacucccucaacgaguucggcgagaagugggagcucaacuccggcgacggcgccuucuacggccccaagaucgacauccagaucaaggacgccaucggccgcuaccaccagugcgccaccauccagcucgacuuccagcuccccauccgcuucaaccucaccuacgucucccacgacggcgacgacaagaagcgccccgucaucguccaccgcgccauccucggcuccgucgagcgcaugaucgccauccucaccgagaacuacggcggcaaguggcccuucuggcucuccccccgccaggucauggucguccccgucggccccaccugcgacgaguacgcccagaagguccgccagcaguuccacgacgccaaguucauggccgacaucgaccucgaccccggcugcacccucaacaagaagauccgcaacgcccagcucgcccaguacaacuucauccucgucgucggcgagaaggagaagaucuccggcaccgucaacauccgcacccgcgacaacaagguccacggcgagcgcaccaucuccgagaccaucgagcgccuccagcagcucaaggaguuccgcuccaagcaggccgaggaggaguucuga

SEQ ID NO: 50483 - RNA, 2409 nt, Artificial Sequence
  derived and/or modified sequence opt2 from TARSL2__Homo_sapiens__NP_689547
auggccgccgaggcccucgccgccgaggccgucgccucccgccucgagcgccaggaggaggacauccgcuggcucugguccgaggucgagcgccuccgcgacgagcagcucaacgcccccuacuccugccaggccgagggccccugccucacccgcgaggucgcccagcuccgcgccgagaacugcgaccuccgccaccgccucugcucccuccgccucugccucgccgaggagcgcucccgccaggccacccucgaguccgccgagcucgaggccgcccaggaggccggcgcccagcccccccccucccagucccaggacaaggacaugaagaagaagaagaugaaggaguccgaggccgacuccgaggucaagcaccagcccaucuucaucaaggagcgccucaagcucuucgagauccucaagaaggaccaccagcuccuccucgccaucuacggcaagaagggcgacaccuccaacaucaucaccguccgcgucgccgacggccagaccguccagggcgaggucuggaagaccacccccuaccaggucgccgccgagaucucccaggagcucgccgaguccaccgucaucgccaaggucaacggcgagcucugggaccucgaccgcccccucgagggcgacuccucccucgagcuccucaccuucgacaacgaggaggcccaggccgucuacuggcacuccuccgcccacauccucggcgaggccauggagcucuacuacggcggccaccucugcuacggcccccccaucgagaacggcuucuacuacgacauguucaucgaggaccgcgccgucuccuccaccgagcucuccgcccucgagaacaucugcaaggccaucaucaaggagaagcagcccuucgagcgccucgaggucuccaaggagauccuccucgagauguucaaguacaacaaguucaagugccgcauccucaacgagaaggucaacaccgccaccaccaccgucuaccgcugcggcccccucaucgaccucugcaagggcccccacguccgccacaccggcaagaucaagaccaucaagaucuucaagaacuccuccaccuacugggagggcaaccccgagauggagacccuccagcgcaucuacggcaucuccuuccccgacaacaagaugaugcgcgacugggagaaguuccaggaggaggccaagaaccgcgaccaccgcaagaucggcaaggagcaggagcucuucuucuuccacgaccucucccccggcuccugcuucuuccucccccgcggcgccuucaucuacaacacccucaccgacuucauccgcgaggaguaccacaagcgcgacuucaccgagguccucucccccaacauguacaacuccaagcucugggaggccuccggccacuggcagcacuacuccgagaacauguucaccuucgagaucgagaaggacaccuucgcccucaagcccaugaacugccccggccacugccucauguucgcccaccgcccccgcuccuggcgcgagaugcccauccgcuucgccgacuucggcguccuccaccgcaacgagcucuccggcacccucuccggccucacccgcguccgccgcuuccagcaggacgacgcccacaucuucugcaccgucgagcagaucgaggaggagaucaagggcugccuccaguuccuccaguccgucuacuccaccuucggcuucuccuuccagcucaaccucuccacccgccccgagaacuuccucggcgagaucgagauguggaacgaggccgagaagcagcuccagaacucccucauggacuucggcgagcccuggaagaugaaccccggcgacggcgccuucuacggccccaagaucgacaucaagaucaaggacgccaucggccgcuaccaccagugcgccaccauccagcucgacuuccagcuccccauccgcuucaaccucaccuacgucuccaaggacggcgacgacaagaagcgccccgucaucauccaccgcgccauccucggcuccgucgagcgcaugaucgccauccucuccgagaacuacggcggcaaguggcccuucuggcucuccccccgccaggucauggucauccccgucggccccaccugcgagaaguacgcccuccaggucuccuccgaguucuucgaggagggcuucauggccgacgucgaccucgaccacuccugcacccucaacaagaagauccgcaacgcccagcucgcccaguacaacuucauccucgucgucggcgagaaggagaagaucgacaacgccgucaacguccgcacccgcgacaacaagauccacggcgagauccucgucaccuccgccaucgacaagcucaagaaccuccgcaagacccgcacccucaacgccgaggaggccuucuga

SEQ ID NO: 50484 - RNA, 924 nt, Artificial Sequence
  derived and/or modified sequence opt2 from TAS2R10__Homo_sapiens__NP_076410
augcuccgcgucgucgagggcaucuucaucuucgucgucgucuccgaguccgucuucggcguccucggcaacggcuucaucggccucgucaacugcaucgacugcgccaagaacaagcucuccaccaucggcuucauccucaccggccucgccaucucccgcaucuuccucaucuggaucaucaucaccgacggcuucauccagaucuucucccccaacaucuacgccuccggcaaccucaucgaguacaucuccuacuucugggucaucggcaaccaguccuccaugugguucgccaccucccucuccaucuucuacuuccucaagaucgccaacuucuccaacuacaucuuccucuggcucaagucccgcaccaacaugguccuccccuucaugaucgucuuccuccucaucuccucccuccucaacuucgccuacaucgccaagauccucaacgacuacaagaccaagaacgacaccgucugggaccucaacauguacaaguccgaguacuucaucaagcagauccuccucaaccucggcgucaucuucuucuucacccucucccucaucaccugcaucuuccucaucaucucccucuggcgccacaaccgccagaugcaguccaacgucaccggccuccgcgacuccaacaccgaggcccacgucaaggccaugaagguccucaucuccuucaucauccucuucauccucuacuucaucggcauggccaucgagaucuccugcuucaccguccgcgagaacaagcuccuccucauguucggcaugaccaccaccgccaucuaccccuggggccacuccuucauccucauccucggcaacuccaagcucaagcaggccucccuccgcguccuccagcagcucaagugcugcgagaagcgcaagaaccuccgcgucaccuga

SEQ ID NO: 50485 - RNA, 912 nt, Artificial Sequence
  derived and/or modified sequence opt2 from TAS2R13__Homo_sapiens__NP_076409
auggaguccgcccuccccuccaucuucacccucgucaucaucgccgaguucaucaucggcaaccucuccaacggcuucaucguccucaucaacugcaucgacugggucuccaagcgcgagcucuccuccgucgacaagcuccucaucauccucgccaucucccgcaucggccucaucugggagauccucgucuccugguuccucgcccuccacuaccucgccaucuucgucuccggcaccggccuccgcaucaugaucuucuccuggaucgucuccaaccacuucaaccucuggcucgccaccaucuucuccaucuucuaccuccucaagaucgccuccuucuccucccccgccuuccucuaccucaaguggcgcgucaacaaggucauccucaugauccuccucggcacccucgucuuccucuuccucaaccucauccagaucaacaugcacaucaaggacuggcucgaccgcuacgagcgcaacaccaccuggaacuucuccauguccgacuucgagaccuucuccgucuccgucaaguucaccaugaccauguucucccucacccccuucaccgucgccuucaucuccuuccuccuccucaucuucucccuccagaagcaccuccagaagaugcagcucaacuacaagggccaccgcgacccccgcaccaagguccacaccaacgcccucaagaucgucaucuccuuccuccucuucuacgccuccuucuuccucugcguccucaucuccuggaucuccgagcucuaccagaacaccgucaucuacaugcucugcgagaccaucggcgucuucucccccuccucccacuccuuccuccucauccucggcaacgccaagcuccgccaggccuuccuccucgucgccgccaaggucugggccaagcgcuga

SEQ ID NO: 50486 - RNA, 954 nt, Artificial Sequence
  derived and/or modified sequence opt2 from TAS2R14__Homo_sapiens__NP_076411
augggcggcgucaucaaguccaucuucaccuucguccucaucgucgaguucaucaucggcaaccucggcaacuccuucaucgcccucgucaacugcaucgacugggucaagggccgcaagaucuccuccgucgaccgcauccucaccgcccucgccaucucccgcaucucccucgucuggcucaucuucggcuccuggugcgucuccgucuucuuccccgcccucuucgccaccgagaagauguuccgcaugcucaccaacaucuggaccgucaucaaccacuucuccgucuggcucgccaccggccucggcaccuucuacuuccucaagaucgccaacuucuccaacuccaucuuccucuaccucaaguggcgcgucaagaaggucguccucguccuccuccucgucaccuccgucuuccucuuccucaacaucgcccucaucaacauccacaucaacgccuccaucaacggcuaccgccgcaacaagaccugcuccuccgacuccuccaacuucacccgcuucuccucccucaucguccucaccuccaccgucuucaucuucauccccuucacccucucccucgccauguuccuccuccucaucuucuccauguggaagcaccgcaagaagaugcagcacaccgucaagaucuccggcgacgccuccaccaaggcccaccgcggcgucaaguccgucaucaccuucuuccuccucuacgccaucuucucccucuccuucuucaucuccgucuggaccuccgagcgccucgaggagaaccucaucauccucucccaggucaugggcauggccuaccccuccugccacuccugcguccucauccucggcaacaagaagcuccgccaggccucccucuccguccuccucuggcuccgcuacauguucaaggacggcgagcccuccggccacaaggaguuccgcgaguccuccuga

SEQ ID NO: 50487 - RNA, 876 nt, Artificial Sequence
  derived and/or modified sequence opt2 from TAS2R16__Homo_sapiens__NP_058641
augauccccauccagcucaccgucuucuucaugaucaucuacguccucgagucccucaccaucaucguccaguccucccucaucgucgccguccucggccgcgaguggcuccagguccgccgccucaugcccgucgacaugauccucaucucccucggcaucucccgcuucugccuccagugggccuccaugcucaacaacuucugcuccuacuucaaccucaacuacguccucugcaaccucaccaucaccugggaguucuucaacauccucaccuucuggcucaacucccuccucaccgucuucuacugcaucaaggucuccuccuucacccaccacaucuuccucuggcuccgcuggcgcauccuccgccucuuccccuggauccuccucggcucccucaugaucaccugcgucaccaucauccccuccgccaucggcaacuacauccagauccagcuccucaccauggagcaccucccccgcaacuccaccgucaccgacaagcucgagaacuuccaccaguaccaguuccaggcccacaccgucgcccucgucauccccuucauccucuuccucgccuccaccaucuuccucauggccucccucaccaagcagauccagcaccacuccaccggccacugcaaccccuccaugaaggcccgcuucaccgcccuccgcucccucgccguccucuucaucgucuucaccuccuacuuccucaccauccucaucaccaucaucggcacccucuucgacaagcgcugcuggcucugggucugggaggccuucgucuacgccuucauccucaugcacuccaccucccucaugcucuccucccccacccucaagcgcauccucaagggcaagugcuga

SEQ ID NO: 50488 - RNA, 900 nt, Artificial Sequence
  derived and/or modified sequence opt2 from TAS2R1__Homo_sapiens__NP_062545
augcucgagucccaccucaucaucuacuuccuccucgccgucauccaguuccuccucggcaucuucaccaacggcaucaucgucgucgucaacggcaucgaccucaucaagcaccgcaagauggccccccucgaccuccuccucuccugccucgccgucucccgcaucuuccuccagcucuucaucuucuacgucaacgucaucgucaucuucuucaucgaguucaucaugugcuccgccaacugcgccauccuccucuucaucaacgagcucgagcucuggcucgccaccuggcucggcgucuucuacugcgccaaggucgccuccguccgccacccccucuucaucuggcucaagaugcgcaucuccaagcucguccccuggaugauccucggcucccuccucuacgucuccaugaucugcgucuuccacuccaaguacgccggcuucaugguccccuacuuccuccgcaaguucuucucccagaacgccaccauccagaaggaggacacccucgccauccagaucuucuccuucgucgccgaguucuccgucccccuccucaucuuccucuucgccguccuccuccucaucuucucccucggccgccacacccgccagaugcgcaacaccgucgccggcucccgcguccccggccgcggcgcccccaucuccgcccuccucuccauccucuccuuccucauccucuacuucucccacugcaugaucaaggucuuccucuccucccucaaguuccacauccgccgcuucaucuuccucuucuucauccucgucaucggcaucuaccccuccggccacucccucauccucauccucggcaaccccaagcucaagcagaacgccaagaaguuccuccuccacuccaagugcugccaguga

SEQ ID NO: 50489 - RNA, 1002 nt, Artificial Sequence
  derived and/or modified sequence opt2 from TAS2R38__Homo_sapiens__NP_789787
augcucacccucacccgcauccgcaccgucuccuacgagguccgcuccaccuuccucuucaucuccguccucgaguucgccgucggcuuccucaccaacgccuucgucuuccucgucaacuucugggacgucgucaagcgccaggcccucuccaacuccgacugcguccuccucugccucuccaucucccgccucuuccuccacggccuccucuuccucuccgccauccagcucacccacuuccagaagcucuccgagccccucaaccacuccuaccaggccaucaucaugcucuggaugaucgccaaccaggccaaccucuggcucgccgccugccucucccuccucuacugcuccaagcucauccgcuucucccacaccuuccucaucugccucgccuccugggucucccgcaagaucucccagaugcuccucggcaucauccucugcuccugcaucugcaccguccucugcgucuggugcuucuucucccgcccccacuucaccgucaccaccguccucuucaugaacaacaacacccgccucaacuggcagaucaaggaccucaaccucuucuacuccuuccucuucugcuaccucugguccgucccccccuuccuccucuuccucgucuccuccggcaugcucaccgucucccucggccgccacaugcgcaccaugaaggucuacacccgcaacucccgcgaccccucccucgaggcccacaucaaggcccucaagucccucgucuccuucuucugcuucuucgucaucuccuccugcgucgccuucaucuccgucccccuccucauccucuggcgcgacaagaucggcgucauggucugcgucggcaucauggccgccugccccuccggccacgccgccauccucaucuccggcaacgccaagcuccgccgcgccgucaugaccauccuccucugggcccaguccucccucaagguccgcgccgaccacaaggccgacucccgcacccucugcuga

SEQ ID NO: 50490 - RNA, 900 nt, Artificial Sequence
  derived and/or modified sequence opt2 from TAS2R50__Homo_sapiens__NP_795371
augaucaccuuccucuacaucuucuucuccauccucaucaugguccucuucguccucggcaacuucgccaacggcuucaucgcccucgucaacuucaucgacugggucaagcgcaagaagaucuccuccgccgaccagauccucaccgcccucgccgucucccgcaucggccuccucugggcccuccuccucaacugguaccucaccguccucaaccccgccuucuacuccgucgagcuccgcaucaccuccuacaacgccugggucgucaccaaccacuucuccauguggcucgccgccaaccucuccaucuucuaccuccucaagaucgccaacuucuccaaccuccucuuccuccaccucaagcgccgcguccgcuccgucauccucgucauccuccucggcacccucaucuuccucgucugccaccuccucgucgccaacauggacgaguccaugugggccgaggaguacgagggcaacaugaccggcaagaugaagcuccgcaacaccguccaccucuccuaccucaccgucaccacccucugguccuucauccccuucacccucucccucaucuccuuccucaugcucaucugcucccucugcaagcaccucaagaagaugcagcuccacggcgagggcucccaggaccucuccaccaagguccacaucaaggcccuccagacccucaucuccuuccuccuccucugcgccaucuucuuccucuuccucaucgucuccgucugguccccccgccgccuccgcaacgaccccgucgucauggucuccaaggccgucggcaacaucuaccucgccuucgacuccuucauccucaucuggcgcaccaagaagcucaagcacaccuuccuccucauccucugccagauccgcugcuga

SEQ ID NO: 50491 - RNA, 957 nt, Artificial Sequence
  derived and/or modified sequence opt2 from TAS2R60__Homo_sapiens__NP_803186
augaacggcgaccacaugguccucggcuccuccgucaccgacaagaaggccaucauccucgucaccauccuccuccuccuccgccucgucgccaucgccggcaacggcuucaucaccgccgcccucggcgucgaguggguccuccgccgcaugcuccuccccugcgacaagcuccucgucucccucggcgccucccgcuucugccuccaguccgucgucaugggcaagaccaucuacgucuuccuccaccccauggccuuccccuacaaccccguccuccaguuccucgccuuccagugggacuuccucaacgccgccacccucugguccuccaccuggcucuccgucuucuacugcgucaagaucgccaccuucacccaccccgucuucuucuggcucaagcacaagcucuccggcuggcuccccuggaugcucuucuccuccgucggccucuccuccuucaccaccauccucuucuucaucggcaaccaccgcauguaccagaacuaccuccgcaaccaccuccagcccuggaacgucaccggcgacuccauccgcuccuacugcgagaaguucuaccucuucccccucaagaugaucaccuggaccaugcccaccgccgucuucuucaucugcaugauccuccucaucaccucccucggccgccaccgcaagaaggcccuccucaccaccuccggcuuccgcgagcccuccguccaggcccacaucaaggcccuccucgcccuccucuccuucgccaugcucuucaucuccuacuuccucucccucgucuucuccgccgccggcaucuuccccccccucgacuucaaguucugggucugggaguccgucaucuaccucugcgccgccguccaccccaucauccuccucuucuccaacugccgccuccgcgccguccucaagucccgccgcuccucccgcugcggcacccccuga

SEQ ID NO: 50492 - RNA, 939 nt, Artificial Sequence
  derived and/or modified sequence opt2 from TAS2R9__Homo_sapiens__NP_076406
augcccuccgccaucgaggccaucuacaucauccucaucgccggcgagcucaccaucggcaucuggggcaacggcuucaucguccucgucaacugcaucgacuggcucaagcgccgcgacaucucccucaucgacaucauccucaucucccucgccaucucccgcaucugccuccucugcgucaucucccucgacggcuucuucaugcuccucuuccccggcaccuacggcaacuccguccucgucuccaucgucaacgucgucuggaccuucgccaacaacuccucccucugguucaccuccugccucuccaucuucuaccuccucaagaucgccaacaucucccaccccuucuucuucuggcucaagcucaagaucaacaaggucaugcucgccauccuccucggcuccuuccucaucucccucaucaucuccguccccaagaacgacgacaugugguaccaccucuucaaggucucccacgaggagaacaucaccuggaaguucaaggucuccaagauccccggcaccuucaagcagcucacccucaaccucggcgucaugguccccuucauccucugccucaucuccuucuuccuccuccucuucucccucguccgccacaccaagcagauccgccuccacgccaccggcuuccgcgaccccuccaccgaggcccacaugcgcgccaucaaggccgucaucaucuuccuccuccuccucaucgucuacuaccccgucuuccucgucaugaccuccuccgcccucaucccccagggcaagcucguccucaugaucggcgacaucgucaccgucaucuuccccuccucccacuccuucauccucaucaugggcaacuccaagcuccgcgaggccuuccucaagaugcuccgcuucgucaagugcuuccuccgccgccgcaagcccuucguccccuga

SEQ ID NO: 50493 - RNA, 1263 nt, Artificial Sequence
  derived and/or modified sequence opt2 from TASP1__Homo_sapiens__NP_060184
augaccauggagaagggcauguccuccggcgagggccuccccucccgcuccucccaggucuccgccggcaagaucaccgccaaggagcucgagaccaagcaguccuacaaggagaagcgcggcggcuucguccucguccacgccggcgccggcuaccacuccgaguccaaggccaaggaguacaagcacgucugcaagcgcgccugccagaaggccaucgagaagcuccaggccggcgcccucgccaccgacgccgucaccgccgcccucgucgagcucgaggacucccccuucaccaacgccggcaugggcuccaaccucaaccuccucggcgagaucgagugcgacgccuccaucauggacggcaagucccucaacuucggcgccgucggcgcccucuccggcaucaagaaccccgucuccgucgccaaccgccuccucugcgagggccagaagggcaagcucuccgccggccgcaucccccccugcuuccucgucggcgagggcgccuaccgcugggccgucgaccacggcauccccuccugcccccccaacaucaugaccacccgcuucucccucgccgccuucaagcgcaacaagcgcaagcucgagcucgccgagcgcgucgacaccgacuucaugcagcucaagaagcgccgccaguccuccgagaaggagaacgacuccggcacccucgacaccgucggcgccgucgucgucgaccacgagggcaacgucgccgccgccgucuccuccggcggccucgcccucaagcaccccggccgcgucggccaggccgcccucuacggcugcggcugcugggccgagaacaccggcgcccacaaccccuacuccaccgccgucuccaccuccggcugcggcgagcaccucguccgcaccauccucgcccgcgagugcucccacgcccuccaggccgaggacgcccaccaggcccuccucgagaccaugcagaacaaguucaucuccucccccuuccucgccuccgaggacggcguccucggcggcgucaucguccuccgcuccugccgcugcuccgccgagcccgacuccucccagaacaagcagacccuccucgucgaguuccucuggucccacaccaccgaguccaugugcgucggcuacauguccgcccaggacggcaaggccaagacccacaucucccgccucccccccggcgccgucgccggccaguccgucgccaucgagggcggcgucugccgccucgagucccccgucaacuga

SEQ ID NO: 50494 - RNA, 753 nt, Artificial Sequence
  derived and/or modified sequence opt2 from TATDN1__Homo_sapiens__NP_001139632
augaucaccggcggcaaccuccaggacuccaaggacgcccuccaccucgcccagaccaacggcauguucuucuccaccgucggcugccaccccacccgcugcggcgaguucgagaagaacaaccccgaccucuaccucaaggagcuccucaaccucgccgagaacaacaagggcaaggucgucgccaucggcgagugcggccucgacuucgaccgccuccaguucugccccaaggacacccagcucaaguacuucgagaagcaguucgagcucuccgagcagaccaagcuccccauguuccuccacugccgcaacucccacgccgaguuccucgacaucaugaagcgcaaccgcgaccgcugcgucggcggcgucguccacuccuucgacggcaccaaggaggccgccgccgcccucaucgaccucgaccucuacaucggcuucaacggcugcucccucaagaccgaggccaaccucgagguccucaaguccauccccuccgagaagcucaugaucgagaccgacgcccccuggugcggcgucaaguccacccacgccggcuccaaguacauccgcaccgccuuccccaccaagaagaagugggaguccggccacugccucaaggaccgcaacgagcccugccacaucauccagauccucgagaucauguccgccguccgcgacgaggacccccucgagcucgccaacacccucuacaacaacaccaucaaggucuucuuccccggcaucuga

SEQ ID NO: 50495 - RNA, 1365 nt, Artificial Sequence
  derived and/or modified sequence opt2 from TAT__Homo_sapiens__NP_000344
auggaccccuacaugauccagauguccuccaagggcaaccuccccuccauccucgacguccacgucaacgucggcggccgcuccuccguccccggcaagaugaagggccgcaaggcccgcugguccguccgccccuccgacauggccaagaagaccuucaaccccauccgcgccaucgucgacaacaugaaggucaagcccaaccccaacaagaccaugaucucccucuccaucggcgaccccaccgucuucggcaaccuccccaccgaccccgaggucacccaggccaugaaggacgcccucgacuccggcaaguacaacggcuacgcccccuccaucggcuuccucuccucccgcgaggagaucgccuccuacuaccacugccccgaggccccccucgaggccaaggacgucauccucaccuccggcugcucccaggccaucgaccucugccucgccguccucgccaaccccggccagaacauccucgucccccgccccggcuucucccucuacaagacccucgccgaguccaugggcaucgaggucaagcucuacaaccuccuccccgagaaguccugggagaucgaccucaagcagcucgaguaccucaucgacgagaagaccgccugccucaucgucaacaaccccuccaaccccugcggcuccgucuucuccaagcgccaccuccagaagauccucgccgucgccgcccgccagugcguccccauccucgccgacgagaucuacggcgacauggucuucuccgacugcaaguacgagccccucgccacccucuccaccgacguccccauccucuccugcggcggccucgccaagcgcuggcucguccccggcuggcgccucggcuggauccucauccacgaccgccgcgacaucuucggcaacgagauccgcgacggccucgucaagcucucccagcgcauccucggccccugcaccaucguccagggcgcccucaaguccauccucugccgcacccccggcgaguucuaccacaacacccucuccuuccucaaguccaacgccgaccucugcuacggcgcccucgccgccauccccggccuccgccccguccgccccuccggcgccauguaccucauggucggcaucgagauggagcacuuccccgaguucgagaacgacgucgaguucaccgagcgccucgucgccgagcaguccguccacugccuccccgccaccugcuucgaguaccccaacuucauccgcgucgucaucaccguccccgaggucaugaugcucgaggccugcucccgcauccaggaguucugcgagcagcacuaccacugcgccgagggcucccaggaggagugcgacaaguga

SEQ ID NO: 50496 - RNA, 2244 nt, Artificial Sequence
  derived and/or modified sequence opt2 from TAX1BP1__Homo_sapiens__NP_001073333
augaccuccuuccaggaggucccccuccagaccuccaacuucgcccacgucaucuuccagaacgucgccaaguccuaccuccccaacgcccaccucgagugccacuacacccucacccccuacauccacccccaccccaaggacugggucggcaucuucaaggucggcugguccaccgcccgcgacuacuacaccuuccucuggucccccaugcccgagcacuacgucgagggcuccaccgucaacugcguccucgccuuccagggcuacuaccuccccaacgacgacggcgaguucuaccaguucugcuacgucacccacaagggcgagauccgcggcgccuccacccccuuccaguuccgcgccuccucccccgucgaggagcuccucaccauggaggacgagggcaacuccgacaugcucgucgucaccaccaaggccggccuccucgagcucaagaucgagaagaccaugaaggagaaggaggagcuccucaagcucaucgccguccucgagaaggagaccgcccagcuccgcgagcaggucggccgcauggagcgcgagcucaaccacgagaaggagcgcugcgaccagcuccaggccgagcagaagggccucaccgaggucacccagucccucaagauggagaacgaggaguucaagaagcgcuucuccgacgccaccuccaaggcccaccagcucgaggaggacaucgucuccgucacccacaaggccaucgagaaggagaccgagcucgacucccucaaggacaagcucaagaaggcccagcacgagcgcgagcagcucgagugccagcucaagaccgagaaggacgagaaggagcucuacaagguccaccucaagaacaccgagaucgagaacaccaagcucauguccgagguccagacccucaagaaccucgacggcaacaaggaguccgucaucacccacuucaaggaggagaucggccgccuccagcucugccucgccgagaaggagaaccuccagcgcaccuuccuccucaccaccuccuccaaggaggacaccugcuuccucaaggagcagcuccgcaaggccgaggagcagguccaggccacccgccaggaggucgucuuccucgccaaggagcucuccgacgccgucaacguccgcgaccgcaccauggccgaccuccacaccgcccgccucgagaacgagaaggucaagaagcagcucgccgacgccgucgccgagcucaagcucaacgccaugaagaaggaccaggacaagaccgacacccucgagcacgagcuccgccgcgaggucgaggaccucaagcuccgccuccagauggccgccgaccacuacaaggagaaguucaaggagugccagcgccuccagaagcagaucaacaagcucuccgaccaguccgccaacaacaacaacgucuucaccaagaagaccggcaaccagcagaaggucaacgacgccuccgucaacaccgaccccgccaccuccgccuccaccgucgacgucaagcccucccccuccgccgccgaggccgacuucgacaucgucaccaagggccaggucugcgagaugaccaaggagaucgccgacaagaccgagaaguacaacaagugcaagcagcuccuccaggacgagaaggccaagugcaacaaguacgccgacgagcucgccaagauggagcucaaguggaaggagcaggucaagaucgccgagaacgucaagcucgagcucgccgagguccaggacaacuacaaggagcucaagcgcucccucgagaaccccgccgagcgcaagauggaggacggcgccgacggcgccuucuaccccgacgagauccagcgcccccccguccgcguccccuccuggggccucgaggacaacgucgucugcucccagcccgcccgcaacuucucccgccccgacggccucgaggacuccgaggacuccaaggaggacgagaacguccccaccgcccccgacccccccucccagcaccuccgcggccacggcaccggcuucugcuucgacuccuccuucgacguccacaagaagugcccccucugcgagcucauguucccccccaacuacgaccaguccaaguucgaggagcacgucgagucccacuggaaggucugccccaugugcuccgagcaguucccccccgacuacgaccagcaggucuucgagcgccacguccagacccacuucgaccagaacguccucaacuucgacuga

SEQ ID NO: 50497 - RNA, 375 nt, Artificial Sequence
  derived and/or modified sequence opt2 from TAX1BP3__Homo_sapiens__NP_055419
auguccuacauccccggccagcccgucaccgccgucguccagcgcgucgagauccacaagcuccgccagggcgagaaccucauccucggcuucuccaucggcggcggcaucgaccaggaccccucccagaaccccuucuccgaggacaagaccgacaagggcaucuacgucacccgcgucuccgagggcggccccgccgagaucgccggccuccagaucggcgacaagaucaugcaggucaacggcugggacaugaccauggucacccacgaccaggcccgcaagcgccucaccaagcgcuccgaggaggucguccgccuccucgucacccgccagucccuccagaaggccguccagcaguccaugcucuccuga

SEQ ID NO: 50498 - RNA, 879 nt, Artificial Sequence
  derived and/or modified sequence opt2 from TAZ__Homo_sapiens__NP_000107
augccccuccacgucaaguggcccuuccccgccguccccccccucaccuggacccucgccuccuccgucgucaugggccucgucggcaccuacuccugcuucuggaccaaguacaugaaccaccucaccguccacaaccgcgagguccucuacgagcucaucgagaagcgcggccccgccaccccccucaucaccgucuccaaccaccaguccugcauggacgacccccaccucuggggcauccucaagcuccgccacaucuggaaccucaagcucaugcgcuggacccccgccgccgccgacaucugcuucaccaaggagcuccacucccacuucuucucccucggcaagugcguccccgucugccgcggcgccgaguucuuccaggccgagaacgagggcaagggcguccucgacaccggccgccacaugcccggcgccggcaagcgccgcgagaagggcgacggcgucuaccagaagggcauggacuucauccucgagaagcucaaccacggcgacuggguccacaucuuccccgagggcaaggucaacauguccuccgaguuccuccgcuucaaguggggcaucggccgccucaucgccgagugccaccucaaccccaucauccucccccucuggcacgucggcaugaacgacguccuccccaacuccccccccuacuucccccgcuucggccagaagaucaccguccucaucggcaagcccuucuccgcccuccccguccucgagcgccuccgcgccgagaacaaguccgccgucgagaugcgcaaggcccucaccgacuucauccaggaggaguuccagcaccucaagacccaggccgagcagcuccacaaccaccuccagcccggccgcuga

SEQ ID NO: 50499 - RNA, 1482 nt, Artificial Sequence
  derived and/or modified sequence opt2 from TBATA__Homo_sapiens__XP_011537769
auggccaccgacguccagcucgccgacuacccccucauguccccccgcucccuccgcggcgaguggcgcauggagcaggagacccagggccccucccagugguccccccagcgcguccgcggccgccacgcccuccucuccaccucccgcguccaccucuacuccaagcgcacccccuucucccagggccaccgcgagaagggcaugcagaccgccaucucccccaaggccgagcucaagcucgagaagaaguccggccgcaagccccgcuccccccgcgacuccggcccccagaaggagcucgucauccccggcaucgucgacuucgagcgcauccgccgcgcccuccgcacccccaagccccagacccccggcaccuacugcuucggccgccucucccaccacuccuucuucucccgccaccacccccacccccagcacgucacccacauccaggaccucaccggcaagcccgucugcgucguccgcgacuuccccgccccccuccccgaguccaccgucuucuccggcugccagaugggcauccccaccaucuccguccccaucggcgacccccaguccaaccgcaacccccagcucuccuccgccuggaagaaggagcucaaggagcucgccucccgcgucgccuuccucaccaaggaggacgagcucaagaagaaggaggacaccaccucccucaacuggaacugcaagucccgccgcccccaggcccccggccucuccggcaccgaccucggcgccgccgagcucggcaucaagaaggagcagaaggaggagccccuccgcgagcagggcgccaaguacuccgccgagaccggccgccucauccccgccuccacccgcgccgucggccgccgccgcucccaccagggccagcagucccaguccuccucccgccacgagggcguccaggccuuccuccuccaggaccaggagcuccucguccucgagcuccucugccgcauccucgagaccgaccuccucuccgccauccaguucuggcuccucuacgccccccccaaggagaaggaccucgcccucggccuccuccagaccgccgucgcccagcuccucccccagccccucgucuccauccccaccgagaagcuccucucccagcuccccgagguccacgagcccccccaggagaagcaggagccccccugccgcugggccccccaccccgcccuccccuucugcucccuccucuccucccaguccauccccgaggagaacgaggacaucaccuucuacaagaagcgcaagacccgcguccacuggcgcuccuccuccccccccgacgccuucaagcccgagcaccgcgaggaggacaucgaggccgagggccgcgagcuccgcggccccaacaccugcaccugccucgcccaggagcagccccagggcuuccgcggcgucuccgucuccaccaccuucaccgccguccccgacucccuccccuga

SEQ ID NO: 50500 - RNA, 2025 nt, Artificial Sequence
  derived and/or modified sequence opt2 from TBC1D15__Homo_sapiens__NP_001139685
auggccgccgccggcgucgucuccggcaagaucaucuacgagcaggagggcgucuacauccacuccuccugcggcaagaccaacgaccaggacggccucaucuccggcauccuccgcguccucgagaaggacgccgaggucaucgucgacuggcgcccccucgacgacgcccucgacuccuccuccauccucuacgcccgcaaggacuccuccuccgucgucgaguggacccaggcccccaaggagcgcggccaccgcggcuccgagcaccucaacuccuacgaggccgagugggacauggucaacaccgucuccuucaagcgcaagccccacaccaacggcgacgcccccucccaccgcaacggcaaguccaagugguccuuccucuucucccucaccgaccucaaguccaucaagcagaacaaggagggcaugggcugguccuaccucgucuucugccucaaggacgacgucguccuccccgcccuccacuuccaccagggcgacuccaagcuccucaucgagucccucgagaaguacgucguccucugcgaguccccccaggacaagcgcacccuccucgucaacugccagaacaagucccucucccaguccuucgagaaccuccucgacgagcccgccuacggccucauccagaagaucaagaaggaccccuacaccgccaccaugaucggcuucuccaaggucaccaacuacaucuucgacucccuccgcggcuccgaccccuccacccaccagcgcccccccuccgagauggccgacuuccucuccgacgccauccccggccucaagaucaaccagcaggaggagcccggcuucgaggucaucacccgcaucgaccucggcgagcgccccgucguccagcgccgcgagcccgucucccucgaggaguggaccaagaacaucgacuccgagggccgcauccucaacgucgacaacaugaagcagaugaucuuccgcggcggccucucccacgcccuccgcaagcaggccuggaaguuccuccucggcuacuuccccugggacuccaccaaggaggagcgcacccagcuccagaagcagaagaccgacgaguacuuccgcaugaagcuccaguggaaguccaucucccaggagcaggagaagcgcaacucccgccuccgcgacuaccgcucccucaucgagaaggacgucaaccgcaccgaccgcaccaacaaguucuacgagggccaggacaaccccggccucauccuccuccacgacauccucaugaccuacugcauguacgacuucgaccucggcuacguccagggcauguccgaccuccucuccccccuccucuacgucauggagaacgaggucgacgccuucuggugcuucgccuccuacauggaccagaugcaccagaacuucgaggagcagaugcagggcaugaagacccagcucauccagcucuccacccuccuccgccuccucgacuccggcuucugcuccuaccucgagucccaggacuccggcuaccucuacuucugcuuccgcuggcuccucauccgcuucaagcgcgaguucuccuuccucgacauccuccgccucugggaggucauguggaccgagcuccccugcaccaacuuccaccuccuccucugcugcgccauccucgaguccgagaagcagcagaucauggagaagcacuacggcuucaacgagauccucaagcacaucaacgagcucuccaugaagaucgacgucgaggacauccucugcaaggccgaggccaucucccuccagauggucaagugcaaggagcucccccaggccgucugcgagauccucggccuccagggcuccgaggucaccacccccgacuccgacgucggcgaggacgagaacgucgucaugacccccugccccaccuccgccuuccaguccaacgcccuccccacccucuccgccuccggcgcccgcaacgacucccccacccagauccccgucuccuccgacgucugccgccucacccccgccuga

SEQ ID NO: 50501 - RNA, 1218 nt, Artificial Sequence
  derived and/or modified sequence opt2 from TBC1D16__Homo_sapiens__NP_001258774
augaaggucgcccccgacaagaccugcaugcaguucuccauccgccgccccaagcuccccuccuccgagacccaccccgaggaguccauguacaagcgccucggcgucuccgccuggcucaaccaccucaacgagcucggccaggucgaggaggaguacaagcuccgcaaggccaucuucuucggcggcaucgacgucuccauccgcggcgaggucuggcccuuccuccuccgcuacuacucccacgaguccaccuccgaggagcgcgaggcccuccgccuccagaagcgcaaggaguacuccgagauccagcagaagcgccucuccaugacccccgaggagcaccgcgccuucuggcgcaacguccaguucaccgucgacaaggacgucguccgcaccgaccgcaacaaccaguucuuccgcggcgaggacaaccccaacgucgaguccaugcgccgcauccuccucaacuacgccgucuacaaccccgccgucggcuacucccagggcauguccgaccucgucgcccccauccucgccgagguccucgacgaguccgacaccuucuggugcuucgucggccucaugcagaacaccaucuucgucuccuccccccgcgacgaggacauggagaagcagcuccucuaccuccgcgagcuccuccgccucacccacguccgcuucuaccagcaccucgucucccucggcgaggacggccuccagaugcucuucugccaccgcuggcuccuccucugcuucaagcgcgaguuccccgaggccgaggcccuccgcaucugggaggccugcugggcccacuaccagaccgacuacuuccaccucuucaucugcgucgccaucgucgccaucuacggcgacgacgucaucgagcagcagcucgccaccgaccagaugcuccuccacuucggcaaccucgccaugcacaugaacggcgagcucguccuccgcaaggcccgcucccuccucuaccaguuccgccuccucccccgcauccccugcucccuccacgaccucugcaagcucugcggcuccggcaugugggacuccggcuccaugcccgccgucgagugcaccggccaccaccccggcuccgaguccugccccuacggcggcaccgucgagaugcccucccccaagucccuccgcgagggcaagaagggccccaagaccccccaggacggcuucggcuuccgccgcuga

SEQ ID NO: 50502 - RNA, 3480 nt, Artificial Sequence
  derived and/or modified sequence opt2 from TBC1D1__Homo_sapiens__NP_001240841
auggagcccaucaccuucaccgcccgcaagcaccuccucuccaacgaggucuccgucgacuucggccuccagcucgucggcucccuccccguccacucccucaccaccaugcccaugcuccccugggucgucgccgagguccgccgccucucccgccaguccacccgcaaggagcccgucaccaagcagguccgccucugcgucucccccuccggccuccgcugcgagcccgagcccggccgcucccagcagugggacccccucaucuacuccuccaucuucgagugcaagccccagcgcguccacaagcucauccacaacucccacgaccccuccuacuucgccugccucaucaaggaggacgccguccaccgccaguccaucugcuacgucuucaaggccgacgaccagaccaagguccccgagaucaucuccuccauccgccaggccggcaagaucgcccgccaggaggagcuccacugccccuccgaguucgacgacaccuucuccaagaaguucgagguccucuucugcggccgcgucaccgucgcccacaagaaggccccccccgcccucaucgacgagugcaucgagaaguucaaccacgucuccggcucccgcggcuccgaguccccccgccccaaccccccccacgccgcccccaccggcucccaggagcccguccgccgccccaugcgcaaguccuucucccagcccggccuccgcucccucgccuuccgcaaggagcuccaggacggcggccuccgcuccuccggcuucuucuccuccuucgaggaguccgacaucgagaaccaccucaucuccggccacaacaucguccagcccaccgacaucgaggagaaccgcaccaugcucuucaccaucggccaguccgaggucuaccucaucucccccgacaccaagaagaucgcccucgagaagaacuucaaggagaucuccuucugcucccagggcauccgccacgucgaccacuucggcuucaucugccgcgaguccuccggcggcggcggcuuccacuucgucugcuacgucuuccagugcaccaacgaggcccucgucgacgagaucaugaugacccucaagcaggccuucaccgucgccgccguccagcagaccgccaaggcccccgcccagcucugcgagggcugcccccuccagucccuccacaagcucugcgagcgcaucgagggcaugaacuccuccaagaccaagcucgagcuccagaagcaccucaccacccucaccaaccaggagcaggccaccaucuucgaggagguccagaagcuccgcccccgcaacgagcagcgcgagaacgagcucaucaucuccuuccuccgcugccucuacgaggagaagcagaaggagcacauccacaucggcgagaugaagcagaccucccagauggccgccgagaacaucggcuccgagcucccccccuccgccacccgcuuccgccucgacaugcucaagaacaaggccaagcgcucccucaccgagucccucgaguccauccucucccgcggcaacaaggcccgcggccuccaggagcacuccaucuccgucgaccucgacuccucccucuccuccacccucuccaacaccuccaaggagcccuccgucugcgagaaggaggcccuccccaucuccgaguccuccuucaagcuccucggcuccuccgaggaccucuccuccgacuccgagucccaccuccccgaggagcccgccccccucuccccccagcaggccuuccgccgccgcgccaacacccucucccacuuccccaucgagugccaggagcccccccagcccgcccgcggcucccccggcgucucccagcgcaagcucaugcgcuaccacuccgucuccaccgagaccccccacgagcgcaacgucgaccccucccccgucggcgaguccaagcaccgccccggccaguccuccgcccccgccccccccccccgccucaaccccuccgccuccucccccaacuucuucaaguaccucaagcacaacuccuccggcgagcaguccggcaacgccguccccaaguccaucuccuaccgcaacgcccuccgcaagaagcuccacuccuccuccuccguccccaacuuccucaaguuccucgcccccgucgacgagaacaacaccuccgacuucaugaacaccaagcgcgacuucgaguccaaggccaaccaccucggcgacuccggcggcacccccgucaagacccgccgccacuccuggcgccagcagaucuuccuccgcgucgccaccccccagaaggccugcgacuccuccucccgcuacgaggacuacuccgagcucggcgagcuccccccccgcuccccccucgagcccgucugcgaggacggccccuucggccccccccccgaggagaagaagcgcaccucccgcgagcuccgcgagcucuggcagaaggccauccuccagcagauccuccuccuccgcauggagaaggagaaccagaagcuccaggccuccgagaacgaccuccucaacaagcgccucaagcucgacuacgaggagaucacccccugccucaaggaggucaccaccgucugggagaagaugcucuccacccccggccgcuccaagaucaaguucgacauggagaagaugcacuccgccgucggccagggcgucccccgccaccaccgcggcgagaucuggaaguuccucgccgagcaguuccaccucaagcaccaguuccccuccaagcagcagcccaaggacguccccuacaaggagcuccucaagcagcucaccucccagcagcacgccauccucaucgaccucggccgcaccuuccccacccaccccuacuucuccgcccagcucggcgccggccagcucucccucuacaacauccucaaggccuacucccuccucgaccaggaggucggcuacugccagggccucuccuucgucgccggcauccuccuccuccacauguccgaggaggaggccuucaagaugcucaaguuccucauguucgacaugggccuccgcaagcaguaccgccccgacaugaucauccuccagauggagaagaccaucaaccaggucuucgagauggacaucgccaagcagcuccaggccuacgaggucgaguaccacguccuccaggaggagcucaucgacuccuccccccucuccgacaaccagcgcauggacaagcucgagaagaccaacuccucccuccgcaagcagaaccucgaccuccucgagcagcuccaggucgccaacggccgcauccagucccucgaggccaccaucgagaagcuccucuccuccgaguccaagcucaagcaggccaugcucacccucgagcucgagcgcuccgcccuccuccagaccgucgaggagcuccgccgccgcuccgccgagcccuccgaccgcgagcccgagugcacccagcccgagcccaccggcgacuga

SEQ ID NO: 50503 - RNA, 1212 nt, Artificial Sequence
  derived and/or modified sequence opt2 from TBC1D20__Homo_sapiens__NP_653229
auggcccuccgcuccgcccagggcgacggccccaccuccggccacugggacggcggcgccgagaaggccgacuucaacgccaagcgcaagaagaaggucgccgagauccaccaggcccucaacuccgaccccaccgacgucgccgcccuccgccgcauggccaucuccgagggcggccuccucaccgacgagauccgccgcaaggucuggcccaagcuccucaacgucaacgccaacgaccccccccccaucuccggcaagaaccuccgccagauguccaaggacuaccagcagguccuccucgacguccgccgcucccuccgccgcuucccccccggcaugcccgaggagcagcgcgagggccuccaggaggagcucaucgacaucauccuccucauccucgagcgcaacccccagcuccacuacuaccagggcuaccacgacaucgucgucaccuuccuccucgucgucggcgagcgccucgccaccucccucgucgagaagcucuccacccaccaccuccgcgacuucauggaccccaccauggacaacaccaagcacauccucaacuaccucaugcccaucaucgaccaggucaaccccgagcuccacgacuucaugcaguccgccgaggucggcaccaucuucgcccucuccuggcucaucaccugguucggccacguccucuccgacuuccgccacgucguccgccucuacgacuucuuccucgccugccacccccucaugcccaucuacuucgccgccgucaucguccucuaccgcgagcaggagguccucgacugcgacugcgacauggccuccguccaccaccuccucucccagaucccccaggaccuccccuacgagacccucaucucccgcgccggcgaccucuucguccaguucccccccuccgagcucgcccgcgaggccgccgcccagcagcaggccgagcgcaccgccgccuccaccuucaaggacuucgagcucgccuccgcccagcagcgccccgacaugguccuccgccagcgcuuccgcggccuccuccgccccgaggaccgcaccaaggacguccucaccaagccccgcaccaaccgcuucgucaagcucgccgucaugggccucaccgucgcccucggcgccgccgcccucgccgucgucaaguccgcccucgagugggcccccaaguuccagcuccagcucuuccccuga

SEQ ID NO: 50504 - RNA, 1320 nt, Artificial Sequence
  derived and/or modified sequence opt2 from TBC1D22A__Homo_sapiens__NP_001271232
auggccuccgacggcgcccgcaagcaguucuggaagcgcuccaacuccaagcuccccggcucccuccuccgcuccaccgccaagaugcccaccacccccgucaaggccaagcgcgucuccaccuuccaggaguucgaguccaacaccuccgacgccugggacgccggcgaggacgacgacgagcuccucgccauggccgccgagucccucaacuccgaggucgucauggagaccgccaaccgcguccuccgcaaccacucccagcgccagggccgccccacccuccaggagggccccggccuccagcagaagccccgccccgaggccgagccccccuccccccccuccggcgaccuccgccucgucaaguccgucuccgagucccacaccuccugccccgccgaggagcuccgccgccucuccugguccggcauccccaagcccguccgccccaugaccuggaagcuccucuccggcuaccuccccgccaacgucgaccgccgccccgccacccuccagcgcaagcagaaggaguacuucgccuucaucgagcacuacuacgacucccgcaacgacgagguccaccaggacaccuaccgccagauccacaucgacaucccccgcaugucccccgaggcccucauccuccagcccaaggucaccgagaucuucgagcgcauccucuucaucugggccauccgccaccccgccuccggcuacguccagggcaucaacgaccucgucacccccuucuucgucgucuucaucugcgaguacaucgaggccgaggaggucgacaccgucgacgucuccggcguccccgccgagguccucugcaacaucgaggccgacaccuacuggugcauguccaagcuccucgacggcauccaggacaacuacaccuucgcccagcccggcauccagaugaaggucaagaugcucgaggagcucgucucccgcaucgacgagcagguccaccgccaccucgaccagcacgagguccgcuaccuccaguucgccuuccgcuggaugaacaaccuccucaugcgcgaggucccccuccgcugcaccauccgccucugggacaccuaccaguccgagcccgacggcuucucccacuuccaccucuacgucugcgccgccuuccucguccgcuggcgcaaggagauccucgaggagaaggacuuccaggagcuccuccucuuccuccagaaccuccccaccgcccacugggacgacgaggacaucucccuccuccucgccgaggccuaccgccucaaguucgccuucgccgacgcccccaaccacuacaagaaguga

SEQ ID NO: 50505 - RNA, 1518 nt, Artificial Sequence
  derived and/or modified sequence opt2 from TBC1D22B__Homo_sapiens__NP_060242
auggccgccgagaacuccaagcaguucuggaagcgcuccgccaagcuccccggcuccauccagcccgucuacggcgcccagcaccccccccucgacccccgccucaccaagaacuucaucaaggagcgcuccaaggucaacaccgucccccucaagaacaagaaggccuccuccuuccacgaguucgcccgcaacaccuccgacgccugggacaucggcgacgacgaggaggaggacuucuccucccccuccuuccagacccucaacuccaaggucgcccucgccaccgccgcccagguccucgagaaccacuccaagcuccgcgucaagcccgagcgcucccaguccaccaccuccgacguccccgccaacuacaaggucaucaaguccuccuccgacgcccagcucucccgcaacuccuccgacaccugccuccgcaacccccuccacaagcagcagucccucccccuccgccccaucaucccccucgucgcccgcaucuccgaccagaacgccuccggcgccccccccaugaccguccgcgagaagacccgccucgagaaguuccgccagcuccucuccucccagaacaccgaccucgacgagcuccgcaagugcuccuggcccggcgucccccgcgagguccgccccaucaccuggcgccuccucuccggcuaccuccccgccaacaccgagcgccgcaagcucacccuccagcgcaagcgcgaggaguacuucggcuucaucgagcaguacuacgacucccgcaacgaggagcaccaccaggacaccuaccgccagauccacaucgacaucccccgcaccaacccccucaucccccucuuccagcagccccucguccaggagaucuucgagcgcauccucuucaucugggccauccgccaccccgccuccggcuacguccagggcaucaacgaccucgucacccccuucuucgucgucuuccucuccgaguacgucgaggaggacgucgagaacuucgacgucaccaaccucucccaggacaugcuccgcuccaucgaggccgacuccuucuggugcauguccaagcuccucgacggcauccaggacaacuacaccuucgcccagcccggcauccagaagaaggucaaggcccucgaggagcucgucucccgcaucgacgagcagguccacaaccacuuccgccgcuacgaggucgaguaccuccaguucgccuuccgcuggaugaacaaccuccucaugcgcgagcucccccuccgcugcaccauccgccucugggacaccuaccaguccgagcccgagggcuucucccacuuccaccucuacgucugcgccgccuuccucaucaaguggcgcaaggagauccucgacgaggaggacuuccagggccuccucaugcuccuccagaaccuccccaccauccacuggggcaacgaggagaucggccuccuccucgccgaggccuaccgccucaaguacauguucgccgacgcccccaaccacuaccgccgcuga

SEQ ID NO: 50506 - RNA, 1680 nt, Artificial Sequence
  derived and/or modified sequence opt2 from TBC1D24__Homo_sapiens__NP_001186036
auggacucccccggcuacaacugcuucgucgacaaggacaagauggacgccgccauccaggaccucggccccaaggagcucuccugcaccgagcuccaggagcucaagcagcucgcccgccagggcuacugggcccagucccacgcccuccgcggcaaggucuaccagcgccucauccgcgacauccccugccgcaccgucacccccgacgccuccgucuacuccgacaucgucggcaagaucgucggcaagcacuccuccuccugccucccccuccccgaguucgucgacaacacccagguccccuccuacugccucaacgcccgcggcgagggcgccguccgcaagauccuccucugccucgccaaccaguuccccgacaucuccuucugccccgcccuccccgccgucgucgcccuccuccuccacuacuccaucgacgaggccgagugcuucgagaaggccugccgcauccucgccugcaacgaccccggccgccgccucaucgaccaguccuuccucgccuucgaguccuccugcaugaccuucggcgaccucgucaacaaguacugccaggccgcccacaagcucauggucgccgucuccgaggacguccuccaggucuacgccgacuggcagcgcuggcucuucggcgagcucccccucugcuacuucgcccgcgucuucgacgucuuccucgucgagggcuacaagguccucuaccgcgucgcccucgccauccucaaguucuuccacaagguccgcgccggccagccccucgaguccgacuccgucaagcaggacauccgcaccuucguccgcgacaucgccaagaccgucucccccgagaagcuccucgagaaggccuucgccauccgccucuucucccgcaaggagauccagcuccuccagauggccaacgagaaggcccucaagcagaagggcaucaccgucaagcagaaguccgucucccucuccaagcgccaguucguccaccucgccguccacgccgagaacuuccgcuccgagaucgucuccguccgcgagaugcgcgacaucugguccuggguccccgagcgcuucgcccucugccagccccuccuccucuucuccucccuccagcacggcuacucccucgcccgcuucuacuuccagugcgagggccacgagcccacccuccuccucaucaagaccacccagaaggaggucugcggcgccuaccucuccaccgacugguccgagcgcaacaaguucggcggcaagcucggcuucuucggcaccggcgagugcuucgucuuccgccuccagcccgagguccagcgcuacgagugggucgucaucaagcaccccgagcucaccaagccccccccccucauggccgccgagcccaccgccccccucucccacuccgccuccuccgaccccgccgaccgccucucccccuuccucgccgcccgccacuucaaccuccccuccaagaccgaguccauguucauggccggcggcuccgacugccucaucgucggcggcggcggcggccaggcccucuacaucgacggcgaccucaaccgcggccgcaccucccacugcgacaccuucaacaaccagccccucugcuccgagaacuuccucaucgccgccgucgaggccuggggcuuccaggaccccgacacccaguga

SEQ ID NO: 50507 - RNA, 2067 nt, Artificial Sequence
  derived and/or modified sequence opt2 from TBC1D25__Homo_sapiens__NP_002527
auggccaccgccuccggcgccuccgaccucuccggcuccggcgcccccccccccggcgucggcgcccaggccgccgccgccgccgaggaggaggagcgcgaggucguccgcguccgcgucaagaagugcgaguccuuccucccccccgaguuccgcuccuucgccgucgacccccagaucaccucccucgacguccuccagcacauccucauccgcgccuucgaccucuccggcaagaagaacuucggcaucuccuaccucggccgcgaccgccucggccaggaggucuaccucucccuccucuccgacugggaccucuccaccgccuucgccaccgccuccaagcccuaccuccagcuccgcgucgacauccgccccuccgaggacuccccccuccucgaggacugggacaucaucucccccaaggacgucaucggcuccgacguccuccucgccgagaagcgcuccucccucaccaccgccgcccuccccuucacccaguccauccucacccaggucggccgcacccucuccaagguccagcagguccucuccugguccuacggcgaggacgucaagcccuucaagcccccccucuccgacgccgaguuccacaccuaccucaaccacgagggccagcucucccgccccgaggagcuccgccuccgcaucuaccacggcggcgucgagcccucccuccgcaaggucgucuggcgcuaccuccucaacgucuaccccgacggccucaccggccgcgagcgcauggacuacaugaagcgcaagucccgcgaguacgagcagcucaaguccgagugggcccagcgcgccaaccccgaggaccucgaguucauccgcuccaccguccucaaggacguccuccgcaccgaccgcgcccaccccuacuacgccggccccgaggacggcccccaccuccgcgcccuccacgaccuccucaccaccuacgccgucacccacccccaggucuccuacugccagggcauguccgaccucgccucccccauccucgccgucauggaccacgagggccacgccuucgucugcuucugcggcaucaugaagcgccucgccgccaacuuccaccccgacggccgcgccauggccaccaaguucgcccaccucaagcuccuccuccgccacgccgaccccgacuucuaccaguaccuccaggaggccggcgccgacgaccucuucuucugcuaccgcuggcuccuccucgagcucaagcgcgaguucgccuucgacgacgcccuccgcaugcucgaggucaccugguccucccucccccccgacccccccgagcacgaggucgagcucgucggcccccccucccaggucgccgacgccggcuucggcggccaccgcggcuggcccguccgccagcgccacaugcuccgccccgccggcggcggcggcuccaccuucgaggacgccgucgaccaccucgccaccgccucccagggccccggcggcggcggccgccuccuccgccaggccucccucgacggccuccagcagcuccgcgacaacaugggcucccgccgcgacccccucguccagcucccccaccccgccgcccucaucuccuccaagucccucuccgagccccuccucaacucccccgacccccuccucuccuccuucucccaccccgacucccccuccuccuccuccccccccuccacccaggaggccucccccaccggcgacauggccgucggcuccccccucaugcaggaggucggcucccccaaggaccccggcaagucccucccccccgucccccccaugggccucccccccccccaggaguucggccgcggcaaccccuucaugcucuuccucugccucgccauccuccucgagcaccgcgaccacaucaugcgcaacggccucgacuacaacgagcucgccaugcacuucgaccgccucguccgcaagcaccaccucggccgcguccuccgccgcgcccgcgcccucuucgccgacuaccuccaguccgaggucugggacuccgaggagggcgccgaggccaccgccgccuccuga

SEQ ID NO: 50508 - RNA, 2787 nt, Artificial Sequence
  derived and/or modified sequence opt2 from TBC1D2__Homo_sapiens__NP_001254500
auggagggcgccggcgagaacgcccccgaguccuccuccuccgcccccggcuccgaggaguccgcccgcgacccccagguccccccccccgaggaggaguccggcgacugcgcccgcucccucgaggccguccccaagaagcucugcggcuaccucuccaaguucggcggcaagggccccauccgcggcuggaagucccgcugguucuucuacgacgagcgcaagugccagcucuacuacucccgcaccgcccaggacgccaacccccucgacuccaucgaccucuccuccgccgucuucgacugcaaggccgacgccgaggagggcaucuucgagaucaagacccccucccgcgucaucacccucaaggccgccaccaagcaggccaugcucuacuggcuccagcagcuccagaugaagcgcugggaguuccacaacuccccccccgccccccccgccacccccgacgccgcccucgccggcaacggccccguccuccaccucgagcucggccaggaggaggccgagcucgaggaguuccucugccccgucaagaccccccccggccucgucggcgucgccgccgcccuccagcccuuccccgcccuccagaacaucucccucaagcaccucggcaccgagauccagaacaccaugcacaacauccgcggcaacaagcaggcccagggcaccggccacgagccccccggcgaggacuccccccaguccggcgagccccagcgcgaggagcagccccucgccuccgacgccuccacccccggccgcgagcccgaggacucccccaagcccgcccccaagcccucccucaccaucuccuucgcccagaaggccaagcgccagaacaacaccuuccccuucuucuccgagggcaucacccgcaaccgcaccgcccaggagaaggucgccgcccucgagcagcagguccucaugcucaccaaggagcucaagucccagaaggagcucgucaagauccuccacaaggcccucgaggccgcccagcaggagaagcgcgccuccuccgccuaccucgccgccgccgaggacaaggaccgccucgagcucguccgccacaagguccgccagaucgccgagcucggccgccgcgucgaggcccucgagcaggagcgcgagucccucgcccacaccgccucccuccgcgagcagcagguccaggagcuccagcagcacguccagcuccucauggacaagaaccacgccaagcagcaggucaucugcaagcucuccgagaaggucacccaggacuucacccacccccccgaccaguccccccuccgccccgacgccgccaaccgcgacuuccucucccagcagggcaagaucgagcaccucaaggacgacauggaggccuaccgcacccagaacugcuuccucaacuccgagauccaccaggucaccaagaucuggcgcaaggucgccgagaaggagaaggcccuccucaccaagugcgccuaccuccaggcccgcaacugccaggucgaguccaaguaccucgccggccuccgccgccuccaggaggcccucggcgacgaggccuccgagugcuccgagcuccuccgccagcucguccaggaggcccuccagugggaggccggcgaggccuccuccgacuccaucgagcucucccccaucuccaaguacgacgaguacggcuuccucaccguccccgacuacgaggucgaggaccucaagcuccucgccaagauccaggcccucgagucccgcucccaccaccuccucggccucgaggccgucgaccgcccccuccgcgagcgcugggccgcccucggcgaccucguccccuccgccgagcucaagcagcuccuccgcgccggcgucccccgcgagcaccgcccccgcgucuggcgcuggcucguccaccuccgcguccagcaccuccacacccccggcugcuaccaggagcuccucucccgcggccaggcccgcgagcaccccgccgcccgccagaucgagcucgaccucaaccgcaccuuccccaacaacaagcacuucaccugccccaccuccuccuuccccgacaagcuccgccgcguccuccucgccuucuccuggcagaaccccaccaucggcuacugccagggccucaaccgccucgccgccaucgcccuccucguccucgaggaggaggaguccgccuucuggugccucgucgccaucgucgagaccaucaugcccgccgacuacuacugcaacacccucaccgccucccaggucgaccagcgcguccuccaggaccuccucuccgagaagcucccccgccucauggcccaccucggccagcaccacgucgaccucucccucgucaccuucaacugguuccucgucgucuucgccgacucccucaucuccaacauccuccuccgcgucugggacgccuuccucuacgagggcaccaaggucgucuuccgcuacgcccucgccaucuucaaguacaacgagaaggagauccuccgccuccagaacggccucgagaucuaccaguaccuccgcuucuucaccaagaccaucuccaacucccgcaagcucaugaacaucgccuucaacgacaugaaccccuuccgcaugaagcagcuccgccagcuccgcaugguccaccgcgagcgccucgaggccgagcuccgcgagcucgagcagcucaaggccgaguaccucgagcgccgcgccucccgccgccgcgccgucuccgagggcugcgccuccgaggacgaggucgagggcgaggccuga

SEQ ID NO: 50509 - RNA, 3774 nt, Artificial Sequence
  derived and/or modified sequence opt2 from TBC1D32__Homo_sapiens__NP_689943
auggcccacuucuccuccgaggaccaggccaugcuccaggccaugcuccgccgccucuuccaguccgucaaggagaagaucaccggcgcccccucccucgagugcgccgaggagauccuccuccaccucgaggagaccgacgagaacuuccacaacuacgaguucgucaaguaccuccgccagcacaucggcaacacccucggcuccaugaucgaggaggagauggagaagugcaccuccgaccgcaaccagggcgaggagugcggcuacgacaccgucguccagcaggucaccaagcgcacccaggaguccaaggaguacaaggagaugaugcacuaccucaagaacaucaugaucgccgucgucgaguccaugaucaacaaguucgaggaggacgagacccgcaaccaggagcgccagaagaagauccagaaggagaagucccacuccuaccgcaccgacaacugcuccgacuccgacuccucccucaaccaguccuacaaguucugccagggcaagcuccagcucauccucgaccagcucgaccccggccagcccaaggagguccgcuacgaggcccuccagacccucugcuccgccccccccuccgacguccucaacugcgagaacuggaccacccucugcgagaagcucaccgucucccucuccgaccccgaccccgucuucuccgaccgcauccucaaguucugcgcccagaccuuccuccucuccccccuccacaugaccaaggagaucuacaccucccucgccaaguaccucgaguccuacuuccucucccgcgagaaccacauccccacccucuccgccggcgucgacaucaccaaccccaacaugacccgccuccucaagaagguccgccuccucaacgaguaccagaaggaggcccccuccuucuggauccgccaccccgagaaguacauggaggagaucgucgaguccacccucucccuccucaccgucaagcacaaccagucccacgucgucucccagaagauccucgaccccaucuacuucuucgcccucgucgacaccaaggccgucugguucaagaaguggaugcacgcccacuacucccgcaccaccguccuccgccuccucgagaccaaguacaagucccucgucaccaccgccauccagcagugcguccaguacuucgagaugugcaagacccgcaaggccgacgagacccucggccacuccaagcacugccgcaacaagcagaagaccuucuacuaccucggccaggagcuccaguacaucuacuucauccacucccucugccuccucggccgccuccucaucuacaagcagggccgcaagcucuuccccaucaagcucaagaacaagaagggccucgucucccucaucgaccuccucguccucuucacccagcucaucuacuacucccccuccugccccaagaugaccuccgccgcccacuccgagaacuacucccccgccuccauggucaccgagguccucuggauccucuccgaccagaaggagugcgccgucgagugccucuacaacaacaucgucaucgagacccuccuccagcccauccacaaccucaugaagggcaacgaggccucccccaacugcuccgagaccgcccucauccacaucgccggcauccucgcccgcaucgccuccgucgaggagggccucauccuccuccucuacggcgccaacaugaacuccuccgaggagucccccaccggcgcccacaucaucgcccaguucuccaagaagcuccucgacgaggacaucuccaucuucuccggcuccgagaugcuccccgucgucaagggcgccuucaucuccgucugccgccacaucuacuccaccugcgagggccuccagguccucaucaccuacaaccuccacgaguccaucgccaaggccuggaagaagaccucccuccucuccgagcgcauccccacccccgucgagggcuccgacuccgucuccuccgucucccaggagucccagaacaucauggccugggaggacaaccuccucgacgaccuccuccacuucgccgccacccccaagggccuccuccuccuccagcgcaccggcgccaucaacgagugcgucaccuucaucuucaaccgcuacgccaagaagcuccaggucucccgccacaagaaguucggcuacggcguccucgucacccgcgucgccuccaccgccgccggcggcaucgcccucaagaaguccggcuucaucaacgagcucaucaccgagcucugguccaaccucgaguacggccgcgacgacguccgcgucacccacccccgcaccacccccgucgaccccaucgaccgcuccugccagaaguccuuccucgcccucgucaaccuccucuccuaccccgccaucuacgagcucguccgcaaccaggaccuccccaacaagaccgaguacucccuccgcgagguccccaccugcgucaucgacaucaucgaccgccucaucauccucaacuccgaggccaagauccgcucccucuucaacuacgagcagucccacaucuucggccuccgcgacuucaucaucgacggccucuccgucgagcgcaaccacguccucguccgcaucaaccucgucggcggcccccucgagcgcauccuccccccccgccuccucgagaaguccgacaaccccuaccccuggcccauguucuccuccuacccccuccccaacugcuaccucuccgacaucacccgcaacgccggcaucaagcaggacaacgaccucgacaagcuccuccucugccucaagaucuccgacaagcagaccgaguggaucgagaacugccagcgccaguucugcaagaugaugaaggccaagcccgacaucaucuccggcgaggcccucaucgagcuccucgagaaguucguccuccaccucaccgagucccccuccgagugcuacuuccccuccgucgaguacaccgccaccgacgccaacgucaagaacgagucccucuccuccguccagcagcucggcaucaagaugaccguccgcuacggcaaguuccucucccuccucaaggacggcgccgagaacgaccucaccuggguccucaagcacugcgagcgcuuccucaagcagcagcagaccuccaucaaguccucccuccucugccuccagggcaacuacgccggccacgacugguucgucuccucccucuucaugaucaugcucggcgacaaggagaagaccuuccaguuccuccaccaguucucccgccuccucaccuccgccuuccucuggcucccccgccuccacaucuccuccuaccuccccaacgacaccgucgaguccggcauccaccccgucuacuucugcuccacccacuacaucgagaugcuccucaaggccgagcucccccucgucuucuccgccuuccacauguccggcuucgcccccucccagaucugccuccaguggaucacccagugcuucuggaacuaccucgacuggaucgagaucugccacuacaucgccaccugcgucuuccucggccccgacuaccaggucuacaucugcaucgccgucuucaagcaccuccagcaggacauccuccagcacacccagacccaggaccuccaggucuuccucaaggaggaggcccuccacggcuuccgcgucuccgacuacuucgaguacauggagauccucgagcagaacuaccgcaccguccuccuccgcgacaugcgcaacauccgccuccaguccaccuga

SEQ ID NO: 50510 - RNA, 1584 nt, Artificial Sequence
  derived and/or modified sequence opt2 from TBC1D3C__Homo_sapiens__XP_006721970
auggacgucgucgaggucgccggcuccuggugggcccaggagcgcgaggacaucaucaugaaguacgagaagggccaccgcgccggccuccccgaggacaagggccccaagcccuuccgcuccuacaacaacaacgucgaccaccucggcaucguccacgagaccgagcuccccccccucaccgcccgcgaggccaagcagauccgccgcgagaucucccgcaaguccaagugggucgacaugcucggcgacugggagaaguacaaguccucccgcaagcucaucgaccgcgccuacaagggcaugcccaugaacauccgcggccccaugugguccguccuccucaacaccgaggagaugaagcucaagaaccccggccgcuaccagaucaugaaggagaagggcaagcgcuccuccgagcacauccagcgcaucgaccgcgacgucuccggcacccuccgcaagcacaucuucuuccgcgaccgcuacggcaccaagcagcgcgagcuccuccacauccuccucgccuacgaggaguacaaccccgaggucggcuacugccgcgaccucucccacaucgccgcccucuuccuccucuaccuccccgaggaggacgccuucugggcccucguccagcuccucgccuccgagcgccacucccuccagggcuuccacucccccaacggcggcaccguccagggccuccaggaccagcaggagcacgucgucgccaccucccagcccaagaccaugggccaccagaucucccucggccucacccuccgccucugggacgucuaccucgucgagggcgagcaggcccucaugcccaucacccgcaucgccuucaagguccagcagaagcgccucaccaagaccucccgcugcggccccugggcccgcuucugcaaccgcuucgucgacaccugggcccgcgacgaggacaccguccucaagcaccuccgcgccuccaugaagaagcucacccgcaagaagggcgaccuccccccccccgccaagcccgagcagggcuccuccgccucccgccccguccccgccucccgcggcggcaagacccucugcaagggcgaccgccaggccccccccggcccccccgcccgcuucccccgccccaucugguccgccucccccccccgcgccccccgcuccuccacccccugccccggcggcgccguccgcgaggacaccuaccccgucggcacccagggcguccccucccccgcccucgcccagggcggcccccagggcuccuggcgcuuccuccaguggaacuccaugccccgccuccccaccgaccucgacgucgagggccccugguuccgccacuacgacuuccgccaguccugcuggguccgcgccaucucccaggaggaccagcucgcccccugcuggcaggccgagcaccccgccgagcgcguccgcuccgccuucgccgcccccuccaccgacuccgaccagggcacccccuuccgcgcccgcgacgagcagcagugcgcccccaccuccggccccugccucugcggccuccaccucgaguccucccaguucccccccggcuucuga

SEQ ID NO: 50511 - RNA, 1650 nt, Artificial Sequence
  derived and/or modified sequence opt2 from TBC1D3F__Homo_sapiens__NP_115634
auggacgucgucgaggucgccggcuccuggugggcccaggagcgcgaggacaucaucaugaaguacgagaagggccaccgcgccggccuccccgaggacaagggccccaagcccuuccgcuccuacaacaacaacgucgaccaccucggcaucguccacgagaccgagcuccccccccucaccgcccgcgaggccaagcagauccgccgcgagaucucccgcaaguccaagugggucgacaugcucggcgacugggagaaguacaaguccucccgcaagcucaucgaccgcgccuacaagggcaugcccaugaacauccgcggccccaugugguccguccuccucaacaucgaggagaugaagcucaagaaccccggccgcuaccagaucaugaaggagaagggcaagcgcuccuccgagcacauccagcgcaucgaccgcgacgucuccggcacccuccgcaagcacaucuucuuccgcgaccgcuacggcaccaagcagcgcgagcuccuccacauccuccucgccuacgaggaguacaaccccgaggucggcuacugccgcgaccucucccacaucgccgcccucuuccuccucuaccuccccgaggaggacgccuucugggcccucguccagcuccucgccuccgagcgccacucccuccagggcuuccacucccccaacggcggcaccguccagggccuccaggaccagcaggagcacgucgucgccaccucccagcccaagaccaugggccaccaggacaagaaggaccucugcggccagugcuccccccucggcugccucauccgcauccucaucgacggcaucucccucggccucacccuccgccucugggacgucuaccucgucgagggcgagcaggcccucaugcccaucacccgcaucgccuucaagguccagcagaagcgccucaccaagaccucccgcugcggccccugggcccgcuucugcaaccgcuucgucgacaccugggcccgcgacgaggacaccguccucaagcaccuccgcgccuccaugaagaagcucacccgcaagaagggcgacguccccccccccgccaagcccgagcagggcuccuccgccucccgccccguccccgccucccgcggcggcaagacccucugcaagggcgaccgccaggccccccccggcccccccgcccgcuucccccgccccaucugguccgccucccccccccgcgccccccgcuccuccacccccugccccggcggcgccguccgcgaggacaccuaccccgucggcacccagggcguccccucccccgcccucgcccagggcggcccccagggcuccuggcgcuuccuccaguggaacuccaugccccgccuccccaccgaccucgacgucgagggccccugguuccgccacuacgacuuccgccaguccugcuggguccgcgccaucucccaggaggaccagcucgcccccugcuggcaggccgagcaccccgccgagcgcguccgcuccgccuucgccgcccccuccaccgacuccgaccagggcacccccuuccgcgcccgcgacgagcagcagugcgcccccaccuccggccccugccucugcggccuccaccucgaguccucccaguucccccccggcuucuga

SEQ ID NO: 50512 - RNA, 3873 nt, Artificial Sequence
  derived and/or modified sequence opt2 from TBC1D4__Homo_sapiens__NP_001273587
auggagccccccuccugcauccaggacgagcccuucccccacccccucgagcccgagcccggcgucuccgcccagcccggccccggcaagcccuccgacaagcgcuuccgccucugguacgucggcggcuccugccucgaccaccgcaccacccuccccaugcuccccuggcucauggccgagauccgccgccgcucccagaagcccgaggccggcggcugcggcgcccccgccgcccgcgaggucauccucguccucuccgcccccuuccuccgcugcguccccgcccccggcgccggcgccuccggcggcaccucccccuccgccacccagcccaaccccgccgucuucaucuucgagcacaaggcccagcacaucucccgcuucauccacaacucccacgaccucaccuacuucgccuaccucaucaaggcccagcccgacgaccccgagucccagauggccugccacgucuuccgcgccaccgaccccucccagguccccgacgucaucuccuccauccgccagcucuccaaggccgccaugaaggaggacgccaagcccuccaaggacaacgaggacgccuucuacaacucccagaaguucgagguccucuacugcggcaaggucaccgucacccacaagaaggcccccuccucccucaucgacgacugcauggagaaguucucccuccacgagcagcagcgccucaagauccagggcgagcagcgcggccccgaccccggcgaggaccucgccgaccucgaggucgucguccccggcucccccggcgacugccuccccgaggaggccgacggcaccgacacccaccucggccuccccgccggcgccucccagcccgcccucaccuccucccgcgucugcuuccccgagcgcauccucgaggacuccggcuucgacgagcagcaggaguuccgcucccgcugcuccuccgucaccggcguccagcgccgcguccacgagggcucccagaagucccagccccgccgccgccacgccuccgcccccucccacguccagcccuccgacuccgagaagaaccgcaccaugcucuuccaggucggccgcuucgagaucaaccucaucucccccgacaccaaguccgucguccucgagaagaacuucaaggacaucuccuccugcucccagggcaucaagcacgucgaccacuucggcuucaucugccgcgagucccccgagcccggccucucccaguacaucugcuacgucuuccagugcgccuccgagucccucgucgacgaggucaugcucacccucaagcaggccuucuccaccgccgccgcccuccaguccgccaagacccagaucaagcucugcgaggccugccccaugcacucccuccacaagcucugcgagcgcaucgagggccucuaccccccccgcgccaagcucgucauccagcgccaccucuccucccucaccgacaacgagcaggccgacaucuucgagcgcguccagaagaugaagcccgucuccgaccaggaggagaacgagcucgucauccuccaccuccgccagcucugcgaggccaagcagaagacccacguccacaucggcgagggccccuccaccaucuccaacuccaccauccccgagaacgccaccuccuccggccgcuucaagcucgacauccucaagaacaaggccaagcgcucccucaccuccucccucgagaacaucuucucccgcggcgccaaccgcaugcgcggccgccucggcuccgucgacuccuucgagcgcuccaacucccucgccuccgagaaggacuacucccccggcgacuccccccccggcaccccccccgccuccccccccuccuccgccuggcagaccuuccccgaggaggacuccgacuccccccaguuccgccgccgcgcccacaccuucucccacccccccuccuccaccaagcgcaagcucaaccuccaggacggccgcgcccagggcguccgcuccccccuccuccgccaguccuccuccgagcagugcuccaaccucuccuccguccgccgcauguacaaggaguccaacuccuccuccucccuccccucccuccacaccuccuucuccgcccccuccuucaccgcccccuccuuccucaaguccuucuaccagaacuccggccgccucuccccccaguacgagaacgagaucuccgacggcgagggccgcaagcgcaccuccuccaccugcuccaacgagucccucuccgucggcggcaccuccgucaccccccgccgcaucuccuggcgccagcgcaucuuccuccgcgucgccucccccaugaacaagucccccuccgccaugcagcagcaggacggccucgaccgcaacgagcuccucccccucuccccccucucccccaccauggaggaggagccccucgucgucuuccucuccggcgaggacgaccccgagaagaucgaggagcgcaagaaguccaaggagcuccgcucccucuggcgcaaggccauccaccagcagauccuccuccuccgcauggagaaggagaaccagaagcucgaggccucccgcgacgagcuccagucccgcaaggucaagcucgacuacgaggaggucggcgccugccagaaggagguccucaucaccugggacaagaagcuccucaacugccgcgccaagauccgcugcgacauggaggacauccacacccuccucaaggagggcguccccaagucccgccgcggcgagaucuggcaguuccucgcccuccaguaccgccuccgccaccgccuccccaacaagcagcagccccccgacaucuccuacaaggagcuccucaagcagcucaccgcccagcagcacgccauccucgucgaccucggccgcaccuuccccacccaccccuacuucuccguccagcucggccccggccagcucucccucuucaaccuccucaaggccuacucccuccucgacaaggaggucggcuacugccagggcaucuccuucgucgccggcguccuccuccuccacauguccgaggagcaggccuucgagaugcucaaguuccucauguacgaccucggcuuccgcaagcaguaccgccccgacaugaugucccuccagauccagauguaccagcucucccgccuccuccacgacuaccaccgcgaccucuacaaccaccucgaggagaacgagaucucccccucccucuacgccgcccccugguuccucacccucuucgccucccaguucucccucggcuucgucgcccgcgucuucgacaucaucuuccuccagggcaccgaggucaucuucaaggucgcccucucccuccucuccucccaggagacccucaucauggagugcgaguccuucgagaacaucgucgaguuccucaagaacacccuccccgacaugaacaccuccgagauggagaagaucaucacccaggucuucgagauggacaucuccaagcagcuccacgccuacgaggucgaguaccacguccuccaggacgagcuccaggaguccuccuacuccugcgaggacuccgagacccucgagaagcucgagcgcgccaacucccagcucaagcgccagaacauggaccuccucgagaagcuccaggucgcccacaccaagauccaggcccucgaguccaaccucgagaaccuccucacccgcgagaccaagaugaagucccucauccgcacccucgagcaggagaagauggccuaccagaagaccgucgagcagcuccgcaagcuccuccccgccgacgcccucgucaacugcgaccuccuccuccgcgaccucaacugcaaccccaacaacaaggccaagaucggcaacaagcccuga

SEQ ID NO: 50513 - RNA, 2454 nt, Artificial Sequence
  derived and/or modified sequence opt2 from TBC1D5__Homo_sapiens__NP_001127853
auguaccacucccucuccgagacccgccacccccuccagcccgaggagcaggaggucggcaucgacccccucuccuccuacuccaacaaguccggcggcgacuccaacaagaacggccgccgcaccuccuccacccucgacuccgagggcaccuucaacuccuaccgcaaggagugggaggagcucuucgucaacaacaacuaccucgccaccauccgccagaagggcaucaacggccagcuccgcuccucccgcuuccgcuccaucugcuggaagcucuuccucugcguccucccccaggacaagucccaguggaucucccgcaucgaggagcuccgcgccugguacuccaacaucaaggagauccacaucaccaacccccgcaaggucgucggccagcaggaccucaugaucaacaacccccucucccaggacgagggcucccucuggaacaaguucuuccaggacaaggagcuccgcuccaugaucgagcaggacgucaagcgcaccuuccccgagaugcaguucuuccagcaggagaacguccgcaagauccucaccgacguccucuucugcuacgcccgcgagaacgagcagcuccucuacaagcagggcaugcacgagcuccucgcccccaucgucuucguccuccacugcgaccaccaggccuuccuccacgccuccgaguccgcccagcccuccgaggagaugaagaccguccucaaccccgaguaccucgagcacgacgccuacgccgucuucucccagcucauggagaccgccgagcccugguucuccaccuucgagcacgacggccagaagggcaaggagacccucaugacccccauccccuucgcccgcccccaggaccucggccccaccaucgccaucgucaccaaggucaaccagauccaggaccaccuccucaagaagcacgacaucgagcucuacaugcaccucaaccgccucgagaucgccccccagaucuacggccuccgcuggguccgccuccucuucggccgcgaguucccccuccaggaccuccucgucgucugggacgcccucuucgccgacggccucucccucggccucgucgacuacaucuucgucgccaugcuccucuacauccgcgacgcccucaucuccuccaacuaccagaccugccucggccuccucaugcacuaccccuucaucggcgacguccacucccucauccucaaggcccucuuccuccgcgaccccaagcgcaacccccgccccgucaccuaccaguuccaccccaaccucgacuacuacaaggcccgcggcgccgaccucaugaacaagucccgcaccaacgccaagggcgccccccucaacaucaacaaggucuccaacucccucaucaacuucggccgcaagcucaucucccccgccauggcccccggcuccgccggcggccccguccccggcggcaacuccuccuccuccuccuccgucgucauccccacccgcaccuccgccgaggcccccucccaccaccuccagcagcagcagcagcagcagcgccucaugaaguccgaguccaugcccguccagcucaacaagggcgacgucgucaccggcuccgacgcccaggucuccguccccguccagacccucaccgaccuccagggccucuccuccaagaacaucuccuccucccccuccgucgagucccuccccggcggccgcgaguucaccggcuccccccccuccuccgccaccaagaaggacuccuucuucuccaacaucucccgcucccgcucccacuccaagaccaugggccgcaaggaguccgaggaggagcucgaggcccagaucuccuuccuccagggccagcucaacgaccucgacgccaugugcaaguacugcgccaaggucauggacacccaccucgucaacauccaggacgucauccuccaggagaaccucgagaaggaggaccagauccucgucucccucgccggccucaagcagaucaaggacauccucaagggcucccuccgcuucaaccagucccagcucgaggccgaggagaacgagcagaucaccaucgccgacaaccacuacugcuccuccggccagggccagggccgcggccagggccaguccguccagauguccggcgccaucaagcaggccuccuccgagacccccggcugcaccgaccgcggcaacuccgacgacuucauccucaucuccaaggacgacgacggcuccuccgcccgcggcuccuucuccggccaggcccagccccuccgcacccuccgcuccaccuccggcaagucccaggcccccgucugcuccccccucgucuucuccgacccccucaugggccccgccuccgccuccuccuccaaccccuccuccucccccgacgacgacuccuccaaggacuccggcuucaccaucgucuccccccucgacaucuga

SEQ ID NO: 50514 - RNA, 801 nt, Artificial Sequence
  derived and/or modified sequence opt2 from TBC1D7__Homo_sapiens__NP_001137438
augaccgaggacucccagcgcaacuuccgcuccgucuacuacgagaaggucggcuuccgcggcgucgaggagaagaagucccucgagauccuccucaaggacgaccgccucggcauccuccccccccaccacgagucccacgccaaggucaugauguaccgcaaggagcaguaccucgacguccuccacgcccucaaggucguccgcuucgucuccgacgccaccccccaggccgaggucuaccuccgcauguaccagcucgaguccggcaagcucccccgcucccccuccuucccccucgagcccgacgacgaggucuuccucgccaucgccaaggccauggaggagauggucgaggacuccgucgacugcuacuggaucacccgccgcuucgucaaccagcucaacaccaaguaccgcgacucccucccccagcuccccaaggccuucgagcaguaccucaaccucgaggacggccgccuccucacccaccuccgcaugugcuccgccgcccccaagcuccccuacgaccucugguucaagcgcugcuucgccggcugccuccccgaguccucccuccagcgcgucugggacaaggucgucuccggcuccugcaagauccucgucuucgucgccgucgagauccuccucaccuucaagaucaaggucauggcccucaacuccgccgagaagaucaccaaguuccucgagaacaucccccaggacuccuccgacgccaucgucuccaaggccaucgaccucuggcacaagcacugcggcacccccguccacuccuccuga

SEQ ID NO: 50515 - RNA, 3423 nt, Artificial Sequence
  derived and/or modified sequence opt2 from TBC1D8__Homo_sapiens__NP_001095896
auguggcucaagcccgaggagguccuccucaagaacgcccucaagcucugggucacccagaaguccuccugcuacuucauccuccagcgccgccgcggccacggcgagggcggcggccgccucaccggccgccucgucggcgcccucgacgccguccucgacuccaacgcccgcgucgcccccuuccgcauccuccuccagguccccggcucccaggucuacucccccaucgccugcggcgccacccucgaggagaucaaccagcacugggacuggcucgagcagaaccuccuccacacccucuccgucuucgacaacaaggacgacaucgccuccuucgucaagggcaaggucaaggcccucaucgccgaggagaccuccucccgccucgccgagcaggaggaggagcccgagaaguuccgcgaggcccucgucaaguucgaggcccgcuucaacuuccccgaggccgagaagcucgucaccuacuacuccugcugcugcuggaagggccgcgucccccgccagggcuggcucuaccucuccaucaaccaccucugcuucuacuccuucuuccucggcaaggagcucaagcucgucguccccugggucgacauccagaagcucgagcgcaccuccaacgucuuccucaccgacaccauccgcaucaccacccagaacaaggagcgcgacuucuccauguuccucaaccucgacgaggucuucaaggucauggagcagcucgccgacgucacccuccgccgccuccucgacaacgaggucuucgaccucgaccccgaccuccaggagcccucccagaucaccaagcgcgaccucgaggcccgcgcccagaacgaguucuuccgcgccuucuuccgccucccccgcaaggagaagcuccacgccgucgucgacugcucccucuggacccccuucucccgcugccacaccaccggccgcauguucgccuccgacuccuacaucugcuucgccucccgcgaggacggcugcugcaagaucauccucccccuccgcgaggucgucuccaucgagaagauggaggacaccucccuccucccccaccccaucaucgucuccauccgcuccaaggucgccuuccaguucaucgagcuccgcgaccgcgacucccucgucgaggcccuccucgcccgccucaagcagguccacgccaaccaccccguccacuacgacaccuccgccgacgacgacauggccucccucgucuuccacuccaccuccaugugcuccgaccaccgcuucggcgaccucgagaugauguccucccagaacuccgaggaguccgagaaggagaaguccccccucaugcaccccgacgcccucgucaccgccuuccagcaguccggcucccagucccccgacucccgcaugucccgcgagcagaucaagaucucccucuggaacgaccacuucgucgaguacggccgcaccgucugcauguuccgcaccgagaagauccgcaagcucgucgccaugggcauccccgagucccuccgcggccgccucuggcuccucuucuccgacgccgucaccgaccucgccucccaccccggcuacuacggcaaccucgucgaggagucccucggcaagugcugccucgucaccgaggagaucgagcgcgaccuccaccgcucccuccccgagcaccccgccuuccagaacgagaccggcaucgccgcccuccgccgcguccucaccgccuacgcccaccgcaaccccaagaucggcuacugccaguccaugaacauccucaccuccguccuccuccucuacaccaaggaggaggaggccuucuggcuccucgucgccgucugcgagcgcaugcuccccgacuacuucaaccaccgcgucaucggcgcccaggucgaccaguccgucuucgaggagcucaucaagggccaccuccccgagcucgccgagcacaugaacgaccucuccgcccucgccuccgucucccucuccugguuccucacccucuuccucuccaucaugccccucgaguccgccgucaacgucgucgacugcuucuucuacgacggcaucaaggccaucuuccagcucggccucgccguccucgaggccaacgccgaggaccucugcuccuccaaggacgacggccaggcccucaugauccucucccgcuuccucgaccacaucaagaacgaggacucccccggcccccccgucggcucccaccacgccuucuucuccgacgaccaggagcccuaccccgucaccgacaucuccgaccucauccgcgacuccuacgagaaguucggcgaccaguccgucgagcagaucgagcaccuccgcuacaagcaccgcauccgcguccuccagggccacgaggacaccaccaagcagaacguccuccgcgucgucauccccgaggucuccauccuccccgaggaccucgaggagcucuacgaccucuucaagcgcgagcacaugauguccugcuacugggagcagccccgccccauggccucccgccacgaccccucccgccccuacgccgagcaguaccgcaucgacgcccgccaguucgcccaccucuuccagcucgucucccccuggaccugcggcgcccacaccgagauccucgccgagcgcaccuuccgccuccucgacgacaacauggaccagcucaucgaguucaaggccuucgucuccugccucgacaucauguacaacggcgagaugaacgagaagaucaagcuccucuaccgccuccacaucccccccgcccucaccgagaacgaccgcgacucccaguccccccuccgcaacccccuccucuccaccucccgcccccucgucuucggcaagcccaacggcgacgccgucgacuaccagaagcagcucaagcagaugaucaaggaccucgccaaggagaaggacaagaccgagaaggagcuccccaagaugucccagcgcgaguucauccaguucugcaagacccucuacuccauguuccacgaggaccccgaggagaacgaccucuaccaggccaucgccaccgucaccacccuccuccuccagaucggcgaggucggccagcgcggcuccuccuccggcuccugcucccaggagugcggcgaggagcuccgcgccuccgcccccucccccgaggacuccgucuucgccgacaccggcaagaccccccaggacucccaggccuuccccgaggccgccgagcgcgacuggaccgucucccucgagcacauccucgccucccuccucaccgagcagucccucgucaacuucuucgagaagccccucgacaugaaguccaagcucgagaacgccaagaucaaccaguacaaccucaagaccuucgagaugucccaccagucccaguccgagcucaagcucuccaaccucuga

SEQ ID NO: 50516 - RNA, 3801 nt, Artificial Sequence
  derived and/or modified sequence opt2 from TBC1D9__Homo_sapiens__NP_055945
augugggucaaccccgaggagguccuccucgccaacgcccucuggaucaccgagcgcgccaaccccuacuucauccuccagcgccgcaagggccacgccggcgacggcggcggcggcggcggccucgccggccuccucgucggcacccucgacgucguccucgacuccuccgcccgcgucgcccccuaccgcauccucuaccagacccccgacucccucgucuacuggaccaucgccugcggcggcucccgcaaggagaucaccgagcacugggaguggcucgagcagaaccuccuccagacccucuccaucuucgagaacgagaacgacaucaccaccuucguccgcggcaagauccagggcaucaucgccgaguacaacaagaucaacgacgucaaggaggacgacgacaccgagaaguucaaggaggccaucgucaaguuccaccgccucuucggcaugcccgaggaggagaagcucgucaacuacuacuccugcuccuacuggaagggcaaggucccccgccagggcuggauguaccucuccaucaaccaccucugcuucuacuccuuccucaugggccgcgaggccaagcucgucauccgcugggucgacaucacccagcucgagaagaacgccacccuccuccuccccgacgucaucaaggucuccacccgcuccuccgagcacuucuucuccgucuuccucaacaucaacgagaccuucaagcucauggagcagcucgccaacaucgccaugcgccagcuccucgacaacgagggcuucgagcaggaccgcucccuccccaagcucaagcgcaagucccccaagaaggucuccgcccucaagcgcgaccucgacgcccgcgccaaguccgagcgcuaccgcgcccucuuccgccuccccaaggacgagaagcucgacggccacaccgacugcacccucuggacccccuucaacaagaugcacauccucggccagauguucgucuccaccaacuacaucugcuucaccuccaaggaggagaaccucugcucccucaucaucccccuccgcgaggucaccaucgucgagaaggccgacuccuccuccguccuccccuccccccucuccaucuccacccgcaaccgcaugaccuuccucuucgccaaccucaaggaccgcgacuuccucguccagcgcaucuccgacuuccuccagcagaccaccuccaagaucuacuccgacaaggaguucgccggcuccuacaacuccuccgacgacgaggucuacucccgccccuccucccucgucuccuccuccccccagcgcuccaccuccuccgacgccgacggcgagcgccaguucaaccucaacggcaacuccguccccaccgccacccagacccucaugaccauguaccgccgccgcucccccgaggaguucaaccccaagcucgccaaggaguuccucaaggagcaggccuggaagauccacuucgccgaguacggccagggcaucugcauguaccgcaccgagaagacccgcgagcucguccucaagggcauccccgaguccaugcgcggcgagcucuggcuccuccucuccggcgccaucaacgagaaggccacccaccccggcuacuacgaggaccucgucgagaaguccaugggcaaguacaaccucgccaccgaggagaucgagcgcgaccuccaccgcucccuccccgagcaccccgccuuccagaacgagaugggcaucgccgcccuccgccgcguccucaccgccuacgccuuccgcaaccccaacaucggcuacugccaggccaugaacaucgucaccuccguccuccuccucuacgccaaggaggaggaggccuucuggcuccucgucgcccucugcgagcgcaugcuccccgacuacuacaacacccgcgucgucggcgcccucgucgaccagggcgucuucgaggagcucgcccgcgacuacgucccccagcucuacgacugcaugcaggaccucggcgucaucuccaccaucucccucuccugguuccucacccucuuccucuccgucaugcccuucgaguccgccgucgucgucgucgacugcuucuucuacgagggcaucaaggucaucuuccagcucgcccucgccguccucgacgccaacgucgacaagcuccucaacugcaaggacgacggcgaggccaugaccguccucggccgcuaccucgacuccgucaccaacaaggacuccacccucccccccaucccccaccuccacucccuccucuccgacgacgucgagcccuaccccgaggucgacaucuuccgccucauccgcaccuccuacgagaaguucggcaccauccgcgccgaccucaucgagcagaugcgcuucaagcagcgccucaaggucauccagacccucgaggacaccaccaagcgcaacgucguccgcaccaucgucaccgagaccuccuucaccaucgacgagcucgaggagcucuacgcccucuucaaggccgagcaccucaccuccugcuacuggggcggcuccuccaacgcccucgaccgccacgaccccucccuccccuaccucgagcaguaccgcaucgacuucgagcaguucaagggcauguucgcccuccucuuccccugggccugcggcacccacuccgacguccucgccucccgccucuuccagcuccucgacgagaacggcgacucccucaucaacuuccgcgaguucgucuccggccucuccgccgccugccacggcgaccucaccgagaagcucaagcuccucuacaagaugcacguccuccccgagcccuccuccgaccaggacgagcccgacuccgccuucgaggccacccaguacuucuucgaggacaucacccccgagugcacccacgucgucggccucgacucccgcuccaagcagggcgccgacgacggcuucgucaccgucucccucaagcccgacaagggcaagcgcgccaacucccaggagaaccgcaacuaccuccgccucuggacccccgagaacaaguccaaguccaagaacgccaaggaccuccccaagcucaaccagggccaguucaucgagcucugcaagaccauguacaacauguucuccgaggaccccaacgagcaggagcucuaccacgccaccgccgccgucaccucccuccuccucgagaucggcgaggucggcaagcucuucgucgcccagcccgccaaggagggcggcuccggcggcuccggccccuccugccaccagggcauccccggcguccucuuccccaagaagggccccggccagcccuacgucgucgaguccgucgagccccuccccgccucccucgcccccgacuccgaggagcacucccucggcggccagauggaggacaucaagcucgaggacuccuccccccgcgacaacggcgccugcuccuccaugcucaucuccgacgacgacaccaaggacgacuccuccauguccuccuacuccguccucuccgccggcucccacgaggaggacaagcuccacugcgaggacaucggcgaggacaccguccucguccgcuccggccagggcaccgccgcccucccccgcuccaccucccucgaccgcgacugggccaucaccuucgagcaguuccucgccucccuccucaccgagcccgcccucgucaaguacuucgacaagcccgucugcaugauggcccgcaucaccuccgccaagaacauccgcaugaugggcaagccccucaccuccgccuccgacuacgagaucuccgccauguccggcuga

SEQ ID NO: 50517 - RNA, 390 nt, Artificial Sequence
  derived and/or modified sequence opt2 from TBCA__Homo_sapiens__NP_001284667
auggccgacccccgcguccgccagaucaagaucaagaccggcgucgucaagcgccucgucaaggagaaggucauguacgagaaggaggccaagcagcaggaggagaagaucgagaagaugcgcgccgaggacggcgagaacuacgacaucaagaagcaggccgagauccuccaggagucccgcaugaugauccccgacugccagcgccgccucgaggccgccuaccucgaccuccagcgcauccucgucuccaaggacuucugcgucauguucaaguucuucuucuccauccaguacauggagucccagaaguucaaguaccucacccuccgcaccuccuggcaguacuuccucuucaccugcccccucuaccgcuacauccucaaguga

SEQ ID NO: 50518 - RNA, 1041 nt, Artificial Sequence
  derived and/or modified sequence opt2 from TBCC__Homo_sapiens__NP_003183
auggaguccgucuccugcuccgccgccgccguccgcaccggcgacauggagucccagcgcgaccucucccucguccccgagcgccuccagcgccgcgagcaggagcgccagcucgaggucgagcgccgcaagcagaagcgccagaaccaggaggucgagaaggagaacucccacuucuucgucgccaccuucgcccgcgagcgcgccgccgucgaggagcuccucgagcgcgccgaguccgucgagcgccucgaggaggccgccucccgccuccagggccuccagaagcucaucaacgacuccgucuucuuccucgccgccuacgaccuccgccagggccaggaggcccucgcccgccuccaggccgcccucgccgagcgccgccgcggccuccagcccaagaagcgcuucgccuucaagacccgcggcaaggacgccgccuccuccaccaaggucgacgccgcccccggcaucccccccgccgucgaguccauccaggacuccccccuccccaagaaggccgagggcgaccucggccccuccugggucugcggcuucuccaaccucgagucccagguccucgagaagcgcgccuccgagcuccaccagcgcgacguccuccucaccgagcucuccaacugcaccguccgccucuacggcaaccccaacacccuccgccucaccaaggcccacuccugcaagcuccucugcggccccgucuccaccuccgucuuccucgaggacugcuccgacugcguccucgccgucgccugccagcagcuccgcauccacuccaccaaggacacccgcaucuuccuccaggucaccucccgcgccaucgucgaggacugcuccggcauccaguucgcccccuacaccugguccuaccccgagaucgacaaggacuucgaguccuccggccucgaccgcuccaagaacaacuggaacgacgucgacgacuucaacuggcucgcccgcgacauggccucccccaacugguccauccuccccgaggaggagcgcaacauccagugggacuga

SEQ ID NO: 50519 - RNA, 3579 nt, Artificial Sequence
  derived and/or modified sequence opt2 from TBCD__Homo_sapiens__NP_005984
auggcccucuccgacgagcccgccgccggcggccccgaggaggaggccgaggacgagacccucgccuucggcgccgcccucgaggccuucggcgaguccgccgagacccgcgcccuccucggccgccuccgcgagguccacggcggcggcgccgagcgcgaggucgcccucgagcgcuuccgcgucaucauggacaaguaccaggagcagccccaccuccucgacccccaccucgaguggaugaugaaccuccuccucgacaucguccaggaccagaccucccccgccucccucguccaccucgccuucaaguuccucuacaucaucaccaagguccgcggcuacaagaccuuccuccgccucuucccccacgaggucgccgacgucgagcccguccucgaccucgucaccauccagaaccccaaggaccacgaggccugggagacccgcuacaugcuccuccucuggcucuccgucaccugccucauccccuucgacuucucccgccucgacggcaaccuccucacccagcccggccaggcccgcauguccaucauggaccgcauccuccagaucgccgaguccuaccucaucgucuccgacaaggcccgcgacgccgccgccguccucgucucccgcuucaucacccgccccgacgucaagcaguccaagauggccgaguuccucgacuggucccucugcaaccucgcccgcuccuccuuccagaccaugcagggcgucaucaccauggacggcacccuccaggcccucgcccagaucuucaagcacggcaagcgcgaggacugccuccccuacgccgccaccguccuccgcugccucgacggcugccgccuccccgaguccaaccagacccuccuccgcaagcucggcgucaagcucguccagcgccucggccucaccuuccucaagcccaaggucgccgccuggcgcuaccagcgcggcugccgcucccucgccgccaaccuccagcuccucacccagggccaguccgagcagaagccccucauccucaccgaggacgacgacgaggacgacgacguccccgagggcgucgagcgcgucaucgagcagcuccucgucggccucaaggacaaggacaccgucguccgcugguccgccgccaagggcaucggccgcauggccggccgccucccccgcgcccucgccgacgacgucgucggcuccguccucgacugcuucuccuuccaggagaccgacaaggccuggcacggcggcugccucgcccucgccgagcucggccgccgcggccuccuccuccccucccgccucgucgacgucgucgccgucauccucaaggcccucaccuacgacgagaagcgcggcgccugcuccgucggcaccaacguccgcgacgccgccugcuacgucugcugggccuucgcccgcgccuacgagccccaggagcucaagcccuucgucaccgccaucuccuccgcccucgucaucgccgccgucuucgaccgcgacaucaacugccgccgcgccgccuccgccgccuuccaggagaacgucggccgccagggcaccuucccccacggcaucgacauccucaccaccgccgacuacuucgccgucggcaaccgcuccaacugcuuccucgucaucuccgucuucaucgccggcuuccccgaguacacccagcccaugaucgaccaccucgucaccaugaagaucucccacugggacggcgucauccgcgagcucgccgcccgcgcccuccacaaccucgcccagcaggcccccgaguucuccgccacccaggucuucccccgccuccucuccaugacccucucccccgaccuccacaugcgccacggcuccauccucgccugcgccgaggucgccuacgcccucuacaagcucgccgcccaggagaaccgccccgucaccgaccaccucgacgagcaggccguccagggccucaagcagauccaccagcagcucuacgaccgccagcucuaccgcggccucggcggccagcucaugcgccaggccgucugcguccucaucgagaagcucucccucuccaagaugcccuuccgcggcgacaccgucaucgacggcuggcaguggcucaucaacgacacccuccgccaccuccaccucaucuccucccacucccgccagcagaugaaggacgccgccgucuccgcccucgccgcccucugcuccgaguacuacaugaaggagcccggcgaggccgaccccgccauccaggaggagcucaucacccaguaccucgccgagcuccgcaaccccgaggagaugacccgcugcggcuucucccucgcccucggcgcccuccccggcuuccuccucaagggccgccuccagcagguccucaccggccuccgcgccgucacccacaccucccccgaggacgucuccuucgccgagucccgccgcgacggccucaaggccaucgcccgcaucugccagaccgucggcgucaaggccggcgcccccgacgaggccgucugcggcgagaacgucucccagaucuacugcgcccuccucggcugcauggacgacuacaccaccgacucccgcggcgacgucggcaccuggguccgcaaggccgccaugaccucccucauggaccucacccuccuccucgcccgcucccagcccgagcucaucgaggcccacaccugcgagcgcaucaugugcugcgucgcccagcaggccuccgagaagaucgaccgcuuccgcgcccacgccgccuccgucuuccucacccuccuccacuucgacuccccccccaucccccacgucccccaccgcggcgagcucgagaagcucuucccccgcuccgacgucgccuccgucaacugguccgcccccucccaggccuucccccgcaucacccagcuccucggccuccccaccuaccgcuaccacguccuccucggccucgucgucucccucggcggccucaccgaguccaccauccgccacuccacccagucccucuucgaguacaugaagggcauccaguccgacccccaggcccucggcuccuucuccggcacccuccuccagaucuucgaggacaaccuccucaacgagcgcgucuccgucccccuccucaagacccucgaccacguccucacccacggcugcuucgacaucuucaccaccgaggaggaccaccccuucgccgucaagcuccucgcccucugcaagaaggagaucaagaacuccaaggacauccagaagcuccucuccggcaucgccgucuucugcgagaugguccaguuccccggcgacguccgccgccaggcccuccuccagcucugccuccuccucugccaccgcuucccccucauccgcaagaccaccgccucccaggucuacgagacccuccucaccuacuccgacgucgucggcgccgacguccucgacgaggucgucaccguccucuccgacaccgccugggacgccgagcucgccgucguccgcgagcagcgcaaccgccucugcgaccuccucggcgucccccgcccccagcucgucccccagcccggcgccugcuga

SEQ ID NO: 50520 - RNA, 1584 nt, Artificial Sequence
  derived and/or modified sequence opt2 from TBCE__Homo_sapiens__NP_001072983
auguccgacacccucaccgccgacgucaucggccgccgcgucgaggucaacggcgagcacgccaccguccgcuucgccggcgucgucccccccgucgccggccccuggcucggcgucgagugggacaaccccgagcgcggcaagcacgacggcucccacgagggcaccgucuacuucaagugccgccaccccaccggcggcuccuucauccgccccaacaaggucaacuucggcaccgacuuccucaccgccaucaagaaccgcuacguccucgaggacggccccgaggaggaccgcaaggagcagaucgucaccaucggcaacaagcccgucgagaccaucggcuucgacuccaucaugaagcagcagucccagcucuccaagcuccaggaggucucccuccgcaacugcgccgucuccugcgccggcgagaagggcggcgucgccgaggccugccccaacauccgcaaggucgaccucuccaagaaccuccucuccuccugggacgaggucauccacaucgccgaccagcuccgccaccucgagguccucaacgucuccgagaacaagcucaaguuccccuccggcuccguccucaccggcacccucuccguccucaagguccucguccucaaccagaccggcaucaccugggccgagguccuccgcugcgucgccggcugccccggccucgaggagcucuaccucgaguccaacaacaucuucaucuccgagcgccccaccgacguccuccagaccgucaagcuccucgaccucuccuccaaccagcucaucgacgagaaccagcucuaccucaucgcccaccucccccgccucgagcagcucauccucuccgacaccggcaucuccucccuccacuuccccgacgccggcaucggcugcaagaccuccauguuccccucccucaaguaccucgucgucaacgacaaccagaucucccagugguccuucuucaacgagcucgagaagcuccccucccuccgcgcccucuccugccuccgcaacccccucaccaaggaggacaaggaggccgagaccgcccgccuccucaucaucgccuccaucggccagcucaagacccucaacaagugcgagauccuccccgaggagcgccgccgcgccgagcucgacuaccgcaaggccuucggcaacgaguggaagcaggccggcggccacaaggaccccgagaagaaccgccucuccgaggaguuccucaccgcccacccccgcuaccaguuccucugccucaaguacggcgcccccgaggacugggagcucaagacccagcagccccucaugcucaagaaccagcuccucacccucaagaucaaguacccccaccagcucgaccagaagguccucgagaagcagcuccccggcuccaugaccauccagaaggucaagggccuccucucccgccuccucaagguccccgucuccgaccuccuccucuccuacgagucccccaagaagcccggccgcgagaucgagcucgagaacgaccucaagucccuccaguucuacuccgucgagaacggcgacugccuccucguccgcugguga

SEQ ID NO: 50521 - RNA, 1275 nt, Artificial Sequence
  derived and/or modified sequence opt2 from TBCEL__Homo_sapiens__NP_001123519
auggaccagcccuccggccgcuccuucaugcagguccucugcgagaaguacucccccgagaacuuccccuaccgccgcggccccggcaugggcguccacguccccgccaccccccagggcucccccaugaaggaccgccucaaccuccccuccguccucguccucaacuccugcggcaucaccugcgccggcgacgagaaggagaucgccgccuucugcgcccacgucuccgagcucgaccucuccgacaacaagcucgaggacuggcacgaggucuccaagaucgucuccaacgucccccagcucgaguuccucaaccucuccuccaacccccucaaccucuccguccucgagcgcaccugcgccggcuccuucuccggcguccgcaagcucguccucaacaacuccaaggccuccugggagaccguccacaugauccuccaggagcuccccgaccucgaggagcucuuccucugccucaacgacuacgagaccgucuccugccccuccaucugcugccacucccucaagcuccuccacaucaccgacaacaaccuccaggacuggaccgagauccgcaagcucggcgucauguuccccucccucgacacccucguccucgccaacaaccaccucaacgccaucgaggagcccgacgacucccucgcccgccucuuccccaaccuccgcuccaucucccuccacaaguccggccuccaguccugggaggacaucgacaagcucaacuccuuccccaagcucgaggagguccgccuccucggcaucccccuccuccagcccuacaccaccgaggagcgccgcaagcucgucaucgcccgccuccccuccgucuccaagcucaacggcuccgucgucaccgacggcgagcgcgaggacuccgagcgcuucuucauccgcuacuacgucgacgucccccaggaggagguccccuuccgcuaccacgagcucaucaccaaguacggcaagcucgagccccucgccgaggucgaccuccgcccccaguccuccgccaaggucgagguccacuucaacgaccaggucgaggagauguccauccgccucgaccagaccgucgccgagcucaagaagcagcucaagacccucguccagcuccccaccuccaacaugcuccucuacuacuucgaccacgaggcccccuucggccccgaggagaugaaguacuccucccgcgcccuccacuccuucggcauccgcgacggcgacaagaucuacgucgaguccaagaccaaguga

SEQ ID NO: 50522 - RNA, 2190 nt, Artificial Sequence
  derived and/or modified sequence opt2 from TBK1__Homo_sapiens__XP_005268867
augcaguccaccuccaaccaccucuggcuccucuccgacauccucggccagggcgccaccgccaacgucuuccgcggccgccacaagaagaccggcgaccucuucgccaucaaggucuucaacaacaucuccuuccuccgccccgucgacguccagaugcgcgaguucgagguccucaagaagcucaaccacaagaacaucgucaagcucuucgccaucgaggaggagaccaccacccgccacaagguccucaucauggaguucugccccugcggcucccucuacaccguccucgaggagcccuccaacgccuacggccuccccgaguccgaguuccucaucguccuccgcgacgucgucggcggcaugaaccaccuccgcgagaacggcaucguccaccgcgacaucaagcccggcaacaucaugcgcgucaucggcgaggacggccaguccgucuacaagcucaccgacuucggcgccgcccgcgagcucgaggacgacgagcaguucgucucccucuacggcaccgaggaguaccuccaccccgacauguacgagcgcgccguccuccgcaaggaccaccagaagaaguacggcgccaccgucgaccucugguccaucggcgucaccuucuaccacgccgccaccggcucccuccccuuccgccccuucgagggcccccgccgcaacaaggaggucauguacaagaucaucaccggcaagcccuccggcgccaucuccggcguccagaaggccgagaacggccccaucgacugguccggcgacaugcccgucuccugcucccucucccgcggccuccagguccuccucacccccguccucgccaacauccucgaggccgaccaggagaagugcuggggcuucgaccaguucuucgccgagaccuccgacauccuccaccgcauggucauccacgucuucucccuccagcagaugaccgcccacaagaucuacauccacuccuacaacaccgccaccaucuuccacgagcucgucuacaagcagaccaagaucaucuccuccaaccaggagcucaucuacgagggccgccgccucguccucgagcccggccgccucgcccagcacuuccccaagaccaccgaggagaaccccaucuucgucgucucccgcgagccccucaacaccaucggccucaucuacgagaagaucucccuccccaagguccacccccgcuacgaccucgacggcgacgccuccauggccaaggccaucaccggcgucgucugcuacgccugccgcaucgccuccacccuccuccucuaccaggagcucaugcgcaagggcauccgcuggcucaucgagcucaucaaggacgacuacaacgagaccguccacaagaagaccgaggucgucaucacccucgacuucugcauccgcaacaucgagaagaccgucaaggucuacgagaagcucaugaagaucaaccucgaggccgccgagcucggcgagaucuccgacauccacaccaagcuccuccgccucuccuccucccagggcaccaucgagaccucccuccaggacaucgacucccgccucucccccggcggcucccucgccgacgccugggcccaccaggagggcacccaccccaaggaccgcaacgucgagaagcuccagguccuccucaacugcaugaccgagaucuacuaccaguucaagaaggacaaggccgagcgccgccucgccuacaacgaggagcagauccacaaguucgacaagcagaagcucuacuaccacgccaccaaggccaugacccacuucaccgacgagugcgucaagaaguacgaggccuuccucaacaaguccgaggaguggauccgcaagaugcuccaccuccgcaagcagcuccucucccucaccaaccagugcuucgacaucgaggaggaggucuccaaguaccaggaguacaccaacgagcuccaggagacccucccccagaagauguucaccgccuccuccggcaucaagcacaccaugacccccaucuaccccuccuccaacacccucgucgagaugacccucggcaugaagaagcucaaggaggagauggagggcgucgucaaggagcucgccgagaacaaccacauccucgagcgcuucggcucccucaccauggacggcggccuccgcaacgucgacugccucuga

SEQ ID NO: 50523 - RNA, 1848 nt, Artificial Sequence
  derived and/or modified sequence opt2 from TBKBP1__Homo_sapiens__NP_055541
auggaguccauguucgaggacgacaucuccauccucacccaggaggcccucggccccuccgaggucuggcucgacucccccggcgaccccucccucggcggcgacaugugcuccgccucccacuucgcccucaucaccgccuacggcgacaucaaggagcgccucggcggccucgagcgcgagaacgccacccuccgccgccgccucaaggucuacgagaucaaguacccccucaucuccgacuucggcgaggagcacggcuucucccucuacgagaucaaggacggcucccuccucgaggucgagaaggucucccuccagcagcgccucaaccaguuccagcacgagcuccagaagaacaaggagcaggaggagcagcucggcgagaugauccaggccuacgagaagcucugcgucgagaaguccgaccucgagaccgagcuccgcgagaugcgcgcccucgucgagacccaccuccgccagaucugcggccucgagcagcagcuccgccagcagcagggccuccaggacgccgccuucuccaaccucucccccccccccgcccccgccccccccugcaccgaccucgaccuccacuaccucgcccuccgcggcggcuccggccucucccacgccggcuggcccggcuccacccccuccgucuccgaccucgagcgccgccgccucgaggaggcccucgaggccgcccagggcgaggcccgcggcgcccagcuccgcgaggagcagcuccaggccgagugcgagcgccuccagggcgagcucaagcagcuccaggagacccgcgcccaggaccucgccuccaaccaguccgagcgcgacauggccugggucaagcgcgucggcgacgaccaggucaaccucgcccucgccuacaccgagcucaccgaggagcucggccgccuccgcgagcucuccucccuccagggccgcauccuccgcacccuccuccaggagcaggcccgcuccggcggccagcgccacuccccccucucccagcgccacucccccgccccccagugccccucccccuccccccccgcccgcgccgccccccccugcccccccugccagucccccgucccccagcgccgcucccccgucccccccugccccuccccccagcagcgccgcucccccgccucccccuccugccccucccccgucccccagcgccgcucccccgucccccccuccugccagucccccuccccccagcgccgcucccccgucccccccuccugccccgccccccagccccgccccccccccccccccccccccggcgagcgcacccucgccgagcgcgccuacgccaagccccccucccaccacgucaaggccggcuuccagggccgccgcuccuacuccgagcucgccgagggcgccgccuacgccggcgccuccccccccuggcuccaggccgaggccgccacccuccccaagccccgcgccuacggcuccgagcucuacggccccggccgcccccucuccccccgccgcgccuucgagggcauccgccuccgcuucgagaagcagcccuccgaggaggacgagugggccguccccaccuccccccccucccccgaggucggcaccauccgcugcgccuccuucugcgccggcuuccccauccccgagucccccgccgccaccgccuacgcccacgccgagcacgcccaguccuggcccuccaucaaccuccucauggagaccgucggcuccgacauccgcuccugcccccucugccagcucggcuuccccgucggcuaccccgacgacgcccucaucaagcacaucgacucccaccucgagaacuccaagaucuga

SEQ ID NO: 50524 - RNA, 1734 nt, Artificial Sequence
  derived and/or modified sequence opt2 from TBL1X__Homo_sapiens__NP_001132938
augaccgagcucgccggcgccuccuccuccugcugccaccgccccgccggccgcggcgccaugcaguccguccuccaccacuuccagcgccuccgcggccgcgagggcggcucccacuucaucaacaccuccuccccccgcggcgaggccaagauguccaucaccuccgacgaggucaacuuccucgucuaccgcuaccuccaggaguccggcuucucccacuccgccuucaccuucggcaucgagucccacaucucccaguccaacaucaacggcacccucgucccccccgccgcccucaucuccauccuccagaagggccuccaguacgucgaggccgagaucuccaucaacgaggacggcaccgucuucgacggccgccccaucgagucccucucccucaucgacgccgucaugcccgacgucguccagacccgccagcaggccuuccgcgagaagcucgcccagcagcaggccuccgccgccgccgccgccgccgccgccaccgccgccgccaccgccgccaccaccaccuccgccggcgucucccaccagaaccccuccaagaaccgcgaggccaccgucaacggcgaggagaaccgcgcccacuccgucaacaaccacgccaagcccauggagaucgacggcgaggucgagauccccuccuccaaggccaccguccuccgcggccacgaguccgaggucuucaucugcgccuggaaccccgucuccgaccuccucgccuccggcuccggcgacuccaccgcccgcaucuggaaccucaacgagaacuccaacggcggcuccacccagcucguccuccgccacugcauccgcgagggcggccacgacguccccuccaacaaggacgucaccucccucgacuggaacaccaacggcacccuccucgccaccggcuccuacgacggcuucgcccgcaucuggaccgaggacggcaaccucgccuccacccucggccagcacaagggccccaucuucgcccucaaguggaaccgcaagggcaacuacauccucuccgccggcgucgacaagaccaccaucaucugggacgcccacaccggcgaggccaagcagcaguuccccuuccacuccgcccccgcccucgacgucgacuggcagaacaacaccaccuucgccuccugcuccaccgacaugugcauccacgucugccgccucggcugcgaccgccccgucaagaccuuccagggccacaccaacgaggucaacgccaucaagugggaccccuccggcaugcuccucgccuccugcuccgacgacaugacccucaagaucugguccaugaagcaggaggucugcauccacgaccuccaggcccacaacaaggagaucuacaccaucaaguggucccccaccggccccgccaccuccaaccccaacuccaacaucaugcucgccuccgccuccuucgacuccaccguccgccucugggacaucgagcgcggcgucugcacccacacccucaccaagcaccaggagcccgucuacuccgucgccuucucccccgacggcaaguaccucgccuccggcuccuucgacaagugcguccacaucuggaacacccaguccggcaaccucguccacuccuaccgcggcaccggcggcaucuucgaggucugcuggaacgcccgcggcgacaaggucggcgccuccgccuccgacggcuccgucugcguccucgaccuccgcaaguga

SEQ ID NO: 50525 - RNA, 1575 nt, Artificial Sequence
  derived and/or modified sequence opt2 from TBL1XR1__Homo_sapiens__XP_005247828
augggcgucaagcaccagcagcagcagcucgucaucggcggcgaccgcaucuucuccugcaccuccccccaccagugcaccgccaacggcuucucccacuccgccuucaccuucggcaucgagucccacaucucccaguccaacaucaacggcgcccucgucccccccgccgcccucaucuccaucauccagaagggccuccaguacgucgaggccgaggucuccaucaacgaggacggcacccucuucgacggccgccccaucgagucccucucccucaucgacgccgucaugcccgacgucguccagacccgccagcaggccuaccgcgacaagcucgcccagcagcaggccgccgccgccgccgccgccgccgccgccgccucccagcagggcuccgccaagaacggcgagaacaccgccaacggcgaggagaacggcgcccacaccaucgccaacaaccacaccgacaugauggaggucgacggcgacgucgagaucccccccaacaaggccgucguccuccgcggccacgaguccgaggucuucaucugcgccuggaaccccgucuccgaccuccucgccuccggcuccggcgacuccaccgcccgcaucuggaaccucuccgagaacuccaccuccggcuccacccagcucguccuccgccacugcauccgcgagggcggccaggacguccccuccaacaaggacgucaccucccucgacuggaacuccgagggcacccuccucgccaccggcuccuacgacggcuucgcccgcaucuggaccaaggacggcaaccucgccuccacccucggccagcacaagggccccaucuucgcccucaaguggaacaagaagggcaacuucauccucuccgccggcgucgacaagaccaccaucaucugggacgcccacaccggcgaggccaagcagcaguuccccuuccacuccgcccccgcccucgacgucgacuggcaguccaacaacaccuucgccuccugcuccaccgacaugugcauccacgucugcaagcucggccaggaccgccccaucaagaccuuccagggccacaccaacgaggucaacgccaucaagugggaccccaccggcaaccuccucgccuccugcuccgacgacaugacccucaagaucugguccaugaagcaggacaacugcguccacgaccuccaggcccacaacaaggagaucuacaccaucaaguggucccccaccggccccggcaccaacaaccccaacgccaaccucaugcucgccuccgccuccuucgacuccaccguccgccucugggacgucgaccgcggcaucugcauccacacccucaccaagcaccaggagcccgucuacuccgucgccuucucccccgacggccgcuaccucgccuccggcuccuucgacaagugcguccacaucuggaacacccagaccggcgcccucguccacuccuaccgcggcaccggcggcaucuucgaggucugcuggaacgccgccggcgacaaggucggcgccuccgccuccgacggcuccgucugcguccucgaccuccgcaaguga

SEQ ID NO: 50526 - RNA, 1569 nt, Artificial Sequence
  derived and/or modified sequence opt2 from TBL1Y__Homo_sapiens__NP_599021
auguccaucaccuccgacgaggucaacuuccucgucuaccgcuaccuccaggaguccggcuucucccacuccgccuucaccuucggcaucgagucccacaucucccaguccaacaucaacggcacccucgucccccccuccgcccucaucuccauccuccagaagggccuccaguacgucgaggccgagaucuccaucaacaaggacggcaccgucuucgacucccgccccaucgagucccucucccucaucgucgccgucauccccgacgucguccagaugcgccagcaggccuucggcgagaagcucacccagcagcaggccuccgccgccgccaccgaggccuccgccauggccaaggccgccaccaugacccccgccgccaucucccagcagaacccccccaagaaccgcgaggccaccgucaacggcgaggagaacggcgcccacgagaucaacaaccacuccaagcccauggagaucgacggcgacgucgagaucccccccaacaaggccaccguccuccgcggccacgaguccgaggucuucaucugcgccuggaaccccgucuccgaccuccucgccuccggcuccggcgacuccaccgcccgcaucuggaaccucaacgagaacuccaacggcggcuccacccagcucguccuccgccacugcauccgcgagggcggccacgacguccccuccaacaaggacgucaccucccucgacuggaacuccgacggcacccuccucgccaugggcuccuacgacggcuucgcccgcaucuggaccgagaacggcaaccucgccuccacccucggccagcacaagggccccaucuucgcccucaaguggaacaagaagggcaacuacguccucuccgccggcgucgacaagaccaccaucaucugggacgcccacaccggcgaggccaagcagcaguuccccuuccacuccgcccccgcccucgacgucgacuggcagaacaacaugaccuucgccuccugcuccaccgacaugugcauccacgucugccgccucggcugcgaccaccccgucaagaccuuccagggccacaccaacgaggucaacgccaucaagugggaccccuccggcaugcuccucgccuccugcuccgacgacaugacccucaagaucugguccaugaagcaggacgccugcguccacgaccuccaggcccacuccaaggagaucuacaccaucaaguggucccccaccggccccgccaccuccaaccccaacuccuccaucaugcucgccuccgccuccuucgacuccaccguccgccucugggacgucgagcagggcgucugcacccacacccucaugaagcaccaggagcccgucuacuccgucgccuucucccccgacggcaaguaccucgccuccggcuccuucgacaaguacguccacaucuggaacacccaguccggcucccucguccacuccuaccagggcaccggcggcaucuucgaggucugcuggaacgcccgcggcgacaaggucggcgccuccgccuccgacggcuccgucugcguccucgaccucuga

SEQ ID NO: 50527 - RNA, 1344 nt, Artificial Sequence
  derived and/or modified sequence opt2 from TBL2__Homo_sapiens__NP_036585
auggagcucucccagauguccgagcucaugggccucuccguccuccucggccuccucgcccucauggccaccgccgccgucgcccgcggcuggcuccgcgccggcgaggagcgcuccggccgccccgccugccagaaggccaacggcuucccccccgacaaguccuccggcuccaagaagcagaagcaguaccagcgcauccgcaaggagaagccccagcagcacaacuucacccaccgccuccucgccgccgcccucaagucccacuccggcaacaucuccugcauggacuucuccuccaacggcaaguaccucgccaccugcgccgacgaccgcaccauccgcaucugguccaccaaggacuuccuccagcgcgagcaccgcuccaugcgcgccaacgucgagcucgaccacgccacccucguccgcuucucccccgacugccgcgccuucaucgucuggcucgccaacggcgacacccuccgcgucuucaagaugaccaagcgcgaggacggcggcuacaccuucaccgccacccccgaggacuuccccaagaagcacaaggcccccgucaucgacaucggcaucgccaacaccggcaaguucaucaugaccgccuccuccgacaccaccguccucaucuggucccucaagggccagguccucuccaccaucaacaccaaccagaugaacaacacccacgccgccgucucccccugcggccgcuucgucgccuccugcggcuucacccccgacgucaaggucugggaggucugcuucggcaagaagggcgaguuccaggaggucguccgcgccuucgagcucaagggccacuccgccgccguccacuccuucgccuucuccaacgacucccgccgcauggccuccgucuccaaggacggcaccuggaagcucugggacaccgacgucgaguacaagaagaagcaggaccccuaccuccucaagaccggccgcuucgaggaggccgccggcgccgcccccugccgccucgcccucucccccaacgcccagguccucgcccucgccuccggcuccuccauccaccucuacaacacccgccgcggcgagaaggaggagugcuucgagcgcguccacggcgagugcaucgccaaccucuccuucgacaucaccggccgcuuccucgccuccugcggcgaccgcgccguccgccucuuccacaacacccccggccaccgcgccauggucgaggagaugcagggccaccucaagcgcgccuccaacgaguccacccgccagcgccuccagcagcagcucacccaggcccaggagacccucaagucccucggcgcccucaagaaguga

SEQ ID NO: 50528 - RNA, 2427 nt, Artificial Sequence
  derived and/or modified sequence opt2 from TBL3__Homo_sapiens__NP_006444
auggccgagaccgccgccggcgucggccgcuucaagaccaacuacgccgucgagcgcaagaucgagcccuucuacaagggcggcaaggcccagcucgaccagaccggccagcaccucuucugcgucugcggcacccgcgucaacauccucgaggucgccuccggcgccguccuccgcucccucgagcaggaggaccaggaggacaucaccgccuucgaccucucccccgacaacgagguccucgucaccgccucccgcgcccuccuccucgcccagugggccuggcaggagggcuccgucacccgccucuggaaggccauccacaccgcccccgucgccaccauggccuucgaccccaccuccacccuccucgccaccggcggcugcgacggcgccguccgcgucugggacaucguccgccacuacggcacccaccacuuccgcggcucccccggcgucguccaccucgucgccuuccaccccgaccccacccgccuccuccucuucuccuccgccaccgacgccgccauccgcgucuggucccuccaggaccgcuccugccucgccguccucaccgcccacuacuccgccgucaccucccucgccuucuccgccgacggccacaccaugcucuccuccggccgcgacaagaucugcaucaucugggaccuccaguccugccaggccacccgcaccguccccgucuucgaguccgucgaggccgccguccuccuccccgaggagcccgucucccagcucggcgucaagucccccggccucuacuuccucaccgccggcgaccagggcacccuccgcgucugggaggccgccuccggccagugcgucuacacccaggcccagccccccggccccggccaggagcucacccacugcacccucgcccacaccgccggcgucguccucaccgccaccgccgaccacaaccuccuccucuacgaggcccgcucccuccgccuccagaagcaguucgccggcuacuccgaggagguccucgacguccgcuuccucggccccgaggacucccacgucgucgucgccuccaacucccccugccucaaggucuucgagcuccagaccuccgccugccagauccuccacggccacaccgacaucguccucgcccucgacgucuuccgcaagggcuggcucuucgccuccugcgccaaggaccaguccguccgcaucuggcgcaugaacaaggccggccaggucaugugcgucgcccagggcuccggccacacccacuccgucggcaccgucugcugcucccgccucaaggaguccuuccucgucaccggcucccaggacugcaccgucaagcucuggccccuccccaaggcccuccucuccaagaacaccgcccccgacaacggccccauccuccuccaggcccagaccacccagcgcugccacgacaaggacaucaacuccgucgccaucgcccccaacgacaagcuccucgccaccggcucccaggaccgcaccgccaagcucugggcccucccccagugccagcuccucggcgucuucuccggccaccgccgcggccucuggugcguccaguucucccccauggaccagguccucgccaccgccuccgccgacggcaccaucaagcucugggcccuccaggacuucuccugccucaagaccuucgagggccacgacgccuccguccucaaggucgccuucgucucccgcggcacccagcuccucuccuccggcuccgacggccucgucaagcucuggaccaucaagaacaacgagugcguccgcacccucgacgcccacgaggacaaggucuggggccuccacugcucccgccucgacgaccacgcccucaccggcgccuccgacucccgcgucauccucuggaaggacgucaccgaggccgagcaggccgaggagcaggcccgccaggaggagcaggucguccgccagcaggagcucgacaaccuccuccacgagaagcgcuaccuccgcgcccucggccucgccaucucccucgaccgcccccacaccguccucaccgucauccaggccauccgccgcgaccccgaggccugcgagaagcucgaggccaccaugcuccgccuccgccgcgaccagaaggaggcccuccuccgcuucugcgucaccuggaacaccaacucccgccacugccacgaggcccaggccguccucggcguccuccuccgccgcgaggcccccgaggagcuccucgccuacgagggcguccgcgccgcccucgaggcccuccuccccuacaccgagcgccacuuccagcgccucucccgcacccuccaggccgccgccuuccucgacuuccucuggcacaacaugaagcuccccguccccgccgccgcccccacccccugggagacccacaagggcgcccuccccuga

SEQ ID NO: 50529 - RNA, 960 nt, Artificial Sequence
  derived and/or modified sequence opt2 from TBP__Homo_sapiens__NP_001165556
augacccccggcauccccaucuucucccccaugaugcccuacggcaccggccucaccccccagcccauccagaacaccaacucccucuccauccucgaggagcagcagcgccagcagcagcagcagcagcagcagcagcagcagcagcagcagcagcagcagcagcagcagcagcagcagcagcagcagcagcagcagcagcagcagcagcagcagcagcagcaggccgucgccgccgccgccguccagcaguccaccucccagcaggccacccagggcaccuccggccaggccccccagcucuuccacucccagacccucaccaccgccccccuccccggcaccaccccccucuaccccucccccaugacccccaugacccccaucacccccgccacccccgccuccgaguccuccggcaucgucccccagcuccagaacaucgucuccaccgucaaccucggcugcaagcucgaccucaagaccaucgcccuccgcgcccgcaacgccgaguacaaccccaagcgcuucgccgccgucaucaugcgcauccgcgagccccgcaccaccgcccucaucuucuccuccggcaagauggucugcaccggcgccaaguccgaggagcagucccgccucgccgcccgcaaguacgcccgcgucguccagaagcucggcuuccccgccaaguuccucgacuucaagauccagaacauggucggcuccugcgacgucaaguuccccauccgccucgagggccucguccucacccaccagcaguucuccuccuacgagcccgagcucuuccccggccucaucuaccgcaugaucaagccccgcaucguccuccucaucuucgucuccggcaaggucguccucaccggcgccaagguccgcgccgagaucuacgaggccuucgagaacaucuaccccauccucaagggcuuccgcaagaccaccuga

SEQ ID NO: 50530 - RNA, 561 nt, Artificial Sequence
  derived and/or modified sequence opt2 from TBPL1__Homo_sapiens__NP_004856
auggacgccgacuccgacgucgcccucgacauccucaucaccaacgucgucugcgucuuccgcacccgcugccaccucaaccuccgcaagaucgcccucgagggcgccaacgucaucuacaagcgcgacgucggcaagguccucaugaagcuccgcaagccccgcaucaccgccaccaucugguccuccggcaagaucaucugcaccggcgccaccuccgaggaggaggccaaguucggcgcccgccgccucgcccgcucccuccagaagcucggcuuccaggucaucuucaccgacuucaaggucgucaacguccucgccgucugcaacaugcccuucgagauccgccuccccgaguucaccaagaacaaccgcccccacgccuccuacgagcccgagcuccaccccgccgucugcuaccgcaucaagucccuccgcgccacccuccagaucuucuccaccggcuccaucaccgucaccggccccaacgucaaggccgucgccaccgccgucgagcagaucuaccccuucgucuucgagucccgcaaggagauccucuga

SEQ ID NO: 50531 - RNA, 1128 nt, Artificial Sequence
  derived and/or modified sequence opt2 from TBPL2__Homo_sapiens__NP_950248
auggccuccgcccccuggcccgagcgcgucccccgccuccucgccccccgccuccccuccuaccccccccccccccccaccgucggccuccgcuccauggagcaggaggagaccuaccucgagcucuaccucgaccagugcgccgcccaggacggccucgcccccccccgcuccccccucuucucccccgucguccccuacgacauguacauccucaacgccuccaaccccgacaccgccuucaacuccaaccccgaggucaaggagaccuccggcgacuucuccuccgucgaccucuccuuccuccccgacgaggucacccaggagaacaaggaccagcccgucaucuccaagcacgagaccgaggagaacuccgagucccaguccccccagucccgccuccccucccccuccgagcaggacgucggccucggccucaacuccuccucccucuccaacucccacucccagcuccaccccggcgacaccgacuccguccagcccucccccgagaagcccaacuccgacucccucucccucgccuccaucacccccaugacccccaugacccccaucuccgagugcugcggcaucgucccccagcuccagaacaucgucuccaccgucaaccucgccugcaagcucgaccucaagaagaucgcccuccacgccaagaacgccgaguacaaccccaagcgcuucgccgccgucaucaugcgcauccgcgagccccgcaccaccgcccucaucuucuccuccggcaagauggucugcaccggcgccaaguccgaggagcagucccgccucgccgcccgcaaguacgcccgcgucguccagaagcucggcuuccccgcccgcuuccucgacuucaagauccagaacauggucggcuccugcgacguccgcuuccccauccgccucgagggccucguccucacccaccagcaguucuccuccuacgagcccgagcucuuccccggccucaucuaccgcauggucaagccccgcaucguccuccucaucuucgucuccggcaaggucguccucaccggcgccaaggagcgcuccgagaucuacgaggccuucgagaacaucuaccccauccucaagggcuucaagaaggccuga

SEQ ID NO: 50532 - RNA, 2049 nt, Artificial Sequence
  derived and/or modified sequence opt2 from TBR1__Homo_sapiens__NP_006584
augcagcucgagcacugccucucccccuccaucaugcucuccaagaaguuccucaacgucuccuccuccuacccccacuccggcggcuccgagcucguccuccacgaccaccccaucaucuccaccaccgacaaccucgagcgcuccuccccccucaagaagaucacccgcggcaugaccaaccaguccgacaccgacaacuuccccgacuccaaggacucccccggcgacguccagcgcuccaagcucucccccguccucgacggcgucuccgagcuccgccacuccuucgacggcuccgccgccgaccgcuaccuccucucccaguccucccagccccaguccgccgccaccgcccccuccgccauguuccccuaccccggccagcacggccccgcccaccccgccuucuccaucggcucccccucccgcuacauggcccaccaccccgucaucaccaacggcgccuacaacucccuccucuccaacuccuccccccagggcuaccccaccgccggcuaccccuacccccagcaguacggccacuccuaccagggcgcccccuucuaccaguucuccuccacccagcccggccucguccccggcaaggcccaggucuaccucugcaaccgcccccucuggcucaaguuccaccgccaccagaccgagaugaucaucaccaagcagggccgccgcauguuccccuuccucuccuucaacaucuccggccucgaccccaccgcccacuacaacaucuucgucgacgucauccucgccgaccccaaccacuggcgcuuccagggcggcaaguggguccccugcggcaaggccgacaccaacguccagggcaaccgcgucuacaugcaccccgacucccccaacaccggcgcccacuggaugcgccaggagaucuccuucggcaagcucaagcucaccaacaacaagggcgccuccaacaacaacggccagauggucguccuccagucccuccacaaguaccagccccgccuccacgucgucgaggucaacgaggacggcaccgaggacaccucccagcccggccgcguccagaccuucaccuuccccgagacccaguucaucgccgucaccgccuaccagaacaccgacaucacccagcucaagaucgaccacaaccccuucgccaagggcuuccgcgacaacuacgacaccaucuacaccggcugcgacauggaccgccucacccccucccccaacgacuccccccgcucccagaucguccccggcgcccgcuacgccauggccggcuccuuccuccaggaccaguucgucuccaacuacgccaaggcccgcuuccaccccggcgccggcgccggccccggccccggcaccgaccgcuccgucccccacaccaacggccuccucuccccccagcaggccgaggaccccggcgcccccuccccccagcgcugguucgucacccccgccaacaaccgccucgacuucgccgccuccgccuacgacaccgccaccgacuucgccggcaacgccgccacccuccucuccuacgccgccgccggcgucaaggcccucccccuccaggccgccggcugcaccggccgcccccucggcuacuacgccgaccccuccggcuggggcgcccgcucccccccccaguacugcggcaccaaguccggcuccguccuccccugcuggcccaacuccgccgccgccgccgcccgcauggccggcgccaaccccuaccucggcgaggaggccgagggccucgccgccgagcgcuccccccucccccccggcgccgccgaggacgccaagcccaaggaccucuccgacuccuccuggaucgagacccccuccuccaucaaguccaucgacuccuccgacuccggcaucuacgagcaggccaagcgccgccgcaucucccccgccgacacccccgucuccgaguccuccuccccccucaaguccgagguccucgcccagcgcgacugcgagaagaacugcgccaaggacaucuccggcuacuacggcuucuacucccacuccuga

SEQ ID NO: 50533 - RNA, 1236 nt, Artificial Sequence
  derived and/or modified sequence opt2 from TBRG1__Homo_sapiens__NP_116200
augucccuccucgacggccucgccuccuccccccgcgccccccuccaguccuccaaggcccgcaugaagaagcuccccaagaagucccagaacgagaaguaccgccucaaguaccuccgccuccgcaaggccgccaaggccaccgucuucgagaacgccgccaucugcgacgagaucgcccgccucgaggagaaguuccucaaggccaaggaggagcgccgcuaccuccucaagaagcuccuccagcuccaggcccucaccgagggcgagguccaggccgccgcccccucccacuccuccucccucccccucaccuacggcgucgccuccuccgucggcaccauccagggcgccggccccaucuccggccccuccaccggcgccgaggagcccuucggcaagaagaccaagaaggagaagaaggagaagggcaaggagaacaacaagcucgagguccucaagaagaccugcaagaagaagaagauggccggcggcgcccgcaagcucguccagcccaucgcccucgaccccuccggccgccccgucuuccccaucggccucggcggccucaccgucuacucccucggcgagaucaucaccgaccgccccggcuuccacgacgaguccgccaucuaccccgucggcuacugcuccacccgcaucuacgccuccaugaagugccccgaccagaagugccucuacaccugccagaucaaggacggcggcguccagccccaguucgagaucguccccgaggacgacccccagaacgccaucgucuccuccuccgccgacgccugccacgccgagcuccuccgcaccaucuccaccaccaugggcaagcucaugcccaaccuccuccccgccggcgccgacuucuucggcuucucccaccccgccauccacaaccucauccaguccugccccggcgcccgcaagugcaucaacuaccagugggucaaguucgacgucugcaagcccggcgacggccagcuccccgagggccuccccgagaacgacgccgccauguccuucgaggccuuccagcgccagaucuucgacgaggaccagaacgacccccuccuccccggcucccucgaccuccccgagcuccagcccgccgccuucgucuccuccuaccagcccauguaccucacccacgagccccucgucgacacccaccuccagcaccucaagucccccucccagggcucccccauccaguccuccgacuga

SEQ ID NO: 50534 - RNA, 1158 nt, Artificial Sequence
  derived and/or modified sequence opt2 from TBX10__Homo_sapiens__NP_005986
auggccgccuuccucuccgccggccucggcauccucgcccccuccgagaccuacccccuccccaccaccuccuccggcugggagccccgccucggcucccccuuccccuccggccccugcaccuccuccaccggcgcccaggccgucgccgagcccaccggccagggccccaagaacccccgcgucucccgcgucaccguccagcucgagaugaagccccucugggaggaguucaaccagcucggcaccgagaugaucgucaccaaggccggccgccgcauguucccccccuuccaggucaagauccucggcauggacucccucgccgacuacgcccuccucauggacuucaucccccucgacgacaagcgcuaccgcuacgccuuccacuccuccgccuggcucgucgccggcaaggccgaccccgccacccccggccgcguccacuuccaccccgacucccccgccaagggcgcccaguggaugcgccagaucgucuccuucgacaagcucaagcucaccaacaaccuccucgacgacaacggccacaucauccucaacuccaugcaccgcuaccagccccgcuuccacgucgucuucgucgacccccgcaaggacuccgagcgcuacgcccaggagaacuucaaguccuucaucuucaccgagacccaguucaccgccgucaccgccuaccagaaccaccgcaucacccagcucaagaucgccuccaaccccuucgccaagggcuuccgcgaguccgaccucgacuccuggcccgucgccccccgcccccuccucuccguccccgcccgcucccacuccucccucucccccugcguccucaagggcgccaccgaccgcgagaaggaccccaacaaggccuccgccuccaccuccaagacccccgccuggcuccaccaccagcuccuccccccccccgagguccuccucgcccccgccaccuaccgccccgucaccuaccagucccucuacuccggcgcccccucccaccucggcaucccccgcacccgccccgcccccuacccccuccccaacauccgcgccgaccgcgaccagggcggccucccccuccccgccggccucggccuccucucccccaccgucgucugccucggccccggccaggacucccaguga

SEQ ID NO: 50535 - RNA, 1824 nt, Artificial Sequence
  derived and/or modified sequence opt2 from TBX18__Homo_sapiens__NP_001073977
auggccgagaagcgccgcggcucccccugcuccaugcucucccucaaggcccacgccuucuccgucgaggcccucaucggcgccgagaagcagcagcagcuccagaagaagcgccgcaagcucggcgccgaggaggccgccggcgccgucgacgacggcggcugcucccgcggcggcggcgccggcgagaagggcuccuccgagggcgacgagggcgccgcccuccccccccccgccggcgccaccuccggccccgcccgcuccggcgccgaccucgagcgcggcgccgccggcggcugcgaggacggcuuccagcagggcgccuccccccucgccucccccggcggcucccccaagggcucccccgcccgcucccucgcccgccccggcaccccccuccccuccccccaggccccccgcgucgaccuccagggcgccgagcucuggaagcgcuuccacgagaucggcaccgagaugaucaucaccaaggccggccgccgcauguuccccgccaugcgcgucaagaucuccggccucgacccccaccagcaguacuacaucgccauggacaucguccccgucgacaacaagcgcuaccgcuacgucuaccacuccuccaaguggauggucgccggcaacgccgacucccccguccccccccgcgucuacauccaccccgacucccccgccuccggcgagaccuggaugcgccaggucaucuccuucgacaagcucaagcucaccaacaacgagcucgacgaccagggccacaucauccuccacuccaugcacaaguaccagccccgcguccacgucauccgcaaggacugcggcgacgaccucucccccaucaagcccguccccuccggcgagggcgucaaggccuucuccuuccccgagaccgucuucaccaccgucaccgccuaccagaaccagcagaucacccgccucaagaucgaccgcaaccccuucgccaagggcuuccgcgacuccggccgcaaccgcaugggccucgaggcccucgucgaguccuacgccuucuggcgccccucccuccgcacccucaccuucgaggacauccccggcauccccaagcagggcaacgccuccuccuccacccuccuccagggcaccggcaacggcguccccgccacccacccccaccuccucuccggcuccuccugcuccucccccgccuuccaccucggccccaacaccucccagcucugcucccucgcccccgccgacuacuccgccugcgcccgcuccggccucacccucaaccgcuacuccaccucccucgccgagaccuacaaccgccucaccaaccaggccggcgagaccuucgcccccccccgcacccccuccuacgucggcgucuccuccuccaccuccgucaacauguccaugggcggcaccgacggcgacaccuucuccugcccccagaccucccucuccaugcagaucuccggcauguccccccagcuccaguacaucaugcccucccccuccuccaacgccuucgccaccaaccagacccaccagggcuccuacaacaccuuccgccuccacucccccugcgcccucuacggcuacaacuucuccaccucccccaagcucgccgccucccccgagaagaucgucuccucccagggcuccuuccucggcuccucccccuccggcaccaugaccgaccgccagaugcucccccccgucgagggcguccaccuccucuccuccggcggccagcaguccuucuucgacucccgcacccucggcucccucacccucuccuccucccaggucuccgcccacauggucuga

SEQ ID NO: 50536 - RNA, 1347 nt, Artificial Sequence
  derived and/or modified sequence opt2 from TBX19__Homo_sapiens__NP_005140
auggccauguccgagcucggcacccgcaagcccuccgacggcaccgucucccaccuccucaacgucgucgaguccgagcuccaggccggccgcgagaagggcgaccccaccgagaagcagcuccagaucauccucgaggacgccccccucuggcagcgcuucaaggaggucaccaacgagaugaucgucaccaagaacggccgccgcauguuccccguccucaagaucuccgucaccggccucgaccccaacgccauguacucccuccuccucgacuucguccccaccgacucccaccgcuggaaguacgucaacggcgaguggguccccgccggcaagcccgaggucuccucccacuccugcgucuacauccaccccgacucccccaacuucggcgcccacuggaugaaggcccccaucuccuucuccaaggucaagcucaccaacaagcucaacggcggcggccagaucaugcucaacucccuccacaaguacgagccccagguccacaucguccgcgucggcuccgcccaccgcauggucaccaacugcuccuuccccgagacccaguucaucgccgucaccgccuaccagaacgaggagaucaccgcccucaagaucaaguacaaccccuucgccaaggccuuccucgacgccaaggagcgcaaccaccuccgcgacguccccgaggccaucuccgagucccagcacgucaccuacucccaccucggcggcuggaucuucuccaaccccgacggcgucugcaccgccggcaacuccaacuaccaguacgccgccccccucccccuccccgccccccacacccaccacggcugcgagcacuacuccggccuccgcggccaccgccaggcccccuaccccuccgccuacaugcaccgcaaccacucccccuccgucaaccucaucgaguccuccuccaacaaccuccaggucuucuccggccccgacuccuggaccucccucuccuccaccccccacgccuccauccucuccgucccccacaccaacggccccaucaaccccggccccucccccuaccccugccucuggaccaucuccaacggcgccggcggccccuccggccccggccccgagguccacgccuccacccccggcgccuuccuccucggcaaccccgccgucaccuccccccccuccguccucuccacccaggcccccaccuccgccggcgucgagguccucggcgagcccucccucaccuccaucgccgucuccaccuggaccgccgucgccucccaccccuucgccggcuggggcggccccggcgccggcggccaccacucccccuccucccucgacggcuga

SEQ ID NO: 50537 - RNA, 1119 nt, Artificial Sequence
  derived and/or modified sequence opt2 from TBX1__Homo_sapiens__NP_005983
augcacuucuccaccgucacccgcgacauggaggccuucaccgccuccucccucuccucccucggcgccgccggcggcuuccccggcgccgccucccccggcgccgaccccuacggcccccgcgagcccccccccccccccccccgcuacgaccccugcgccgccgccgcccccggcgcccccggcccccccccccccccccacgccuaccccuucgcccccgccgccggcgccgccaccuccgccgccgccgagcccgagggccccggcgccuccugcgccgccgccgccaaggcccccgucaagaagaacgccaaggucgccggcgucuccguccagcucgagaugaaggcccucugggacgaguucaaccagcucggcaccgagaugaucgucaccaaggccggccgccgcauguuccccaccuuccaggucaagcucuucggcauggaccccauggccgacuacaugcuccucauggacuucguccccgucgacgacaagcgcuaccgcuacgccuuccacuccuccuccuggcucgucgccggcaaggccgaccccgccacccccggccgcguccacuaccaccccgacucccccgccaagggcgcccaguggaugaagcagaucgucuccuucgacaagcucaagcucaccaacaaccuccucgacgacaacggccacaucauccucaacuccaugcaccgcuaccagccccgcuuccacgucgucuacgucgacccccgcaaggacuccgagaaguacgccgaggagaacuucaagaccuucgucuucgaggagacccgcuucaccgccgucaccgccuaccagaaccaccgcaucacccagcucaagaucgccuccaaccccuucgccaagggcuuccgcgacugcgaccccgaggacuggccccgcaaccaccgccccggcgcccucccccucauguccgccuucgcccgcucccgcaaccccgucgccucccccacccagcccuccggcaccgagaagggccucgucaccgagggcuccggccuccagcccggccuccucgacguccuccucaagccccccuccaagaaguccgagucccuccgccccccccacugcaaggacaccuga

SEQ ID NO: 50538 - RNA, 1344 nt, Artificial Sequence
  derived and/or modified sequence opt2 from TBX20__Homo_sapiens__NP_001071121
auggaguucaccgccucccccaagccccagcucuccucccgcgccaacgccuucuccaucgccgcccucauguccuccggcggcuccaaggagaaggaggccaccgagaacaccaucaagccccucgagcaguucgucgagaaguccuccugcgcccagccccucggcgagcucaccucccucgacgcccacggcgaguucggcggcggcuccggcuccucccccuccuccuccucccucugcaccgagccccucauccccaccacccccaucauccccuccgaggagauggccaagaucgccugcucccucgagaccaaggagcucugggacaaguuccacgagcucggcaccgagaugaucaucaccaaguccggccgccgcauguuccccaccauccgcgucuccuucuccggcgucgaccccgaggccaaguacaucguccucauggacaucguccccgucgacaacaagcgcuaccgcuacgccuaccaccgcuccuccuggcucgucgccggcaaggccgaccccccccuccccgcccgccucuacguccaccccgacucccccuucaccggcgagcagcuccucaagcagauggucuccuucgagaaggucaagcucaccaacaacgagcucgaccagcacggccacaucauccucaacuccaugcacaaguaccagccccgcguccacaucaucaagaagaaggaccacaccgccucccuccucaaccucaaguccgaggaguuccgcaccuucaucuuccccgagaccgucuucaccgccgucaccgccuaccagaaccagcucaucaccaagcucaagaucgacuccaaccccuucgccaagggcuuccgcgacuccucccgccucaccgacaucgagcgcgaguccgucgagucccucauccagaagcacuccuacgcccgcucccccauccgcaccuacggcggcgaggaggacguccucggcgacgagucccagaccacccccaaccgcggcuccgccuucaccaccuccgacaaccucucccucuccuccugggucuccuccuccuccuccuuccccggcuuccagcacccccagucccucaccgcccucggcaccuccaccgccuccaucgccacccccaucccccaccccauccagggcucccucccccccuacucccgccucggcaugccccucacccccuccgccaucgccuccuccaugcagggcuccggccccaccuuccccuccuuccacaugccccgcuaccaccacuacuuccagcagggccccuacgccgccauccagggccuccgccacuccuccgccgucaugacccccuucgucuga

SEQ ID NO: 50539 - RNA, 1608 nt, Artificial Sequence
  derived and/or modified sequence opt2 from TBX21__Homo_sapiens__NP_037483
augggcaucgucgagcccggcugcggcgacaugcucaccggcaccgagcccaugcccggcuccgacgagggccgcgcccccggcgccgacccccagcaccgcuacuucuaccccgagcccggcgcccaggacgccgacgagcgccgcggcggcggcucccucggcucccccuaccccggcggcgcccucguccccgccccccccucccgcuuccucggcgccuacgccuaccccccccgcccccaggccgccggcuuccccggcgccggcgaguccuuccccccccccgccgacgccgagggcuaccagcccggcgagggcuacgccgcccccgacccccgcgccggccucuaccccggcccccgcgaggacuacgcccuccccgccggccucgaggucuccggcaagcuccgcgucgcccucaacaaccaccuccucugguccaaguucaaccagcaccagaccgagaugaucaucaccaagcagggccgccgcauguuccccuuccucuccuucaccgucgccggccucgagcccaccucccacuaccgcauguucgucgacgucguccucgucgaccagcaccacuggcgcuaccaguccggcaaguggguccagugcggcaaggccgagggcuccaugcccggcaaccgccucuacguccaccccgacucccccaacaccggcgcccacuggaugcgccaggaggucuccuucggcaagcucaagcucaccaacaacaagggcgccuccaacaacgucacccagaugaucguccuccagucccuccacaaguaccagccccgccuccacaucgucgaggucaacgacggcgagcccgaggccgccugcaacgccuccaacacccacaucuucaccuuccaggagacccaguucaucgccgucaccgccuaccagaacgccgagaucacccagcucaagaucgacaacaaccccuucgccaagggcuuccgcgagaacuucgaguccauguacaccuccgucgacaccuccauccccuccccccccggccccaacugccaguuccucggcggcgaccacuacuccccccuccuccccaaccaguaccccguccccucccgcuucuaccccgaccuccccggccaggccaaggacgucgucccccaggccuacuggcucggcgccccccgcgaccacuccuacgaggccgaguuccgcgccgucuccaugaagcccgccuuccuccccuccgcccccggccccaccauguccuacuaccgcggccaggagguccucgcccccggcgccggcuggcccgucgccccccaguacccccccaagaugggccccgccuccugguuccgccccaugcgcacccuccccauggagcccggccccggcggcuccgagggccgcggccccgaggaccagggccccccccucgucuggaccgagaucgcccccauccgccccgaguccuccgacuccggccucggcgagggcgacuccaagcgccgccgcgucucccccuaccccuccuccggcgacuccuccucccccgccggcgcccccucccccuucgacaaggaggccgagggccaguucuacaacuacuuccccaacuga

SEQ ID NO: 50540 - RNA, 1563 nt, Artificial Sequence
  derived and/or modified sequence opt2 from TBX22__Homo_sapiens__NP_001103348
auggcccucuccucccgcgcccgcgccuucuccgucgaggcccucgucggccgccccuccaagcgcaagcuccaggaccccauccaggccgagcagcccgagcuccgcgagaagaagggcggcgaggaggaggaggagcgccgcuccuccgccgccggcaaguccgagccccucgagaagcagcccaagaccgagcccuccaccuccgccuccuccggcugcggcuccgacuccggcuacggcaacuccuccgagucccucgaggagaaggacauccagauggagcuccagggcuccgagcucuggaagcgcuuccacgacaucggcaccgagaugaucaucaccaaggccggccgccgcauguuccccuccguccgcgucaaggucaagggccucgaccccggcaagcaguaccacgucgccaucgacgucguccccgucgacuccaagcgcuaccgcuacgucuaccacuccucccaguggauggucgccggcaacaccgaccaccucugcaucaucccccgcuucuacguccaccccgacucccccugcuccggcgagaccuggaugcgccagaucaucuccuucgaccgcaugaagcucaccaacaacgagauggacgacaagggccacaucauccuccaguccaugcacaaguacaagccccgcguccacgucaucgagcagggcuccuccgucgaccucucccagauccagucccuccccaccgagggcgucaagaccuucuccuucaaggagaccgaguucaccaccgucaccgccuaccagaaccagcagaucaccaagcucaagaucgagcgcaaccccuucgccaagggcuuccgcgacaccggccgcaaccgcggcguccucgacggccuccucgagaccuaccccuggcgccccuccuucacccucgacuucaagaccuucggcgccgacacccaguccggcuccuccggcuccucccccgucaccuccuccggcggcgcccccuccccccucaacucccuccucuccccccucugcuucucccccauguuccaccuccccaccuccucccucggcaugcccugccccgaggccuaccuccccaacgucaaccucccccucugcuacaagaucugccccaccaacuucuggcagcagcagccccucguccuccccgcccccgagcgccucgccuccuccaacuccucccagucccucgccccccucaugauggagguccccaugcucuccucccucggcgucaccaacuccaaguccggcuccuccgaggacuccuccgaccaguaccuccaggcccccaacuccaccaaccagaugcucuacggccuccagucccccggcaacaucuuccuccccaacuccaucacccccgaggcccucuccugcuccuuccaccccuccuacgacuucuaccgcuacaacuucuccaugcccucccgccucaucuccggcuccaaccaccucaaggucaacgacgacucccaggucuccuucggcgagggcaagugcaaccacguccacugguaccccgccaucaaccacuaccucuga

SEQ ID NO: 50541 - RNA, 2139 nt, Artificial Sequence
  derived and/or modified sequence opt2 from TBX2__Homo_sapiens__XP_011523460
augcgcgagcccgcccucgccgccuccgccauggccuaccaccccuuccacgccccccgccccgccgacuuccccauguccgccuuccucgccgccgcccagcccuccuucuuccccgcccucgcccucccccccggcgcccucgccaagccccuccccgaccccggccucgccggcgccgccgccgccgccgccgccgccgccgccgccgccgaggccggccuccacgucuccgcccucggcccccacccccccgccgcccaccuccgcucccucaagucccucgagcccgaggacgaggucgaggacgaccccaaggucacccucgaggccaaggagcucugggaccaguuccacaagcucggcaccgagauggucaucaccaaguccggccgccgcauguucccccccuucaagguccgcgucuccggccucgacaagaaggccaaguacauccuccucauggacaucgucgccgccgacgacugccgcuacaaguuccacaacucccgcuggauggucgccggcaaggccgaccccgagaugcccaagcgcauguacauccaccccgacucccccgccaccggcgagcaguggauggccaagcccgucgccuuccacaagcucaagcucaccaacaacaucuccgacaagcacggcuucaccauccucaacuccaugcacaaguaccagccccgcuuccacaucguccgcgccaacgacauccucaagcuccccuacuccaccuuccgcaccuacgucuuccccgagaccgacuucaucgccgucaccgccuaccagaacgacaagaucacccagcucaagaucgacaacaaccccuucgccaagggcuuccgcgacaccggcaacggccgccgcgagaagcgcaagcagcucacccuccccucccuccgccucuacgaggagcacugcaagcccgagcgcgacggcgccgaguccgacgccuccuccugcgaccccccccccgcccgcgagccccccaccucccccggcgccgcccccuccccccuccgccuccaccgcgcccgcgccgaggagaaguccugcgccgccgacuccgaccccgagcccgagcgccucuccgaggagcgcgccggcgccccccucggccgcucccccgcccccgacuccgccucccccacccgccucaccgagcccgagcgcgcccgcgagcgccgcucccccgagcgcggcaaggagcccgccgaguccggcggcgacggccccuucggccuccgcucccucgagaaggagcgcgccgaggcccgccgcaaggacgagggccgcaaggaggccgccgagggcaaggagcagggccucgccccccucgucguccagaccgacuccgccuccccccucggcgccggccaccuccccggccucgccuucuccucccaccuccacggccagcaguucuucggcccccucggcgccggccagccccucuuccuccaccccggccaguucaccaugggccccggcgccuucuccgccaugggcaugggccaccuccucgccuccgucgccggcggcggcaacggcggcggcggcggccccggcaccgccgccggccucgacgccggcggccucggccccgccgccuccgccgccuccaccgccgcccccuuccccuuccaccucucccagcacaugcucgccucccagggcauccccaugcccaccuucggcggccucuuccccuaccccuacaccuacauggccgccgccgccgccgccgccuccgcccuccccgccaccuccgccgccgccgccgccgccgccgccgccggcucccucucccgcucccccuuccucggcuccgcccgcccccgccuccgcuucucccccuaccagauccccgucaccaucccccccuccaccucccuccucaccaccggccucgccuccgagggcuccaaggccgccggcggcaacucccgcgagcccuccccccuccccgagcucgcccuccgcaaggucggcgcccccucccgcggcgcccucucccccuccggcuccgccaaggaggccgccaacgagcuccaguccauccagcgccucgucuccggccucgagucccagcgcgcccucucccccggccgcgagucccccaaguga

SEQ ID NO: 50542 - RNA, 2172 nt, Artificial Sequence
  derived and/or modified sequence opt2 from TBX3__Homo_sapiens__NP_005987
augucccucuccaugcgcgaccccgucauccccggcaccuccauggccuaccaccccuuccucccccaccgcgcccccgacuucgccauguccgccguccucggccaccagccccccuucuuccccgcccucacccucccccccaacggcgccgccgcccucucccuccccggcgcccucgccaagcccaucauggaccagcucgucggcgccgccgagaccggcauccccuucuccucccucggcccccaggcccaccuccgcccccucaagaccauggagcccgaggaggaggucgaggacgaccccaagguccaccucgaggccaaggagcucugggaccaguuccacaagcgcggcaccgagauggucaucaccaaguccggccgccgcauguucccccccuucaagguccgcugcuccggccucgacaagaaggccaaguacauccuccucauggacaucaucgccgccgacgacugccgcuacaaguuccacaacucccgcuggauggucgccggcaaggccgaccccgagaugcccaagcgcauguacauccaccccgacucccccgccaccggcgagcaguggauguccaaggucgucaccuuccacaagcucaagcucaccaacaacaucuccgacaagcacggcuucaccauccucaacuccaugcacaaguaccagccccgcuuccacaucguccgcgccaacgacauccucaagcuccccuacuccaccuuccgcaccuaccucuuccccgagaccgaguucaucgccgucaccgccuaccagaacgacaagaucacccagcucaagaucgacaacaaccccuucgccaagggcuuccgcgacaccggcaacggccgccgcgagaagcgcaagcagcucacccuccaguccaugcgcgucuucgacgagcgccacaagaaggagaacggcaccuccgacgaguccuccuccgagcaggccgccuucaacugcuucgcccaggccuccucccccgccgccuccaccgucggcaccuccaaccucaaggaccucugccccuccgagggcgaguccgacgccgaggccgaguccaaggaggagcacggccccgaggccugcgacgccgccaagaucuccaccaccaccuccgaggagcccugccgcgacaagggcucccccgccgucaaggcccaccucuucgccgccgagcgcccccgcgacuccggccgccucgacaaggccucccccgacucccgccacucccccgccaccaucuccuccuccacccgcggccucggcgccgaggagcgccgcucccccguccgcgagggcaccgcccccgccaaggucgaggaggcccgcgcccuccccggcaaggaggccuucgccccccucaccguccagaccgacgccgccgccgcccaccucgcccagggcccccuccccggccucggcuucgcccccggccucgccggccagcaguucuucaacggccacccccucuuccuccaccccucccaguucgccaugggcggcgccuucuccuccauggccgccgccggcaugggcccccuccucgccaccgucuccggcgccuccaccggcgucuccggccucgacuccaccgccauggccuccgccgccgccgcccagggccucuccggcgccuccgccgccacccuccccuuccaccuccagcagcacguccucgccucccagggccucgccaugucccccuucggcucccucuuccccuaccccuacaccuacauggccgccgccgccgccgccuccuccgccgccgccuccuccuccguccaccgccaccccuuccucaaccucaacaccaugcgcccccgccuccgcuacucccccuacuccauccccguccccguccccgacggcuccucccuccucaccaccgcccuccccuccauggccgccgccgccggcccccucgacggcaaggucgccgcccucgccgccucccccgccuccgucgccgucgacuccggcuccgagcucaacucccgcuccuccacccucuccuccuccuccaugucccucucccccaagcucugcgccgagaaggaggccgccaccuccgagcuccaguccauccagcgccucgucuccggccucgaggccaagcccgaccgcucccgcuccgccucccccuga

SEQ ID NO: 50543 - RNA, 1638 nt, Artificial Sequence
  derived and/or modified sequence opt2 from TBX4__Homo_sapiens__NP_060958
augcuccaggacaagggccucuccgaguccgaggaggccuuccgcgcccccggccccgcccucggcgaggccuccgccgccaacgcccccgagcccgcccucgccgcccccggccucuccggcgccgcccucggcuccccccccggccccggcgccgacgucgucgccgccgccgccgccgagcagaccaucgagaacaucaaggucggccuccacgagaaggagcucuggaagaaguuccacgaggccggcaccgagaugaucaucaccaaggccggccgccgcauguuccccuccuacaaggucaaggucaccggcaugaaccccaagaccaaguacauccuccucaucgacaucguccccgccgacgaccaccgcuacaaguucugcgacaacaaguggauggucgccggcaaggccgagcccgccaugcccggccgccucuacguccaccccgacucccccgccaccggcgcccacuggaugcgccagcucgucuccuuccagaagcucaagcucaccaacaaccaccucgaccccuucggccacaucauccucaacuccaugcacaaguaccagccccgccuccacaucgucaaggccgacgagaacaacgccuucggcuccaagaacaccgccuucugcacccacgucuuccccgagaccuccuucaucuccgucaccuccuaccagaaccacaagaucacccagcucaagaucgagaacaaccccuucgccaagggcuuccgcggcuccgacgacuccgaccuccgcgucgcccgccuccaguccaaggaguaccccgucaucuccaaguccaucaugcgccagcgccucaucuccccccagcucuccgccacccccgacgucggcccccuccucggcacccaccaggcccuccagcacuaccagcacgagaacggcgcccacucccagcucgccgagccccaggaccucccccucuccaccuuccccacccagcgcgacuccucccucuucuaccacugccucaagcgccgcgacggcacccgccaccucgaccuccccugcaagcgcuccuaccucgaggcccccuccuccgucggcgaggaccacuacuuccgcucccccccccccuacgaccagcagaugcucucccccuccuacugcuccgaggucaccccccgcgaggccugcauguacuccggcuccggccccgagaucgccggcgucuccggcgucgacgaccuccccccccccccccucuccugcaacauguggaccuccgucucccccuacaccuccuacuccguccagaccauggagaccguccccuaccagcccuuccccacccacuucaccgccaccaccaugaugccccgccuccccacccucuccgcccaguccucccagccccccggcaacgcccacuucuccgucuacaaccagcucucccagucccagguccgcgagcgcggccccuccgccuccuucccccgcgagcgcggccucccccagggcugcgagcgcaagccccccuccccccaccucaacgccgccaacgaguuccucuacucccagaccuucucccucucccgcgaguccucccuccaguaccacuccggcaugggcaccgucgagaacuggaccgacggcuga

SEQ ID NO: 50544 - RNA, 1407 nt, Artificial Sequence
  derived and/or modified sequence opt2 from TBX5__Homo_sapiens__NP_542448
auggagggcaucaaggucuuccuccacgagcgcgagcucuggcucaaguuccacgaggucggcaccgagaugaucaucaccaaggccggccgccgcauguuccccuccuacaaggucaaggucaccggccucaaccccaagaccaaguacauccuccucauggacaucguccccgccgacgaccaccgcuacaaguucgccgacaacaagugguccgucaccggcaaggccgagcccgccaugcccggccgccucuacguccaccccgacucccccgccaccggcgcccacuggaugcgccagcucgucuccuuccagaagcucaagcucaccaacaaccaccucgaccccuucggccacaucauccucaacuccaugcacaaguaccagccccgccuccacaucgucaaggccgacgagaacaacggcuucggcuccaagaacaccgccuucugcacccacgucuuccccgagaccgccuucaucgccgucaccuccuaccagaaccacaagaucacccagcucaagaucgagaacaaccccuucgccaagggcuuccgcggcuccgacgacauggagcuccaccgcaugucccgcaugcaguccaaggaguaccccgucgucccccgcuccaccguccgccagaaggucgccuccaaccacucccccuucuccuccgagucccgcgcccucuccaccuccuccaaccucggcucccaguaccagugcgagaacggcgucuccggccccucccaggaccuccuccccccccccaaccccuacccccucccccaggagcacucccagaucuaccacugcaccaagcgcaaggaggaggagugcuccaccaccgaccaccccuacaagaagcccuacauggagaccucccccuccgaggaggacuccuucuaccgcuccuccuacccccagcagcagggccucggcgccuccuaccgcaccgaguccgcccagcgccaggccugcauguacgccuccuccgccccccccuccgagcccguccccucccucgaggacaucuccugcaacaccuggcccuccaugcccuccuacuccuccugcaccgucaccaccguccagcccauggaccgccuccccuaccagcacuucuccgcccacuucaccuccggcccccucgucccccgccucgccggcauggccaaccacggcuccccccagcucggcgagggcauguuccagcaccagaccuccgucgcccaccagcccgucguccgccagugcggcccccagaccggccuccagucccccggcacccuccagccccccgaguuccucuacucccacggcgucccccgcacccucuccccccaccaguaccacuccguccacggcgucggcaugguccccgagugguccgacaacuccuga

SEQ ID NO: 50545 - RNA, 1311 nt, Artificial Sequence
  derived and/or modified sequence opt2 from TBX6__Homo_sapiens__NP_004599
auguaccacccccgcgagcucuaccccucccucggcgccggcuaccgccucggccccgcccagcccggcgccgacuccuccuucccccccgcccucgccgagggcuaccgcuaccccgagcucgacacccccaagcucgacugcuuccucuccggcauggaggccgccccccgcacccucgccgcccaccccccccucccccuccucccccccgccaugggcaccgagcccgcccccuccgcccccgaggcccuccacucccuccccggcgucucccucucccucgagaaccgcgagcucuggaaggaguucuccuccgucggcaccgagaugaucaucaccaaggccggccgccgcauguuccccgccugccgcgucuccgucaccggccucgaccccgaggcccgcuaccucuuccuccucgacgucauccccgucgacggcgcccgcuaccgcuggcagggccgccgcugggagcccuccggcaaggccgagccccgccuccccgaccgcgucuacauccaccccgacucccccgccaccggcgcccacuggaugcgccagcccgucuccuuccaccgcgucaagcucaccaacuccacccucgacccccacggccaccucauccuccacuccaugcacaaguaccagccccgcauccaccucguccgcgccgcccagcucugcucccagcacuggggcggcauggccuccuuccgcuuccccgagaccaccuucaucuccgucaccgccuaccagaacccccagaucacccagcucaagaucgccgccaaccccuucgccaagggcuuccgcgagaacggccgcaacugcaagcgcgagcgcgacgcccgcgucaagcgcaagcuccgcggccccgagcccgccgccaccgaggccuacggcuccggcgacacccccggcggccccugcgacuccacccucggcggcgacauccgcgaguccgaccccgagcaggcccccgcccccggcgaggccaccgccgcccccgccccccucugcggcggccccuccgccgaggccuaccuccuccaccccgccgccuuccacggcgcccccucccaccuccccacccgcucccccuccuuccccgaggcccccgacuccggccgcuccgcccccuacuccgccgccuuccucgagcucccccacggcuccggcggcuccggcuaccccgccgccccccccgccguccccuucgccccccacuuccuccagggcggccccuucccccuccccuacaccgcccccggcggcuaccucgacgucggcuccaagcccauguacuga

SEQ ID NO: 50546 - RNA, 1224 nt, Artificial Sequence
  derived and/or modified sequence opt2 from TBXA2R__Homo_sapiens__NP_963998
auguggcccaacggcuccucccucggccccugcuuccgccccaccaacaucacccucgaggagcgccgccucaucgccucccccugguucgccgccuccuucugcgucgucggccucgccuccaaccuccucgcccucuccguccucgccggcgcccgccagggcggcucccacacccgcuccuccuuccucaccuuccucugcggccucguccucaccgacuuccucggccuccucgucaccggcaccaucgucgucucccagcacgccgcccucuucgaguggcacgccgucgaccccggcugccgccucugccgcuucaugggcgucgucaugaucuucuucggccucuccccccuccuccucggcgccgccauggccuccgagcgcuaccucggcaucacccgccccuucucccgccccgccgucgccucccagcgccgcgccugggccaccgucggccucgucugggccgccgcccucgcccucggccuccucccccuccucggcgucggccgcuacaccguccaguaccccggcuccuggugcuuccucacccucggcgccgaguccggcgacgucgccuucggccuccucuucuccaugcucggcggccucuccgucggccucuccuuccuccucaacaccgucuccgucgccacccucugccacgucuaccacggccaggaggccgcccagcagcgcccccgcgacuccgaggucgagaugauggcccagcuccucggcaucauggucgucgccuccgucugcuggcucccccuccucgucuucaucgcccagaccguccuccgcaacccccccgccaugucccccgccggccagcucucccgcaccaccgagaaggagcuccucaucuaccuccgcgucgccaccuggaaccagauccucgaccccugggucuacauccucuuccgccgcgccguccuccgccgccuccagccccgccucuccacccgcccccgccgcucccucacccucuggcccucccucgaguacuccggcaccaucuccgcccacugcaaccuccgccuccccggcuccuccgacucccgcgccuccgccucccgcgccgccggcaucaccggcgucucccacugcgcccgccccugcaugcucuucgaccccgaguucgaccuccucgccggcguccagcuccuccccuucgagccccccaccggcaaggcccucucccgcaaggacuga

SEQ ID NO: 50547 - RNA, 1605 nt, Artificial Sequence
  derived and/or modified sequence opt2 from TBXAS1__Homo_sapiens__NP_001052
augauggaggcccucggcuuccucaagcucgaggucaacggccccauggucaccgucgcccucuccgucgcccuccucgcccuccucaagugguacuccaccuccgccuucucccgccucgagaagcucggccuccgccaccccaagcccucccccuucaucggcaaccucaccuucuuccgccagggcuucugggagucccagauggagcuccgcaagcucuacggcccccucugcggcuacuaccucggccgccgcauguucaucgucaucuccgagcccgacaugaucaagcagguccucgucgagaacuucuccaacuucaccaaccgcauggccuccggccucgaguucaaguccgucgccgacuccguccucuuccuccgcgacaagcgcugggaggagguccgcggcgcccucauguccgccuucucccccgagaagcucaacgagauggucccccucaucucccaggccugcgaccuccuccucgcccaccucaagcgcuacgccgaguccggcgacgccuucgacauccagcgcugcuacugcaacuacaccaccgacgucgucgccuccgucgccuucggcacccccgucgacuccuggcaggcccccgaggaccccuucgucaagcacugcaagcgcuucuucgaguucugcaucccccgccccauccucguccuccuccucuccuuccccuccaucauggucccccucgcccgcauccuccccaacaagaaccgcgacgagcucaacggcuucuucaacaagcucauccgcaacgucaucgcccuccgcgaccagcaggccgccgaggagcgccgccgcgacuuccuccagaugguccucgacgcccgccacuccgccucccccaugggcguccaggacuucgacaucguccgcgacgucuucuccuccaccggcugcaagcccaaccccucccgccagcaccagcccucccccauggcccgcccccucaccgucgacgagaucgucggccaggccuucaucuuccucaucgccggcuacgagaucaucaccaacacccucuccuucgccaccuaccuccucgccaccaaccccgacugccaggagaagcuccuccgcgaggucgacgucuucaaggagaagcacauggcccccgaguucugcucccucgaggagggccuccccuaccucgacauggucaucgccgagacccuccgcauguacccccccgccuuccgcuucacccgcgaggccgcccaggacugcgagguccucggccagcgcauccccgccggcgccguccucgagauggccgucggcgcccuccaccacgaccccgagcacuggcccucccccgagaccuucaaccccgagcgcuucaccgccgaggcccgccagcagcaccgccccuucaccuaccuccccuucggcgccggcccccgcuccugccucggcguccgccucggccuccucgaggucaagcucacccuccuccacguccuccacaaguuccgcuuccaggccugccccgagacccaggucccccuccagcucgaguccaaguccgcccucggccccaagaacggcgucuacaucaagaucgucucccgcuga

SEQ ID NO: 50548 - RNA, 213 nt, Artificial Sequence
  derived and/or modified sequence opt2 from TCAIM__Homo_sapiens__NP_001025010
auguucugccaccuccgccccaugcgccgccucugccucgagaagaucuucccccacugguuccccuucucccgcgcccucuccggcgccgaggccgucaacgcccuccgccccuucuacuucgccguccaccccgacuucuucggccagcaccccgucgagcgcgacgacaccuggaaguccuuccagugccccuccgacuucucccucuga

SEQ ID NO: 50549 - RNA, 504 nt, Artificial Sequence
  derived and/or modified sequence opt2 from TCAP__Homo_sapiens__NP_003664
auggccaccuccgagcucuccugcgaggucuccgaggagaacugcgagcgccgcgaggccuucugggccgaguggaaggaccucacccucuccacccgccccgaggagggcugcucccuccacgaggaggacacccagcgccacgagaccuaccaccagcagggccagugccagguccucguccagcgcucccccuggcucaugaugcgcaugggcauccucggccgcggccuccaggaguaccagcuccccuaccagcgcguccucccccuccccaucuucacccccgccaagaugggcgccaccaaggaggagcgcgaggacacccccauccagcuccaggagcuccucgcccucgagaccgcccucggcggccagugcgucgaccgccaggaggucgccgagaucaccaagcagcucccccccgucguccccgucuccaagcccggcgcccuccgccgcucccucucccgcuccaugucccaggaggcccagcgcggcuga

SEQ ID NO: 50550 - RNA, 906 nt, Artificial Sequence
  derived and/or modified sequence opt2 from TCEA1__Homo_sapiens__NP_006747
auggaggacgaggucguccgcuucgccaagaagauggacaagaugguccagaagaagaacgccgccggcgcccucgaccuccucaaggagcucaagaacauccccaugacccucgagcuccuccaguccacccgcaucggcauguccgucaacgccauccgcaagcaguccaccgacgaggaggucaccucccucgccaagucccucaucaaguccuggaagaagcuccucgacggccccuccaccgagaaggaccucgacgagaagaagaaggagcccgccaucaccucccagaacucccccgaggcccgcgaggaguccaccuccuccggcaacgucuccaaccgcaaggacgagaccaacgcccgcgacaccuacgucuccuccuucccccgcgcccccuccaccuccgacuccguccgccucaagugccgcgagaugcucgccgccgcccuccgcaccggcgacgacuacaucgccaucggcgccgacgaggaggagcucggcucccagaucgaggaggccaucuaccaggagauccgcaacaccgacaugaaguacaagaaccgcguccgcucccgcaucuccaaccucaaggacgccaagaaccccaaccuccgcaagaacguccucugcggcaacaucccccccgaccucuucgcccgcaugaccgccgaggagauggccuccgacgagcucaaggagaugcgcaagaaccucaccaaggaggccauccgcgagcaccagauggccaagaccggcggcacccagaccgaccucuucaccugcggcaagugcaagaagaagaacugcaccuacacccagguccagacccgcuccgccgacgagcccaugaccaccuucgucgucugcaacgagugcggcaaccgcuggaaguucugcuga

SEQ ID NO: 50551 - RNA, 900 nt, Artificial Sequence
  derived and/or modified sequence opt2 from TCEA2__Homo_sapiens__NP_003186
augaugggcaaggaggaggagaucgcccgcaucgcccgccgccucgacaagauggucaccaagaaguccgccgagggcgccauggaccuccuccgcgagcucaaggccaugcccaucacccuccaccuccuccaguccacccgcgucggcauguccgucaacgcccuccgcaagcaguccuccgacgaggaggucaucgcccucgccaagucccucaucaaguccuggaagaagcuccucgacgccuccgacgccaaggcccgcgagcgcggccgcggcaugccccuccccaccuccucccgcgacgccuccgaggcccccgaccccucccgcaagcgccccgagcucccccgcgcccccuccaccccccgcaucaccaccuucccccccguccccgucaccugcgacgccguccgcaacaagugccgcgagaugcucaccgccgcccuccagaccgaccacgaccacgucgccaucggcgccgacugcgagcgccucuccgcccagaucgaggagugcaucuuccgcgacgucggcaacaccgacaugaaguacaagaaccgcguccgcucccgcaucuccaaccucaaggacgccaagaaccccgaccuccgccgcaacguccucugcggcgccaucaccccccagcagaucgccgucaugaccuccgaggagauggccuccgacgagcucaaggagauccgcaaggccaugaccaaggaggccauccgcgagcaccagauggcccgcaccggcggcacccagaccgaccucuucaccugcggcaagugccgcaagaagaacugcaccuacacccagguccagacccgcuccuccgacgagcccaugaccaccuucgucgucugcaacgagugcggcaaccgcuggaaguucugcuga

SEQ ID NO: 50552 - RNA, 1032 nt, Artificial Sequence
  derived and/or modified sequence opt2 from TCEA3__Homo_sapiens__XP_011540358
augggccaggaggaggagcuccuccgcaucgccaagaagcucgagaagauggucgcccgcaagaacaccgagggcgcccucgaccuccucaagaagcuccacuccugccagauguccauccagcuccuccagaccacccgcaucggcgucgccgucaacggcguccgcaagcacugcuccgacaaggaggucgucucccucgccaagguccucaucaagaacuggaagcgccuccucgacucccccggcccccccaagggcgagaagggcgaggagcgcgagaaggccaagaagaaggagaagggccucgagugcuccgacuggaagcccgaggccggccucucccccccccgcaagaagcgcgaggaccccaagacccgcuccaacuccuccaaguccaaggccgagucccccaagacccccuccuccccccucacccccaccuucgccuccuccaugugccuccucgcccccugcuaccucaccggcgacuccguccgcgacaagugcgucgagaugcucuccgccgcccucaaggccgacgacgacuacaaggacuacggcgucaacugcgacaagauggccuccgagaucgaggaccacaucuaccaggagcucaaguccaccgacaugaaguaccgcaaccgcguccgcucccgcaucuccaaccucaaggacccccgcaaccccggccuccgccgcaacguccucuccggcgccaucuccgccggccucaucgccaagaugaccgccgaggagauggccuccgacgagcuccgcgagcuccgcaacgccaugacccaggaggccauccgcgagcaccagauggccaagaccggcggcaccaccaccgaccucuuccagugcuccaagugcaagaagaagaacugcaccuacaaccagguccagacccgcuccgccgacgagcccaugaccaccuucguccucugcaacgagugcggcaaccgcuggaagccccccuggcgcaugccccgcaaccucuccaacuucgucgccuuccucguccucuga

SEQ ID NO: 50553 - RNA, 480 nt, Artificial Sequence
  derived and/or modified sequence opt2 from TCEAL1__Homo_sapiens__NP_001006641
auggacaagccccgcaaggagaacgaggaggagccccaguccgcccccaagaccgacgaggagcgcccccccgucgagcacucccccgagaagcagucccccgaggagcaguccuccgaggagcaguccuccgaggaggaguucuuccccgaggagcuccuccccgagcuccuccccgagaugcuccucuccgaggagcgccccccccaggagggccucucccgcaaggaccucuucgagggccgcccccccauggagcagccccccugcggcgucggcaagcacaagcucgaggagggcuccuucaaggagcgccucgcccgcucccgcccccaguuccgcggcgacauccacggccgcaaccucuccaacgaggagaugauccaggccgccgacgagcucgaggagaugaagcgcguccgcaacaagcucaugaucaugcacuggaaggccaagcgcucccgccccuaccccaucuga

SEQ ID NO: 50554 - RNA, 684 nt, Artificial Sequence
  derived and/or modified sequence opt2 from TCEAL2__Homo_sapiens__NP_525129
auggagaagcucuucaacgagaacgagggcaugcccuccaaccagggcaagaucgacaacgaggagcagcccccccacgagggcaagcccgaggucgccugcauccucgaggacaagaagcucgagaacgagggcaacaccgagaacaccggcaagcgcgucgaggagccccucaaggacaaggagaagcccgaguccgccggcaaggccaagggcgagggcaaguccgagcgcaagggcaaguccgagaugcagggcggcuccaagaccgagggcaagcccgagcgcggcggccgcgccgagggcgagggcgagcccgacuccgagcgcgagcccgaguccgagggcgagcccgaguccgagacccgcgccgccggcaagcgccccgccgaggacgacaucccccgcaaggccaagcgcaagaccaacaagggccucgcccaguaccucaagcaguacaaggaggccauccacgacaugaacuucuccaacgaggacaugauccgcgaguucgacaacauggcccgcgucgaggacaagcgccgcaaguccaagcagaagcucggcgccuuccucuggaugcagcgcaaccuccaggaccccuucuacccccgcggcccccgcgaguuccgcggcggcugccgcgccccccgccgcgacaccgaggacauccccuacgucuga

SEQ ID NO: 50555 - RNA, 1077 nt, Artificial Sequence
  derived and/or modified sequence opt2 from TCEAL4__Homo_sapiens__NP_001287830
augcccgccggcggccaggccccccagcucacccccgucauccccgccuucugggaggcccgcggccuccccaacuccaagggccgcgacaagguccacaucugccagugcgaggaguggaagggccacaucuccuacgucgagcgcgacaucaccaccuccgagaucaagucccucccccaggucuccguccgcgccuuccacgccgccuccggcacccucgaguggcgcaagggcaacggcuacggccgcggcaagggcuggggcuggggccgcgucgagucccgcgaggccggccccuccgucgaccgcgacggcggccuccgcgucugcugcucccagcgcuccgccaagcccgagaaggaggagcagcccguccagaacccccgccgcuccgucaaggaccgcaagcgccgcggcaaccucgacauggagaagcucuacuccgagaacgagggcauggccuccaaccagggcaagauggagaacgaggagcagccccaggacgagcgcaagcccgaggucaccugcacccucgaggacaagaagcucgagaacgagggcaagaccgagaacaagggcaagaccggcgacgaggagaugcucaaggacaagggcaagcccgaguccgagggcgaggccaaggagggcaaguccgagcgcgagggcgaguccgagauggagggcggcuccgagcgcgagggcaagcccgagaucgagggcaagcccgaguccgagggcgagcccggcuccgagacccgcgccgccggcaagcgccccgccgaggacgacgucccccgcaaggccaagcgcaagaccaacaagggccucgcccacuaccucaaggaguacaaggaggccauccacgacaugaacuucuccaacgaggacaugauccgcgaguucgacaacauggccaagguccaggacgagaagcgcaaguccaagcagaagcucggcgccuuccucuggaugcagcgcaaccuccaggaccccuucuacccccgcggcccccgcgaguuccgcggcggcugccgcgccccccgccgcgacaucgaggacauccccuacgucuga

SEQ ID NO: 50556 - RNA, 303 nt, Artificial Sequence
  derived and/or modified sequence opt2 from TCEAL7__Homo_sapiens__NP_689491
augcagaagcccugcaaggagaacgagggcaagcccaagugcuccguccccaagcgcgaggagaagcgccccuacggcgaguucgagcgccagcagaccgagggcaacuuccgccagcgccuccuccagucccucgaggaguucaaggaggacaucgacuaccgccacuucaaggacgaggagaugacccgcgagggcgacgagauggagcgcugccucgaggagauccgcggccuccgcaagaaguuccgcgcccuccacuccaaccaccgccacucccgcgaccgccccuaccccaucuga

SEQ ID NO: 50557 - RNA, 291 nt, Artificial Sequence
  derived and/or modified sequence opt2 from TCEB1__Homo_sapiens__NP_001191793
auguacgucaagcucaucuccuccgacggccacgaguucaucgucaagcgcgagcacgcccucaccuccggcaccaucaaggccaugcucuccggccccggccaguucgccgagaacgagaccaacgaggucaacuuccgcgagauccccucccacguccucuccaaggucugcauguacuucaccuacaagguccgcuacaccaacuccuccaccgagauccccgaguuccccaucgcccccgagaucgcccucgagcuccucauggccgccaacuuccucgacugcuga

SEQ ID NO: 50558 - RNA, 357 nt, Artificial Sequence
  derived and/or modified sequence opt2 from TCEB2__Homo_sapiens__NP_009039
auggacgucuuccucaugauccgccgccacaagaccaccaucuucaccgacgccaaggaguccuccaccgucuucgagcucaagcgcaucgucgagggcauccucaagcgcccccccgacgagcagcgccucuacaaggacgaccagcuccucgacgacggcaagacccucggcgagugcggcuucaccucccagaccgcccgcccccaggcccccgccaccgucggccucgccuuccgcgccgacgacaccuucgaggcccucugcaucgagcccuucuccuccccccccgagcuccccgacgucaugaagccccaggacuccggcuccuccgccaacgagcaggccguccaguga

SEQ ID NO: 50559 - RNA, 1641 nt, Artificial Sequence
  derived and/or modified sequence opt2 from TCEB3C__Homo_sapiens__NP_663628
auggccgccggcuccaccacccuccgcgccgucggcaagcuccagguccgccucgccaccaagaccgagcccaagaagcucgagaaguaccuccagaagcucuccgcccuccccaugaccgccgacauccucgccgagaccggcauccgcaagaccgucaagcgccuccgcaagcaccagcacgucggcgacuucgcccgcgaccucgccgcccgcuggaagaagcucguccucgucgaccgcaacaccggccccgacccccaggaccccgaggaguccgccucccgccagcgcuucggcgaggcccuccaggagcgcgagaaggccuggggcuuccccgagaacgccaccgccccccgcucccccucccacucccccgagcaccgccgcaccgcccgccgcaccccccccggccagcagcgcccccacccccgcucccccucccgcgagccccgcgccgagcgcaagcgcccccgcauggcccccgccgacuccggcccccaccgcgacccccccacccgcaccgccccccuccccaugcccgagggccccgagcccgccguccccggcgagcagcccggccgcggccacgcccacgccgcccagggcggcccccuccucggccagggcugccagggccagccccagggcgaggccgucggcucccacuccaagggccacaaguccucccgcggcgccuccgcccagaaguccccccccguccaggagucccaguccgagcgccuccaggccgccggcgccgacuccgccggccccaagaccguccccucccacgucuucuccgagcucugggaccccuccgaggccuggaugcaggccaacuacgaccuccucuccgccuucgaggccaugaccucccaggccaaccccgaggcccucuccgcccccgcccuccaggaggaggccgccuuccccggccgccgcgucaacgccaagaugcccgucuacuccggcucccgccccgccugccagcuccagguccccacccuccgccagcagugccuccgcgucccccgcaacaaccccgacgcccucggcgacgucgagggcguccccuacuccguccucgagcccguccucgagggcuggacccccgaccagcucuaccgcaccgagaaggacaacgccgcccucgcccgcgagaccgacgagcucuggcgcauccacugccuccaggacuucaaggaggagaagccccaggagcacgaguccuggcgcgagcucuaccuccgccuccgcgacgcccgcgagcagcgccuccgcgucgucaccaccaagauccgcuccgcccgcgagaacaagcccuccggccgccagaccaagaugaucugcuucaacuccgucgccaagacccccuacgacgccucccgccgccaggagaaguccgccggcgccgccgaccccggcaacggcgagauggagcccgcccccaagcccgccggcuccucccaggcccccuccggccucggcgacggcgacggcggcuccgucuccggcggcggcuccuccaaccgccacgccgcccccgccgacaagacccgcaagcaggccgccaagaaggucgccccccucauggccaaggccauccgcgacuacaagggccgcuucucccgccgcuga

SEQ ID NO: 50560 - RNA, 3234 nt, Artificial Sequence
  derived and/or modified sequence opt2 from TCERG1__Homo_sapiens__NP_001035095
auggccgagcgcggcggcgacggcggcgaguccgagcgcuucaaccccggcgagcuccgcauggcccagcagcaggcccuccgcuuccgcggccccgcccccccccccaacgccgucaugcgcggcccccccccccucaugcgcccccccccccccuucggcaugaugcgcggcccccccccccccccccgcccccccuucggccgcccccccuucgaccccaacaugccccccaugcccccccccggcggcauccccccccccaugggccccccccaccuccagcgcccccccuucaugcccccccccauguccuccaugccccccccccccggcaugauguucccccccggcaugccccccgucaccgcccccggcacccccgcccucccccccaccgaggagaucugggucgagaacaagacccccgacggcaaggucuacuacuacaacgcccgcacccgcgaguccgccuggaccaagcccgacggcgucaaggucauccagcaguccgagcucacccccaugcucgccgcccaggcccagguccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccagguccaggcccagguccaggcccagguccaggcccaggccgucggcgccuccacccccaccaccuccucccccgcccccgccgucuccaccuccaccuccuccuccacccccuccuccaccaccuccaccaccaccaccgccaccuccgucgcccagaccgucuccacccccaccacccaggaccagacccccuccuccgccgucuccgucgccacccccaccgucuccgucuccacccccgcccccaccgccacccccguccagaccgucccccagccccacccccagacccucccccccgccgucccccacuccgucccccagcccaccaccgccauccccgccuucccccccgucauggucccccccuuccgcgucccccuccccggcaugcccaucccccuccccggcguccuccccggcauggccccccccaucguccccaugauccacccccaggucgccaucgccgccucccccgccacccucgccggcgccaccgccgucuccgaguggaccgaguacaagaccgccgacggcaagaccuacuacuacaacaaccgcacccucgaguccaccugggagaagccccaggagcucaaggagaaggagaagcucgaggagaagaucaaggagcccaucaaggagcccuccgaggagccccuccccauggagaccgaggaggaggaccccaaggaggagcccaucaaggagaucaaggaggagcccaaggaggaggagaugaccgaggaggagaaggccgcccagaaggccaagcccgucgccaccgcccccauccccggcacccccuggugcgucgucuggaccggcgacgagcgcgucuucuucuacaaccccaccacccgccucuccaugugggaccgccccgacgaccucaucggccgcgccgacgucgacaagaucauccaggagcccccccacaagaagggcauggaggagcucaagaagcuccgccaccccacccccaccaugcucuccauccagaaguggcaguucuccauguccgccaucaaggaggagcaggagcucauggaggagaucaacgaggacgagcccgucaaggccaagaagcgcaagcgcgacgacaacaaggacaucgacuccgagaaggaggccgccauggaggccgagaucaaggccgcccgcgagcgcgccaucgucccccucgaggcccgcaugaagcaguucaaggacaugcuccucgagcgcggcgucuccgccuucuccaccugggagaaggagcuccacaagaucgucuucgacccccgcuaccuccuccucaaccccaaggagcgcaagcaggucuucgaccaguacgucaagacccgcgccgaggaggagcgccgcgagaagaagaacaagaucaugcaggccaaggaggacuucaagaagaugauggaggaggccaaguucaacccccgcgccaccuucuccgaguucgccgccaagcacgccaaggacucccgcuucaaggccaucgagaagaugaaggaccgcgaggcccucuucaacgaguucgucgccgccgcccgcaagaaggagaaggaggacuccaagacccgcggcgagaagaucaaguccgacuucuucgagcuccucuccaaccaccaccucgacucccagucccgcugguccaaggucaaggacaaggucgaguccgacccccgcuacaaggccgucgacuccuccuccaugcgcgaggaccucuucaagcaguacaucgagaagaucgccaagaaccucgacuccgagaaggagaaggagcucgagcgccaggcccgcaucgaggccucccuccgcgagcgcgagcgcgagguccagaaggcccgcuccgagcagaccaaggagaucgaccgcgagcgcgagcagcacaagcgcgaggaggccauccagaacuucaaggcccuccucuccgacaugguccgcuccuccgacgucuccugguccgacacccgccgcacccuccgcaaggaccaccgcugggaguccggcucccuccucgagcgcgaggagaaggagaagcucuucaacgagcacaucgaggcccucaccaagaagaagcgcgagcacuuccgccagcuccucgacgagaccuccgccaucacccucaccuccaccuggaaggaggucaagaagaucaucaaggaggacccccgcugcaucaaguucuccuccuccgaccgcaagaagcagcgcgaguucgaggaguacauccgcgacaaguacaucaccgccaaggccgacuuccgcacccuccucaaggagaccaaguucaucaccuaccgcuccaagaagcucauccaggaguccgaccagcaccucaaggacgucgagaagauccuccagaacgacaagcgcuaccucguccucgacugcguccccgaggagcgccgcaagcucaucgucgccuacgucgacgaccucgaccgccgcggccccccccccccccccaccgccuccgagcccacccgccgcuccaccaaguga

SEQ ID NO: 50561 - RNA, 1761 nt, Artificial Sequence
  derived and/or modified sequence opt2 from TCERG1L__Homo_sapiens__NP_777597
augcaggccggcgcccgcuuccagcgccgccgccgccagcuccagcagcagcagccccgccgccgccagccccuccucuggcccauggacgccgagccccccccccccccccccugggucuggaugguccccggcuccgccggccuccuccgccucuccgccggcgucgucgucccccccguccuccucgccuccgcccccccccccgccgccccccuccuccccggccuccccggcuggcccgcccccuccgagcccguccucccccuccucccccuccccuccgcccccgacuccgccgccgccgccgccgcccaccccuuccccgcccuccacggccaguggcucuucggcggccacucccccucccucggccucccccccuccuccaccgucgagcucguccccgucuucccccaccucugccccuccgcccucgccacccccaucggcaaguccuggaucgacaagcgcauccccaacugcaagaucuucuucaacaacuccuucgcccucgacuccaccuggauccaccccgaggagucccgcuucuuccacggccacgagaagccccgccuccucgccaaccaggucgccgucucccucucccgccccgcccccgccucccgcccccuccccaccgucguccucgccccccagcccauccccggcggcugccacaacucccucaaggucaccuccucccccgccaucgccaucgccaccgccgccgccgccgccauggucuccgucgaccccgagaaccuccgcggccccucccccuccuccguccagccccgccacuuccucacccucgcccccaucaagaucccccuccgcaccucccccgucuccgacacccgcaccgagcgcggccgcgucgcccgcccccccgcccucaugcuccgcgcccagaagucccgcgacggcgacaaggaggacaaggagcccccccccaugcucggcggcggcgaggacuccaccgcccgcggcaaccgccccgucgccuccacccccguccccggcucccccuggugcgucgucuggaccggcgacgaccgcgucuucuucuucaaccccaccaugcaccucuccgucugggagaagcccauggaccucaaggaccgcggcgaccucaaccgcaucaucgaggaccccccccacaagcgcaagcucgaggcccccgccaccgacaacuccgacggcuccuccuccgaggacaaccgcgaggaccaggacgucaagaccaagcgcaaccgcaccgagggcugcggcucccccaagcccgaggaggccaagcgcgaggacaagggcacccgcaccccccccccccagauccuccucccccucgaggagcgcgucacccacuuccgcgacaugcuccucgagcgcggcgucuccgccuucuccaccugggagaaggagcuccacaagaucgucuucgacccccgcuaccuccuccucaacuccgaggagcgcaagcagaucuucgagcaguucgucaagacccgcaucaaggaggaguacaaggagaagaaguccaagcuccuccucgccaaggaggaguucaagaagcuccucgaggaguccaaggucuccccccgcaccaccuucaaggaguucgccgagaaguacggccgcgaccagcgcuuccgccucguccagaagcgcaaggaccaggagcacuucuucaaccaguucauccucauccucaagaagcgcgacaaggagaaccgccuccgccuccgcaagaugcgcuga

SEQ ID NO: 50562 - RNA, 2049 nt, Artificial Sequence
  derived and/or modified sequence opt2 from TCF12__Homo_sapiens__NP_003196
augaacccccagcagcagcgcauggccgccaucggcaccgacaaggagcucuccgaccuccucgacuucuccgccauguucuccccccccgucaacuccggcaagacccgccccaccacccucggcuccucccaguucuccggcuccggcaucgacgagcgcggcggcaccaccuccuggggcaccuccggccagcccucccccuccuacgacuccucccgcggcuucaccgacuccccccacuacuccgaccaccucaacgacucccgccucggcgcccacgagggccucucccccacccccuucaugaacuccaaccucaugggcaagaccuccgagcgcggcuccuucucccucuacucccgcgacaccggccuccccggcugccaguccucccuccuccgccaggaccucggccucggcucccccgcccagcucuccuccuccggcaagcccggcaccgccuacuacuccuucuccgccaccuccucccgccgccgcccccuccacgacuccgccgcccucgacccccuccaggccaagaagguccgcaaggucccccccggccuccccuccuccgucuacgcccccucccccaacuccgacgacuucaaccgcgagucccccuccuaccccucccccaagccccccaccuccauguucgccuccaccuucuucaugcaggacggcacccacaacuccuccgaccucugguccuccuccaacggcaugucccagcccggcuucggcggcauccucggcaccuccaccucccacaugucccaguccuccuccuacggcaaccuccacucccacgaccgccucuccuaccccccccacuccgucucccccaccgacaucaacaccucccucccccccauguccuccuuccaccgcggcuccaccuccuccucccccuacgucgccgccucccacaccccccccaucaacggcuccgacuccauccucggcacccgcggcaacgccgccggcuccucccagaccggcgacgcccucggcaaggcccucgccuccaucuacucccccgaccacaccuccuccuccuuccccuccaaccccuccacccccgucggcucccccuccccccucaccggcaccucccaguggccccgccccggcggccaggcccccuccucccccuccuacgagaacucccuccacucccuccagucccgcauggaggaccgccucgaccgccucgacgacgccauccacguccuccgcaaccacgccgucggccccuccaccucccuccccgccggccacuccgacauccacucccuccucggccccucccacaacgcccccaucggcucccucaacuccaacuacggcggcuccucccucgucgccuccucccgcuccgccuccauggucggcacccaccgcgaggacuccgucucccucaacggcaaccacuccguccucuccuccaccgucaccaccuccuccaccgaccucaaccacaagacccaggagaacuaccgcggcggccuccagucccaguccggcaccgucgucaccaccgagaucaagaccgagaacaaggagaaggacgagaaccuccacgagccccccuccuccgacgacaugaaguccgacgacgaguccucccagaaggacaucaaggucuccucccgcggccgcaccuccuccaccaacgaggacgaggaccucaaccccgagcagaagaucgagcgcgagaaggagcgccgcauggccaacaacgcccgcgagcgccuccgcguccgcgacaucaacgaggccuucaaggagcucggccgcaugugccagcuccaccucaaguccgagaagccccagaccaagcuccucauccuccaccaggccgucgccgucauccucucccucgagcagcagguccgcgagcgcaaccucaaccccaaggccgccugccucaagcgccgcgaggaggagaaggucuccgccgucuccgccgagccccccaccacccuccccggcacccaccccggccucuccgagaccaccaaccccaugggccacauguga

SEQ ID NO: 50563 - RNA, 600 nt, Artificial Sequence
  derived and/or modified sequence opt2 from TCF15__Homo_sapiens__NP_004600
auggccuucgcccuccuccgccccgucggcgcccacguccucuaccccgacguccgccuccucuccgaggacgaggagaaccgcuccgaguccgacgccuccgaccaguccuucggcugcugcgagggccccgaggccgcccgccgcggccccggccccggcggcggccgccgcgccggcggcggcggcggcgccggccccgucgucgucguccgccagcgccaggccgccaacgcccgcgagcgcgaccgcacccaguccgucaacaccgccuucaccgcccuccgcacccucauccccaccgagcccgucgaccgcaagcucuccaagaucgagacccuccgccucgccuccuccuacaucgcccaccucgccaacguccuccuccucggcgacuccgccgacgacggccagcccugcuuccgcgccgccggcuccgccaagggcgccguccccgccgccgccgacggcggccgccagccccgcuccaucugcaccuucugccucuccaaccagcgcaagggcggcggccgccgcgaccucggcggcuccugccucaagguccgcggcgucgccccccuccgcggcccccgccgcuga

SEQ ID NO: 50564 - RNA, 1038 nt, Artificial Sequence
  derived and/or modified sequence opt2 from TCF19__Homo_sapiens__XP_005249391
augcuccccugcuuccagcuccuccgcaucggcggcggccgcggcggcgaccucuacaccuuccacccccccgccggcgccggcugcaccuaccgccucggccaccgcgccgaccucugcgacgucgcccuccgcccccagcaggagcccggccucaucuccggcauccacgccgagcuccacgccgagccccgcggcgacgacuggcgcgucucccucgaggaccacuccucccagggcacccucgucaacaacguccgccucccccgcggccaccgccucgagcucuccgacggcgaccuccucaccuucggccccgagggcccccccggcaccucccccuccgaguucuacuucauguuccagcagguccgcgucaagccccaggacuucgccgccaucaccaucccccgcucccgcggcgaggcccgcgucggcgccggcuuccgccccaugcuccccucccagggcgccccccagcgcccccucuccaccuucucccccgcccccaaggccacccucauccucaacuccaucggcucccucuccaagcuccgcccccagccccucaccuucucccccuccuggggcggccccaagucccuccccguccccgccccccccggcgagaugggcaccacccccuccgcccccccccagcgcaaccgccgcaaguccguccaccgcguccucgccgagcucgacgacgaguccgagccccccgagaaccccccccccguccucauggagccccgcaagaagcuccgcgucgacaaggccccccucacccccaccggcaaccgccgcggccgcccccgcaaguaccccgucuccgcccccauggccccccccgccgucggcggcggcgagcccugcgccgcccccugcugcugccucccccaggaggagaccgucgccuggguccagugcgacggcugcgacgucugguuccacgucgccugcgucggcugcuccauccaggccgcccgcgaggccgacuuccgcugccccggcugccgcgccggcauccagaccuga

SEQ ID NO: 50565 - RNA, 5883 nt, Artificial Sequence
  derived and/or modified sequence opt2 from TCF20__Homo_sapiens__NP_005641
augcaguccuuccgcgagcaguccuccuaccacggcaaccagcaguccuacccccaggagguccacggcuccucccgccucgaggaguucuccccccgccaggcccagauguuccagaacuucggcggcaccggcggcuccuccggcuccuccggcuccggcuccggcggcggccgccgcggcgccgccgccgccgccgccgccauggccuccgagaccuccggccaccagggcuaccagggcuuccgcaaggaggccggcgacuucuacuacauggccggcaacaaggaccccgucaccaccggcaccccccagcccccccagcgccgccccuccggccccguccaguccuacggccccccccagggcuccuccuucggcaaccaguacggcuccgagggccacgucggccaguuccaggcccagcacuccggccucggcggcgucucccacuaccagcaggacuacaccggccccuucucccccggcuccgcccaguaccagcagcaggccuccucccagcagcagcagcagcagguccagcagcuccgccagcagcucuaccagucccaccagccccucccccaggccaccggccagcccgccuccuccuccucccaccuccagcccaugcagcgccccuccacccuccccuccuccgccgccggcuaccagcuccgcgucggccaguucggccagcacuaccaguccuccgccuccuccuccuccuccuccuccuuccccuccccccagcgcuucucccaguccggccaguccuacgacggcuccuacaacgucaacgccggcucccaguacgagggccacaacgucggcuccaacgcccaggccuacggcacccaguccaacuacuccuaccagccccaguccaugaagaacuucgagcaggccaagaucccccagggcacccagcagggccagcagcagcagcagccccagcagcagcagcaccccucccagcacgucaugcaguacaccaacgccgccaccaagcucccccuccagucccaggucggccaguacaaccagcccgagguccccguccgcucccccaugcaguuccaccagaacuucucccccaucuccaaccccucccccgccgccuccgucguccagucccccuccugcuccuccacccccuccccccucaugcagaccggcgagaaccuccagugcggccagggcuccguccccaugggcucccgcaaccgcauccuccagcucaugccccagcucucccccacccccuccaugaugcccucccccaacucccacgccgccggcuucaagggcuucggccucgagggcguccccgagaagcgccucaccgaccccggccucuccucccucuccgcccucuccacccaggucgccaaccuccccaacaccguccagcacaugcuccucuccgacgcccucaccccccagaagaagaccuccaagcgccccuccuccuccaagaaggccgacuccugcaccaacuccgagggcuccucccagcccgaggagcagcucaagucccccauggccgagucccucgacggcggcugcuccuccuccuccgaggaccagggcgagcgcguccgccagcucuccggccaguccaccuccuccgacaccaccuacaagggcggcgccuccgagaaggccggcuccucccccgcccagggcgcccagaacgagcccccccgccucaacgccucccccgccgcccgcgaggaggccaccucccccggcgccaaggacaugccccucuccuccgacggcaaccccaaggucaacgagaagaccgucggcgucaucgucucccgcgaggccaugaccggccgcgucgagaagcccggcggccaggacaagggcucccaggaggacgaccccgccgccacccagcgcccccccuccaacggcggcgccaaggagaccucccacgccucccucccccagcccgagccccccggcggcggcggcuccaagggcaacaagaacggcgacaacaacuccaaccacaacggcgagggcaacggccaguccggccacuccgccgccggccccggcuucaccucccgcaccgagcccuccaagucccccggcucccuccgcuacuccuacaaggacuccuucggcuccgccgucccccgcaacgucuccggcuucccccaguaccccaccggccaggagaagggcgacuucaccggccacggcgagcgcaagggccgcaacgagaaguuccccucccuccuccaggagguccuccagggcuaccaccaccaccccgaccgccgcuacucccgcuccacccaggagcaccagggcauggccggcucccucgagggcaccacccgccccaacguccucgucucccagaccaacgagcucgccucccgcggccuccucaacaaguccaucggcucccuccucgagaacccccacuggggccccugggagcgcaaguccuccuccaccgcccccgagaugaagcagaucaaccucaccgacuaccccaucccccgcaaguucgagaucgagccccaguccuccgcccacgagcccggcggcucccucuccgagcgccgcuccgucaucugcgacaucuccccccuccgccagaucguccgcgaccccggcgcccacucccucggccacauguccgccgacacccgcaucggccgcaacgaccgccucaaccccacccucucccaguccgucauccuccccggcggccucgucuccauggagaccaagcucaagucccaguccggccagaucaaggaggaggacuucgagcaguccaagucccaggccuccuucaacaacaagaaguccggcgaccacugccacccccccuccaucaagcacgaguccuaccgcggcaacgccucccccggcgccgccacccacgacucccucuccgacuacggcccccaggacucccgccccacccccaugcgccgcguccccggccgcgucggcggccgcgagggcaugcgcggccgcucccccucccaguaccacgacuucgccgagaagcucaagaugucccccggccgcucccgcggccccggcggcgacccccaccacaugaacccccacaugaccuucuccgagcgcgccaaccgcuccucccuccacacccccuucucccccaacuccgagacccucgccuccgccuaccacgccaacacccgcgcccacgccuacggcgaccccaacgccggccucaacucccagcuccacuacaagcgccagauguaccagcagcagcccgaggaguacaaggacugguccuccggcuccgcccagggcgucaucgccgccgcccagcaccgccaggagggcccccgcaaguccccccgccagcagcaguuccucgaccgcguccgcuccccccucaagaacgacaaggacggcaugauguacggcccccccgucggcaccuaccacgaccccuccgcccaggaggccggccgcugccucauguccuccgacggccuccccaacaagggcauggagcucaagcacggcucccagaagcuccaggaguccugcugggaccucucccgccagaccucccccgccaaguccuccggcccccccggcauguccucccagaagcgcuacggccccccccacgagaccgacggccacggccucgccgaggccacccaguccuccaagcccggcuccgucaugcuccgccuccccggccaggaggaccacuccucccagaacccccucaucaugcgccgccgcguccgcuccuucaucucccccauccccuccaagcgccagucccaggacgucaagaacuccuccaccgaggacaagggccgccuccuccacuccuccaaggagggcgccgacaaggccuucaacuccuacgcccaccucucccacucccaggacaucaaguccauccccaagcgcgacuccuccaaggaccuccccucccccgacucccgcaacugccccgccgucacccucaccucccccgccaagaccaagauccuccccccccgcaagggccgcggccucaagcucgaggccaucguccagaagaucaccucccccaacauccgccgcuccgccuccuccaacuccgccgaggccggcggcgacaccgucacccucgacgacauccucucccucaaguccggcccccccgagggcggcuccgucgccguccaggacgccgacaucgagaagcgcaagggcgaggucgccuccgaccucgucucccccgccaaccaggagcuccacgucgagaagccccucccccgcuccuccgaggaguggcgcggcuccgucgacgacaaggucaagaccgagacccacgccgagaccgucaccgccggcaaggagccccccggcgccaugaccuccaccaccucccagaagcccggcuccaaccagggccgccccgacggcucccucggcggcaccgccccccucaucuuccccgacuccaagaacgucccccccgucggcauccucgcccccgaggccaaccccaaggccgaggagaaggagaacgacaccgucaccaucucccccaagcaggagggcuucccccccaagggcuacuuccccuccggcaagaagaagggccgccccaucggcuccgucaacaagcagaagaagcagcagcagcccccccccccccccccccagcccccccagauccccgagggcuccgccgacggcgagcccaagcccaagaagcagcgccagcgccgcgagcgccgcaagcccggcgcccagccccgcaagcgcaagaccaagcaggccguccccaucgucgagccccaggagcccgagaucaagcucaaguacgccacccagccccucgacaagaccgacgccaagaacaaguccuucuaccccuacauccacgucgucaacaagugcgagcucggcgccgucugcaccaucaucaacgccgaggaggaggagcagaccaagcucguccgcggccgcaagggccagcgcucccucacccccccccccuccuccaccgaguccaaggcccuccccgccuccuccuucaugcuccagggccccgucgucaccgaguccuccgucaugggccaccucgucugcugccucugcggcaagugggccuccuaccgcaacaugggcgaccucuucggccccuucuacccccaggacuacgccgccacccuccccaagaaccccccccccaagcgcgccaccgagaugcaguccaaggucaagguccgccacaaguccgccuccaacggcuccaagaccgacaccgaggaggaggaggagcagcagcagcagcagaaggagcagcgcucccucgccgcccacccccgcuucaagcgccgccaccgcuccgaggacugcggcggcggcccccgcucccucucccgcggccuccccugcaagaaggccgccaccgagggcuccuccgagaagaccguccucgacuccaagcccuccguccccaccaccuccgagggcggccccgagcucgagcuccagauccccgagcucccccucgacuccaacgaguucuggguccacgagggcugcauccucugggccaacggcaucuaccucgucugcggccgccucuacggccuccaggaggcccucgagaucgcccgcgagaugaagugcucccacugccaggaggccggcgccacccucggcugcuacaacaagggcugcuccuuccgcuaccacuaccccugcgccaucgacgccgacugccuccuccacgaggagaacuucuccguccgcugccccaagcacaagcccccccuccccugcccccuccccccccuccagaacaagaccgccaagggcucccucuccaccgagcaguccgagcgcggcuga

SEQ ID NO: 50566 - RNA, 540 nt, Artificial Sequence
  derived and/or modified sequence opt2 from TCF21__Homo_sapiens__NP_003197
auguccaccggcucccucuccgacgucgaggaccuccaggaggucgagaugcucgagugcgacggccucaagauggacuccaacaaggaguucgucaccuccaacgaguccaccgaggaguccuccaacugcgagaacggcuccccccagaagggccgcggcggccucggcaagcgccgcaaggcccccaccaagaaguccccccucuccggcgucucccaggagggcaagcagguccagcgcaacgccgccaacgcccgcgagcgcgcccgcaugcgcguccucuccaaggccuucucccgccucaagaccacccuccccugggucccccccgacaccaagcucuccaagcucgacacccuccgccucgccuccuccuacaucgcccaccuccgccagauccucgccaacgacaaguacgagaacggcuacauccaccccgucaaccucaccuggcccuucauggucgccggcaagcccgaguccgaccucaaggaggucgucaccgccucccgccucugcggcaccaccgccuccuga

SEQ ID NO: 50567 - RNA, 2031 nt, Artificial Sequence
  derived and/or modified sequence opt2 from TCF25__Homo_sapiens__NP_055787
augucccgccgcgcccuccgccgccuccgcggcgagcagcgcggccaggagccccucggccccggcgcccuccacuucgaccuccgcgacgacgacgacgccgaggaggagggccccaagcgcgagcucggcguccgccgccccggcggcgccggcaaggagggcguccgcgucaacaaccgcuucgagcucaucaacaucgacgaccucgaggacgaccccgucgucaacggcgagcgcuccggcugcgcccucaccgacgccgucgcccccggcaacaagggccgcggccagcgcggcaacaccgaguccaagaccgacggcgacgacaccgagaccguccccuccgagcagucccacgccuccggcaagcuccgcaagaagaagaagaagcagaagaacaagaaguccuccaccggcgaggccuccgagaacggccucgaggacaucgaccgcauccucgagcgcaucgaggacuccaccggccucaaccgccccggccccgccccccucuccucccgcaagcacguccucuacgucgagcaccgccaccucaaccccgacaccgagcucaagcgcuacuucggcgcccgcgccauccucggcgagcagcgcccccgccagcgccagcgcgucuaccccaagugcaccuggcucaccacccccaaguccaccuggccccgcuacuccaagcccggccucuccaugcgccuccucgaguccaagaagggccucuccuucuucgccuucgagcacuccgaggaguaccagcaggcccagcacaaguuccucgucgccgucgaguccauggagcccaacaacaucgucguccuccuccagaccucccccuaccacgucgacucccuccuccagcucuccgacgccugccgcuuccaggaggaccaggagauggcccgcgaccucgucgagcgcgcccucuacuccauggagugcgccuuccacccccucuucucccucaccuccggcgccugccgccucgacuaccgccgccccgagaaccgcuccuucuaccucgcccucuacaagcagauguccuuccucgagaagcgcggcugcccccgcaccgcccucgaguacugcaagcucauccucucccucgagcccgacgaggacccccucugcaugcuccuccucaucgaccaccucgcccuccgcgcccgcaacuacgaguaccucauccgccucuuccaggagugggaggcccaccgcaaccucucccagcuccccaacuucgccuucuccgucccccucgccuacuuccuccucucccagcagaccgaccuccccgagugcgagcaguccuccgcccgccagaaggccucccuccucauccagcaggcccucaccauguuccccggcguccuccucccccuccucgaguccugcuccguccgccccgacgccuccgucuccucccaccgcuucuucggccccaacgccgagaucucccagccccccgcccucucccagcucgucaaccucuaccucggccgcucccacuuccucuggaaggagcccgccaccauguccuggcucgaggagaacguccacgagguccuccaggccgucgacgccggcgaccccgccgucgaggccugcgagaaccgccgcaagguccucuaccagcgcgccccccgcaacauccaccgccacgucauccucuccgagaucaaggaggccgucgccgcccucccccccgacgucaccacccaguccgucaugggcuucgacccccucccccccuccgacaccaucuacuccuacguccgccccgagcgccucucccccaucucccacggcaacaccaucgcccucuucuuccgcucccuccuccccaacuacaccauggagggcgagcgccccgaggagggcgucgccggcggccucaaccgcaaccagggccucaaccgccucaugcucgccguccgcgacaugauggccaacuuccaccucaacgaccucgaggccccccacgaggacgacgccgagggcgagggcgagugggacuga

SEQ ID NO: 50568 - RNA, 1956 nt, Artificial Sequence
  derived and/or modified sequence opt2 from TCF3__Homo_sapiens__NP_001129611
augaaccagccccagcgcauggcccccgucggcaccgacaaggagcucuccgaccuccucgacuucuccaugauguucccccuccccgucaccaacggcaagggccgccccgccucccucgccggcgcccaguucggcggcuccggccucgaggaccgccccuccuccggcuccuggggcuccggcgaccaguccuccuccuccuucgaccccucccgcaccuucuccgagggcacccacuucaccgagucccacuccucccucuccuccuccaccuuccucggccccggccucggcggcaaguccggcgagcgcggcgccuacgccuccuucggccgcgacgccggcgucggcggccucacccaggccggcuuccucuccggcgagcucgcccucaacucccccggcccccucucccccuccggcaugaagggcaccucccaguacuaccccuccuacuccggcuccucccgccgccgcgccgccgacggcucccucgacacccagcccaagaagguccgcaaggucccccccggccuccccuccuccgucuacccccccuccuccggcgaggacuacggccgcgacgccaccgccuaccccuccgccaagacccccuccuccaccuaccccgcccccuucuacgucgccgacggcucccuccaccccuccgccgagcucugguccccccccggccaggccggcuucggccccaugcucggcggcggcuccuccccccucccccucccccccggcuccggccccgucggcuccuccggcuccuccuccaccuucggcggccuccaccagcacgagcgcaugggcuaccagcuccacggcgccgaggucaacggcggccuccccuccgccuccuccuucuccuccgcccccggcgccaccuacggcggcgucuccucccacaccccccccgucuccggcgccgacucccuccucggcucccgcggcaccaccgccggcuccuccggcgacgcccucggcaaggcccucgccuccaucuacucccccgaccacuccuccaacaacuucuccuccucccccuccacccccgucggcuccccccagggccucgccggcaccucccaguggccccgcgccggcgcccccggcgcccucucccccuccuacgacggcggccuccacggccuccaguccaagaucgaggaccaccucgacgaggccauccacguccuccgcucccacgccgucggcaccgccggcgacaugcacacccuccuccccggccacggcgcccucgccuccggcuucaccggccccaugucccucggcggccgccacgccggccucgucggcggcucccaccccgaggacggccucgccggcuccaccucccucaugcacaaccacgccgcccuccccucccagcccggcacccuccccgaccucucccgcccccccgacuccuacuccggccucggccgcgccggcgccaccgccgccgccuccgagaucaagcgcgaggagaaggaggacgaggagaacaccuccgccgccgaccacuccgaggaggagaagaaggagcucaaggccccccgcgcccgcaccuccuccaccgacgagguccucucccucgaggagaaggaccuccgcgaccgcgagcgccgcauggccaacaacgcccgcgagcgcguccgcguccgcgacaucaacgaggccuuccgcgagcucggccgcaugugccagaugcaccucaaguccgacaaggcccagaccaagcuccucauccuccagcaggccguccaggucauccucggccucgagcagcagguccgcgagcgcaaccucaaccccaaggccgccugccucaagcgccgcgaggaggagaaggucuccggcgucgucggcgacccccagaugguccucuccgccccccaccccggccucuccgaggcccacaaccccgccggccacauguga

SEQ ID NO: 50569 - RNA, 2322 nt, Artificial Sequence
  derived and/or modified sequence opt2 from TCF4__Homo_sapiens__NP_001230155
auguucuccaagcgccucgagaagaucccccaggucccccuccucuuccccuucaucuucaucauccucaccaacuacuccaagauggagggcgccgucgagucccagcccuccuucuucaagaccucccaggacaucgucaccugcaccugggucgagaacugcuacuccuccuucucccgccgcccccucgagcagauguucugcaagcaccaguccaagaacaucaucuccuggaccggcauggucgcccacaccugcaaccccuccacccucggcggccagggccucugcgacuucgccaagaugcaccaccagcagcgcauggccgcccucggcaccgacaaggagcucuccgaccuccucgacuucuccgccauguucuccccccccgucuccuccggcaagaacggccccaccucccucgccuccggccacuucaccggcuccaacgucgaggaccgcuccuccuccggcuccuggggcaacggcggccaccccucccccucccgcaacuacggcgacggcacccccuacgaccacaugaccucccgcgaccucggcucccacgacaaccucuccccccccuucgucaacucccgcauccaguccaagaccgagcgcggcuccuacuccuccuacggccgcgaguccaaccuccagggcugccaccagcagucccuccucggcggcgacauggacaugggcaaccccggcacccucucccccaccaagcccggcucccaguacuaccaguacuccuccaacaacccccgccgccgcccccuccacuccuccgccauggagguccagaccaagaagguccgcaaggucccccccggccuccccuccuccgucuacgcccccuccgccuccaccgccgacuacaaccgcgacucccccggcuaccccuccuccaagcccgccaccuccaccuuccccuccuccuucuucaugcaggacggccaccacuccuccgaccccugguccuccuccuccggcaugaaccagcccggcuacgccggcaugcucggcaacuccucccacaucccccaguccuccuccuacugcucccuccacccccacgagcgccucuccuaccccucccacuccuccgccgacaucaacuccucccucccccccauguccaccuuccaccgcuccggcaccaaccacuacuccaccuccuccugcaccccccccgccaacggcaccgacuccaucauggccaaccgcggcuccggcgccgccggcuccucccagaccggcgacgcccucggcaaggcccucgccuccaucuacucccccgaccacaccaacaacuccuucuccuccaaccccuccacccccgucggcuccccccccucccucuccgccggcaccgccgucuggucccgcaacggcggccaggccuccuccucccccaacuacgagggcccccuccacucccuccagucccgcaucgaggaccgccucgagcgccucgacgacgccauccacguccuccgcaaccacgccgucggccccuccaccgccaugcccggcggccacggcgacaugcacggcaucaucggccccucccacaacggcgccaugggcggccucggcuccggcuacggcaccggccuccucuccgccaaccgccacucccucauggucggcacccaccgcgaggacggcgucgcccuccgcggcucccacucccuccuccccaaccagguccccgucccccagcuccccguccaguccgccaccucccccgaccucaaccccccccaggaccccuaccgcggcaugccccccggccuccagggccaguccgucuccuccggcuccuccgagaucaaguccgacgacgagggcgacgagaaccuccaggacaccaaguccuccgaggacaagaagcucgacgacgacaagaaggacaucaaguccaucacccgcucccgcuccuccaacaacgacgacgaggaccucacccccgagcagaaggccgagcgcgagaaggagcgccgcauggccaacaacgcccgcgagcgccuccgcguccgcgacaucaacgaggccuucaaggagcucggccgcaugguccagcuccaccucaaguccgacaagccccagaccaagcuccucauccuccaccaggccgucgccgucauccucucccucgagcagcagguccgcgagcgcaaccucaaccccaaggccgccugccucaagcgccgcgaggaggagaaggucuccuccgagccccccccccucucccucgccggcccccaccccggcaugggcgacgccuccaaccacaugggccagauguga

SEQ ID NO: 50570 - RNA, 810 nt, Artificial Sequence
  derived and/or modified sequence opt2 from TCF7__Homo_sapiens__NP_001128323
auguacaaggagaccgucuacuccgccuucaaccuccucaugcacuaccccccccccuccggcgccggccagcacccccagccccagcccccccuccacaaggccaaccagcccccccacggcgucccccagcucucccucuacgagcacuucaacuccccccaccccacccccgcccccgccgacaucucccagaagcagguccaccgcccccuccagacccccgaccucuccggcuucuacucccucaccuccggcuccaugggccagcucccccacaccgucuccugguucacccaccccucccucaugcucggcuccggcguccccggccaccccgccgccaucccccaccccgccaucgucccccccuccggcaagcaggagcuccagcccuucgaccgcaaccucaagacccaggccgaguccaaggccgagaaggaggccaagaagcccaccaucaagaagccccucaacgccuucaugcucuacaugaaggagaugcgcgccaaggucaucgccgagugcacccucaaggaguccgccgccaucaaccagauccucggccgccgcuggcacgcccucucccgcgaggagcaggccaaguacuacgagcucgcccgcaaggagcgccagcuccacaugcagcucuaccccggcugguccgcccgcgacaacuacggcaagaagaagcgccgcucccgcgagaagcaccaggaguccaccaccgagaccaacuggccccgcgagcucaaggacggcaacggccaggagucccucuccauguccuccuccuccucccccgccuga

SEQ ID NO: 50571 - RNA, 1767 nt, Artificial Sequence
  derived and/or modified sequence opt2 from TCF7L1__Homo_sapiens__NP_112573
augccccagcucggcggcggcggcggcggcggcggcggcggcuccggcggcggcggcggcuccuccgccggcgccgccggcggcggcgacgaccucggcgccaacgacgagcucauccccuuccaggacgagggcggcgaggagcaggagcccuccuccgacuccgccuccgcccagcgcgaccucgacgaggucaaguccucccucgucaacgaguccgagaaccaguccuccuccuccgacuccgaggccgagcgccgcccccagcccguccgcgacaccuuccagaagccccgcgacuacuucgccgagguccgccgcccccaggacuccgccuucuucaagggcccccccuaccccggcuaccccuuccucaugauccccgaccucuccucccccuaccucuccaacggcccccucucccccggcggcgcccgcaccuaccuccagaugaaguggccccuccucgacguccccuccuccgccaccgucaaggacacccgcucccccucccccgcccaccucuccaacaagguccccgucguccagcacccccaccacaugcacccccucaccccccucaucaccuacuccaacgaccacuucucccccggcuccccccccacccaccucucccccgagaucgaccccaagaccggcaucccccgccccccccaccccuccgagcucucccccuacuacccccucucccccggcgccgucggccagaucccccacccccucggcuggcucgucccccagcagggccagcccauguacucccucccccccggcggcuuccgccaccccuaccccgcccucgccaugaacgccuccauguccucccucgucuccucccgcuucuccccccacauggucgcccccgcccaccccggccuccccaccuccggcaucccccaccccgccaucgucucccccaucgucaagcaggagcccgccccccccucccucucccccgccgucuccgucaagucccccgucaccgucaagaaggaggaggagaagaagccccacgucaagaagccccucaacgccuucaugcucuacaugaaggagaugcgcgccaaggucgucgccgagugcacccucaaggaguccgccgccaucaaccagauccucggccgcaaguggcacaaccucucccgcgaggagcaggccaaguacuacgagcucgcccgcaaggagcgccagcuccacucccagcucuaccccaccugguccgcccgcgacaacuacggcaagaagaagaagcgcaagcgcgagaagcagcucucccagacccagucccagcagcagguccaggaggccgagggcgcccucgccuccaaguccaagaagcccugcguccaguaccucccccccgagaagcccugcgacucccccgccuccucccacggcuccaugcucgacucccccgccacccccuccgccgcccucgccucccccgccgcccccgccgccacccacuccgagcaggcccagccccucucccucaccaccaagcccgagacccgcgcccagcucgcccuccacuccgccgccuuccucuccgccaaggccgccgccuccuccuccggccagaugggcucccagcccccccuccucucccgcccccucccccucggcuccaugcccaccgcccuccucgccuccccccccuccuuccccgccacccuccacgcccaccaggcccuccccguccuccaggcccagccccucucccucgucaccaaguccgcccacuga

SEQ ID NO: 50572 - RNA, 1809 nt, Artificial Sequence
  derived and/or modified sequence opt2 from TCF7L2__Homo_sapiens__NP_001139746
augccccagcucaacggcggcggcggcgacgaccucggcgccaacgacgagcucaucuccuucaaggacgagggcgagcaggaggagaaguccuccgagaacuccuccgccgagcgcgaccucgccgacgucaaguccucccucgucaacgaguccgagaccaaccagaacuccuccuccgacuccgaggccgagcgccgcccccccccccgcuccgaguccuuccgcgacaagucccgcgagucccucgaggaggccgccaagcgccaggacggcggccucuucaagggcccccccuaccccggcuaccccuucaucaugauccccgaccucaccucccccuaccuccccaacggcucccucucccccaccgcccgcacccuccacuuccaguccggcuccacccacuacuccgccuacaagaccaucgagcaccagaucgccguccaguaccuccagaugaaguggccccuccucgacguccaggccggcucccuccagucccgccaggcccucaaggacgcccgcucccccucccccgcccacaucgucuccaacaagguccccgucguccagcacccccaccacguccacccccucaccccccucaucaccuacuccaacgagcacuucacccccggcaacccccccccccaccuccccgccgacgucgaccccaagaccggcaucccccgccccccccacccccccgacaucucccccuacuacccccucucccccggcaccgucggccagaucccccacccccucggcuggcucgucccccagcagggccagcccgucuaccccaucaccaccggcggcuuccgccaccccuaccccaccgcccucaccgucaacgccuccaugucccgcuuccccccccacaugguccccccccaccacacccuccacaccaccggcaucccccaccccgccaucgucacccccaccgucaagcaggaguccucccaguccgacgucggcucccuccacuccuccaagcaccaggacuccaagaaggaggaggagaagaagaagccccacaucaagaagccccucaacgccuucaugcucuacaugaaggagaugcgcgccaaggucgucgccgagugcacccucaaggaguccgccgccaucaaccagauccucggccgccgcuggcacgcccucucccgcgaggagcaggccaaguacuacgagcucgcccgcaaggagcgccagcuccacaugcagcucuaccccggcugguccgcccgcgacaacuacggcaagaagaagaagcgcaagcgcgacaagcagcccggcgagaccaacgacgccaacacccccaagaagugccgcgcccucuucggccucgaccgccagacccucuggugcaagcccugccgccgcaagaagaagugcguccgcuacauccagggcgagggcuccugccucuccccccccuccuccgacggcucccuccucgacucccccccccccucccccaaccuccucggcucccccccccgcgacgccaagucccagaccgagcagacccagccccucucccucucccucaagcccgacccccucgcccaccucuccaugaugccccccccccccgcccuccuccucgccgaggccacccacaaggccuccgcccucugccccaacggcgcccucgaccucccccccgccgcccuccagcccgccgcccccuccuccuccaucgcccagcccuccaccuccucccuccacucccacuccucccucgccggcacccagccccagccccucucccucgucaccaagucccucgaguga

SEQ ID NO: 50573 - RNA, 1503 nt, Artificial Sequence
  derived and/or modified sequence opt2 from TCFL5__Homo_sapiens__NP_006593
auguccggccccggcccccgcgagcccccccccgaggccggcgccgccggcggcgaggccgccgucgagggcgccggcggcggcgacgccgcccucggcgagcccggccucuccuucaccaccaccgaccucucccucgucgagaugaccgaggucgaguacacccagcuccagcacauccucugcucccacauggaggccgccgccgacggcgagcucgagacccgccucaacuccgcccuccucgccgccgccggccccggcgccggcgccggcggcuucgccgccggcggccagggcggcgccgcccccgucuaccccguccucugccccuccgcccucgccgccgacgcccccugccucggccacaucgacuuccaggagcuccgcaugaugcuccucuccgaggccggcgccgccgagaagaccuccggcggcggcgacggcgcccgcgcccgcgccgacggcgccgccaaggagggcgccggcgccgccgccgccgccgccggccccgacggcgcccccgaggcccgcgccaagcccgccguccgcguccgccucgaggaccgcuucaacuccauccccgccgagcccccccccgccccccgcggccccgagccccccgagcccggcggcgcccucaacaaccucgucacccucauccgccaccccuccgagcucaugaacgucccccuccagcagcagaacaagugcaccgcccucgucaagaacaagaccgccgccaccaccaccgcccuccaguucaccuacccccucuucaccaccaacgccugcuccaccuccggcaacuccaaccucucccagacccaguccuccuccaacuccugcuccguccucgaggccgccaagcaccaggacaucggccucccccgcgccuucuccuucugcuaccagcaggagaucgaguccaccaagcagacccucggcucccgcaacaagguccuccccgagcaggucuggaucaaggucggcgaggccgcccucugcaagcaggcccucaagcgcaaccgcucccgcaugcgccagcucgacaccaacgucgagcgccgcgcccucggcgagauccagaacgucggcgagggcgccaccgccacccagggcgccuggcaguccuccgaguccucccaggccaaccucggcgagcaggcccaguccggcccccagggcggccgcucccagcgccgcgagcgccacaaccgcauggagcgcgaccgccgccgccgcauccgcaucugcugcgacgagcucaaccuccucguccccuucugcaacgccgagaccgacaaggccaccacccuccaguggaccaccgccuuccucaaguacauccaggagcgccacggcgacucccucaagaaggaguucgaguccgucuucugcggcaagaccggccgccgccucaagcucacccgccccgacucccucgucaccugccccgcccagggcucccuccaguccucccccuccauggagaucaaguga

SEQ ID NO: 50574 - RNA, 5832 nt, Artificial Sequence
  derived and/or modified sequence opt2 from TCHH__Homo_sapiens__NP_009044
auguccccccuccuccgcuccaucugcgacaucaccgagaucuucaaccaguacgucucccacgacugcgacggcgccgcccucaccaagaaggaccucaagaaccuccucgagcgcgaguucggcgccguccuccgccgcccccacgaccccaagaccgucgaccucauccucgagcuccucgaccucgacuccaacggccgcgucgacuucaacgaguuccuccucuucaucuucaaggucgcccaggccugcuacuacgcccucggccaggccaccggccucgacgaggagaagcgcgcccgcugcgacggcaaggagucccuccuccaggaccgccgccaggaggaggaccagcgccgcuucgagccccgcgaccgccagcucgaggaggagcccggccagcgccgccgccagaagcgccaggagcaggagcgcgagcucgccgagggcgaggagcaguccgagaagcaggagcgccucgagcagcgcgaccgccagcgccgcgacgaggagcucuggcgccagcgccaggaguggcaggagcgcgaggagcgccgcgccgaggaggagcagcuccaguccugcaagggccacgagaccgaggaguuccccgacgaggagcagcuccgccgccgcgagcuccucgagcuccgccgcaagggccgcgaggagaagcagcagcagcgccgcgagcgccaggaccgcgucuuccaggaggaggaggagaaggaguggcgcaagcgcgagaccguccuccgcaaggaggaggagaagcuccaggaggaggagccccagcgccagcgcgagcuccaggaggaggaggagcagcuccgcaagcucgagcgccaggagcuccgccgcgagcgccaggaggaggagcagcagcagcagcgccuccgccgcgagcagcagcuccgccgcaagcaggaggaggagcgccgcgagcagcaggaggagcgccgcgagcagcaggagcgccgcgagcagcaggaggagcgccgcgagcagcagcuccgccgcgagcaggaggagcgccgcgagcagcagcuccgccgcgagcaggaggaggagcgccgcgagcagcagcuccgccgcgagcaggaggaggagcgccgcgagcagcagcuccgccgcgagcagcagcuccgccgcgagcagcagcuccgccgcgagcagcagcuccgccgcgagcagcagcuccgccgcgagcagcagcuccgccgcgagcagcagcuccgccgcgagcagcagcuccgccgcgagcagcagcuccgccgcgagcaggaggaggagcgccacgagcagaagcacgagcaggagcgccgcgagcagcgccucaagcgcgagcaggaggagcgccgcgacuggcucaagcgcgaggaggagaccgagcgccacgagcaggagcgccgcaagcagcagcucaagcgcgaccaggaggaggagcgccgcgagcgcuggcucaagcucgaggaggaggagcgccgcgagcagcaggagcgccgcgagcagcagcuccgccgcgagcaggaggagcgccgcgagcagcgccucaagcgccaggaggaggaggagcgccuccagcagcgccuccgcuccgagcagcagcuccgccgcgagcaggaggagcgccgcgagcagcuccucaagcgcgaggaggagaagcgccucgagcaggagcgccgcgagcagcgccucaagcgcgagcaggaggagcgccgcgaccagcuccucaagcgcgaggaggagcgccgccagcagcgccucaagcgcgagcaggaggagcgccucgagcagcgccucaagcgcgaggaggucgagcgccucgagcaggaggagcgccgcgagcagcgccucaagcgcgaggagcccgaggaggagcgccgccagcagcuccucaaguccgaggagcaggaggagcgccgccagcagcagcuccgccgcgagcagcaggagcgccgcgagcagcgccucaagcgcgaggaggaggaggagcgccucgagcagcgccucaagcgcgagcacgaggaggagcgccgcgagcaggagcucgccgaggaggagcaggagcaggcccgcgagcgcaucaagucccgcauccccaaguggcaguggcagcucgaguccgaggccgacgcccgccaguccaaggucuacucccgcccccgcaagcaggagggccagcgccgccgccaggagcaggaggagaagcgccgccgccgcgaguccgagcuccaguggcaggaggaggagcgcgcccaccgccagcagcaggaggaggagcagcgccgcgacuucaccuggcaguggcaggccgaggagaaguccgagcgcggccgccagcgccucuccgcccgccccccccuccgcgagcagcgcgagcgccagcuccgcgccgaggagcgccagcagcgcgagcagcgcuuccuccccgaggaggaggagaaggagcagcgccgccgccagcgccgcgagcgcgagaaggagcuccaguuccucgaggaggaggagcagcuccagcgccgcgagcgcgcccagcagcuccaggaggaggaggacggccuccaggaggaccaggagcgccgccgcucccaggagcagcgccgcgaccagaaguggcgcuggcagcucgaggaggagcgcaagcgccgccgccacacccucuacgccaagcccgcccuccaggagcagcuccgcaaggagcagcagcuccuccaggaggaggaggaggagcuccagcgcgaggagcgcgagaagcgccgccgccaggagcaggagcgccaguaccgcgaggaggagcagcuccagcaggaggaggagcagcuccuccgcgaggagcgcgagaagcgccgccgccaggagcgcgagcgccaguaccgcaaggacaagaagcuccagcagaaggaggagcagcuccucggcgaggagcccgagaagcgccgccgccaggagcgcgagaagaaguaccgcgaggaggaggagcuccagcaggaggaggagcagcuccuccgcgaggagcgcgagaagcgccgccgccaggagugggagcgccaguaccgcaagaaggacgagcuccagcaggaggaggagcagcuccuccgcgaggagcgcgagaagcgccgccuccaggagcgcgagcgccaguaccgcgaggaggaggagcuccagcaggaggaggagcagcuccucggcgaggagcgcgagacccgccgccgccaggagcucgagcgccaguaccgcaaggaggaggagcuccagcaggaggaggagcagcuccuccgcgaggagcccgagaagcgccgccgccaggagcgcgagcgccagugccgcgaggaggaggagcuccagcaggaggaggagcagcuccuccgcgaggagcgcgagaagcgccgccgccaggagcucgagcgccaguaccgcgaggaggaggagguccagcaggaggaggagcagcuccuccgcgaggagcccgagaagcgccgccgccaggagcucgagcgccaguaccgcgaggaggaggagcuccagcaggaggaggagcagcuccuccgcgaggagcaggagaagcgccgccaggagcgcgagcgccaguaccgcgaggaggaggagcuccagcgccagaagcgcaagcagcgcuaccgcgacgaggaccagcgcuccgaccucaaguggcagugggagcccgagaaggagaacgccguccgcgacaacaaggucuacugcaagggccgcgagaacgagcaguuccgccagcucgaggacucccagcuccgcgaccgccagucccagcaggaccuccagcaccuccucggcgagcagcaggagcgcgaccgcgagcaggagcgccgccgcuggcagcagcgcgaccgccacuuccccgaggaggagcagcucgagcgcgaggagcagaaggaggccaagcgccgcgaccgcaagucccaggaggagaagcagcuccuccgcgaggagcgcgaggagaagcgccgccgccaggagaccgaccgcaaguuccgcgaggaggagcagcuccuccaggagcgcgaggagcagccccuccgccgccaggagcgcgaccgcaaguuccgcgaggaggagcuccgccaccaggagcagggccgcaaguuccucgaggaggagcagcgccuccgccgccaggagcgcgagcgcaaguuccucaaggaggagcagcagcuccgcugccaggagcgcgagcagcagcuccgccaggaccgcgaccgcaaguuccgcgaggaggagcagcagcucucccgccaggagcgcgaccgcaaguuccgcgaggaggagcagcagguccgccgccaggagcgcgagcgcaaguuccucgaggaggagcagcagcuccgccaggagcgccaccgcaaguuccgcgaggaggagcagcuccuccaggagcgcgaggagcagcagcuccaccgccaggagcgcgaccgcaaguuccucgaggaggagcagcagcuccgccgccaggagcgcgaccgcaaguuccgcgagcaggagcuccgcucccaggagcccgagcgcaaguuccucgaggaggagcagcagcuccaccgccagcagcgccagcgcaaguuccuccaggaggagcagcagcuccgccgccaggagcgcggccagcagcgccgccaggaccgcgaccgcaaguuccgcgaggaggagcagcuccgccaggagcgcgaggagcagcagcucucccgccaggagcgcgaccgcaaguuccgccucgaggagcagaagguccgccgccaggagcaggagcgcaaguucauggaggacgagcagcagcuccgccgccaggagggccagcagcagcuccgccaggagcgcgaccgcaaguuccgcgaggacgagcagcuccuccaggagcgcgaggagcagcagcuccaccgccaggagcgcgaccgcaaguuccucgaggaggagccccagcuccgccgccaggagcgcgagcagcagcuccgccacgaccgcgaccgcaaguuccgcgaggaggagcagcuccuccaggagggcgaggagcagcagcuccgccgccaggagcgcgaccgcaaguuccgcgaggaggagcagcagcuccgccgccaggagcgcgagcgcaaguuccuccaggaggagcagcagcuccgccgccaggagcucgagcgcaaguuccgcgaggaggagcagcuccgccaggagaccgagcaggagcagcuccgccgccaggagcgcuaccgcaagauccucgaggaggagcagcuccgccccgagcgcgaggagcagcagcuccgccgccaggagcgcgaccgcaaguuccgcgaggaggagcagcuccgccaggagcgcgaggagcagcagcuccgcucccaggaguccgaccgcaaguuccgcgaggaggagcagcuccgccaggagcgcgaggagcagcagcuccgcccccagcagcgcgacggcaaguaccgcugggaggaggagcagcuccagcucgaggagcaggagcagcgccuccgccaggagcgcgaccgccaguaccgcgccgaggagcaguucgccacccaggagaagucccgccgcgaggagcaggagcucuggcaggaggaggagcagaagcgccgccaggagcgcgagcgcaagcuccgcgaggagcacauccgccgccagcagaaggaggagcagcgccaccgccaggucggcgagaucaagucccaggagggcaagggccacggccgccuccucgagcccggcacccaccaguucgccuccguccccguccgcuccuccccccucuacgaguacauccaggagcagcgcucccaguaccgccccuga

SEQ ID NO: 50575 - RNA, 1497 nt, Artificial Sequence
  derived and/or modified sequence opt2 from TCHP__Homo_sapiens__XP_011537139
auggcccuccccacccuccccuccuacuggugcucccagcagcgccucaaccagcagcucgcccgccagcgcgagcaggaggcccgccuccgccagcagugggagcagaacucccgcuacuuccgcauguccgacaucugcuccuccaagcaggccgagugguccuccaagaccuccuaccagcgcuccaugcacgccuaccagcgcgagaagaugaaggaggagaagcgccgcucccucgaggcccgccgcgagaagcuccgccagcucaugcaggaggagcaggaccuccucgcccgcgagcucgaggagcuccgccucuccaugaaccuccaggagcgccgcauccgcgagcagcacggcaagcucaaguccgccaaggaggagcagcgcaagcucaucgccgagcagcuccucuacgagcacuggaagaagaacaaccccaagcuccgcgagauggagcucgaccuccaccagaagcacgucgucaacuccugggagaugcagaaggaggagaagaagcagcaggaggccaccgccgagcaggagaacaagcgcuacgagaacgaguacgagcgcgcccgccgcgaggcccucgagcgcaugaaggccgaggaggagcgccgccagcucgaggacaagcuccaggccgaggcccuccuccagcagauggaggagcucaagcucaaggaggucgaggccaccaagcucaagaaggagcaggagaaccuccucaagcagcgcugggagcucgagcgccucgaggaggagcgcaagcagauggaggccuuccgccagaaggccgagcucggccgcuuccuccgccaccaguacaacgcccagcucucccgccgcacccagcagauccaggaggagcucgaggccgaccgccgcauccuccaggcccuccucgagaaggaggacgagucccagcgccuccaccucgcccgccgcgagcaggucauggccgacgucgccuggaugaagcaggccaucgaggagcagcuccagcucgagcgcgcccgcgaggccgagcuccagaugcuccuccgcgaggaggccaaggagaugugggagaagcgcgaggccgagugggcccgcgagcgcuccgcccgcgaccgccucauguccgagguccucaccggccgccagcagcagauccaggagaagaucgagcagaaccgccgcgcccaggaggagucccucaagcaccgcgagcagcucauccgcaaccucgaggagguccgcgagcucgcccgccgcgagaaggaggaguccgagaagcucaaguccgcccgcaagcaggagcucgaggcccaggucgccgagcgccgccuccaggccugggaggccgaccagcaggaggaggaggaggaggaggaggcccgccgcgucgagcagcucuccgacgcccuccuccagcaggaggccgagaccauggccgagcagggcuaccgccccaagcccuacggccaccccaagaucgccuggaacuga

SEQ ID NO: 50576 - RNA, 1845 nt, Artificial Sequence
  derived and/or modified sequence opt2 from TCIRG1__Homo_sapiens__NP_006044
augaccuuccucaucuccuacuggggcgagcagaucggccagaagauccgcaagaucaccgacugcuuccacugccacgucuuccccuuccuccagcaggaggaggcccgccucggcgcccuccagcagcuccagcagcagucccaggagcuccaggagguccucggcgagaccgagcgcuuccucucccagguccucggccgcguccuccagcuccucccccccggccagguccagguccacaagaugaaggccgucuaccucgcccucaaccagugcuccgucuccaccacccacaagugccucaucgccgaggccuggugcuccguccgcgaccuccccgcccuccaggaggcccuccgcgacuccuccauggaggagggcgucuccgccgucgcccaccgcauccccugccgcgacaugccccccacccucauccgcaccaaccgcuucaccgccuccuuccagggcaucgucgacgccuacggcgucggccgcuaccaggaggucaaccccgcccccuacaccaucaucaccuuccccuuccucuucgccgucauguucggcgacgucggccacggccuccucauguuccucuucgcccucgccaugguccucgccgagaaccgccccgccgucaaggccgcccagaacgagaucuggcagaccuucuuccgcggccgcuaccuccuccuccucaugggccucuucuccaucuacaccggcuucaucuacaacgagugcuucucccgcgccaccuccaucuuccccuccggcugguccgucgccgccauggccaaccaguccggcugguccgacgccuuccucgcccagcacaccaugcucacccucgaccccaacgucaccggcgucuuccucggccccuaccccuucggcaucgaccccaucuggucccucgccgccaaccaccucuccuuccucaacuccuucaagaugaagauguccgucauccucggcgucguccacauggccuucggcgucguccucggcgucuucaaccacguccacuucggccagcgccaccgccuccuccucgagacccuccccgagcucaccuuccuccucggccucuucggcuaccucgucuuccucgucaucuacaaguggcucugcgucugggccgcccgcgccgccuccgcccccuccauccucauccacuucaucaacauguuccucuucucccacucccccuccaaccgccuccucuacccccgccaggaggucguccaggccacccucgucguccucgcccucgccaugguccccauccuccuccucggcaccccccuccaccuccuccaccgccaccgccgccgccuccgccgccgccccgccgaccgccaggaggagaacaaggccggccuccucgaccuccccgacgccuccgucaacggcugguccuccgacgaggagaaggccggcggccucgacgacgaggaggaggccgagcucguccccuccgagguccucaugcaccaggccauccacaccaucgaguucugccucggcugcgucuccaacaccgccuccuaccuccgccucugggcccucucccucgcccacgcccagcucuccgagguccucugggccauggucaugcgcaucggccucggccucggccgcgaggucggcgucgccgccgucguccucguccccaucuucgccgccuucgccgucaugaccgucgccauccuccucgucauggagggccucuccgccuuccuccacgcccuccgccuccacugggucgaguuccagaacaaguucuacuccggcaccggcuacaagcucucccccuucaccuucgccgccaccgacgacuga

SEQ ID NO: 50577 - RNA, 345 nt, Artificial Sequence
  derived and/or modified sequence opt2 from TCL1A__Homo_sapiens__NP_001092195
auggccgagugccccacccucggcgaggccgucaccgaccaccccgaccgccucugggccugggagaaguucgucuaccucgacgagaagcagcacgccuggcucccccucaccaucgagaucaaggaccgccuccagcuccgcguccuccuccgccgcgaggacgucguccucggccgccccaugacccccacccagaucggccccucccuccuccccaucauguggcagcucuaccccgacggccgcuaccgcuccuccgacuccuccuucuggcgccucgucuaccacaucaagaucgacggcgucgaggacaugcuccucgagcuccuccccgacgacuga

SEQ ID NO: 50578 - RNA, 387 nt, Artificial Sequence
  derived and/or modified sequence opt2 from TCL1B__Homo_sapiens__NP_004909
auggccuccgaggccuccguccgccucggcgucccccccggccgccucuggauccagcgccccggcaucuacgaggacgaggagggccgcaccugggucaccgucgucguccgcuucaaccccucccgccgcgagugggcccgcgccucccagggcucccgcuacgagcccuccaucaccguccaccucuggcagauggccguccacacccgcgagcuccucuccuccggccagaugcccuucucccagcuccccgccgucuggcagcucuaccccggccgcaaguaccgcgccgccgacuccuccuucugggagaucgccgaccacggccagaucgacuccauggagcagcucguccucaccuaccagcccgagcgcaaggacuga

SEQ ID NO: 50579 - RNA, 1302 nt, Artificial Sequence
  derived and/or modified sequence opt2 from TCN1__Homo_sapiens__NP_001053
augcgccagucccaccagcucccccucgucggccuccuccucuucuccuucauccccucccagcucugcgagaucugcgaggucuccgaggagaacuacauccgccucaagccccuccucaacaccaugauccaguccaacuacaaccgcggcaccuccgccgucaacgucguccucucccucaagcucgucggcauccagauccagacccucaugcagaagaugauccagcagaucaaguacaacgucaagucccgccucuccgacgucuccuccggcgagcucgcccucaucauccucgcccucggcgucugccgcaacgccgaggagaaccucaucuacgacuaccaccucaucgacaagcucgagaacaaguuccaggccgagaucgagaacauggaggcccacaacggcaccccccucaccaacuacuaccagcucucccucgacguccucgcccucugccucuucaacggcaacuacuccaccgccgaggucgucaaccacuucacccccgagaacaagaacuacuacuucggcucccaguucuccgucgacaccggcgccauggccguccucgcccucaccugcgucaagaagucccucaucaacggccagaucaaggccgacgagggcucccucaagaacaucuccaucuacaccaagucccucgucgagaagauccucuccgagaagaaggagaacggccucaucggcaacaccuucuccaccggcgaggccaugcaggcccucuucgucuccuccgacuacuacaacgagaacgacuggaacugccagcagacccucaacaccguccucaccgagaucucccagggcgccuucuccaaccccaacgccgccgcccagguccuccccgcccucaugggcaagaccuuccucgacaucaacaaggacuccuccugcgucuccgccuccggcaacuucaacaucuccgccgacgagcccaucaccgucaccccccccgacucccaguccuacaucuccgucaacuacuccguccgcaucaacgagaccuacuucaccaacgucaccguccucaacggcuccgucuuccucuccgucauggagaaggcccagaagaugaacgacaccaucuucggcuucaccauggaggagcgcuccuggggccccuacaucaccugcauccagggccucugcgccaacaacaacgaccgcaccuacugggagcuccucuccggcggcgagccccucucccagggcgccggcuccuacgucguccgcaacggcgagaaccucgagguccgcugguccaaguacuga

SEQ ID NO: 50580 - RNA, 1284 nt, Artificial Sequence
  derived and/or modified sequence opt2 from TCN2__Homo_sapiens__NP_000346
augcgccaccucggcgccuuccucuuccuccucggcguccucggcgcccucaccgagaugugcgagauccccgagauggacucccaccucgucgagaagcucggccagcaccuccuccccuggauggaccgccucucccucgagcaccucaaccccuccaucuacgucggccuccgccucuccucccuccaggccggcaccaaggaggaccucuaccuccacucccucaagcucggcuaccagcagugccuccucggcuccgccuucuccgaggacgacggcgacugccagggcaagcccuccaugggccagcucgcccucuaccuccucgcccuccgcgccaacugcgaguucguccgcggccacaagggcgaccgccucgucucccagcucaagugguuccucgaggacgagaagcgcgccaucggccacgaccacaagggccacccccacaccuccuacuaccaguacggccucggcauccucgcccucugccuccaccagaagcgcguccacgacuccgucgucgacaagcuccucuacgccgucgagcccuuccaccagggccaccacuccgucgacaccgccgccauggccggccucgccuucaccugccucaagcgcuccaacuucaaccccggccgccgccagcgcaucaccauggccauccgcaccguccgcgaggagauccucaaggcccagacccccgagggccacuucggcaacgucuacuccaccccccucgcccuccaguuccucaugaccucccccaugcgcggcgccgagcucggcaccgccugccucaaggcccgcgucgcccuccucgccucccuccaggacggcgccuuccagaacgcccucaugaucucccagcuccuccccguccucaaccacaagaccuacaucgaccucaucuuccccgacugccucgccccccgcgucaugcucgagcccgccgccgagaccaucccccagacccaggagaucaucuccgucacccuccagguccucucccuccucccccccuaccgccaguccaucuccguccucgccggcuccaccgucgaggacguccucaagaaggcccacgagcucggcggcuucaccuacgagacccaggccucccucuccggccccuaccucaccuccgucaugggcaaggccgccggcgagcgcgaguucuggcagcuccuccgcgaccccaacaccccccuccuccagggcaucgccgacuaccgccccaaggacggcgagaccaucgagcuccgccucgucuccugguga

SEQ ID NO: 50581 - RNA, 4236 nt, Artificial Sequence
  derived and/or modified sequence opt2 from TCOF1__Homo_sapiens__NP_000347
auggccgaggcccgcaagcgccgcgagcuccucccccucaucuaccaccaccuccuccgcgccggcuacguccgcgccgcccgcgaggucaaggagcaguccggccagaagugcuuccucgcccagcccgucacccuccucgacaucuacacccacuggcagcagaccuccgagcucggccgcaagcgcaaggccgaggaggacgccgcccuccaggccaagaagacccgcgucuccgaccccaucuccaccuccgaguccuccgaggaggaggaggaggccgaggccgagaccgccaaggccaccccccgccucgccuccaccaacuccuccguccucggcgccgaccuccccuccuccaugaaggagaaggccaaggccgagaccgagaaggccggcaagaccggcaacuccaugccccaccccgccaccggcaagaccgucgccaaccuccucuccggcaaguccccccgcaaguccgccgagcccuccgccaacaccacccucgucuccgagaccgaggaggagggcuccguccccgccuucggcgccgccgccaagcccggcauggucuccgccggccaggccgacuccuccuccgaggacaccuccuccuccuccgacgagaccgacgucgaggucaaggccuccgagaagauccuccagguccgcgccgccuccgcccccgccaagggcacccccggcaagggcgccacccccgccccccccggcaaggccggcgccgucgccucccagaccaaggccggcaagcccgaggaggacuccgaguccuccuccgaggaguccuccgacuccgaggaggagacccccgccgccaaggcccuccuccaggccaaggccuccggcaagaccucccaggucggcgccgccuccgcccccgccaaggaguccccccgcaagggcgccgcccccgccccccccggcaagaccggccccgccgucgccaaggcccaggccggcaagcgcgaggaggacucccaguccuccuccgaggaguccgacuccgaggaggaggcccccgcccaggccaagcccuccggcaaggccccccagguccgcgccgccuccgcccccgccaaggaguccccccgcaagggcgccgcccccgcccccccccgcaagaccggccccgccgccgcccagguccaggucggcaagcaggaggaggacucccgcuccuccuccgaggaguccgacuccgaccgcgaggcccucgccgccaugaacgccgcccaggucaagccccucggcaaguccccccaggucaagcccgccuccaccaugggcaugggcccccucggcaagggcgccggccccgucccccccggcaaggucggccccgccacccccuccgcccaggucggcaagugggaggaggacuccgaguccuccuccgaggaguccuccgacuccuccgacggcgagguccccaccgccgucgcccccgcccaggagaagucccucggcaacauccuccaggccaagcccaccuccucccccgccaagggccccccccagaaggccggccccgucgccguccaggucaaggccgagaagcccauggacaacuccgaguccuccgaggaguccuccgacuccgccgacuccgaggaggcccccgccgccaugaccgccgcccaggccaagcccgcccucaagaucccccagaccaaggccugccccaagaagaccaacaccaccgccuccgccaaggucgcccccguccgcgucggcacccaggccccccgcaaggccggcaccgccaccucccccgccggcuccucccccgccgucgccggcggcacccagcgccccgccgaggacuccuccuccuccgaggaguccgacuccgaggaggagaagaccggccucgccgucaccgucggccaggccaaguccgucggcaagggccuccaggucaaggccgccuccguccccgucaagggcucccucggccagggcaccgcccccguccuccccggcaagaccggccccaccgucacccaggucaaggccgagaagcaggaggacuccgaguccuccgaggaggaguccgacuccgaggaggccgccgccucccccgcccaggucaagaccuccgucaagaagacccaggccaaggccaaccccgccgccgcccgcgcccccuccgccaagggcaccaucuccgcccccggcaaggucgucaccgccgccgcccaggccaagcagcgcucccccuccaaggucaagccccccguccgcaacccccagaacuccaccguccucgcccgcggccccgccuccguccccuccgucggcaaggccgucgccaccgccgcccaggcccagaccggccccgaggaggacuccggcuccuccgaggaggaguccgacuccgaggaggaggccgagacccucgcccaggucaagcccuccggcaagacccaccagauccgcgccgcccucgcccccgccaaggaguccccccgcaagggcgccgcccccaccccccccggcaagaccggccccuccgccgcccaggccggcaagcaggacgacuccggcuccuccuccgaggaguccgacuccgacggcgaggcccccgccgccgucaccuccgcccaggucaucaagcccccccucaucuucgucgaccccaaccgcucccccgccggccccgccgccacccccgcccaggcccaggccgccuccaccccccgcaaggcccgcgccuccgaguccaccgcccgcuccuccuccuccgaguccgaggacgaggacgucauccccgccacccagugccucacccccggcauccgcaccaacgucgucaccaugcccaccgcccacccccgcaucgcccccaaggccuccauggccggcgccuccuccuccaaggaguccucccgcaucuccgacggcaagaagcaggagggccccgccacccaggucuccaagaagaaccccgccucccucccccucacccaggccgcccucaagguccucgcccagaaggccuccgaggcccagccccccgucgcccgcacccagcccuccuccggcgucgacuccgccgucggcacccuccccgccaccuccccccaguccaccuccguccaggccaagggcaccaacaagcuccgcaagcccaagcuccccgagguccagcaggccaccaaggcccccgaguccuccgacgacuccgaggacuccuccgacuccuccuccggcuccgaggaggacggcgagggcccccagggcgccaaguccgcccacacccucggccccacccccucccgcaccgagacccucgucgaggagaccgccgccgaguccuccgaggacgacgucgucgcccccucccagucccuccucuccggcuacaugacccccggccucacccccgccaacucccaggccuccaaggccacccccaagcucgacuccucccccuccgucuccuccacccucgccgccaaggacgaccccgacggcaagcaggaggccaagccccagcaggccgccggcaugcucucccccaagaccggcggcaaggaggccgccuccggcaccaccccccagaagucccgcaagcccaagaagggcgccggcaacccccaggccuccacccucgcccuccaguccaacaucacccagugccuccucggccagcccuggccccucaacgaggcccagguccaggccuccgucgucaagguccucaccgagcuccucgagcaggagcgcaagaaggucgucgacaccaccaaggaguccucccgcaagggcugggagucccgcaagcgcaagcucuccggcgaccagcccgccgcccgcaccccccgcuccaagaagaagaagaagcucggcgccggcgagggcggcgaggccuccgucucccccgagaagaccuccaccaccuccaagggcaaggccaagcgcgacaaggccuccggcgacgucaaggagaagaagggcaagggcucccucggcucccagggcgccaaggacgagcccgaggaggagcuccagaagggcaugggcaccgucgagggcggcgaccaguccaaccccaaguccaagaaggagaagaagaaguccgacaagcgcaagaaggacaaggagaagaaggagaagaagaagaaggccaagaaggccuccaccaaggacuccgagucccccucccagaagaagaagaagaagaagaagaagaccgccgagcagaccgucuga

SEQ ID NO: 50582 - RNA, 981 nt, Artificial Sequence
  derived and/or modified sequence opt2 from TCP10__Homo_sapiens__NP_004601
auggagaagacccccgccgccgccgaggucccccgcgaggacuccaacgccggcgagaugcccucccuccagcagcagaucaccucccuccaccaggagcucggccgccagcagucccucugggccgacauccaccgcaagcuccagucccacauggacgcccuccgcaagcagaaccgcgagcuccgcgaggagcuccgcggccuccagcgccagcagugggaggccggcaagaagcccgccgccuccccccacgccggccgcgagucccacacccucgcccucgagcccgccuucggcaagaucucccaccucuccgccgacgaggacaccacccccaaguacgccggccgcaagucccaguccgccacccuccucggccagcgcugguccuccaaccaccucgccccccccaagcccaugucccucaagaccgagcgcaucaacuccggcaagacccccccccaggaggaccgcgagaaguccccccccggccgccgccaggaccgcucccccgcccccaccggccgccccacccccggcgccgagcgccgcggcgucuccgaggacggcaagaucaugcaccccuccucccgcuccccccagaacuccggcggccgcaagucccccguccaggccucccaggccaccacccuccaggagcagaccgccgccgcccgcggcgccgaccgcuccuccuccguccucggcuccuccgagggcggcuuccucucccgcguccaggccgacgaguucgccuccuccgcccccgacuccgccgagcgccagaaccuccccgucaacccccccuccucccucgagaucgcccaggccauggacaccaagaugaagaaggaggagguccaggaggagaagcgccaccccaagggcaaggccgacgacugccgccgcuccggcuuccccuccgaguuccccggcgcccuccacgccgcccccucccgccaggacaugggccccuga

SEQ ID NO: 50583 - RNA, 1062 nt, Artificial Sequence
  derived and/or modified sequence opt2 from TCP10L2__Homo_sapiens__NP_001138593
augcucgagggccagcucgaggcccgcgagcccaaggagggcacccaccccgaggaccccugccccggcgccggcgccgccauggagaagacccccgccgccgccgaggucccccgcgaggacuccaacgccggcgagaugcccucccuccagcagcagaucaccucccuccaccaggagcucggccgccagcagucccucugggccgacauccaccgcaagcuccagucccacauggacgcccuccgcaagcagaaccgcgagcuccgcgaggagcuccgcggccuccagcgccagcagugggaggccggcaagaagcccgccgccuccccccacgccggccgcgagucccacacccucgcccucgagcccgccuucggcaagaucuccccccucuccgccgacgaggagaccacccccaaguacgccggccgcaagucccaguccgccacccuccucggccagcgcugguccuccaaccaccucgccccccccaagcccaugucccucaagaccgagcgcaucaacuccggcaagacccccccccaggaggaccgcgagaaguccccccccggccgccgccaggaccgcucccccgcccccaccggccgccccacccccggcgccgagcgccgcgaggucuccgaggacggcaagaucaugcaccccuccucccgcucccuccagaacuccggcggccgcaagucccccguccaggccucccaggccgccacccuccaggagcagaccgccgccgccggcgucgccgaccgcuccuccuccguccucggcuccuccgagggcggcuuccucucccgcguccaggccgaggaguucgccuccuccucccccgacuccgccgagcgccagaaccuccccgucaacccccccuccucccucgagaucgcccaggccauggacaccaagaugaagaaggaggagguccaggaggagaagcgccaccccaacggcaaggccgacgacugccgccgcuccggcuuccccuccgaguuccccggcgcccuccacgccgcccccucccgccaggacaugggccccuga

SEQ ID NO: 50584 - RNA, 1530 nt, Artificial Sequence
  derived and/or modified sequence opt2 from TCP11L1__Homo_sapiens__NP_060863
auguccgagaaccucgacaaguccaacgucaacgaggccggcaaguccaaguccaacgacuccgaggagggccucgaggacgccgucgagggcgccgacgaggcccuccagaaggccaucaaguccgacuccuccuccccccagcgcguccagcgcccccacuccucccccccccgcuucgucaccgucgaggagcuccucgagaccgcccgcggcgucaccaacauggcccucgcccacgagaucgucgucaacggcgacuuccagaucaagcccgucgagcuccccgagaacucccucaagaagcgcgucaaggagaucguccacaaggccuucugggacugccucuccguccagcucuccgaggacccccccgccuacgaccacgccaucaagcucgucggcgagaucaaggagacccuccucuccuuccuccuccccggccacacccgccuccgcaaccagaucaccgagguccucgaccucgaccucaucaagcaggaggccgagaacggcgcccucgacaucuccaagcucgccgaguucaucaucggcaugaugggcacccucugcgcccccgcccgcgacgaggaggucaagaagcucaaggacaucaaggagaucgucccccucuuccgcgagaucuucuccguccucgaccucaugaaggucgacauggccaacuucgccaucuccuccauccgcccccaccucaugcagcaguccgucgaguacgagcgcaagaaguuccaggagauccucgagcgccagcccaacucccucgacuucgucacccaguggcucgaggaggccuccgaggaccucaugacccagaaguacaagcacgcccuccccgucggcggcauggccgccggcuccggcgacaugccccgccucucccccgucgccguccagaacuacgccuaccucaagcuccucaagugggaccaccuccagcgccccuuccccgagaccguccucauggaccagucccgcuuccacgagcuccagcuccagcucgagcagcucaccauccucggcgccguccuccucgucaccuucuccauggccgcccccggcaucuccucccaggccgacuucgccgagaagcucaagaugaucgucaagauccuccucaccgacaugcaccuccccuccuuccaccucaaggacguccucaccaccaucggcgagaaggucugccucgaggucuccuccugccucucccucugcggcuccucccccuucaccaccgacaaggagaccguccucaagggccagauccaggccgucgccucccccgacgaccccauccgccgcaucauggagucccgcauccucaccuuccucgagaccuaccucgccuccggccaccagaagccccuccccaccguccccggcggccucucccccguccagcgcgagcucgaggaggucgccaucaaguucgcccgccucgucaacuacaacaagauggucuucugccccuacuacgacgccauccucuccaagauccucguccgcuccuga

SEQ ID NO: 50585 - RNA, 1206 nt, Artificial Sequence
  derived and/or modified sequence opt2 from TCP1__Homo_sapiens__NP_001008897
auguccuccaagaucaucggcaucaacggcgacuucuucgccaacauggucgucgacgccguccucgccaucaaguacaccgacauccgcggccagccccgcuaccccgucaacuccgucaacauccucaaggcccacggccgcucccagauggaguccaugcucaucuccggcuacgcccucaacugcgucgucggcucccagggcaugcccaagcgcaucgucaacgccaagaucgccugccucgacuucucccuccagaagaccaagaugaagcucggcguccaggucgucaucaccgaccccgagaagcucgaccagauccgccagcgcgaguccgacaucaccaaggagcgcauccagaagauccucgccaccggcgccaacgucauccucaccaccggcggcaucgacgacaugugccucaaguacuucgucgaggccggcgccauggccguccgccgcguccucaagcgcgaccucaagcgcaucgccaaggccuccggcgccaccauccucuccacccucgccaaccucgagggcgaggagaccuucgaggccgccaugcucggccaggccgaggaggucguccaggagcgcaucugcgacgacgagcucauccucaucaagaacaccaaggcccgcaccuccgccuccaucauccuccgcggcgccaacgacuucaugugcgacgagauggagcgcucccuccacgacgcccucugcgucgucaagcgcguccucgaguccaaguccgucguccccggcggcggcgccgucgaggccgcccucuccaucuaccucgagaacuacgccaccuccaugggcucccgcgagcagcucgccaucgccgaguucgcccgcucccuccucgucauccccaacacccucgccgucaacgccgcccaggacuccaccgaccucgucgccaagcuccgcgccuuccacaacgaggcccaggucaaccccgagcgcaagaaccucaaguggaucggccucgaccucuccaacggcaagccccgcgacaacaagcaggccggcgucuucgagcccaccaucgucaaggucaagucccucaaguucgccaccgaggccgccaucaccauccuccgcaucgacgaccucaucaagcuccaccccgaguccaaggacgacaagcacggcuccuacgaggacgccguccacuccggcgcccucaacgacuga

SEQ ID NO: 50586 - RNA, 312 nt, Artificial Sequence
  derived and/or modified sequence opt2 from TCTA__Homo_sapiens__NP_071503
auggccgaguccugguccggccaggcccuccaggcccuccccgccaccguccucggcgcccucggcuccgaguuccuccgcgagugggaggcccaggacaugcgcgucacccucuucaagcuccuccuccucuggcucguccucucccuccucggcauccagcucgccuggggcuucuacggcaacaccgucaccggccucuaccaccgccccggccucggcggccagaacggcuccacccccgacggcuccacccacuuccccuccugggagauggccgccaacgagccccucaagacccaccgcgaguga

SEQ ID NO: 50587 - RNA, 1506 nt, Artificial Sequence
  derived and/or modified sequence opt2 from TCTE1__Homo_sapiens__XP_011512640
augcaggacaccgucaccaccuccgcccuccucgaccccucccacuccuccgucuccacccaggacaacuccuccaccggcggccacaccuccuccaccuccccccagcucuccaagcccuccaucacccccguccccgccaagucccgcaacccccacccccgcgccaacauccgccgcaugcgccgcaucaucgccgaggaccccgaguggucccucgccaucgucccccuccucaccgagcucugcauccagcacaucauccgcaacuuccagaagaaccccauccucaagcagaugcuccccgagcaccagcagaagguccucaaccaccucucccccgaccucccccucgccgucaccgccaaccucaucgacuccgagaacuacuggcuccgcugcugcaugcaccgcuggcccgucugccacgucgcccaccacggcggcuccuggaagcgcauguucuucgagcgccaccucgagaaccuccucaagcacuucauccccggcaccaccgaccccgccgucauccucgaccuccucccccucugccgcaacuacguccgccgcguccacgucgaccaguuccucccccccguccagcuccccgcccagcuccgccccggcgaccaguccgacuccggcuccgagggcgagauggaggagcccaccgucgaccacuaccagcucggcgaccucgucgccggccucucccaccucgaggagcucgaccucgucuacgacgucaaggacugcggcaugaacuucgaguggaaccucuuccucuucaccuaccgcgacugccucucccucgccgccgccaucaaggccugccacacccucaagaucuucaagcucacccgcuccaaggucgacgacgacaaggcccgcaucaucauccgcucccuccucgaccaccccguccucgaggagcucgaccucucccagaaccucaucggcgaccgcggcgcccgcggcgccgccaagcuccucucccacucccgccuccgcguccucaaccucgccaacaaccagguccgcgcccccggcgcccagucccucgcccacgcccucgcccacaacaccaaccucaucucccucaaccuccgccucaacugcaucgaggacgagggcggccaggcccucgcccacgcccuccagaccaacaagugccucaccacccuccaccucggcggcaacgagcucuccgagcccaccgccacccuccucucccagguccucgccaucaacaccacccucaccuccaucaaccucuccugcaaccacaucggccucgacggcggcaagcagcuccucgagggcauguccgacaacaagacccuccucgaguucgaccuccgccucuccgacgucgcccaggaguccgaguaccucaucggccaggcccucuacgccaaccgcgaggccgcccgccagcgcgcccucaaccccucccacuucauguccaccaucaccgccaacggccccgagaacuccgucggcuga

SEQ ID NO: 50588 - RNA, 1764 nt, Artificial Sequence
  derived and/or modified sequence opt2 from TCTN1__Homo_sapiens__NP_001076006
augcgcccccgcggccuccccccccuccucgucguccuccucggcugcugggccuccgucuccgcccagaccgacgccacccccgccgucaccaccgagggccucaacuccaccgaggccgcccucgccaccuucggcaccuuccccuccacccgcccccccggcaccccccgcgcccccggccccuccuccggcccccgccccacccccgucaccgacgucgccguccucugcgucugcgaccucucccccgcccagugcgacaucaacugcugcugcgaccccgacugcuccuccgucgacuucuccgucuucuccgccugcuccguccccgucgucaccggcgacucccaguucugcucccagaaggccgucaucuacucccucaacuucaccgccaaccccccccagcgcgucuucgagcucgucgaccagaucaaccccuccaucuucugcauccacaucaccaacuacaagcccgcccucuccuucaucaaccccgagguccccgacgagaacaacuucgacacccucaugaagaccuccgacggcuucacccucaacgccgaguccuacgucuccuucaccaccaagcucgacauccccaccgccgccaaguacgaguacggcgucccccuccagaccuccgacuccuuccuccgcuuccccuccucccucaccuccucccucugcaccgacaacaaccccgccgccuuccucgucaaccaggccgucaagugcacccgcaagaucaaccucgagcagugcgaggagaucgaggcccucuccauggccuucuacuccucccccgagauccuccgcguccccgacucccgcaagaagguccccaucaccguccaguccaucgucauccagucccucaacaagacccucacccgccgcgaggacaccgacguccuccagcccacccucgucaacgccggccacuucucccucugcgucaacgucguccucgaggucaaguacucccucaccuacaccgacgccggcgaggucaccaaggccgaccucuccuucguccucggcaccgucuccuccgucgucgucccccuccagcagaaguucgagauccacuuccuccaggagaacacccagcccgucccccucuccggcaaccccggcuacgucgucggccucccccucgccgccggcuuccagccccacaagggcuccggcaucauccagaccaccaaccgcuacggccagcucaccauccuccacuccaccaccgagcaggacugccucgcccucgagggcguccgcacccccguccucuucggcuacaccaugcaguccggcugcaagcuccgccucaccggcgcccuccccugccagcucgucgcccagaaggucaagucccuccucuggggccagggcuuccccgacuacgucgcccccuucggcaacucccaggcccaggacaugcucgacuggguccccauccacuucaucacccaguccuucaaccgcaaggacuccugccagcuccccggcgcccucgucaucgaggucaaguggaccaaguacggcucccuccucaacccccaggccaagaucgucaacgucaccgccaaccucaucuccuccuccuuccccgaggccaacuccggcaacgagcgcaccauccucaucuccaccgccgucaccuucgucgacgucuccgcccccgccgaggccggcuuccgcgccccccccgccaucaacgcccgccuccccuucaacuucuucuuccccuucgucuga

SEQ ID NO: 50589 - RNA, 2091 nt, Artificial Sequence
  derived and/or modified sequence opt2 from TCTN2__Homo_sapiens__NP_001137322
augggcuuccagccccccgccgcccuccuccuccgccucuuccuccuccagggcauccuccgccuccucuggggcgaccucgccuucaucccccccuucauccgcauguccggccccgccgucuccgccucccucgucggcgacaccgagggcgucaccgucucccucgccguccuccaggacgaggccggcauccuccccauccccaccugcggcguccucaacaacgagaccgaggacugguccgucaccgucauccccggcgccguccucgaggucaccguccgcuggaagcgcggccucgacuggugcuccuccaacgagaccgacuccuucuccgagucccccugcauccuccagacccuccucgucuccgccucccacaacuccuccugcuccgcccaccuccucauccaggucgagaucuacgccaacuccucccucacccacaacgccuccgagaacgucaccgucauccccaaccaggucuaccagccccucggccccugccccugcaaccucaccgccggcgccugcgacguccgcugcugcugcgaccaggagugcuccuccaaccucaccacccucuuccgccgcuccugcuucaccggcgucuucggcggcgacgucaacccccccuucgaccagcucugcuccgccggcaccaccacccgcggcguccccgacugguuccccuuccucugcguccaguccccccucgccaacacccccuuccucggcuacuucuaccacggcgccgucucccccaagcaggacuccuccuucgaggucuacgucgacaccgacgccaaggacuucgccgacuucggcuacaagcagggcgaccccaucaugaccgucaagaaggccuacuucaccaucccccaggucucccucgccggccagugcaugcagaacgcccccgucgccuuccuccacaacuucgacgucaagugcgucaccaaccucgagcucuaccaggagcgcgacggcaucaucaacgccaagaucaagaacgucgcccucggcggcaucgucacccccaaggucaucuacgaggaggccaccgaccucgacaaguucaucaccaacaccgagaccccccucaacaacggcuccaccccccgcaucgucaacgucgaggagcacuacaucuucaaguggaacaacaacaccaucuccgagaucaacgucaagaucuuccgcgccgagaucaacgcccaccagaagggcaucaugacccagcgcuucgucgucaaguuccucuccuacaacuccggcaacgaggaggagcucuccggcaaccccggcuaccagcucggcaagcccguccgcgcccucaacaucaaccgcaugaacaacgucaccacccuccaccucuggcaguccgccggccgcggccucugcaccuccgccaccuucaagcccauccucuucggcgagaacguccucuccggcugccuccucgaggucggcaucaacgagaacugcacccagcuccgcgagaacgccgucgagcgccucgacucccucauccaggccacccacgucgccaugcgcggcaacuccgacuacgccgaccucuccgacggcuggcucgagaucauccgcgucgacgcccccgaccccggcgccgacccccucgccuccuccgucaacggcaugugccucgacauccccgcccaccucuccauccgcauccucaucuccgacgccggcgccgucgagggcaucacccagcaggagauccucggcgucgagacccgcuucuccuccgucaacuggcaguaccagugcggccucaccugcgagcacaaggccgaccuccuccccaucuccgccuccguccaguucaucaagauccccgcccagcucccccacccccucacccgcuuccagaucaacuacaccgaguacgacugcaaccgcaacgaggucugcuggccccagcuccucuaccccuggacccaguacuaccagggcgagcuccacucccagugcgucgccaagggccuccuccuccuccucuuccucacccucgcccucuuccucuccaaccccuggacccgcaucugcaaggccuacuccuga

SEQ ID NO: 50590 - RNA, 1380 nt, Artificial Sequence
  derived and/or modified sequence opt2 from TCTN3__Homo_sapiens__NP_001137445
augcgcaccccccagcucgcccuccuccaggucuucuuccucgucuuccccgacggcguccgcccccagcccuccuccucccccuccggcgccguccccaccucccucgagcuccagcgcggcaccgacggcggcacccuccagucccccuccgaggccaccgccacccgccccgccguccccggccuccccaccgucguccccacccucgucacccccuccgcccccggcaaccgcaccgucgaccucuuccccguccuccccaucugcgucugcgaccucacccccggcgccugcgacaucaacugcugcugcgaccgcgacugcuaccuccuccacccccgcaccgucuucuccuucugccuccccggcuccguccgcuccuccuccugggucugcgucgacaacuccgucaucuuccgcuccaacucccccuuccccucccgcgucuucauggacuccaacggcauccgccaguucugcguccacgucaacaacugcuuccucgaguccaaguccaccaccugcacccgcuucuucaagaaccucgccuccuccugcacccucgacuccgcccucaacgccgccuccuacuacaacuucaccguccucaaggucccccgcuccaugaccgacccccagaacauggaggccuuccagcaguccaccgccgccucccucaccuccccccgcuccggcaaccccggcuacaucgucggcaagccccuccucgcccucaccgacgacaucuccuacuccaugacccuccuccagucccagggcaacggcuccugcuccgucaagcgccacgagguccaguucggcgucaacgccaucuccggcugcaagcuccgccucaagaaggccgacugcucccaccuccagcaggagaucuaccagacccuccacggccgcccccgccccgaguacgucgccaucuucggcaacgccgaccccgcccagaagggcggcuggacccgcauccucaaccgccacugcuccaucuccgccaucaacugcaccuccugcugccucauccccgucucccucgagauccagguccucugggccuacgucggccuccucuccaacccccaggcccacgucuccggcguccgcuuccucuaccagugccaguccauccaggacucccagcaggucaccgaggucucccucaccacccucgucaacuucgucgacaucacccagaagccccagcccccccgcggccagcccaagauggacuggaaguggcccuucgacuucuuccccuucaaggucgccuucucccgcggcgucuucucccagaagugcuccgucucccccauccucauccucugccuccuccuccucggcguccucaaccucgagaccauguga

SEQ ID NO: 50591 - RNA, 519 nt, Artificial Sequence
  derived and/or modified sequence opt2 from TDGF1__Homo_sapiens__NP_001167607
auggccaucuccaaggucuucgagcucggccucgucgccggccucggccaccaggaguucgcccgccccucccgcggcuaccucgccuuccgcgacgacuccaucuggccccaggaggagcccgccauccgcccccgcuccucccagcgcgucccccccaugggcauccagcacuccaaggagcucaaccgcaccugcugccucaacggcggcaccugcaugcucggcuccuucugcgccugcccccccuccuucuacggccgcaacugcgagcacgacguccgcaaggagaacugcggcuccgucccccacgacaccuggcuccccaagaagugcucccucugcaagugcuggcacggccagcuccgcugcuucccccaggccuuccuccccggcugcgacggccucgucauggacgagcaccucgucgccucccgcacccccgagcucccccccuccgcccgcaccaccaccuucaugcucgucggcaucugccucuccauccaguccuacuacuga

SEQ ID NO: 50592 - RNA, 1233 nt, Artificial Sequence
  derived and/or modified sequence opt2 from TDG__Homo_sapiens__NP_003202
auggaggccgagaacgccggcuccuacucccuccagcaggcccaggccuucuacaccuuccccuuccagcagcucauggccgaggcccccaacauggccgucgucaacgagcagcagaugcccgaggagguccccgcccccgcccccgcccaggagcccguccaggaggcccccaagggccgcaagcgcaagccccgcaccaccgagcccaagcagcccgucgagcccaagaagcccgucgaguccaagaaguccggcaaguccgccaaguccaaggagaagcaggagaagaucaccgacaccuucaaggucaagcgcaaggucgaccgcuucaacggcgucuccgaggccgagcuccucaccaagacccuccccgacauccucaccuucaaccucgacaucgucaucaucggcaucaaccccggccucauggccgccuacaagggccaccacuaccccggccccggcaaccacuucuggaagugccucuucauguccggccucuccgagguccagcucaaccacauggacgaccacacccuccccggcaaguacggcaucggcuucaccaacauggucgagcgcaccacccccggcuccaaggaccucuccuccaaggaguuccgcgagggcggccgcauccucguccagaagcuccagaaguaccagccccgcaucgccgucuucaacggcaagugcaucuacgagaucuucuccaaggaggucuucggcgucaaggucaagaaccucgaguucggccuccagccccacaagauccccgacaccgagacccucugcuacgucaugcccuccuccuccgcccgcugcgcccaguucccccgcgcccaggacaagguccacuacuacaucaagcucaaggaccuccgcgaccagcucaagggcaucgagcgcaacauggacguccaggagguccaguacaccuucgaccuccagcucgcccaggaggacgccaagaagauggccgucaaggaggagaaguacgaccccggcuacgaggccgccuacggcggcgccuacggcgagaaccccugcuccuccgagcccugcggcuucuccuccaacggccucaucgaguccgucgagcuccgcggcgaguccgccuucuccggcauccccaacggccaguggaugacccaguccuucaccgaccagauccccuccuucuccaaccacugcggcacccaggagcaggaggaggagucccacgccuga

SEQ ID NO: 50593 - RNA, 1221 nt, Artificial Sequence
  derived and/or modified sequence opt2 from TDO2__Homo_sapiens__NP_005642
auguccggcugccccuuccucggcaacaacuucggcuacaccuucaagaagcuccccgucgagggcuccgaggaggacaagucccagaccggcgucaaccgcgccuccaagggcggccucaucuacggcaacuaccuccaccucgagaagguccucaacgcccaggagcuccaguccgagaccaagggcaacaagauccacgacgagcaccucuucaucaucacccaccaggccuacgagcucugguucaagcagauccucugggagcucgacuccguccgcgagaucuuccagaacggccacguccgcgacgagcgcaacaugcucaaggucgucucccgcaugcaccgcgucuccgucauccucaagcuccucguccagcaguucuccauccucgagaccaugaccgcccucgacuucaacgacuuccgcgaguaccucucccccgccuccggcuuccagucccuccaguuccgccuccucgagaacaagaucggcguccuccagaacaugcgcguccccuacaaccgccgccacuaccgcgacaacuucaagggcgaggagaacgagcuccuccucaaguccgagcaggagaagacccuccucgagcucgucgaggccuggcucgagcgcacccccggccucgagccccacggcuucaacuucuggggcaagcucgagaagaacaucacccgcggccucgaggaggaguucauccgcauccaggccaaggaggaguccgaggagaaggaggagcaggucgccgaguuccagaagcagaaggagguccuccucucccucuucgacgagaagcgccacgagcaccuccucuccaagggcgagcgccgccucuccuaccgcgcccuccagggcgcccucaugaucuacuucuaccgcgaggagccccgcuuccagguccccuuccagcuccucaccucccucauggacaucgacucccucaugaccaaguggcgcuacaaccacgucugcaugguccaccgcaugcucggcuccaaggccggcaccggcggcuccuccggcuaccacuaccuccgcuccaccgucuccgaccgcuacaaggucuucgucgaccucuucaaccucuccaccuaccucaucccccgccacuggauccccaagaugaaccccaccauccacaaguuccucuacaccgccgaguacugcgacuccuccuacuucuccuccgacgaguccgacuga

SEQ ID NO: 50594 - RNA, 1032 nt, Artificial Sequence
  derived and/or modified sequence opt2 from TDP1__Homo_sapiens__XP_006720263
augaugcuccuccucuacgaggagggccuccgcgucgucauccacaccuccaaccucauccacgccgacuggcaccagaagacccagggcaucuggcucuccccccucuacccccgcaucgccgacggcacccacaaguccggcgagucccccacccacuucaaggccgaccucaucuccuaccucauggccuacaacgcccccucccucaaggaguggaucgacgucauccacaagcacgaccucuccgagaccaacgucuaccucaucggcuccacccccggccgcuuccagggcucccagaaggacaacuggggccacuuccgccucaagaagcuccucaaggaccacgccuccuccaugcccaacgccgaguccuggcccgucgucggccaguucuccuccgucggcucccucggcgccgacgaguccaaguggcucugcuccgaguucaaggaguccaugcucacccucggcaaggaguccaagacccccggcaaguccuccgucccccucuaccucaucuaccccuccgucgagaacguccgcaccucccucgagggcuaccccgccggcggcucccuccccuacuccauccagaccgccgagaagcagaacuggcuccacuccuacuuccacaagugguccgccgagaccuccggccgcuccaacgccaugccccacaucaagaccuacaugcgccccucccccgacuucuccaagaucgccugguuccucgucaccuccgccaaccucuccaaggccgccuggggcgcccucgagaagaacggcacccagcucaugauccgcuccuacgagcucggcguccucuuccuccccuccgccuucggccucgacuccuucaaggucaagcagaaguucuucgccggcucccaggagcccauggccaccuuccccguccccuacgaccucccccccgagcucuacggcuccaaggaccgccccuggaucuggaacauccccuacgucaaggcccccgacacccacggcaacauguggguccccuccuga

SEQ ID NO: 50595 - RNA, 1089 nt, Artificial Sequence
  derived and/or modified sequence opt2 from TDP2__Homo_sapiens__NP_057698
auggagcucggcuccugccucgagggcggccgcgaggccgccgaggaggagggcgagcccgaggucaagaagcgccgccuccucugcgucgaguucgccuccgucgccuccugcgacgccgccgucgcccagugcuuccucgccgagaacgacugggagauggagcgcgcccucaacuccuacuucgagccccccgucgaggaguccgcccucgagcgccgccccgagaccaucuccgagcccaagaccuacgucgaccucaccaacgaggagaccaccgacuccaccaccuccaagaucucccccuccgaggacacccagcaggagaacggcuccauguucucccucaucaccuggaacaucgacggccucgaccucaacaaccucuccgagcgcgcccgcggcgucugcuccuaccucgcccucuacucccccgacgucaucuuccuccaggaggucaucccccccuacuacuccuaccucaagaagcgcuccuccaacuacgagaucaucaccggccacgaggagggcuacuucaccgccaucaugcucaagaagucccgcgucaagcucaagucccaggagaucauccccuuccccuccaccaagaugaugcgcaaccuccucugcguccacgucaacgucuccggcaacgagcucugccucaugaccucccaccucgaguccacccgcggccacgccgccgagcgcaugaaccagcucaagaugguccucaagaagaugcaggaggcccccgaguccgccaccgucaucuucgccggcgacaccaaccuccgcgaccgcgaggucacccgcugcggcggccuccccaacaacaucgucgacgucugggaguuccucggcaagcccaagcacugccaguacaccugggacacccagaugaacuccaaccucggcaucaccgccgccugcaagcuccgcuucgaccgcaucuucuuccgcgccgccgccgaggagggccacaucaucccccgcucccucgaccuccucggccucgagaagcucgacugcggccgcuuccccuccgaccacuggggccuccucugcaaccucgacaucauccucuga

SEQ ID NO: 50596 - RNA, 3570 nt, Artificial Sequence
  derived and/or modified sequence opt2 from TDRD1__Homo_sapiens__NP_942090
auguccgucaagucccccuucaacgucaugucccgcaacaaccucgaggccccccccugcaagaugaccgagcccuucaacuucgagaagaacgagaacaagcuccccccccacgagucccuccgcucccccggcacccuccccaaccaccccaacuuccgccucaaguccuccgagaacggcaacaagaagaacaacuuccuccucugcgagcagaccaagcaguaccucgccucccaggaggacaacuccgucuccuccaaccccaacggcaucaacggcgaggucgucggcuccaagggcgaccgcaagaagcuccccgccggcaacuccgucuccccccccuccgccgaguccaacuccccccccaaggaggucaacaucaagcccggcaacaacguccgccccgccaaguccaagaagcucaacaagcucgucgagaacucccucuccaucuccaaccccggccucuucaccucccucggccccccccuccgcuccaccaccugccaccgcugcggccucuucggcucccuccgcugcucccagugcaagcagaccuacuacugcuccaccgccugccagcgccgcgacugguccgcccacuccaucgucugccgccccguccagcccaacuuccacaagcucgagaacaaguccuccaucgagaccaaggacgucgaggucaacaacaaguccgacugcccccucggcgucaccaaggagaucgccaucugggccgagcgcaucauguucuccgaccuccgcucccuccagcucaagaagaccauggagaucaagggcaccgucaccgaguucaagcaccccggcgacuucuacguccagcucuacuccuccgagguccucgaguacaugaaccagcucuccgccucccucaaggagaccuacgccaacguccacgagaaggacuacauccccgucaagggcgaggucugcaucgccaaguacaccgucgaccagaccuggaaccgcgccaucauccagaacgucgacguccagcagaagaaggcccacguccucuacaucgacuacggcaacgaggagaucaucccccucaaccgcaucuaccaccucaaccgcaacaucgaccucuucccccccugcgccaucaagugcuucgucgccaacgucauccccgccgagggcaacugguccuccgacugcaucaaggccaccaagccccuccucauggagcaguacugcuccaucaagaucgucgacauccucgaggaggaggucgucaccuucgccgucgaggucgagcuccccaacuccggcaagcuccucgaccacguccucaucgagaugggcuacggccucaagcccuccggccaggacuccaagaaggagaacgccgaccaguccgaccccgaggacgucggcaagaugaccaccgagaacaacaucgucgucgacaaguccgaccucauccccaagguccucacccucaacgucggcgacgaguucugcggcgucgucgcccacauccagacccccgaggacuucuucugccagcagcuccaguccggccgcaagcucgccgagcuccaggccucccucuccaaguacugcgaccagcuccccccccgcuccgacuucuaccccgccaucggcgacaucugcugcgcccaguucuccgaggacgaccagugguaccgcgccuccguccucgccuacgccuccgaggaguccguccucgucggcuacgucgacuacggcaacuucgagauccucucccucaugcgccucugccccaucauccccaagcuccucgagcuccccaugcaggccaucaagugcguccucgccggcgucaagcccucccucggcaucuggacccccgaggccaucugccucaugaagaagcucguccagaacaagaucaucaccgucaaggucgucgacaagcucgagaacuccucccucgucgagcucaucgacaaguccgagaccccccacgucuccgucuccaagguccuccucgacgccggcuucgccgucggcgagcaguccauggucaccgacaagcccuccgacgucaaggagaccuccgucccccucggcgucgagggcaaggucaacccccucgaguggaccugggucgagcucggcgucgaccagaccgucgacgucgucgucugcgucaucuacucccccggcgaguucuacugccacguccucaaggaggacgcccucaagaagcucaacgaccucaacaagucccucgccgagcacugccagcagaagcuccccaacggcuucaaggccgagaucggccagcccugcugcgccuucuucgccggcgacggcuccugguaccgcgcccucgucaaggagauccuccccaacggccacgucaagguccacuucgucgacuacggcaacaucgaggaggucaccgccgacgagcuccgcaugaucuccuccaccuuccucaaccuccccuuccagggcauccgcugccagcucgccgacauccagucccgcaacaagcacugguccgaggaggccaucacccgcuuccagaugugcgucgccggcaucaagcuccaggcccgcgucgucgaggucaccgagaacggcaucggcgucgagcucaccgaccucuccaccugcuacccccgcaucaucuccgacguccucaucgacgagcaccucguccucaaguccgccuccccccacaaggaccuccccaacgaccgccucgucaacaagcacgagcuccagguccacguccagggccuccaggccaccuccuccgccgagcaguggaagaccaucgagcuccccgucgacaagaccauccaggccaacguccucgagaucaucucccccaaccucuucuacgcccuccccaagggcaugcccgagaaccaggagaagcucugcaugcucaccgccgagcuccucgaguacugcaacgcccccaagucccgcccccccuaccgcccccgcaucggcgacgccugcugcgccaaguacaccuccgacgacuucugguaccgcgccgucguccucggcaccuccgacaccgacgucgagguccucuacgccgacuacggcaacaucgagacccucccccucugccgcguccagcccaucaccuccucccaccucgcccuccccuuccagaucauccgcugcucccucgagggccucauggagcucaacggcuccuccucccagcucaucaucaugcuccucaagaacuucaugcucaaccagaacgucaugcucuccgucaagggcaucaccaagaacguccacaccgucuccgucgagaagugcuccgagaacggcaccgucgacgucgccgacaagcucgucaccuucggccucgccaagaacaucaccccccagcgccaguccgcccucaacaccgagaagauguaccgcaugaacugcugcugcaccgagcuccagaagcaggucgagaagcacgagcacauccuccucuuccuccucaacaacuccaccaaccagaacaaguucaucgagaugaagaagcuccucaagaagaccgccucccucggcggcaagccccucuga

SEQ ID NO: 50597 - RNA, 2235 nt, Artificial Sequence
  derived and/or modified sequence opt2 from TDRD3__Homo_sapiens__NP_001139542
auggcccaggucgccggcgccgcccucucccaggccggcugguaccucuccgacgagggcaucgaggccugcaccuccucccccgacaaggucaacgucaacgacaucauccucaucgcccucaacaccgaccuccgcaccaucggcaagaaguuccuccccuccgacaucaacuccggcaaggucgagaagcucgagggccccugcguccuccagauccagaagauccgcaacgucgccgcccccaaggacaacgaggagucccaggccgccccccgcaugcuccgccuccagaugaccgacggccacaucuccugcaccgccgucgaguucuccuacauguccaagaucucccucaacaccccccccggcaccaaggucaagcucuccggcaucgucgacaucaagaacggcuuccuccuccucaacgacuccaacaccaccguccucggcggcgaggucgagcaccucaucgagaagugggagcuccagcgcucccucuccaagcacaaccgcuccaacaucggcaccgagggcggccccccccccuucguccccuucggccagaagugcgucucccacguccaggucgacucccgcgagcucgaccgccgcaagacccuccaggucaccaugcccgucaagcccaccaacgacaacgacgaguucgagaagcagcgcaccgccgccaucgccgaggucgccaaguccaaggagaccaagaccuucggcggcggcggcggcggcgcccgcuccaaccucaacaugaacgccgccggcaaccgcaaccgcgagguccuccagaaggagaaguccaccaaguccgagggcaagcacgagggcgucuaccgcgagcucgucgacgagaaggcccucaagcacaucaccgagaugggcuucuccaaggaggccucccgccaggcccucauggacaacggcaacaaccucgaggccgcccucaacguccuccucaccuccaacaagcagaagcccgucaugggccccccccuccgcggccgcggcaagggccgcggccgcauccgcuccgaggacgaggaggaccucggcaacgcccgccccuccgcccccuccacccucuucgacuuccucgaguccaagaugggcacccucaacgucgaggagcccaagucccagccccagcagcuccaccagggccaguaccgcuccuccaacaccgagcagaacggcgucaaggacaacaaccaccuccgccaccccccccgcaacgacacccgccagccccgcaacgagaagcccccccgcuuccagcgcgacucccagaacuccaaguccguccucgagggcuccggccucccccgcaaccgcggcuccgagcgccccuccaccuccuccgucuccgaggucugggccgaggaccgcaucaagugcgaccgccccuacucccgcuacgaccgcaccaaggacaccuccuacccccucggcucccagcacuccgacggcgccuucaagaagcgcgacaacuccaugcagucccgcuccggcaagggccccuccuucgccgaggccaaggagaacccccucccccagggcuccgucgacuacaacaaccagaagcgcggcaagcgcgagucccagaccuccauccccgacuacuucuacgaccgcaagucccagaccaucaacaacgaggccuucuccggcaucaagaucgagaagcacuucaacgucaacaccgacuaccagaaccccguccgcuccaacuccuucaucggcguccccaacggcgaggucgagaugccccucaagggccgccgcaucggccccaucaagcccgccggccccgucaccgccguccccugcgacgacaagaucuucuacaacuccggccccaagcgccgcuccggccccaucaagcccgagaagauccucgaguccuccauccccauggaguacgccaagauguggaagcccggcgacgagugcuucgcccucuacugggaggacaacaaguucuaccgcgccgaggucgaggcccuccacuccuccggcaugaccgccgucgucaaguucaucgacuacggcaacuacgaggagguccuccucuccaacaucaagcccauccagaccgaggccugggaggaggagggcaccuacgaccagacccucgaguuccgccgcggcggcgacggccagccccgccgcuccacccgccccacccagcaguucuaccagcccccccgcgcccgcaacuga

SEQ ID NO: 50598 - RNA, 2946 nt, Artificial Sequence
  derived and/or modified sequence opt2 from TDRD5__Homo_sapiens__NP_001186020
auguccgagcaggagcgcauccaggagugccuccgcaaggagauccgcucccuccucaucuccaccaaggacggccucuccccccaggagcucgagaaggaguaccuccucauggucggcaaccaccucccccuccgcauccucggcuaccgcuccaccauggagcucguccucgacaugcccgacgucguccgcgucugccccggcgccggcggcaccgucauccucaaggccauccccgacgaguccaccaagggcaucgccucccucgucgccaagcagcgcuccucccacaagcuccgcaacuccaugcacaagggccgccccuccaucuacuccggcccccgcucccaccgccgcguccccuaccgcggccgcgucgcccccauccuccccgccgucgucaaguccgagcucaaggaccuccucgcccucucccccguccuccucuccgacuucgagaaggccuucgccaagcgcuucggccgcuccuuccaguacaugcaguacggcuuccucuccauguucgagguccucaacgccgccuccgacgucaucuccgucgagcagacccgcgccggcucccuccucaugcucaagaaguccgucaccgaggagaagccccgcggcugccccgccggcaagaucuucacccagcccuuccgcaugaagcagggcuccuacuccaccggcuuccccgucgccaagcccugcuucucccagcccaccuccaacauggagccccccaagcagaucauguccauggagaagaccuccaagcucaacgucgucgagaccucccgccucaaccacaccgagaagcucaaccagcucgagaacaccuucaaguccgucaucgcccagaucggccccggcggcaccaucuccuccgagcucaagcacaagaucaaguucgucgucuccaaguuccccgagggccucuucaucuccaagcuccucggcgaguacgaggucaucuucaaggagcagcucucccccaagaagcucggcuuccucaacgucaccgagcucgucggcgcccucuccgacauccuccacgucgaguuccgcaagggccaccaggaccuccucgucuucgacgccgacaagaagccccucccccccguccaguccgacaagaagaucgaggccaaggccugcgucuccucccccccccgcaacucccucuccaccgccgccgucaaggagaccgucuggaacugccccuccaagaagcagaaggagccccagcagaagaucugcaagaagcccaaccucgucgucaagccccuccagcuccaggucgagaccaacaaguccgagcucaaccucgccauggccaaccacgacaucccccccgacgccguccccaacaagaagcucugccgccuccccccccucgacaccuccucccucaucggcgucuucgucgaguacaucaucucccccucccaguucuacauccgcaucuacucccgcgacuccuccgagcuccucgaggacaugaugaucgagaugcgccgcugcuacuccaaccagcucgucuccgaccgcuacgucaugcccgagugcuucauccagcccggccaccucugcugcguccgcaucuccgaggacaaguggugguaccgcgucaucauccaccgcguccucgagaagcaggaggucgaggucuucuaccccgacuucggcaacaucggcaucguccagaaguccucccuccgcuuccucaagugcugcuacaccaagcuccccgcccaggccauccccugcucccucgccuggguccgccccgucgaggagcacuggaccuccaaggccauccuccaguuccagaagcucugcggccucaagccccucgucggcgucgucgacgaguacgucgacggcauccucaacaucuuccucugcgacaccuccuccaacgaggacgucuacuuccaccacguccuccgcaccgagggccacgccaucgucugccgcgagaacaucuccuccaagggcuucuccgagcucaacccccucgcccucuacaccaccuccuccggcggccccgaggacaucguccucaccgagcucggcuaccccucccagcagcacuacuucaacgaggaccgcaagaucuccccccaguccaaggaguccgagcuccgcauccucgacgagauccccaccggcaugcccugccucgaguccgucaccaucggcgacgacaucugggacgagaacuggcucccccuccaggccaagaugggcaagggcggcgacgccgccucccaccucuucaccgccucccucggcggcaagaaccaguacuccuccugcaaggagaugccccagaaggacuggugcuucuccacccccaaggacaccugggacgacuccuggcagcccuccggccucgucaacggcaccaaggucgagguccacaagcccgagguccucggcgcccaggagaagaacaccggcaccaaccgcacccagaagcagcucgacaucaacggcuccuccgacuccuccacccuccccaagcucgaggaguucugcaccucccucacccaguccgagcaguccgccgacggcucccaguccgagcccaacaacucccagacccagcccaagcagauccagcucuccaccgccgcccccugcuccaccaccgccgucgacgacuccgccgagaagcccuccggcuccgucgaguccucccccgagauccucaagaacgaggacuucuccuccucccgcgccaucacccucuacaaggacaagcgccaggaguccgucgaccagcucucccucauccucuccuacgagugccagaucucccagaagcucuacaucccccgcuccaccgccaccgccgcccucggcgccgccgcccgccucgccaccucccgcucccuccuccacugguaccccuccgucaagcgcauggaggccuga

SEQ ID NO: 50599 - RNA, 6291 nt, Artificial Sequence
  derived and/or modified sequence opt2 from TDRD6__Homo_sapiens__NP_001010870
augugcuccacccccggcaugcccgcccccggcgccucccucgcccuccgcgucuccuucgucgacguccaccccgacgucauccccguccagcucuggggccucgucggcgagcgccgcggcgaguaccuccgccucucccgcgagauccaggaggccgccgccacccgcggccagugggcccucggcuccgccuccgccucccccggcgagcucugccucguccaggucggccuccucuggcaccgcugccgcgucgucucccgccaggcccaggagucccgcgucuuccuccucgacgagggccgcaccaucaccgccggcgccggcucccucgcccccggccgccgcgaguucuucaaccuccccuccgagguccucggcugcguccucgccggccucguccccgccggcugcggcgccggcuccggcgagcccccccagcacuggcccgccgacgccgucgacuuccucuccaaccuccagggcaaggagguccacggcugcguccucgacguccuccuccuccaccgccucguccuccucgagguccccgacgucuuccagcagaugcgcgagcucggccucgcccgccgcguccccgacucccucuuccgcucccuccucgagcgcuaccucaccgccgccaccgccuccgucggcuccggcguccccguccucucccgcgucccccucaagcagaagcagcccggccucgacuacuucuacccccagcuccagcucggcgucaccgaggccgucgucaucacccaggucugccacccccaccgcauccacugccagcuccgcuccgucucccaggagauccaccgccucuccgaguccauggcccaggucuaccgcggcuccaccggcaccggcgacgagaacuccaccuccgccaccugggaggagcgcgaggagucccccgacaagcccggcucccccugcgccuccugcggccucgacggccacugguaccgcgcccuccuccucgagaccuuccgcccccagcgcugcgcccagguccuccacgucgacuacggccgcaaggagcucgucuccugcuccucccuccgcuaccuccuccccgaguacuuccgcaugcccgucgucaccuaccccugcgcccucuacggccucugggacggcggccgcggcuggucccgcucccaggucggcgaccucaagacccucauccucggcaaggccgucaacgccaagaucgaguucuacugcuccuucgagcacgucuacuacgucucccucuacggcgaggacggcaucaaccucaaccgcgucuucggcguccaguccugcugccucgccgaccgcguccuccagucccaggccaccgaggaggaggagcccgagaccucccagucccagucccccgccgaggaggucgacgaggagaucucccuccccgcccuccgcuccauccgccucaagaugaacgccuucuacgacgcccaggucgaguucgucaagaaccccuccgaguucuggauccgccuccgcaagcacaacgucaccuucuccaagcucaugcgccgcaugugcggcuucuacuccuccgccuccaagcucgacggcgucguccucaagcccgagcccgacgaccucugcugcgucaaguggaaggagaacggcuacuaccgcgccaucgucaccaagcucgacgacaaguccgucgacgucuuccucgucgaccgcggcaacuccgagaacgucgacugguacgacguccgcaugcuccucccccaguuccgccagcuccccauccucgccgucaagugcacccucgccgacaucuggccccucggcaagaccuggucccaggaggccgucuccuucuucaagaagaccguccuccacaaggagcucgucauccacauccucgacaagcaggaccaccaguacgucaucgagauccucgacgagucccgcaccggcgaggagaacaucuccaaggucaucgcccaggccggcuacgccaaguaccaggaguucgagaccaaggagaacauccucgucaacgcccacucccccggccacgucuccaaccacuucaccaccgaguccaacaagauccccuucgccaagaccggcgagggcgagcagaaggccaagcgcgagaacaagaccaccuccgucuccaaggcccucuccgacaccaccgucgucaccaacggcuccaccgagcucgucguccaggagaaggucaagcgcgccuccgucuacuucccccucaugcagaacugccucgagaucaagcccggcuccuccuccaagggcgagcucgaggucggcuccaccgucgagguccgcgucuccuacgucgagaaccccggcuacuucuggugccagcucacccgcaacauccagggccucaagacccucauguccgacauccaguacuacugcaagaacaccgccgccccccaccagcgcaacacccucgccugccucgccaagcgcaccgucaaccgccaguggucccgcgcccucaucuccggcauccaguccgucgagcacgucaacgucaccuucgucgacuacggcgaccgcgagauggucuccgucaagaacaucuacuccaucuccgaggaguuccucaaggucaaggcccaggccuuccgcugcucccucuacaaccucauccagcccgucggccagaaccccuucgucugggacgucaaggccauccaggccuucaacgaguucaucgacaacgccuggcagaagaaccucgagcucaagugcaccaucuucgcccucgccuccaucaacgaggagcucuucaacaucgucgaccuccucacccccuuccaguccgccugccacuuccucgucgagaagcgccucgcccgccccgucaagcuccagaagccccucgaguccuccguccagcuccacuccuacuucuacuccacccacgacaugaagaucggcuccgaggagcucgucuacaucacccacaucgacgaccccuggaccuucuacugccagcucgcccgcaacgccaacauccucgagcagcucuccugcuccaucacccagcucuccaagguccuccucaaccucaagaccuccccccucaaccccggcacccucugccucgccaaguacaccgacggcaacugguaccgcggcaucgucaucgagaaggagcccaagaaggucuucuucgucgacuucggcaacaucuacgucgucaccuccgacgaccuccuccccauccccuccgacgccuacgacguccuccuccuccccaugcaggccguccgcugcucccucuccgacauccccgaccacauccccgaggaggucgucgucugguuccaggagaccauccucgacaagucccucaaggcccucgucgucgccaaggaccccgacggcacccucaucaucgagcucuacggcgacaacauccagaucuccgccuccaucaacaagaagcucggccuccucuccuacaaggaccgcauccgcaagaaggaguccgagguccucugcuccaccaccgagacccucgaggagaagaacgagaacaugaagcuccccugcaccgaguaccucuccaaguccgucggcuacaagcuccccaacaaggagauccucgaggaguccuacaagccccagaucaacuccuccuacaaggagcucaagcuccuccagucccucaccaagaccaaccucgucacccaguaccaggacuccgucggcaacaagaacucccaggucuucccccucaccaccgagaagaaggaggagaucuccgccgagaccccccucaagaccgcccgcgucgaggccacccucuccgagcgcaagaucggcgacuccugcgacaaggaccucccccucaaguucugcgaguucccccagaagaccaucaugcccggcuucaagaccaccgucuacgucucccacaucaacgaccucuccgacuucuacguccagcucaucgaggacgaggccgagaucucccaccucuccgagcgccucaacuccgucaagacccgccccgaguacuacgucggccccccccuccagcgcggcgacaugaucugcgccgucuuccccgaggacaaccucugguaccgcgccgucaucaaggagcagcagcccaacgaccuccucuccguccaguucaucgacuacggcaacgucuccgucguccacaccaacaagaucggccgccucgaccucgucaacgccauccuccccggccucugcauccacugcucccuccagggcuucgagguccccgacaacaagaacuccaagaagaugaugcacuacuucucccagcgcaccuccgaggccgccauccgcugcgaguucgucaaguuccaggaccgcugggaggucauccucgccgacgagcacggcaucaucgccgacgacaugaucucccgcuacgcccucuccgagaagucccaggucgagcucuccacccaggucaucaaguccgccuccuccaaguccgucaacaaguccgacaucgacaccuccgucuuccucaacugguacaaccccgagaagaagaugauccgcgccuacgccaccgucaucgacggccccgaguacuucuggugccaguucgccgacaccgagaagcuccagugccucgaggucgagguccagaccgccggcgagcaggucgccgaccgccgcaacugcauccccugccccuacaucggcgaccccugcaucguccgcuaccgcgaggacggccacuacuaccgcgcccucaucaccaacaucugcgaggacuaccucgucuccguccgccucgucgacuucggcaacaucgaggacugcgucgaccccaaggcccucugggccauccccuccgagcuccucuccguccccaugcaggccuuccccugcugccucuccggcuucaacaucuccgagggccucugcucccaggagggcaacgacuacuucuacgagaucaucaccgaggacguccucgagaucaccauccucgagauccgccgcgacgucugcgacaucccccucgccaucgucgaccucaaguccaagggcaaguccaucaacgagaagauggagaaguacuccaagaccggcaucaaguccgcccuccccuacgagaacaucgacuccgagaucaagcagacccucggcuccuacaaccucgacgucggccucaagaagcucuccaacaaggccguccagaacaagaucuacauggagcagcagaccgacgagcucgccgagaucaccgagaaggacgucaacaucaucggcaccaagcccuccaacuuccgcgaccccaagaccgacaacaucugcgagggcuucgagaaccccugcaaggacaagaucgacaccgaggagcucgagggcgagcucgagugccaccucgucgacaaggccgaguucgacgacaaguaccucaucaccggcuucaacacccuccucccccacgccaacgagaccaaggagauccucgagcucaacucccucgaggucccccucucccccgacgacgaguccaaggaguuccucgagcucgaguccaucgagcuccagaacucccucgucgucgacgaggagaagggcgagcucucccccgucccccccaacgucccccucucccaggagugcgucaccaagggcgccauggagcucuucacccuccagcucccccucuccugcgaggccgagaagcagcccgagcucgagcuccccaccgcccagcucccccucgacgacaagauggacccccucucccucggcgucucccagaaggcccaggaguccaugugcaccgaggacaugcgcaaguccuccugcgucgaguccuucgacgaccagcgccgcaugucccuccaccuccacggcgccgacugcgaccccaagacccagaacgagaugaacaucugcgaggaggaguucgucgaguacaagaaccgcgacgccaucuccgcccucaugccccucuucuccgaggaggaguccuccgacggcuccaagcacaacaacggccuccccgaccacaucuccgcccagcuccagaacaccuacacccucaaggccuucaccgucggcuccaagugcgucgucugguccucccuccgcaacaccugguccaagugcgagauccucgagaccgccgaggagggcacccgcguccucaaccucuccaacggcauggaggagaucgucaaccccgagaacgucuggaacggcauccccaagcucgacaaguccccccccgagaagcgcggccucgaggucauggagaucuga

SEQ ID NO: 50600 - RNA, 3075 nt, Artificial Sequence
  derived and/or modified sequence opt2 from TDRD7__Homo_sapiens__NP_001289813
auggccugcaccgagaccgcccgcaucgcccagcucgucgcccgccagcgcuccuccaagcgcaagaccggccgccaggucaacugccagaugcgcgucaagaagaccaugcccuucuuccucgagggcaagcccaaggccacccuccgccagcccggcuucgccuccaacuucuccgucggcaagaagcccaaccccgccccccuccgcgacaagggcaacuccgucggcgucaagcccgacgccgagaugucccccuacaugcuccacaccacccucggcaacgaggccuucaaggacauccccguccagcgccacgucaccauguccaccaacaaccgcuucucccccaaggccucccuccagcccccccuccagaugcaccucucccgcaccuccaccaaggagauguccgacaaccucaaccagaccgucgagaagcccaacgucaagccccccgccuccuacaccuacaagauggacgagguccagaaccgcaucaaggagauccucaacaagcacaacaacggcaucuggaucuccaagcucccccacuucuacaaggagcucuacaaggaggaccucaaccagggcauccuccagcaguucgagcacuggccccacaucugcaccgucgagaagcccugcuccggcggccaggaccuccuccucuaccccgccaagcgcaagcagcuccuccgcuccgagcucgacaccgagaaggucccccucuccccccuccccggccccaagcagacccccccccucaagggcugccccaccgucauggccggcgacuucaaggagaaggucgccgaccuccucgucaaguacaccuccggccucugggccuccgcccuccccaaggccuucgaggagauguacaaggucaaguuccccgaggacgcccucaagaaccucgccucccucuccgacgucugcuccaucgacuacaucuccggcaacccccagaaggccauccucuacgccaagcucccccuccccaccgacaagauccagaaggacgccggccaggcccacggcgacaacgacaucaaggccauggucgagcaggaguaccuccaggucgaggaguccaucgccgaguccgccaacaccuucauggaggacaucaccguccccccccucaugauccccaccgaggccucccccuccguccucgucgucgagcucuccaacaccaacgaggucgucauccgcuacgucggcaaggacuacuccgccgcccaggagcucauggaggacgagaugaaggaguacuacuccaagaaccccaagaucacccccguccaggccgucaacgucggccagcuccucgccgucaacgccgaggaggacgccuggcuccgcgcccaggucaucuccaccgaggagaacaagaucaaggucugcuacgucgacuacggcuucuccgagaacgucgagaaguccaaggccuacaagcucaaccccaaguucugcucccucuccuuccaggccaccaagugcaagcucgccggccucgagguccucuccgacgaccccgaccucgucaaggucgucgagucccucaccugcggcaagaucuucgccgucgagauccucgacaaggccgacaucccccucgucguccucuacgacaccuccggcgaggacgacaucaacaucaacgccaccugccucaaggccaucugcgacaagucccucgagguccaccuccaggucgacgccauguacaccaacgucaaggucaccaacaucugcuccgacggcacccucuacugccagguccccugcaagggccucaacaagcucuccgaccuccuccgcaagaucgaggacuacuuccacugcaagcacaugaccuccgagugcuucgucucccuccccuucugcggcaagaucugccucuuccacugcaagggcaaguggcuccgcgucgagaucaccaacguccacuccucccgcgcccucgacguccaguuccucgacuccggcaccgucaccuccgucaaggucuccgagcuccgcgagauccccccccgcuuccuccaggagaugaucgccauccccccccaggccaucaagugcugccucgccgaccucccccaguccaucggcauguggacccccgacgccguccucuggcuccgcgacuccguccucaacugcuccgacugcuccaucaaggucaccaaggucgacgagacccgcggcaucgcccacgucuaccucuucacccccaagaacuuccccgacccccaccgcuccaucaaccgccagaucaccaacgccgaccucuggaagcaccagaaggacgucuuccucuccgccaucuccuccggcgccgacucccccaacuccaagaacggcaacaugcccauguccggcaacaccggcgagaacuuccgcaagaaccucaccgacgucaucaagaaguccauggucgaccacaccuccgccuucuccaccgaggagcuccccccccccguccaccucuccaagcccggcgagcacauggacgucuacguccccgucgccugccaccccggcuacuucgucauccagcccuggcaggagauccacaagcucgagguccucauggaggagaugauccucuacuacuccgucuccgaggagcgccacaucgccgucgagaaggaccaggucuacgccgccaaggucgagaacaaguggcaccgcguccuccucaagggcauccucaccaacggccucgucuccgucuacgagcucgacuacggcaagcacgagcucgucaacauccgcaagguccagccccucgucgacauguuccgcaagcuccccuuccaggccgucaccgcccagcucgccggcgucaagugcaaccagugguccgaggaggccuccauggucuuccgcaaccacgucgagaagaagccccucgucgcccucguccagaccgucaucgagaacgccaaccccugggaccgcaaggucgucgucuaccucgucgacaccucccuccccgacaccgacaccuggauccacgacuucauguccgaguaccucaucgagcucuccaaggucaacuga

SEQ ID NO: 50601 - RNA, 4149 nt, Artificial Sequence
  derived and/or modified sequence opt2 from TDRD9__Homo_sapiens__NP_694591
augcuccgcaagcucaccaucgagcagaucaacgacugguucaccaucggcaagaccgucaccaacgucgagcuccucggcgccccccccgccuuccccgccggcgccgcccgcgaggagguccagcgccaggacgucgcccccggcgccggccccgccgcccaggcccccgcccucgcccaggcccccgcccgccccgccgccgccuucgagcgcucccucucccagcgcuccuccgaggucgaguacaucaacaaguaccgccagcucgaggcccaggagcucgacgucugccgcuccguccagcccaccuccggccccggcccccgccccucccucgccaagcucuccuccgucaccugcauccccggcaccaccuacaaguaccccgaccuccccaucucccgcuacaaggaggaggucgucucccucaucgaguccaacuccgucgucaucauccacggcgccaccggcuccggcaaguccacccagcucccccaguacauccucgaccacuacguccagcgcuccgccuacugcuccaucgucgucacccagccccgcaagaucggcgccuccuccaucgcccgcuggaucuccaaggagcgcgccuggacccucggcggcgucgucggcuaccaggucggccucgagaagaucgccaccgaggacacccgccucaucuacaugaccaccggcguccuccuccagaagaucgucuccgccaagucccucauggaguucacccacaucaucaucgacgagguccacgagcgcaccgaggagauggacuuccuccuccucgucguccgcaagcuccuccgcaccaacucccgcuucgucaaggucguccucauguccgccaccaucuccugcaaggaguucgccgacuacuucgccguccccguccagaacaagaugaaccccgccuacaucuucgaggucgagggcaagccccacuccgucgaggaguacuaccucaacgaccucgagcacauccaccacuccaagcucuccccccaccuccucgaggagcccgucaucaccaaggacaucuacgaggucgccgucucccucauccagauguucgacgaccucgacaugaaggaguccggcaacaaggccugguccggcgcccaguucguccucgagcgcuccuccguccucgucuuccuccccggccucggcgagaucaacuacaugcacgagcuccucaccucccucguccacaagcgccuccaggucuacccccuccacuccuccgucgcccucgaggagcagaacaacgucuuccucucccccguccccggcuaccgcaagaucauccucuccaccaacaucgccgaguccuccgucaccguccccgacgucaaguacgucaucgacuucugccucacccgcacccucgucugcgacgaggacaccaacuaccagucccuccgccucuccugggccuccaagaccuccugcaaccagcgcaagggccgcgccggccgcgucucccgcggcuacugcuaccgccucguccacaaggacuucugggacaacuccauccccgaccacgucguccccgagaugcuccgcugcccccucggcuccaccauccucaaggucaagcuccucgacaugggcgagccccgcgcccuccucgccaccgcccucuccccccccggccucuccgacaucgagcgcaccauccuccuccucaaggaggucggcgcccucgccgucuccggccagcgcgaggacgagaacccccacgacggcgagcucaccuuccucggccgcguccucgcccagcuccccgucaaccagcagcucggcaagcucaucguccucggccacgucuucggcugccucgacgagugccucaucaucgccgccgcccucucccucaagaacuucuucgccaugcccuuccgccagcaccucgacggcuaccgcaacaaggucaacuucuccggcuccuccaaguccgacugcaucgcccucgucgaggccuucaagaccuggaaggccugccgccagaccggcgagcuccgcuaccccaaggacgagcucaacuggggccgccucaacuacauccagaucaagcgcauccgcgaggucgccgagcucuacgaggagcucaagacccgcaucucccaguucaacaugcacgucgacucccgccgccccgucauggaccaggaguacaucuacaagcagcgcuucauccuccaggucguccucgccggcgccuucuaccccaacuacuucaccuucggccagcccgacgaggagauggccguccgcgagcucgccggcaaggaccccaagaccaccgucguccucaagcacaucccccccuacggcuuccucuacuacaagcagcuccagucccucuuccgccagugcggccaggucaaguccaucgucuucgacggcgccaaggccuucgucgaguucucccgcaaccccaccgagcgcuucaagacccuccccgccgucuacauggccaucaagaugucccagcucaaggucucccucgagcucuccguccacuccgccgaggagaucgagggcaagguccagggcaugaacgucuccaagcuccgcaacacccgcgucaacgucgacuuccagaagcagaccgucgaccccaugcaggucuccuucaacaccuccgaccgcucccagaccgucaccgaccuccuccucaccaucgacgucaccgaggucgucgaggucggccacuucuggggcuaccgcaucgacgagaacaacuccgagauccucaagaagcucaccgccgagaucaaccagcucacccucgucccccuccccacccacccccaccccgaccucgucugccucgcccccuucgccgacuucgacaagcagcgcuacuuccgcgcccagguccucuacgucuccggcaacuccgccgaggucuucuucgucgacuacggcaacaagucccacgucgaccuccaccuccucauggagauccccugccaguuccucgagcuccccuuccaggcccucgaguucaagaucugcaagaugcgccccuccgccaagucccucgucugcggcaagcacugguccgacggcgccucccagugguucgccucccucgucuccggcugcacccuccucgucaaggucuucuccgucguccacuccguccuccacgucgacgucuaccaguacuccggcguccaggacgccaucaacauccgcgacguccucauccagcagggcuacgccgagcucaccgaggaguccuacgaguccaagcagucccacgagguccucaagggccucuucuccaaguccgucgagaacaugaccgacggcuccguccccuuccccaugaaggacgacgagaaguaccucauccgcauccuccucgaguccuucuccaccaacaagcucggcacccccaacugcaaggccgagcuccacggccccuucaaccccuacgagcucaagugccacucccucacccgcaucuccaaguuccgcugcgucuggaucgagaaggaguccaucaacuccgucaucaucuccgacgcccccgaggaccuccaccagcgcaugcucgucgccgccucccucuccaucaacgccaccggcuccaccaugcuccuccgcgagaccucccucaugccccacauccccggccuccccgcccuccucuccaugcucuucgcccccgucaucgagcuccgcaucgaccagaacggcaaguacuacaccggcguccucugcggccucggcuggaaccccgccaccggcgccuccauccuccccgagcacgacauggagcucgccuucgacguccaguucuccgucgaggacgucgucgaggucaacauccuccgcgccgccaucaacaagcucgucugcgacggccccaacggcugcaagugccucggccccgagcgcgucgcccagcuccaggacaucgcccgccagaagcuccucggccucuucugccaguccaagccccgcgagaagaucguccccaaguggcacgagaagcccuacgaguggaaccaggucgaccccaagcucgucauggagcaggccgaccgcgaguccucccgcggcaagaacaccuuccucuaccagcuccacaagcucgucguccucggcaccuga

SEQ ID NO: 50602 - RNA, 1551 nt, Artificial Sequence
  derived and/or modified sequence opt2 from TDRKH__Homo_sapiens__NP_001077433
auguccaccgagcgcaccuccuggaccucccucuccaccauccagaagaucgcccucggccucggcauccccgccuccgccaccgucgccuacauccucuaccgccgcuaccgcgagucccgcgaggagcgccucaccuucgucggcgaggacgacaucgagaucgagaugcgcgucccccaggaggccgucaagcucaucaucggccgccagggcgccaacaucaagcagcuccgcaagcagaccggcgcccgcaucgacgucgacaccgaggacgucggcgacgagcgcguccuccucaucuccggcuuccccguccaggccuccggcgccaagaucaccugcgacaaggaguccgagggcacccuccuccucucccgccucaucaagaucuccggcacccagaaggaggucgccgccgccaagcaccucauccucgagaaggucuccgaggacgaggagcuccgcaagcgcaucgcccacuccgccgagacccgcgucccccgcaagcagcccaucuccguccgccgcgaggacaugaccgagcccggcggcgccggcgagcccgcccucuggaagaacaccuccuccuccauggagcccaccgccccccucgucacccccccccccaagggcggcggcgacauggccgucgucgucuccaaggagggcuccugggagaagcccuccgacgacuccuuccagaaguccgaggcccaggccauccccgagaugcccauguucgagauccccucccccgacuucuccuuccacgccgacgaguaccucgaggucuacgucuccgccuccgagcaccccaaccacuucuggauccagaucgucggcucccgcucccuccagcucgacaagcucgucaacgagaugacccagcacuacgagaacuccguccccgaggaccucaccguccacgucggcgacaucgucgccgccccccuccccaccaacggcuccugguaccgcgcccgcguccucggcacccucgagaacggcaaccucgaccucuacuucgucgacuucggcgacaacggcgacugcccccucaaggaccuccgcgcccuccgcuccgacuuccucucccuccccuuccaggccaucgagugcucccucgcccgcaucgcccccuccggcgaccagugggaggaggaggcccucgacgaguucgaccgccucacccacugcgccgacuggaagccccucgucgccaagaucuccuccuacguccagaccggcaucuccaccuggcccaagaucuaccucuacgacaccuccaacggcaagaagcucgacaucggccucgagcucguccacaagggcuacgccaucgagcuccccgaggacaucgaggagaaccgcgccguccccgacaugcucaaggacauggccaccgagaccgacgccucccucuccacccuccucaccgagaccaagaaguccuccggcgagaucacccacacccucuccugccucucccucuccgaggccgccuccauguccggcgacgacaaccucgaggacgacuaccuccucuga

SEQ ID NO: 50603 - RNA, 597 nt, Artificial Sequence
  derived and/or modified sequence opt2 from TDRP__Homo_sapiens__NP_001243042
auguggaagcucggccgcggccgcguccuccucgacgagccccccgaggaggaggacggccuccgcggcggccccccccccgccgccgccgccgccgcccaggcccagguccagggcgccuccuuccgcggcuggaaggaggucaccucccucuucaacaaggacgacgagcagcaccuccucgagcgcugcaagucccccaaguccaagggcaccaaccuccgccucaaggaggagcucaaggccgagaagaaguccggcuucugggacaaccucguccucaagcagaacauccaguccaagaagcccgacgagaucgagggcugggagccccccaagcucgcccucgaggacaucuccgccgaccccgaggacaccgucggcggccaccccuccugguccggcugggaggacgacgccaagggcuccaccaaguacaccucccucgccuccuccgccaacuccucccgcuggucccuccgcgccgccggccgccucaucaaggaggucuggaucaacuucucccagcucaucaucuccuuccgcaagcacugccucgcccacuaccgcgagcuccgccucugcaucaaguacuga

SEQ ID NO: 50604 - RNA, 1281 nt, Artificial Sequence
  derived and/or modified sequence opt2 from TEAD1__Homo_sapiens__NP_068780
auggagcccuccuccugguccggcuccgagucccccgccgagaacauggagcgcauguccgacuccgccgacaagcccaucgacaacgacgccgagggcgucuggucccccgacaucgagcaguccuuccaggaggcccucgccaucuacccccccugcggccgccgcaagaucauccucuccgacgagggcaagauguacggccgcaacgagcucaucgcccgcuacaucaagcuccgcaccggcaagacccgcacccgcaagcaggucuccucccacauccagguccucgcccgccgcaagucccgcgacuuccacuccaagcucaaggaccagaccgccaaggacaaggcccuccagcacauggccgccauguccuccgcccagaucgucuccgccaccgccauccacaacaagcucggccuccccggcaucccccgccccaccuuccccggcgcccccggcuucuggcccggcaugauccagaccggccagcccggcuccucccaggacgucaagcccuucguccagcaggccuaccccauccagcccgccgucaccgcccccauccccggcuucgagcccgccuccgcccccgcccccuccguccccgccuggcagggccgcuccaucggcaccaccaagcuccgccucgucgaguucuccgccuuccucgagcagcagcgcgaccccgacuccuacaacaagcaccucuucguccacaucggccacgccaaccacuccuacuccgacccccuccucgaguccgucgacauccgccagaucuacgacaaguuccccgagaagaagggcggccucaaggagcucuucggcaagggcccccagaacgccuucuuccucgucaaguucugggccgaccucaacugcaacauccaggacgacgccggcgccuucuacggcgucaccucccaguacgaguccuccgagaacaugaccgucaccugcuccaccaaggucugcuccuucggcaagcaggucgucgagaaggucgagaccgaguacgcccgcuucgagaacggccgcuucgucuaccgcaucaaccgcucccccaugugcgaguacaugaucaacuucauccacaagcucaagcaccuccccgagaaguacaugaugaacuccguccucgagaacuucaccauccuccucgucgucaccaaccgcgacacccaggagacccuccucugcauggccugcgucuucgaggucuccaacuccgagcacggcgcccagcaccacaucuaccgccucgucaaggacuga

SEQ ID NO: 50605 - RNA, 1353 nt, Artificial Sequence
  derived and/or modified sequence opt2 from TEAD2__Homo_sapiens__NP_001243587
augggcgagccccgcgccggcgccgcccucgacgacggcuccggcuggaccggcuccgaggagggcuccgaggagggcaccggcggcuccgagggcgccggcggcgacggcggccccgacgccgagggcgucuggucccccgacaucgagcaguccuuccaggaggcccucgccaucuacccccccugcggccgccgcaagaucauccucuccgacgagggcaagauguacggccgcaacgagcucaucgcccgcuacaucaagcuccgcaccggcaagacccgcacccgcaagcaggucuccucccacauccagguccucgcccgccgcaagucccgcgagauccaguccaagcucaaggaccaggucuccaaggacaaggccuuccagaccauggccaccauguccuccgcccagcucaucuccgcccccucccuccaggccaagcucggccccaccggcccccaggucguccaggccuccgagcucuuccaguucugguccggcggcuccggcccccccuggaacguccccgacgucaagcccuucucccagacccccuucacccucucccucaccccccccuccaccgaccuccccggcuacgagcccccccaggcccucuccccccuccccccccccacccccuccccccccgccuggcaggcccgcggccucggcaccgcccgccuccagcucgucgaguucuccgccuucgucgagccccccgacgccgucgacuccuaccagcgccaccucuucguccacaucucccagcacugccccucccccggcgcccccccccucgaguccgucgacguccgccagaucuacgacaaguuccccgagaagaagggcggccuccgcgagcucuacgaccgcggccccccccacgccuucuuccucgucaaguucugggccgaccucaacuggggccccuccggcgaggaggccggcgccggcggcuccaucuccuccggcggcuucuacggcgucuccucccaguacgagucccucgagcacaugacccucaccugcuccuccaaggucugcuccuucggcaagcaggucgucgagaaggucgagaccgagcgcgcccagcucgaggacggccgcuucgucuaccgccuccuccgcucccccaugugcgaguaccucgucaacuuccuccacaagcuccgccagcuccccgagcgcuacaugaugaacuccguccucgagaacuucaccauccuccaggucgucaccaaccgcgacacccaggagcuccuccucugcaccgccuacgucuucgaggucuccaccuccgagcgcggcgcccagcaccacaucuaccgccucguccgcgacuga

SEQ ID NO: 50606 - RNA, 1308 nt, Artificial Sequence
  derived and/or modified sequence opt2 from TEAD3__Homo_sapiens__NP_003205
auggccuccaacuccuggaacgccuccuccucccccggcgaggcccgcgaggacggccccgagggccucgacaagggccucgacaacgacgccgagggcgucuggucccccgacaucgagcaguccuuccaggaggcccucgccaucuacccccccugcggccgccgcaagaucauccucuccgacgagggcaagauguacggccgcaacgagcucaucgcccgcuacaucaagcuccgcaccggcaagacccgcacccgcaagcaggucuccucccacauccagguccucgcccgcaagaagguccgcgaguaccaggucggcaucaaggccaugaaccucgaccaggucuccaaggacaaggcccuccaguccauggccuccauguccuccgcccagaucgucuccgccuccguccuccagaacaaguucuccccccccuccccccucccccaggccgucuucuccaccuccucccgcuucugguccucccccccccuccucggccagcagcccggccccucccaggacaucaagcccuucgcccagcccgccuaccccauccagcccccccucccccccacccucuccuccuacgagccccucgccccccuccccuccgccgccgccuccguccccgucuggcaggaccgcaccaucgccuccucccgccuccgccuccucgaguacuccgccuucauggagguccagcgcgaccccgacaccuacuccaagcaccucuucguccacaucggccagaccaaccccgccuucuccgaccccccccucgaggccgucgacguccgccagaucuacgacaaguuccccgagaagaagggcggccucaaggagcucuacgagaagggcccccccaacgccuucuuccucgucaaguucugggccgaccucaacuccaccauccaggagggccccggcgccuucuacggcgucuccucccaguacuccuccgccgacuccaugaccaucuccgucuccaccaaggucugcuccuucggcaagcaggucgucgagaaggucgagaccgaguacgcccgccucgagaacggccgcuucgucuaccgcauccaccgcucccccaugugcgaguacaugaucaacuucauccacaagcucaagcaccuccccgagaaguacaugaugaacuccguccucgagaacuucaccauccuccaggucgucaccucccgcgacucccaggagacccuccucgucaucgccuucgucuucgaggucuccaccuccgagcacggcgcccagcaccacgucuacaagcucgucaaggacuga

SEQ ID NO: 50607 - RNA, 1305 nt, Artificial Sequence
  derived and/or modified sequence opt2 from TEAD4__Homo_sapiens__NP_003204
auggagggcaccgccggcaccaucaccuccaacgagugguccucccccaccucccccgagggcuccaccgccuccggcggcucccaggcccucgacaagcccaucgacaacgacgccgagggcgucuggucccccgacaucgagcaguccuuccaggaggcccucgccaucuacccccccugcggccgccgcaagaucauccucuccgacgagggcaagauguacggccgcaacgagcucaucgcccgcuacaucaagcuccgcaccggcaagacccgcacccgcaagcaggucuccucccacauccagguccucgcccgccgcaaggcccgcgagauccaggccaagcucaaggaccaggccgccaaggacaaggcccuccaguccauggccgccauguccuccgcccagaucaucuccgccaccgccuuccacuccuccauggcccucgcccgcggccccggccgccccgccgucuccggcuucuggcagggcgcccuccccggccaggccggcaccucccacgacgucaagcccuucucccagcagaccuacgccguccagcccccccucccccuccccggcuucgagucccccgccggccccgcccccucccccuccgccccccccgccccccccuggcagggccgcuccgucgccuccuccaagcucuggaugcucgaguucuccgccuuccucgagcagcagcaggaccccgacaccuacaacaagcaccucuucguccacaucggccaguccucccccuccuacuccgaccccuaccucgaggccgucgacauccgccagaucuacgacaaguuccccgagaagaagggcggccucaaggaccucuucgagcgcggccccuccaacgccuucuuccucgucaaguucugggccgaccucaacaccaacaucgaggacgagggcuccuccuucuacggcgucuccucccaguacgagucccccgagaacaugaucaucaccugcuccaccaaggucugcuccuucggcaagcaggucgucgagaaggucgagaccgaguacgcccgcuacgagaacggccacuacuccuaccgcauccaccgcuccccccucugcgaguacaugaucaacuucauccacaagcucaagcaccuccccgagaaguacaugaugaacuccguccucgagaacuucaccauccuccaggucgucaccaaccgcgacacccaggagacccuccucugcaucgccuacgucuucgaggucuccgccuccgagcacggcgcccagcaccacaucuaccgccucgucaaggaguga

SEQ ID NO: 50608 - RNA, 1896 nt, Artificial Sequence
  derived and/or modified sequence opt2 from TEC__Homo_sapiens__XP_011512038
augaacuucaacaccauccucgaggagauccucaucaagcgcucccagcagaagaagaagaccuccccccucaacuacaaggagcgccucuucguccucaccaaguccaugcucaccuacuacgagggccgcgccgagaagaaguaccgcaagggcuucaucgacgucuccaagaucaagugcgucgagaucgucaagaacgacgacggcgucauccccugccagaacaaguaccccuuccaggucguccacgacgccaacacccucuacaucuucgcccccuccccccagucccgcgaccucugggucaagaagcucaaggaggagaucaagaacaacaacaacaucaugaucaaguaccaccccaaguucuggaccgacggcuccuaccagugcugccgccagaccgagaagcucgcccccggcugcgagaaguacaaccucuucgaguccuccauccgcaaggcccucccccccgcccccgagaccaagaagcgccgcccccccccccccaucccccucgaggaggaggacaacuccgaggagaucgucgucgccauguacgacuuccaggccgccgagggccacgaccuccgccucgagcgcggccaggaguaccucauccucgagaagaacgacguccacugguggcgcgcccgcgacaaguacggcaacgagggcuacauccccuccaacuacgucaccggcaagaaguccaacaaccucgaccaguacgagugguacugccgcaacaugaaccgcuccaaggccgagcagcuccuccgcuccgaggacaaggagggcggcuucaugguccgcgacuccucccagcccggccucuacaccgucucccucuacaccaaguucggcggcgagggcuccuccggcuuccgccacuaccacaucaaggagaccaccaccucccccaagaaguacuaccucgccgagaagcacgccuucggcuccauccccgagaucaucgaguaccacaagcacaacgccgccggccucgucacccgccuccgcuaccccgucuccgucaagggcaagaacgcccccaccaccgccggcuucuccuacgagaagugggagaucaaccccuccgagcucaccuucaugcgcgagcucggcuccggccucuucggcgucguccgccucggcaaguggcgcgcccaguacaaggucgccaucaaggccauccgcgagggcgccaugugcgaggaggacuucaucgaggaggccaaggucaugaugaagcucacccaccccaagcucguccagcucuacggcgucugcacccagcagaagcccaucuacaucgucaccgaguucauggagcgcggcugccuccucaacuuccuccgccagcgccagggccacuucucccgcgacguccuccucuccaugugccaggacgucugcgagggcauggaguaccucgagcgcaacuccuucauccaccgcgaccucgccgcccgcaacugccucgucuccgaggccggcgucgucaaggucuccgacuucggcauggcccgcuacguccucgacgaccaguacaccuccuccuccggcgccaaguuccccgucaaguggugcccccccgaggucuucaacuacucccgcuucuccuccaaguccgacgucugguccuucggcguccucaugugggaggucuucaccgagggccgcaugcccuucgagaaguacaccaacuacgaggucgucaccauggucacccgcggccaccgccucuaccagcccaagcucgccuccaacuacgucuacgaggucaugcuccgcugcuggcaggagaagcccgagggccgccccuccuucgaggaccuccuccgcaccaucgacgagcucgucgagugcgaggagaccuucggccgcuga

SEQ ID NO: 50609 - RNA, 3804 nt, Artificial Sequence
  derived and/or modified sequence opt2 from TECPR2__Homo_sapiens__NP_001166102
auggccuccaucuccgagcccgucaccuuccgcgaguucugcccccucuacuaccuccucaacgccauccccaccaagauccagaagggcuuccgcuccaucgucgucuaccucaccgcccucgacaccaacggcgacuacaucgccgucggcuccuccaucggcaugcucuaccucuacugccgccaccucaaccagaugcgcaaguacaacuucgagggcaagaccgaguccaucaccgucgucaagcuccucuccugcuucgacgaccucgucgccgccggcaccgccuccggccgcgucgccgucuuccagcucgucuccucccuccccggccgcaacaagcagcuccgccgcuucgacgucaccggcauccacaagaacuccaucaccgcccucgccuggucccccaacggcaugaagcucuucuccggcgacgacaagggcaagaucgucuacuccucccucgaccucgaccagggccucugcaacucccagcucguccucgaggagcccuccuccaucguccagcucgacuacucccagaagguccuccucgucuccacccuccagcgcucccuccucuucuacaccgaggagaaguccguccgccagaucggcacccagccccgcaaguccaccggcaaguucggcgccugcuucauccccggccucugcaagcaguccgaccucacccucuacgccucccgccccggccuccgccucuggaaggccgacguccacggcaccguccaggccaccuucauccucaaggacgccuucgccggcggcgucaagcccuucgagcuccacccccgccucgagucccccaacuccggcuccugcucccuccccgagcgccaccucggccucgucuccugcuucuuccaggagggcuggguccucuccuggaacgaguacuccaucuaccuccucgacaccgucaaccaggccaccgucgccggccucgagggcuccggcgacaucgucuccgucuccugcaccgagaacgagaucuucuuccucaagggcgaccgcaacaucauccgcaucuccucccgccccgagggccucaccuccaccguccgcgacggccucgagauguccggcugcuccgagcgcguccacguccagcaggccgagaagcuccccggcgccaccgucuccgagacccgccuccgcggcuccuccauggccuccuccgucgccuccgagccccgcucccgcuccuccucccucaacuccaccgacuccggcuccggccuccucccccccggccuccaggccacccccgagcucggcaagggcucccagccccucucccagcgcuucaacgccaucuccuccgaggacuucgaccaggagcucgucgucaagcccaucaaggucaagcgcaagaagaagaagaagaagaccgagggcggcucccgcuccaccugccacuccucccucgaguccacccccugcuccgaguuccccggcgacuccccccagucccucaacaccgaccuccucuccaugaccuccuccguccucggcuccuccgucgaccagcucuccgccgagucccccgaccaggaguccuccuucaacggcgaggucaacggcgucccccaggagaacaccgaccccgagaccuucaacguccucgaggucuccggcuccaugcccgacucccucgccgaggaggacgacauccgcaccgagaugccccacugccaccacgcccacggccgcgagcuccucaacggcgcccgcgaggacgucggcggcuccgacgucaccggccucggcgacgagcccugccccgccgacgacggccccaacuccacccagcuccccuuccaggagcaggacuccucccccggcgcccacgacggcgaggacauccagcccaucggcccccaguccaccuucugcgaggucccccuccucaacucccucaccguccccuccucccucuccugggcccccuccgccgagcaguggcuccccggcacccgcgccgacgagggcucccccgucgagcccucccaggagcaggacauccucaccuccauggaggccuccggccaccucuccaccaaccucuggcacgccgucaccgacgacgacaccggccagaaggagauccccaucuccgagcgcguccucggcuccgucggcggccagcucacccccgucuccgcccucgccgccuccacccacaagcccuggcucgagcagcccccccgcgaccagacccucaccuccuccgacgaggaggacaucuacgcccacggccuccccuccuccuccuccgagaccuccgucaccgagcucggccccuccugcucccagcaggaccucucccgccucggcgccgaggacgccggccuccucaagcccgaccaguucgccgaguccuggaugggcuacuccggccccggcuacggcauccucucccucgucgucuccgagaaguacaucuggugccucgacuacaagggcggccucuucugcuccgcccuccccggcgccggccuccgcuggcagaaguucgaggacgccguccagcaggucgccgucucccccuccggcgcccuccucuggaagaucgagcagaaguccaaccgcgccuucgccugcggcaaggucaccaucaagggcaagcgccacugguacgaggcccucccccaggccgucuucgucgcccucuccgacgacaccgccuggaucauccgcaccuccggcgaccucuaccuccagaccggccucuccgucgaccgccccugcgcccgcgccgucaaggucgacugccccuacccccucucccagaucaccgcccgcaacaacgucgucugggcccucaccgagcagcgcgcccuccucuaccgcgagggcgucuccuccuucugccccgagggcgagcaguggaagugcgacaucgucuccgagcgccaggcccucgagcccgucugcaucacccucggcgaccagcagacccucugggcccucgacauccacggcaaccucugguuccgcaccggcaucaucuccaagaagccccagggcgacgacgaccacugguggcaggucuccaucaccgacuacgucgucuucgaccagugcucccucuuccagaccaucauccacgccacccacuccgucgccaccgccgcccaggcccccgucgagaaggucgccgacaagcuccgcauggccuucuggucccagcagcuccagugccagcccucccuccucggcgucaacaacuccggcgucuggaucuccuccggcaagaacgaguuccacgucgccaagggcucccucaucggcaccuacuggaaccacgucgucccccgcggcaccgccuccgccaccaagugggccuucguccucgccuccgccgcccccaccaaggagggcuccuuccucuggcucugccaguccuccaaggaccucugcuccgucuccgcccaguccgcccagucccgccccuccaccguccagcucccccccgaggccgagaugcgcgccuacgccgccugccaggacgcccucugggcccucgacucccucggccaggucuucauccgcacccucuccaaguccugccccaccggcaugcacuggacccgccucgaccucucccagcucggcgccgucaagcucaccucccucgccugcggcaaccagcacaucugggccugcgacucccgcggcggcgucuacuuccgcgucggcacccagccccucaaccccucccucaugcuccccgccuggaucaugaucgagccccccguccaggucucccgcuccuga

SEQ ID NO: 50610 - RNA, 927 nt, Artificial Sequence
  derived and/or modified sequence opt2 from TECR__Homo_sapiens__NP_612510
augaagcacuacgaggucgagauccucgacgccaagacccgcgagaagcucugcuuccucgacaaggucgagccccacgccaccaucgccgagaucaagaaccucuucaccaagacccacccccagugguaccccgcccgccagucccuccgccucgaccccaagggcaagucccucaaggacgaggacguccuccagaagcuccccgucggcaccaccgccacccucuacuuccgcgaccucggcgcccagaucuccugggucaccgucuuccucaccgaguacgccggcccccucuucaucuaccuccucuucuacuuccgcguccccuucaucuacggccacaaguacgacuucaccuccucccgccacaccgucguccaccucgccugcaucugccacuccuuccacuacaucaagcgccuccucgagacccucuucguccaccgcuucucccacggcaccaugccccuccgcaacaucuucaagaacugcaccuacuacuggggcuucgccgccuggauggccuacuacaucaaccacccccucuacaccccccccaccuacggcgcccagcaggucaagcucgcccucgccaucuucgucaucugccagcucggcaacuucuccauccacauggcccuccgcgaccuccgccccgccggcuccaagacccgcaagauccccuaccccaccaagaaccccuucaccuggcucuuccuccucgucuccugccccaacuacaccuacgaggucggcuccuggaucggcuucgccaucaugacccagugccuccccgucgcccucuucucccucgucggcuucacccagaugaccaucugggccaagggcaagcaccgcuccuaccucaaggaguuccgcgacuaccccccccuccgcaugcccaucauccccuuccuccucuga

SEQ ID NO: 50611 - RNA, 1092 nt, Artificial Sequence
  derived and/or modified sequence opt2 from TECRL__Homo_sapiens__NP_001010874
auguucaagcgccacaagucccucgccuccgagcgcaagcgcgcccuccucucccagcgcgccacccgcuucauccucaaggacgacaugcgcaacuuccacuuccucuccaagcucguccucuccgccggcccccuccgccccacccccgccgucaagcacuccaagaccacccacuucgagaucgagaucuucgacgcccagacccgcaagcagaucugcauccucgacaaggucacccaguccuccaccauccacgacgucaagcagaaguuccacaaggccugccccaagugguaccccucccgcgucggccuccagcucgagugcggcggccccuuccucaaggacuacaucaccauccaguccaucgccgccuccuccaucgucacccucuacgccaccgaccucggccagcaggucuccuggaccaccgucuuccucgccgaguacaccggcccccuccucaucuaccuccucuucuaccuccgcauccccugcaucuacgacggcaaggaguccgcccgccgccuccgccaccccgucguccaccucgccugcuucugccacugcauccacuacauccgcuaccuccucgagacccucuucguccacaaggucuccgccggccacaccccccucaagaaccucaucauguccugcgccuucuacuggggcuucaccuccuggaucgccuacuacaucaaccacccccucuacaccccccccuccuucggcaaccgccagaucaccgucuccgccaucaacuuccucaucugcgaggccggcaaccacuucaucaacgucaugcucucccaccccaaccacaccggcaacaacgccugcuuccccucccccaacuacaaccccuucaccuggauguucuuccucgucuccugccccaacuacaccuacgagaucggcuccuggaucuccuucaccgucaugacccagacccuccccgucggcaucuucacccuccucauguccauccagaugucccucugggcccagaagaagcacaagaucuaccuccgcaaguucaacuccuacauccaccgcaaguccgccaugauccccuucauccucuga

SEQ ID NO: 50612 - RNA, 6468 nt, Artificial Sequence
  derived and/or modified sequence opt2 from TECTA__Homo_sapiens__NP_005413
augaacuacuccuccuuccuccgcaucugggucuccuucaucuucgcccucguccagcaccaggcccagccccgcgagcucauguaccccuucuggcagaacgacaccaagacccccaaggucgacgacggcuccuccuccgagaucaagcucgccauccccgucuucuucuucggcguccccuaccgcaccgucuacgucaacaacaacggcgucgucuccuucaacguccucgucucccaguucacccccgaguccuucccccucaccgacggccgcgccuucgucgcccccuucugggccgacguccacaacggcauccgcggcgagaucuacuaccgcgagaccauggagcccgccauccucaagcgcgccaccaaggacauccgcaaguacuucaaggacauggccaccuucuccgccaccugggucuucaucgucaccugggaggaggucaccuucuacggcggcuccuccaccacccccgucaacaccuuccaggccguccucgucuccgacggcuccuacaccuucacccucuucaacuacuacgagaucaacuggaccaccggcaccgccuccggcggcgacccccucaccggccucggcggcgucauggcccaggccggcuucaacggcggcaaccucaccaacuucuucucccuccccggcucccgcacccccgagaucgucaacauccaggagaccaccaacgucaacguccccggccgcugggccuucaaggucgacggcaaggagaucgaccccgccaacggcugcaccucccgcggccaguuccuccgccgcggcgaggucuucugggacgaccucaacugcaccgucaagugccgcugccucgacuucaacaacgagaucuacugccaggaggccuccugcucccccuacgaggucugcgagcccaagggcaaguucuucuacugcuccgccgucgagaccuccaccugcgucgucuucggcgagccccacuaccacaccuucgacggcuuccucuuccacuuccagggcuccugcgccuaccuccucgcccgccagugccuccagaccuccucccuccccuucuucuccgucgaggccaagaacgagcaccgccgcggcuccgccgucuccugggucaaggagcucuccgucgaggucaacggcuacaagauccucauccccaagggcuccuacggccgcgucaaggucaacgaccucgucaccucccuccccgucacccucgaccucggcaccgucaagaucuaccaguccggcaucuccaccgccgucgagaccgacuucggccuccucgucaccuucgacggccagcacuacgccuccaucuccguccccggcuccuacaucaacuccaccugcggccucugcggcaacuacaacaagaacccccucgacgacuuccuccgccccgacggccgccccgccauguccguccucgaccucggcgaguccuggcgcgucuaccacgccgacuggaagugcgacuccggcugcgucgacaacugcacccagugcgacgccgccaccgaggcccucuacuucggcuccgacuacugcggcuuccucaacaagaccgacggcccccucugggagugcggcaccgucgucgaccccaccgccuucguccacuccugcgucuacgaccucugcuccguccgcgacaacggcacccuccucugccaggccauccaggccuacgcccucgucugccaggcccucggcauccccaucggcgacuggcgcacccagaccggcugcgucuccaccguccagugccccuccuucucccacuacuccgucugcaccuccuccugccccgacaccugcuccgaccucaccgccucccgcaacugcgccacccccugcaccgagggcugcgagugcaaccagggcuucguccucuccaccucccagugcgucccccuccacaagugcggcugcgacuucgacggccacuacuacaccaugggcgaguucuucugggccaccgccaacugcaccguccagugccucugcgaggagggcggcgacgucuacugcuucaacaagaccugcggcuccggcgaggucugcgccgucgaggacggcuaccagggcugcuuccccaagcgcgagaccgucugccuccucucccagaaccagguccuccacaccuucgacggcgccuccuacgccuuccccuccgaguucuccuacacccuccucaagaccugccccgagcgccccgaguaccucgagaucgacaucaacaagaagaagcccgacgccggccccgccuggcuccgcggccuccgcauccucgucgccgaccaggaggucaagaucggcggcaucggcgccuccgaggucaagcucaacggccaggaggucgagcuccccuucuuccaccccuccggcaagcucgagaucuaccgcaacaagaacuccaccaccgucgaguccaagggcgucgucaccguccaguacuccgacaucggccuccucuacauccgccucuccaccaccuacuucaacugcaccggcggccucugcggcuucuacaacgccaacgccuccgacgaguucugccuccccaacggcaagugcaccgacaaccucgccgucuuccucgaguccuggaccaccuucgaggagaucugcaacggcgagugcggcgaccuccucaaggccugcaacaacgacuccgagcuccucaaguucuaccgcucccgcucccgcugcggcaucaucaacgaccccuccaacuccuccuuccucgagugccacggcgucgucaacgucaccgccuacuaccgcaccugccucuuccgccucugccaguccggcggcaacgaguccgagcucugcgacuccgucgcccgcuacgccuccgccugcaagaacgccgacgucgaggucggccccuggcgcaccuacgacuucugcccccucgagugccccgagaacucccacuucgaggagugcaucaccugcaccgagaccugcgagacccucacccucggccccaucugcgucgacuccugcuccgagggcugccagugcgacgagggcuacgcccuccucggcucccagugcgucacccgcuccgagugcggcugcaacuucgagggccaccagcucgccaccaacgagaccuucugggucgaccucgacugccagaucuucugcuacugcuccggcaccgacaaccgcguccacugcgagaccauccccugcaaggacgacgaguacugcauggaggagggcggccucuacuacugccaggcccgcaccgacgccuccugcaucgucuccggcuacggccacuaccucaccuucgacggcuuccccuucgacuuccagaccuccugcccccucauccucugcaccaccggcucccgccccuccuccgacuccuuccccaaguucgucgucaccgccaagaacgaggaccgcgaccccucccucgcccucugggucaagcaggucgacgucaccgucuucggcuacuccaucgucauccaccgcgccuacaagcacaccguccucgucaacuccgagcgccucuaccucccccucaagcucggccagggcaagaucaacaucuucuccuucggcuuccacgucgucgucgagaccgacuucggccucaaggucgucuacgacuggaagaccuuccucuccaucaccgucccccgcuccaugcagaacuccaccuacggccucugcggccgcuacaacggcaaccccgacgacgaccucgagaugcccaugggccuccucgccuccuccgucaacgaguucggccaguccugggucaagcgcgacaccuucugccaggucggcugcggcgaccgcugccccuccugcgccaaggucgagggcuucuccaagguccagcagcucugcucccucauccccaaccagaacgccgccuucuccaagugccacuccaaggucaaccccaccuucuucuacaagaacugccucuucgacuccugcaucgacggcggcgccguccagaccgccugcuccuggcuccagaacuacgccuccaccugccagacccagggcaucaccgucaccggcuggcgcaacuacaccuccugcaccgucaccugcccccccaacucccacuacgaguccugcgucuccgucugccagccccgcugcgccgccauccgccucaaguccgacugcucccacuacugcgucgagggcugccacugcgacgccggcuacguccucaacggcaaguccugcauccucccccacuccugcggcugcuacuccgacggcaaguacuacgagcccaagcagcucuucuggaacuccgacugcacccgccgcugccgcugcuuccgccgcaacgucauccagugcgacccccgccagugcaaguccgacgaggagugcgcccuccgcaacggcguccgcggcugcuucuccaccaagaccuccuacugccucgccgccggcggcggcgucuuccgcaccuucgacggcgccuuccuccgcuuccccgccaacugcgccuucguccucuccaccaucugccagaagcuccccgacaucuccuuccagcucaucaucaacuucgacaagugguccgcccccaaccucaccaucaucucccccgucuacuucuacaucaacgaggagcagauccucaucaacgaccgcaacaccgucaaggucaacggcacccaggucaacguccccuucaucaccggccucgccaccaagaucuacuccuccgagggcuuccucgucaucgacaccucccccgacauccagaucuacuacaacggcuucaacgucaucaagaucuccaucuccgagcgccuccagaacaaggucugcggccucugcggcaacuucaacggcgaccucaccgacgacuacgucacccuccgcggcaagcccgucgucuccuccgucguccucgcccaguccuggaagaccaacggcaugcagaagcgcccccucgcccccuccugcaacgagcuccaguucucccaguacgccgccaugugcgacaacguccacauccagaagaugcagggcgacggcuacugccucaagcucaccgacaugaagggcuucuuccagcccugcuacggccuccucgacccccuccccuucuacgaguccugcuaccucgacggcugcuacucccacaagaaguuccagcucugcggcucccucgccgccuacggcgaggccugccgcuccuucggcauccucuccaccgaguggaucgagaaggagaacugcuccggcgucgucgaggaccccugcgucggcgccgacugccccaaccgcaccugcgagcucggcaacggccgcgagcucugcggcugcaucgagcccccccccuacggcaacaacucccacgacaucaucgacgccgaggucaccugcaaggccgcccagauggaggucuccaucuccaagugcaagcucuuccagcucggcuucgagcgcgagggcguccgcaucaacgaccgccagugcaccggcaucgagggcgaggacuucaucuccuuccagaucaacaacaccaagggcaacugcggcaacaucguccaguccaacggcacccacaucauguacaagaacacccucuggaucgaguccgccaacaacaccggcaacaucaucacccgcgaccgcaccaucaacgucgaguucuccugcgccuacgagcucgacaucaagaucucccucgacuccgucgucaagcccaugcucuccgucaucaaccucaccguccccacccaggagggcuccuucaucaccaagauggcccucuacaagaacgccuccuacaagcaccccuaccgccagggcgaggucguccucaccacccgcgacguccucuacgucggcgucuucgucgucggcgccgacgccacccaccucauccucacccucaacaagugcuacgccacccccacccgcgacuccaacgacaagcuccgcuacuucaucaucgagggcggcugccagaaccucaaggacaacaccaucggcaucgaggagaacgccgucucccucaccugccgcuuccacgucaccgucuucaaguucaucggcgacuacgacgagguccaccuccacugcgccgucucccucugcgacuccgagaaguacuccugcaagaucaccugcccccacaacucccgcaucgccaccgacuacaccaaggagcccaaggagcagaucaucuccgucggccccauccgccgcaagcgccucgacuggugcgaggacaacggcggcugcgagcagaucugcaccucccgcgucgacggcccccucugcuccugcgucaccggcacccuccaggaggacggcaaguccugccgcgccuccaacuccuccauggagcuccaggucuggacccuccuccucaucaugauccagaucucccucuggcacuucgucuacaaguccggcaccaccuccuga

SEQ ID NO: 50613 - RNA, 822 nt, Artificial Sequence
  derived and/or modified sequence opt2 from TEF__Homo_sapiens__NP_001138870
auggacaugcccgagguccucaagucccuccucgagcacucccuccccuggcccgagaagcgcaccgacaaggagaagggcaaggagaagcucgaggaggacgaggccgccgccgccuccaccauggccgucuccgccucccucaugccccccaucugggacaagaccauccccuacgacggcgaguccuuccaccucgaguacauggaccucgacgaguuccuccucgagaacggcauccccgccucccccacccaccucgcccacaaccuccuccuccccgucgccgagcucgagggcaaggaguccgccuccuccuccaccgccuccccccccuccuccuccaccgccaucuuccagcccuccgagaccgucuccuccaccgaguccucccucgagaaggagcgcgagacccccucccccaucgaccccaacugcgucgaggucgacgucaacuucaaccccgaccccgccgaccucguccucuccuccguccccggcggcgagcucuucaacccccgcaagcacaaguucgccgaggaggaccucaagccccagcccaugaucaagaaggccaagaaggucuucguccccgacgagcagaaggacgagaaguacuggacccgccgcaagaagaacaacgucgccgccaagcgcucccgcgacgcccgccgccucaaggagaaccagaucaccauccgcgccgccuuccucgagaaggagaacaccgcccuccgcaccgaggucgccgagcuccgcaaggaggucggcaagugcaagaccaucgucuccaaguacgagaccaaguacggcccccucuga

SEQ ID NO: 50614 - RNA, 1083 nt, Artificial Sequence
  derived and/or modified sequence opt2 from TEFM__Homo_sapiens__NP_078959
auguccggcuccguccucuucaccgccggcgagcgcuggcgcugcuuccucacccccucccgcuccucccucuacugggcccuccacaacuucugcugccgcaagaaguccaccacccccaagaagaucacccccaacgucaccuucugcgacgagaacgccaaggagcccgagaacgcccucgacaagcucuucuccuccgagcagcaggccuccauccuccacguccucaacaccgccuccaccaaggagcucgaggccuuccgccuccuccgcggccgccgcuccaucaacaucgucgagcaccgcgagaacuucggccccuuccagaaccucgagucccucaugaacgucccccucuucaaguacaaguccaccguccaggucugcaacuccauccucugccccaagaccggccgcgagaagcgcaagucccccgagaaccgcuuccuccgcaagcuccucaagcccgacaucgagcgcgagcgccucaaggccgucaacuccaucaucuccaucgucuucggcacccgccgcaucgccugggcccaccucgaccgcaagcucaccguccucgacuggcagcaguccgaccgcuggucccucaugcgcggcaucuacuccuccuccgucuaccucgaggagaucuccuccaucaucuccaagaugcccaaggccgacuucuacguccucgagaagaccggccucuccauccagaacuccucccucuuccccauccuccuccacuuccacaucauggaggccaugcucuacgcccuccucaacaagaccuucgcccaggacggccagcaccagguccucuccaugaaccgcaacgccgucggcaagcacuucgagcucaugaucggcgacucccgcaccuccggcaaggagcucgucaagcaguuccucuucgacuccauccucaaggccgacccccgcgucuucuuccccuccgacaagaucguccacuaccgccagauguuccucuccaccgagcuccagcgcgucgaggagcucuacgacucccuccuccaggccaucgccuucuacgagcucgccgucuucgacucccagcccuga

SEQ ID NO: 50615 - RNA, 3375 nt, Artificial Sequence
  derived and/or modified sequence opt2 from TEK__Homo_sapiens__NP_000450
auggacucccucgccucccucguccucugcggcgucucccuccuccucuccggcaccgucgagggcgccauggaccucauccucaucaacucccucccccucgucuccgacgccgagaccucccucaccugcaucgccuccggcuggcgcccccacgagcccaucaccaucggccgcgacuucgaggcccucaugaaccagcaccaggacccccucgaggucacccaggacgucacccgcgagugggccaagaaggucgucuggaagcgcgagaaggccuccaagaucaacggcgccuacuucugcgagggccgcguccgcggcgaggccauccgcauccgcaccaugaagaugcgccagcaggccuccuuccuccccgccacccucaccaugaccgucgacaagggcgacaacgucaacaucuccuucaagaagguccucaucaaggaggaggacgccgucaucuacaagaacggcuccuucauccacuccgucccccgccacgagguccccgacauccucgagguccaccucccccacgcccagccccaggacgccggcgucuacuccgcccgcuacaucggcggcaaccucuucaccuccgccuucacccgccucaucguccgccgcugcgaggcccagaaguggggccccgagugcaaccaccucugcaccgccugcaugaacaacggcgucugccacgaggacaccggcgagugcaucugcccccccggcuucaugggccgcaccugcgagaaggccugcgagcuccacaccuucggccgcaccugcaaggagcgcugcuccggccaggagggcugcaaguccuacgucuucugccuccccgaccccuacggcugcuccugcgccaccggcuggaagggccuccagugcaacgaggccugccaccccggcuucuacggccccgacugcaagcuccgcugcuccugcaacaacggcgagaugugcgaccgcuuccagggcugccucugcucccccggcuggcagggccuccagugcgagcgcgagggcaucccccgcaugacccccaagaucgucgaccuccccgaccacaucgaggucaacuccggcaaguucaaccccaucugcaaggccuccggcuggccccuccccaccaacgaggagaugacccucgucaagcccgacggcaccguccuccaccccaaggacuucaaccacaccgaccacuucuccgucgccaucuucaccauccaccgcauccucccccccgacuccggcgucugggucugcuccgucaacaccgucgccggcauggucgagaagcccuucaacaucuccgucaagguccuccccaagccccucaacgcccccaacgucaucgacaccggccacaacuucgccgucaucaacaucuccuccgagcccuacuucggcgacggccccaucaaguccaagaagcuccucuacaagcccgucaaccacuacgaggccuggcagcacauccaggucaccaacgagaucgucacccucaacuaccucgagccccgcaccgaguacgagcucugcguccagcucguccgccgcggcgagggcggcgagggccaccccggccccguccgccgcuucaccaccgccuccaucggccucccccccccccgcggccucaaccuccuccccaagucccagaccacccucaaccucaccuggcagcccaucuuccccuccuccgaggacgacuucuacgucgaggucgagcgccgcuccguccagaaguccgaccagcagaacaucaagguccccggcaaccucaccuccguccuccucaacaaccuccacccccgcgagcaguacgucguccgcgcccgcgucaacaccaaggcccagggcgagugguccgaggaccucaccgccuggacccucuccgacauccuccccccccagcccgagaacaucaagaucuccaacaucacccacuccuccgccgucaucuccuggaccauccucgacggcuacuccaucuccuccaucaccauccgcuacaagguccagggcaagaacgaggaccagcacgucgacgucaagaucaagaacgccaccaucacccaguaccagcucaagggccucgagcccgagaccgccuaccaggucgacaucuucgccgagaacaacaucggcuccuccaaccccgccuucucccacgagcucgucacccuccccgagucccaggcccccgccgaccucggcggcggcaagaugcuccucaucgccauccucggcuccgccggcaugaccugccucaccguccuccucgccuuccucaucauccuccagcucaagcgcgccaacguccagcgccgcauggcccaggccuuccagaacguccgcgaggagcccgccguccaguucaacuccggcacccucgcccucaaccgcaaggucaagaacaaccccgaccccaccaucuaccccguccucgacuggaacgacaucaaguuccaggacgucaucggcgagggcaacuucggccagguccucaaggcccgcaucaagaaggacggccuccgcauggacgccgccaucaagcgcaugaaggaguacgccuccaaggacgaccaccgcgacuucgccggcgagcucgagguccucugcaagcucggccaccaccccaacaucaucaaccuccucggcgccugcgagcaccgcggcuaccucuaccucgccaucgaguacgccccccacggcaaccuccucgacuuccuccgcaagucccgcguccucgagaccgaccccgccuucgccaucgccaacuccaccgccuccacccucuccucccagcagcuccuccacuucgccgccgacgucgcccgcggcauggacuaccucucccagaagcaguucauccaccgcgaccucgccgcccgcaacauccucgucggcgagaacuacgucgccaagaucgccgacuucggccucucccgcggccaggaggucuacgucaagaagaccaugggccgccuccccguccgcuggauggccaucgagucccucaacuacuccgucuacaccaccaacuccgacgucugguccuacggcguccuccucugggagaucgucucccucggcggcacccccuacugcggcaugaccugcgccgagcucuacgagaagcucccccagggcuaccgccucgagaagccccucaacugcgacgacgaggucuacgaccucaugcgccagugcuggcgcgagaagcccuacgagcgccccuccuucgcccagauccucgucucccucaaccgcaugcucgaggagcgcaagaccuacgucaacaccacccucuacgagaaguucaccuacgccggcaucgacugcuccgccgaggaggccgccuga

SEQ ID NO: 50616 - RNA, 1257 nt, Artificial Sequence
  derived and/or modified sequence opt2 from TEKT1__Homo_sapiens__NP_444515
auggccaagcuccuccagcccccccccaaguuccuccccuccgaguggcacaucgccaacaagaaccaguaccaccgcgccgacgcccagcgcucccgcuccgagcgccucgucgccgagucccagcgccucgucgacgagaucgagaagaccacccgcaagucccaguccgacgucaacaagaagcucgagcagcgccucgaggagguccaguucuggaagaaggagcucgacgacaagcucgagcagcucgucaacgucaccgacgaccuccucaucuacaagauccgccucgagaaggcccucgagacccucaaggagccccuccacaucaccgagaccugccucgccuaccgcgagaagcgcaucggcaucgaccucguccacgacaccgucgagcacgagcucaucaaggaggccgagaucauccagggcaucauggcccuccucacccgcacccucgaggaggccuccgagcagauccgcaugaaccgcuccgccaaguacaaccucgagaaggaccucaaggacaaguucgucgcccucaccaucgacgacaucugcuucucccucaacaacaacucccccaacauccgcuacuccgagaacgccguccgcaucgagcccaacuccgucucccucgaggacuggcucgacuucuccuccaccaacgucgagaaggccgacaagcagcgcaacaacucccucaugcucaaggcccucgucgaccgcauccucucccagaccgccaacgaccuccgcaagcagugcgacgucgucgacaccgccuucaagaacggccucaaggacaccaaggacgcccgcgacaagcucgccgaccaccucgccaaggucauggaggagaucgccucccaggagaagaacaucaccgcccucgagaaggccauccucgaccaggagggccccgccaaggucgcccacacccgccucgagacccgcacccaccgccccaacgucgagcucugccgcgacgucgcccaguaccgccucaugaaggagguccaggagaucacccacaacgucgcccgccucaaggagacccucgcccaggcccaggccgagcucaagggccuccaccgccgccagcucgcccuccaggaggagauccaggucaaggagaacaccaucuacaucgacgagguccucugcaugcagaugcgcaaguccaucccccuccgcgacggcgaggaccacggcgucugggccggcggccuccgccccgacgccgucugcuga

SEQ ID NO: 50617 - RNA, 1458 nt, Artificial Sequence
  derived and/or modified sequence opt2 from TEKT5__Homo_sapiens__NP_653275
auggaguuccucggcaccacccagaccgccuccuacugcggccccaagaagugcugcggccucaccucccuccccgccguccaggcccccgucauccaggagugcuaccagcccuacuaccuccccggcuaccgcuaccucaacuccuggcgccccucccucuucuacaagaucgccaacguccagaccugccccgacgaguccaccuccacccuccgcccccccaccauccuccccacccuccgcuccgcccucuucucccgcuacuccccccacgacugggaccaguccaaccagcuccagguccgcggcgccgaggccucccgccucugggccucccgccucaccgacgacuccaugcgccuccuccaggacaaggaccagcucacccaccagaugcaggagggcaccugccgcaaccucggccagcgccucuccgacaucggcuucuggaaguccgagcucuccuacgagcucgaccgccuccucaccgagaaccagaaccucgagaccgucaagcgccgccucgagugcgccgccaacgaggucaacugcccccuccaggucgcccucgagugccucuaccaccgcgagaagcgcaucggcaucgaccucguccacgacaacgucgagaagaaccucauccgcgaggucgaccuccucaagugcugccaggagcagaugcgcaagcucgcccagcgcaucgacauccagaugcgcgacaaccgcgacgcccagcacguccucgagcgcgaccucgaggacaaguccuccgcccagugcaucgacgagaagugcuucaaccuccgcaacaccuccgacugcaucuccuucuuccacggcauggagaagaucgacggcaccaucuccguccccgagaccugggccaaguucuccaacgacaacaucaagcacucccagaacaugcgcgccaacuccauccagcuccgcgaggaggccgagcaccucuucgagacccucuccgaccagauguggcgccaguucaccgacaccaaccucgccuucaacgcccgcaucuccgaggucaccgacgucaagaacaagcuccagacccagcucgccaagacccuccaggagaucuuccaggccgagaacaccaucaugcuccucgagcgcuccaucauggccaaggagggcccccucaaggucgcccagacccgccucgagugccgcacccgccgccccaacauggagcucugccgcgacaucccccagcucaagcucgucaacgaggucuucaccaucgacgacacccuccagacccucaagcuccgccuccgcgagacccaggacacccuccagcuccucgucaugaccaagugccgccucgagcacgagcucgccaucaaggccaacacccucugcaucgacaaggagaagugcaugggcaugcgcaagaccuuccccugcaccccccgccucgucggccacaccuga

SEQ ID NO: 50618 - RNA, 2514 nt, Artificial Sequence
  derived and/or modified sequence opt2 from TELO2__Homo_sapiens__NP_057195
auggagcccgcccccuccgagguccgccucgccguccgcgaggccauccacgcccucuccuccuccgaggacggcggccacaucuucugcacccucgagucccucaagcgcuaccucggcgagauggagccccccgcccucccccgcgagaaggaggaguucgccuccgcccacuucucccccguccuccgcugccucgccucccgccucucccccgccuggcucgagcuccucccccacggccgccucgaggagcucugggccuccuucuuccucgagggccccgccgaccaggccuuccucguccucauggagaccaucgagggcgccgccggccccuccuuccgccucaugaagauggcccgccuccucgcccgcuuccuccgcgagggccgccucgccguccucauggaggcccagugccgccagcagacccagcccggcuucauccuccuccgcgagacccuccucggcaaggucgucgcccuccccgaccaccucggcaaccgccuccagcaggagaaccucgccgaguucuucccccagaacuacuuccgccuccucggcgaggaggucguccgcguccuccaggccgucgucgacucccuccagggcggccucgacuccuccgucuccuucgucucccagguccucggcaaggccugcguccacggccgccagcaggagauccucggcguccucgucccccgccucgccgcccucacccagggcuccuaccuccaccagcgcgucugcuggcgccucgucgagcagguccccgaccgcgccauggaggccguccucaccggccucgucgaggccgcccucggccccgagguccucucccgccuccucggcaaccucgucgucaagaacaagaaggcccaguucgucaugacccagaagcuccucuuccuccagucccgccucaccacccccaugcuccagucccuccucggccaccucgccauggacucccagcgccgcccccuccuccuccagguccucaaggagcuccucgagaccuggggcuccuccuccgccauccgccacaccccccucccccagcagcgccacgucuccaaggccguccucaucugccucgcccagcucggcgagcccgagcuccgcgacucccgcgacgagcuccucgccuccaugauggccggcgucaagugccgccucgacuccucccucccccccguccgccgccucggcaugaucgucgccgaggucgucuccgcccgcauccaccccgagggccccccccucaaguuccaguacgaggaggacgagcucucccucgagcuccucgcccucgccuccccccagcccgccggcgacggcgccuccgaggccggcaccucccucguccccgccaccgccgagccccccgccgagacccccgccgagaucgucgacggcggcgucccccaggcccagcucgccggcuccgacuccgaccucgacuccgacgacgaguucguccccuacgacauguccggcgaccgcgagcucaaguccuccaaggcccccgccuacguccgcgacugcgucgaggcccucaccaccuccgaggacaucgagcgcugggaggccgcccuccgcgcccucgagggccucgucuaccgcucccccaccgccacccgcgaggucuccgucgagcucgccaagguccuccuccaccucgaggagaagaccugcgucgucggcuucgccggccuccgccagcgcgcccucgucgccgucaccgucaccgaccccgcccccgucgccgacuaccucaccucccaguucuacgcccucaacuacucccuccgccagcgcauggacauccucgacguccucacccucgccgcccaggagcucucccgccccggcugccucggccgcaccccccagcccggcucccccucccccaacacccccugccuccccgaggccgccgucucccagcccggcuccgccgucgccuccgacuggcgcgucgucgucgaggagcgcauccgcuccaagacccagcgccucuccaagggcggcccccgccagggccccgccggcucccccucccgcuucaacuccgucgccggccacuucuucuucccccuccuccagcgcuucgaccgcccccucgucaccuucgaccuccucggcgaggaccagcucguccucggccgccucgcccacacccucggcgcccucaugugccucgccgucaacaccaccgucgccgucgccaugggcaaggcccuccucgaguucgucugggcccuccgcuuccacaucgacgccuacguccgccagggccuccucuccgccgucuccuccguccuccucucccuccccgccgcccgccuccucgaggaccucauggacgagcuccucgaggcccgcuccuggcucgccgacgucgccgagaaggaccccgacgaggacugccgcacccucgcccuccgcgcccuccuccuccuccagcgccucaagaaccgccuccucccccccgccucccccuga

SEQ ID NO: 50619 - RNA, 8178 nt, Artificial Sequence
  derived and/or modified sequence opt2 from TENM1__Homo_sapiens__NP_055068
auggagcagaccgacugcaagcccuaccagccccuccccaaggucaagcacgagauggaccucgccuacaccuccuccuccgacgaguccgaggacggccgcaagccccgccaguccuacaacucccgcgagacccuccacgaguacaaccaggagcuccgcaugaacuacaacucccagucccgcaagcgcaaggaggucgagaaguccacccaggagauggaguucugcgagaccucccacacccucugcuccggcuaccagaccgacaugcacuccgucucccgccacggcuaccagcucgagaugggcuccgacgucgacaccgagaccgagggcgccgccucccccgaccacgcccuccgcauguggauccgcggcaugaaguccgagcacuccuccugccucuccucccgcgccaacuccgcccucucccucaccgacaccgaccacgagcgcaaguccgacggcgagaacggcuucaaguucucccccgucugcugcgacauggaggcccaggccggcuccacccaggacguccaguccuccccccacaaccaguucaccuuccgcccccucccccccccccccccccccccccacgccugcaccugcgcccgcaagcccccccccgccgccgacucccuccagcgccgcuccaugaccacccgcucccagcccucccccgccgcccccgccccccccaccuccacccaggacuccguccaccuccacaacuccuggguccucaacuccaacaucccccucgagacccgccacuuccucuucaagcacggcuccggcuccuccgccaucuucuccgccgccucccagaacuacccccucaccuccaacaccgucuacuccccccccccccgcccccucccccgcuccaccuucucccgccccgccuucaccuucaacaagcccuaccgcugcugcaacuggaagugcaccgcccucuccgccaccgccaucaccgucacccucgcccuccuccucgccuacgucaucgccguccaccucuucggccucaccuggcagcuccagcccgucgagggcgagcucuacgccaacggcgucuccaagggcaaccgcggcaccgaguccauggacaccaccuacucccccaucggcggcaaggucuccgacaaguccgagaagaaggucuuccagaagggccgcgccaucgacaccggcgaggucgacaucggcgcccaggucaugcagaccaucccccccggccucuucuggcgcuuccagaucaccauccaccaccccaucuaccucaaguucaacaucucccucgccaaggacucccuccucggcaucuacggccgccgcaacaucccccccacccacacccaguucgacuucgucaagcucauggacggcaagcagcucgucaagcaggacuccaagggcuccgacgacacccagcacuccccccgcaaccucauccucaccucccuccaggagaccggcuucaucgaguacauggaccagggccccugguaccucgccuucuacaacgacggcaagaagauggagcaggucuucguccucaccaccgccaucgagaucauggacgacugcuccaccaacugcaacggcaacggcgagugcaucuccggccacugccacugcuuccccggcuuccucggccccgacugcgcccgcgacuccugccccguccucugcggcggcaacggcgaguacgagaagggccacugcgucugccgccacggcuggaagggccccgagugcgacguccccgaggagcagugcaucgaccccaccugcuucggccacggcaccugcaucaugggcgucugcaucugcguccccggcuacaagggcgagaucugcgaggaggaggacugccucgaccccaugugcuccaaccacggcaucugcgucaagggcgagugccacugcuccaccggcuggggcggcgucaacugcgagaccccccuccccgucugccaggagcagugcuccggccacggcaccuuccuccucgacgccggcgucugcuccugcgaccccaaguggaccggcuccgacugcuccaccgagcucugcaccauggagugcggcucccacggcgucugcucccgcggcaucugccagugcgaggagggcugggucggccccaccugcgaggagcgcuccugccacucccacugcaccgagcacggccagugcaaggacggcaagugcgagugcucccccggcugggagggcgaccacugcaccaucgcccacuaccucgacgccguccgcgacggcugccccggccucugcuucggcaacggccgcugcacccucgaccagaacggcuggcacugcgucugccaggucggcugguccggcaccggcugcaacgucgucauggagaugcucugcggcgacaaccucgacaacgacggcgacggccucaccgacugcgucgaccccgacugcugccagcaguccaacugcuacaucuccccccucugccagggcucccccgacccccucgaccucauccagcagucccagacccucuucucccagcacaccucccgccucuucuacgaccgcaucaaguuccucaucggcaaggacuccacccacgucaucccccccgaggucuccuucgacucccgccgcgccugcgucauccgcggccaggucgucgccaucgacggcaccccccucgucggcgucaacgucuccuuccuccaccacuccgacuacggcuucaccaucucccgccaggacggcuccuucgaccucgucgccaucggcggcaucuccgucauccucaucuucgaccgcucccccuuccuccccgagaagcgcacccucuggcuccccuggaaccaguucaucgucgucgagaaggucaccaugcagcgcgucgucuccgacccccccuccugcgacaucuccaacuucaucucccccaaccccaucguccuccccuccccccucaccuccuucggcggcuccugccccgagcgcggcaccaucguccccgagcuccaggucguccaggaggagauccccauccccuccuccuucguccgccucuccuaccucuccucccgcacccccggcuacaagacccuccuccgcauccuccucacccacuccaccauccccgucggcaugaucaagguccaccucaccgucgccgucgagggccgccucacccagaagugguuccccgccgccaucaaccucgucuacaccuucgccuggaacaagaccgacaucuacggccagaaggucuggggccucgccgaggcccucgucuccgucggcuacgaguacgagaccugccccgacuucauccucugggagcagcgcaccgucguccuccagggcuucgagauggacgccuccaaccucggcggcuggucccucaacaagcaccacauccucaacccccaguccggcaucauccacaagggcaacggcgagaacauguucaucucccagcagccccccgucaucuccaccaucaugggcaacggccaccagcgcuccgucgccugcaccaacugcaacggccccgcccacaacaacaagcucuucgcccccgucgcccucgccuccggccccgacggcuccgucuacgucggcgacuucaacuucguccgccgcaucuuccccuccggcaacuccgucuccauccucgagcucuccaccucccccgcccacaaguacuaccucgccauggaccccgucuccgagucccucuaccucuccgacaccaacacccgcaaggucuacaagcucaagucccucgucgagaccaaggaccucuccaagaacuucgaggucgucgccggcaccggcgaccagugccuccccuucgaccagucccacugcggcgacggcggccgcgccuccgaggccucccucaacuccccccgcggcaucaccgucgaccgccacggcuucaucuacuucgucgacggcaccaugauccgcaagaucgacgagaacgccgucaucaccaccgucaucggcuccaacggccucaccuccacccagccccucuccugcgacuccggcauggacaucacccagguccgccucgaguggcccaccgaccucgccgucaaccccauggacaacucccucuacguccucgacaacaacaucguccuccagaucuccgagaaccgccgcguccgcaucaucgccggccgccccauccacugccagguccccggcaucgaccacuuccucgucuccaaggucgccauccacuccacccucgaguccgcccgcgccaucuccgucucccacuccggccuccucuucaucgccgagaccgacgagcgcaaggucaaccgcauccagcaggucaccaccaacggcgagaucuacaucaucgccggcgcccccaccgacugcgacugcaagaucgaccccaacugcgacugcuucuccggcgacggcggcuacgccaaggacgccaagaugaaggcccccuccucccucgccgucucccccgacggcacccucuacgucgccgaccucggcaacguccgcauccgcaccaucucccgcaaccaggcccaccucaacgacaugaacaucuacgagaucgccucccccgccgaccaggagcucuaccaguucaccgucaacggcacccaccuccacacccucaaccucaucacccgcgacuacgucuacaacuucaccuacaacuccgagggcgaccucggcgccaucaccuccuccaacggcaacuccguccacauccgccgcgacgccggcggcaugccccucuggcucgucguccccggcggccaggucuacuggcucaccaucuccuccaacggcguccucaagcgcgucuccgcccagggcuacaaccucgcccucaugaccuaccccggcaacaccggccuccucgccaccaaguccaacgagaacggcuggaccaccgucuacgaguacgaccccgagggccaccucaccaacgccaccuuccccaccggcgaggucuccuccuuccacuccgaccucgagaagcucaccaaggucgagcucgacaccuccaaccgcgagaacguccucauguccaccaaccucaccgccaccuccaccaucuacauccucaagcaggagaacacccaguccaccuaccgcgucaaccccgacggcucccuccgcgucaccuucgccuccggcauggagaucggccucuccuccgagccccacauccucgccggcgccgucaaccccacccucggcaagugcaacaucucccuccccggcgagcacaacgccaaccucaucgaguggcgccagcgcaaggagcagaacaagggcaacgucuccgccuucgagcgccgccuccgcgcccacaaccgcaaccuccucuccaucgacuucgaccacaucacccgcaccggcaagaucuacgacgaccaccgcaaguucacccuccgcauccucuacgaccagaccggccgccccauccucuggucccccgucucccgcuacaacgaggucaacaucaccuacucccccuccggccucgucaccuucauccagcgcggcaccuggaacgagaagauggaguacgaccaguccggcaagaucaucucccgcaccugggccgacggcaagaucugguccuacaccuaccucgagaaguccgucaugcuccuccuccacucccagcgccgcuacaucuucgaguacgaccagcccgacugccuccucuccgucaccaugcccuccaugguccgccacucccuccagaccaugcucuccgucggcuacuaccgcaacaucuacaccccccccgacuccuccaccuccuucauccaggacuacucccgcgacggccgccuccuccagacccuccaccucggcaccggccgccgcguccucuacaaguacaccaagcaggcccgccucuccgagguccucuacgacaccacccaggucacccucaccuacgaggaguccuccggcgucaucaagaccauccaccucaugcacgacggcuucaucugcaccauccgcuaccgccagaccggcccccucaucggccgccagaucuuccgcuucuccgaggagggccucgucaacgcccgcuucgacuacuccuacaacaacuuccgcgucaccuccaugcaggccgucaucaacgagaccccccuccccaucgaccucuaccgcuacgucgacgucuccggccgcaccgagcaguucggcaaguucuccgucaucaacuacgaccucaaccaggucaucaccaccaccgucaugaagcacaccaagaucuucuccgccaacggccaggucaucgagguccaguacgagauccucaaggccaucgccuacuggaugaccauccaguacgacaacgucggccgcauggucaucugcgacauccgcgucggcgucgacgccaacaucacccgcuacuucuacgaguacgacgccgacggccagcuccagaccgucuccgucaacgacaagacccaguggcgcuacuccuacgaccucaacggcaacaucaaccuccucucccacggcaaguccgcccgccucaccccccuccgcuacgaccuccgcgaccgcaucacccgccucggcgagauccaguacaagauggacgaggacggcuuccuccgccagcgcggcaacgacaucuucgaguacaacuccaacggccuccuccagaaggccuacaacaaggccuccggcuggaccguccaguacuacuacgacggccucggccgccgcgucgccuccaaguccucccucggccagcaccuccaguucuucuacgccgaccucaccaaccccauccgcgucacccaccucuacaaccacaccuccuccgagaucaccucccucuacuacgaccuccagggccaccucaucgccauggagcucuccuccggcgaggaguacuacgucgccugcgacaacaccggcaccccccucgccgucuucuccucccgcggccaggucaucaaggagauccucuacacccccuacggcgacaucuaccacgacaccuaccccgacuuccaggucaucaucggcuuccacggcggccucuacgacuuccucaccaagcucguccaccucggccagcgcgacuacgacgucgucgccggccgcuggaccacccccaaccaccacaucuggaagcagcucaaccuccuccccaagcccuucaaccucuacuccuucgagaacaacuaccccgucggcaagauccaggacgucgccaaguacaccaccgacauccgcuccuggcucgagcucuucggcuuccagcuccacaacguccuccccggcuuccccaagcccgagcucgagaaccucgagcucaccuacgagcuccuccgccuccagaccaagacccaggagugggaccccggcaagaccauccucggcauccagugcgagcuccagaagcagcuccgcaacuucaucucccucgaccagcuccccaugaccccccgcuacaacgacggccgcugccucgagggcggcaagcagccccgcuucgccgccguccccuccgucuucggcaagggcaucaaguucgccaucaaggacggcaucgucaccgccgacaucaucggcgucgccaacgaggacucccgccgccucgccgccauccucaacaacgcccacuaccucgagaaccuccacuucaccaucgagggccgcgacacccacuacuucaucaagcucggcucccucgaggaggaccucguccucaucggcaacaccggcggccgccgcauccucgagaacggcgucaacgucaccgucucccagaugaccuccguccucaacggccgcacccgccgcuucgccgacauccagcuccagcacggcgcccucugcuucaacauccgcuacggcaccaccgucgaggaggagaagaaccacguccucgagaucgcccgccagcgcgccgucgcccaggccuggaccaaggagcagcgccgccuccaggagggcgaggagggcauccgcgccuggaccgagggcgagaagcagcagcuccucuccaccggccgcguccagggcuacgacggcuacuucguccucuccgucgagcaguaccucgagcucuccgacuccgccaacaacauccacuucaugcgccaguccgagaucggccgccgcuga

SEQ ID NO: 50620 - RNA, 8298 nt, Artificial Sequence
  derived and/or modified sequence opt2 from TENM2__Homo_sapiens__NP_001116151
auggacgucaaggaccgccgccaccgcucccucacccgcggccgcugcggcaaggagugccgcuacaccuccuccucccucgacuccgaggacugccgcguccccacccagaaguccuacuccuccuccgagacccucaaggccuacgaccacgacucccgcaugcacuacggcaaccgcgucaccgaccucauccaccgcgaguccgacgaguucccccgccagggcaccaacuucacccucgccgagcucggcaucugcgagcccuccccccaccgcuccggcuacugcuccgacaugggcauccuccaccagggcuacucccucuccaccggcuccgacgccgacuccgacaccgagggcggcaugucccccgagcacgccauccgccucuggggccgcggcaucaagucccgccgcuccuccggccucuccucccgcgagaacuccgcccucacccucaccgacuccgacaacgagaacaaguccgacgacgagaacggccgccccaucccccccaccuccucccccucccuccuccccuccgcccagcuccccuccucccacaaccccccccccgucuccugccagaugccccuccucgacuccaacaccucccaccagaucauggacaccaaccccgacgaggaguucucccccaacuccuaccuccuccgcgccugcuccggcccccagcaggccuccuccuccggcccccccaaccaccacucccaguccacccuccgccccccccucccccccccccacaaccacacccucucccaccaccacuccuccgccaacucccucaaccgcaacucccucaccaaccgccgcucccagauccacgcccccgcccccgcccccaacgaccucgccaccacccccgaguccguccagcuccaggacuccuggguccucaacuccaacgucccccucgagacccgccacuuccucuucaagaccuccuccggcuccaccccccucuucuccuccuccucccccggcuacccccucaccuccggcaccgucuacaccccccccccccgccuccucccccgcaacaccuucucccgcaaggccuucaagcucaagaagcccuccaaguacugcuccuggaagugcgccgcccucuccgccaucgccgccgcccuccuccucgccauccuccucgccuacuucaucgccaugcaccuccucggccucaacuggcagcuccagcccgccgacggccacaccuucaacaacggcauccgcaccggccuccccggcaacgacgacgucgccaccaugcccuccggcggcaagguccccuggucccucaagaacuccuccaucgacuccggcgaggccgaggucggccgccgcgucacccaggaggucccccccggcgucuucuggcgcucccagauccacaucucccagccccaguuccucaaguucaacaucucccucggcaaggacgcccucuucggcgucuacauccgccgcggccucccccccucccacgcccaguacgacuucauggagcgccucgacggcaaggagaagugguccgucgucgaguccccccgcgagcgccgcuccauccagacccucguccagaacgaggccgucuucguccaguaccucgacgucggccucuggcaccucgccuucuacaacgacggcaaggacaaggagauggucuccuucaacaccgucguccucgacuccguccaggacugcccccgcaacugccacggcaacggcgagugcgucuccggcgucugccacugcuuccccggcuuccucggcgccgacugcgccaaggccgccugccccguccucugcuccggcaacggccaguacuccaagggcaccugccagugcuacuccggcuggaagggcgccgagugcgacguccccaugaaccagugcaucgaccccuccugcggcggccacggcuccugcaucgacggcaacugcgucugcuccgccggcuacaagggcgagcacugcgaggaggucgacugccucgaccccaccugcuccucccacggcgucugcgucaacggcgagugccucugcucccccggcuggggcggccucaacugcgagcucgcccgcguccagugccccgaccagugcuccggccacggcaccuaccuccccgacaccggccucugcuccugcgaccccaacuggaugggccccgacugcuccgucgaggucugcuccgucgacugcggcacccacggcgucugcaucggcggcgccugccgcugcgaggagggcuggaccggcgccgccugcgaccagcgcgucugccacccccgcugcaucgagcacggcaccugcaaggacggcaagugcgagugccgcgagggcuggaacggcgagcacugcaccaucgacggcugccccgaccucugcaacggcaacggccgcugcacccucggccagaacuccuggcagugcgucugccagaccggcuggcgcggccccggcugcaacgucgccauggagaccuccugcgccgacaacaaggacaacgagggcgacggccucgucgacugccucgaccccgacugcugccuccaguccgccugccagaacucccuccucugccgcggcucccgcgacccccucgacaucauccagcagggccagaccgacuggcccgccgucaaguccuucuacgaccgcaucaagcuccucgccggcaaggacuccacccacaucauccccggcgagaaccccuucaacuccucccucgucucccucauccgcggccaggucgucaccaccgacggcaccccccucgucggcgucaacgucuccuucgucaaguaccccaaguacggcuacaccaucacccgccaggacggcaccuucgaccucaucgccaacggcggcgccucccucacccuccacuucgagcgcgcccccuucaugucccaggagcgcaccgucuggcuccccuggaacuccuucuacgccauggacacccucgucaugaagaccgaggagaacuccauccccuccugcgaccucuccggcuucguccgccccgaccccaucaucaucuccuccccccucuccaccuucuucuccgccgcccccggccagaaccccaucguccccgagacccagguccuccacgaggagaucgagcuccccggcuccaacgucaagcuccgcuaccucuccucccgcaccgccggcuacaagucccuccucaagaucaccaugacccaguccaccgucccccucaaccucauccgcguccaccucauggucgccgucgagggccaccucuuccagaaguccuuccaggccucccccaaccucgccuacaccuucaucugggacaagaccgacgccuacggccagcgcgucuacggccucuccgacgccgucgucuccgucggcuucgaguacgagaccugccccucccucauccucugggagaagcgcaccgcccuccuccagggcuucgagcucgaccccuccaaccucggcggcuggucccucgacaagcaccacauccucaacgucaaguccggcauccuccacaagggcaccggcgagaaccaguuccucacccagcagcccgccaucaucaccuccaucaugggcaacggccgccgccgcuccaucuccugccccuccugcaacggccucgccgagggcaacaagcuccucgcccccgucgcccucgccgucggcaucgacggcucccucuacgucggcgacuucaacuacauccgccgcaucuuccccucccgcaacgucaccuccauccucgagcuccgcaacaaggaguucaagcacuccaacaaccccgcccacaaguacuaccucgccgucgaccccgucuccggcucccucuacgucuccgacaccaacucccgccgcaucuaccgcgucaagucccucuccggcaccaaggaccucgccggcaacuccgaggucgucgccggcaccggcgagcagugccuccccuucgacgaggcccgcugcggcgacggcggcaaggccaucgacgccacccucauguccccccgcggcaucgccgucgacaagaacggccucauguacuucgucgacgccaccaugauccgcaaggucgaccagaacggcaucaucuccacccuccucggcuccaacgaccucaccgccguccgcccccucuccugcgacuccuccauggacgucgcccagguccgccucgaguggcccaccgaccucgccgucaaccccauggacaacucccucuacguccucgagaacaacgucauccuccgcaucaccgagaaccaccaggucuccaucaucgccggccgccccaugcacugccagguccccggcaucgacuacucccucuccaagcucgccauccacuccgcccucgaguccgccuccgccaucgccaucucccacaccggcguccucuacaucaccgagaccgacgagaagaagaucaaccgccuccgccaggucaccaccaacggcgagaucugccuccucgccggcgccgccuccgacugcgacugcaagaacgacgucaacugcaacugcuacuccggcgacgacgccuacgccaccgacgccauccucaacucccccuccucccucgccgucgcccccgacggcaccaucuacaucgccgaccucggcaacauccgcauccgcgccgucuccaagaacaagcccguccucaacgccuucaaccaguacgaggccgccucccccggcgagcaggagcucuacgucuucaacgccgacggcauccaccaguacaccgucucccucgucaccggcgaguaccucuacaacuucaccuacuccaccgacaacgacgucaccgagcucaucgacaacaacggcaacucccucaagauccgccgcgacuccuccggcaugccccgccaccuccucaugcccgacaaccagaucaucacccucaccgucggcaccaacggcggccucaaggucgucuccacccagaaccucgagcucggccucaugaccuacgacggcaacaccggccuccucgccaccaaguccgacgagaccggcuggaccaccuucuacgacuacgaccacgagggccgccucaccaacgucacccgccccaccggcgucgucaccucccuccaccgcgagauggagaaguccaucaccaucgacaucgagaacuccaaccgcgacgacgacgucaccgucaucaccaaccucuccuccgucgaggccuccuacaccgucguccaggaccagguccgcaacuccuaccagcucugcaacaacggcacccuccgcgucauguacgccaacggcaugggcaucuccuuccacuccgagccccacguccucgccggcaccaucacccccaccaucggccgcugcaacaucucccuccccauggagaacggccucaacuccaucgaguggcgccuccgcaaggagcagaucaagggcaaggucaccaucuucggccgcaagcuccgcguccacggccgcaaccuccucuccaucgacuacgaccgcaacauccgcaccgagaagaucuacgacgaccaccgcaaguucacccuccgcaucaucuacgaccaggucggccgccccuuccucuggcuccccuccuccggccucgccgccgucaacgucuccuacuucuucaacggccgccucgccggccuccagcgcggcgccauguccgagcgcaccgacaucgacaagcagggccgcaucgucucccgcauguucgccgacggcaaggucugguccuacuccuaccucgacaaguccaugguccuccuccuccagucccagcgccaguacaucuucgaguacgacuccuccgaccgccuccucgccgucaccaugcccuccgucgcccgccacuccauguccacccacaccuccaucggcuacauccgcaacaucuacaacccccccgaguccaacgccuccgucaucuucgacuacuccgacgacggccgcauccucaagaccuccuuccucggcaccggccgccaggucuucuacaaguacggcaagcucuccaagcucuccgagaucgucuacgacuccaccgccgucaccuucggcuacgacgagaccaccggcguccucaagauggucaaccuccaguccggcggcuucuccugcaccauccgcuaccgcaagaucggcccccucgucgacaagcagaucuaccgcuucuccgaggagggcauggucaacgcccgcuucgacuacaccuaccacgacaacuccuuccgcaucgccuccaucaagcccgucaucuccgagaccccccuccccgucgaccucuaccgcuacgacgagaucuccggcaaggucgagcacuucggcaaguucggcgucaucuacuacgacaucaaccagaucaucaccaccgccgucaugacccucuccaagcacuucgacacccacggccgcaucaaggagguccaguacgagauguuccgcucccucauguacuggaugaccguccaguacgacuccaugggccgcgucaucaagcgcgagcucaagcucggccccuacgccaacaccaccaaguacaccuacgacuacgacggcgacggccagcuccaguccgucgccgucaacgaccgccccaccuggcgcuacuccuacgaccucaacggcaaccuccaccuccucaaccccggcaacuccguccgccucaugccccuccgcuacgaccuccgcgaccgcaucacccgccucggcgacguccaguacaagaucgacgacgacggcuaccucugccagcgcggcuccgacaucuucgaguacaacuccaagggccuccucacccgcgccuacaacaaggccuccggcugguccguccaguaccgcuacgacggcgucggccgccgcgccuccuacaagaccaaccucggccaccaccuccaguacuucuacuccgaccuccacaaccccacccgcaucacccacgucuacaaccacuccaacuccgagaucaccucccucuacuacgaccuccagggccaccucuucgccauggaguccuccuccggcgaggaguacuacgucgccuccgacaacaccggcaccccccucgccgucuucuccaucaacggccucaugaucaagcagcuccaguacaccgccuacggcgagaucuacuacgacuccaaccccgacuuccagauggucaucggcuuccacggcggccucuacgacccccucaccaagcucguccacuucacccagcgcgacuacgacguccucgccggccgcuggaccucccccgacuacaccauguggaagaacgucggcaaggagcccgcccccuucaaccucuacauguucaaguccaacaacccccucuccuccgagcucgaccucaagaacuacgucaccgacgucaaguccuggcucgucauguucggcuuccagcucuccaacaucauccccggcuucccccgcgccaagauguacuucguccccccccccuacgagcucuccgagucccaggccuccgagaacggccagcucaucaccggcguccagcagaccaccgagcgccacaaccaggccuucauggcccucgagggccaggucaucaccaagaagcuccacgccuccauccgcgagaaggccggccacugguucgccaccaccacccccaucaucggcaagggcaucauguucgccaucaaggagggccgcgucaccaccggcgucuccuccaucgccuccgaggacucccgcaaggucgccuccguccucaacaacgccuacuaccucgacaagaugcacuacuccaucgagggcaaggacacccacuacuucgucaagaucggcuccgccgacggcgaccucgucacccucggcaccaccaucggccgcaagguccucgaguccggcgucaacgucaccgucucccagcccacccuccucgucaacggccgcacccgccgcuucaccaacaucgaguuccaguacuccacccuccuccucuccauccgcuacggccucacccccgacacccucgacgaggagaaggcccgcguccucgaccaggcccgccagcgcgcccucggcaccgccugggccaaggagcagcagaaggcccgcgacggccgcgagggcucccgccucuggaccgagggcgagaagcagcagcuccucuccaccggccgcguccagggcuacgagggcuacuacguccuccccgucgagcaguaccccgagcucgccgacuccuccuccaacauccaguuccuccgccagaacgagaugggcaagcgcuga

SEQ ID NO: 50621 - RNA, 8100 nt, Artificial Sequence
  derived and/or modified sequence opt2 from TENM3__Homo_sapiens__NP_001073946
auggacgucaaggagcgccgccccuacugcucccucaccaagucccgccgcgagaaggagcgccgcuacaccaacuccuccgccgacaacgaggagugccgcguccccacccagaaguccuacuccuccuccgagacccucaaggccuucgaccacgacuccucccgccuccucuacggcaaccgcgucaaggaccucguccaccgcgaggccgacgaguucacccgccagggccagaacuucacccuccgccagcucggcgucugcgagcccgccacccgccgcggccucgccuucugcgccgagaugggccucccccaccgcggcuacuccaucuccgccggcuccgacgccgacaccgagaacgaggccgucaugucccccgagcacgccaugcgccucuggggccgcggcgucaaguccggccgcuccuccugccucuccucccgcuccaacuccgcccucacccucaccgacaccgagcacgagaacaaguccgacuccgagaacgagcagcccgccuccaaccagggccaguccacccuccagccccucccccccucccacaagcagcacuccgcccagcaccaccccuccaucaccucccucaaccgcaacucccucaccaaccgccgcaaccagucccccgccccccccgccgcccuccccgccgagcuccagaccacccccgaguccguccagcuccaggacuccuggguccucggcuccaacgucccccucgagucccgccacuuccucuucaagaccggcaccggcaccaccccccucuucuccaccgccacccccggcuacaccauggccuccggcuccgucuacuccccccccacccgcccccucccccgcaacacccucucccgcuccgccuucaaguucaagaaguccuccaaguacugcuccuggaagugcaccgcccucugcgccgucggcgucuccguccuccucgccauccuccucuccuacuucaucgccaugcaccucuucggccucaacuggcagcuccagcagaccgagaacgacaccuucgagaacggcaaggucaacuccgacaccaugcccaccaacaccgucucccuccccuccggcgacaacggcaagcucggcggcuucacccaggagaacaacaccaucgacuccggcgagcucgacaucggccgccgcgccauccaggagaucccccccggcaucuucuggcgcucccagcucuucaucgaccagccccaguuccucaaguucaacaucucccuccagaaggacgcccucaucggcgucuacggccgcaagggccucccccccucccacacccaguacgacuucgucgagcuccucgacggcucccgccucaucgcccgcgagcagcgcucccuccucgagaccgagcgcgccggccgccaggcccgcuccgucucccuccacgaggccggcuucauccaguaccucgacuccggcaucuggcaccucgccuucuacaacgacggcaagaacgccgagcaggucuccuucaacaccaucgucaucgaguccgucgucgagugcccccgcaacugccacggcaacggcgagugcgucuccggcaccugccacugcuuccccggcuuccucggccccgacugcucccgcgccgccugccccguccucugcuccggcaacggccaguacuccaagggccgcugccucugcuucuccggcuggaagggcaccgagugcgacguccccaccacccagugcaucgacccccagugcggcggccgcggcaucugcaucaugggcuccugcgccugcaacuccggcuacaagggcgaguccugcgaggaggccgacugcaucgaccccggcugcuccaaccacggcgucugcauccacggcgagugccacugcucccccggcuggggcggcuccaacugcgagauccucaagaccaugugccccgaccagugcuccggccacggcaccuaccuccaggaguccggcuccugcaccugcgaccccaacuggaccggccccgacugcuccaacgagaucugcuccgucgacugcggcucccacggcgucugcaugggcggcaccugccgcugcgaggagggcuggaccggccccgccugcaaccagcgcgccugccacccccgcugcgccgagcacggcaccugcaaggacggcaagugcgagugcucccagggcuggaacggcgagcacugcaccaucgagggcugccccggccucugcaacuccaacggccgcugcacccucgaccagaacggcuggcacugcgucugccagcccggcuggcgcggcgccggcugcgacgucgccauggagacccucugcaccgacuccaaggacaacgagggcgacggccucaucgacugcauggaccccgacugcugccuccaguccuccugccagaaccagcccuacugccgcggccuccccgacccccaggacaucaucucccagucccuccagucccccucccagcaggccgccaaguccuucuacgaccgcaucuccuuccucaucggcuccgacuccacccacgucauccccggcgagucccccuucaacaagucccucgccuccgucauccgcggccagguccucaccgccgacggcaccccccucaucggcgucaacgucuccuucuuccacuaccccgaguacggcuacaccaucacccgccaggacggcauguucgaccucgucgccaacggcggcgccucccucacccucgucuucgagcgcucccccuuccucacccaguaccacaccgucuggauccccuggaacgucuucuacgucauggacacccucgucaugaagaaggaggagaacgacauccccuccugcgaccucuccggcuucguccgccccaaccccaucaucgucuccuccccccucuccaccuucuuccgcuccucccccgaggacucccccaucauccccgagacccagguccuccacgaggagaccaccauccccggcaccgaccucaagcucuccuaccucuccucccgcgccgccggcuacaaguccguccucaagaucaccaugacccaguccaucauccccuucaaccucaugaagguccaccucauggucgccgucgucggccgccucuuccagaagugguuccccgccucccccaaccucgccuacaccuucaucugggacaagaccgacgccuacaaccagaaggucuacggccucuccgaggccgucgucuccgucggcuacgaguacgaguccugccucgaccucacccucugggagaagcgcaccgccauccuccagggcuacgagcucgacgccuccaacaugggcggcuggacccucgacaagcaccacguccucgacguccagaacggcauccucuacaagggcaacggcgagaaccaguucaucucccagcagccccccgucgucuccuccaucaugggcaacggccgccgccgcuccaucuccugccccuccugcaacggccaggccgacggcaacaagcuccucgcccccgucgcccucgccugcggcaucgacggcucccucuacgucggcgacuucaacuacguccgccgcaucuuccccuccggcaacgucaccuccguccucgagcucuccuccaaccccgcccaccgcuacuaccucgccaccgaccccgucaccggcgaccucuacgucuccgacaccaacacccgccgcaucuaccgccccaagucccucaccggcgccaaggaccucaccaagaacgccgaggucgucgccggcaccggcgagcagugccuccccuucgacgaggcccgcugcggcgacggcggcaaggccgucgaggccacccucaugucccccaagggcauggccgucgacaagaacggccucaucuacuucgucgacggcaccaugauccgcaaggucgaccagaacggcaucaucuccacccuccucggcuccaacgaccucaccuccgcccgcccccucaccugcgacaccuccaugcacaucucccagguccgccucgaguggcccaccgaccucgccaucaaccccauggacaacuccaucuacguccucgacaacaacgucguccuccagaucaccgagaaccgccagguccgcaucgccgccggccgccccaugcacugccagguccccggcgucgaguaccccgucggcaagcacgccguccagaccacccucgaguccgccaccgccaucgccgucuccuacuccggcguccucuacaucaccgagaccgacgagaagaagaucaaccgcauccgccaggucaccaccgacggcgagaucucccucgucgccggcauccccuccgagugcgacugcaagaacgacgccaacugcgacugcuaccaguccggcgacggcuacgccaaggacgccaagcucuccgcccccuccucccucgccgccucccccgacggcacccucuacaucgccgaccucggcaacauccgcauccgcgccgucuccaagaacaagccccuccucaacuccaugaacuucuacgaggucgccucccccaccgaccaggagcucuacaucuucgacaucaacggcacccaccaguacaccgucucccucgucaccggcgacuaccucuacaacuucuccuacuccaacgacaacgacaucaccgccgucaccgacuccaacggcaacacccuccgcauccgccgcgaccccaaccgcaugcccguccgcgucgucucccccgacaaccaggucaucuggcucaccaucggcaccaacggcugccucaaguccaugaccgcccagggccucgagcucguccucuucaccuaccacggcaacuccggccuccucgccaccaaguccgacgagaccggcuggaccaccuucuucgacuacgacuccgagggccgccucaccaacgucaccuuccccaccggcgucgucaccaaccuccacggcgacauggacaaggccaucaccgucgacaucgaguccuccucccgcgaggaggacgucuccaucaccuccaaccucuccuccaucgacuccuucuacaccaugguccaggaccagcuccgcaacuccuaccagaucggcuacgacggcucccuccgcaucaucuacgccuccggccucgacucccacuaccagaccgagccccacguccucgccggcaccgccaaccccaccgucgccaagcgcaacaugacccuccccggcgagaacggccagaaccucgucgaguggcgcuuccgcaaggagcaggcccagggcaaggucaacgucuucggccgcaagcuccgcgucaacggccgcaaccuccucuccgucgacuucgaccgcaccaccaagaccgagaagaucuacgacgaccaccgcaaguuccuccuccgcaucgccuacgacaccuccggccaccccacccucuggcuccccuccuccaagcucauggccgucaacgucaccuacuccuccaccggccagaucgccuccauccagcgcggcaccaccuccgagaaggucgacuacgacggccagggccgcaucgucucccgcgucuucgccgacggcaagaccugguccuacaccuaccucgagaaguccaugguccuccuccuccacucccagcgccaguacaucuucgaguacgacaugugggaccgccucuccgccaucaccaugcccuccgucgcccgccacaccaugcagaccauccgcuccaucggcuacuaccgcaacaucuacaacccccccgaguccaacgccuccaucaucaccgacuacaacgaggagggccuccuccuccagaccgccuuccucggcaccucccgccgcguccucuucaaguaccgccgccagacccgccucuccgagauccucuacgacuccacccgcgucuccuucaccuacgacgagaccgccggcguccucaagaccgucaaccuccaguccgacggcuucaucugcaccauccgcuaccgccagaucggcccccucaucgaccgccagaucuuccgcuucuccgaggacggcauggucaacgcccgcuucgacuacuccuacgacaacuccuuccgcgucaccuccaugcagggcgucaucaacgagaccccccuccccaucgaccucuaccaguucgacgacaucuccggcaaggucgagcaguucggcaaguucggcgucaucuacuacgacaucaaccagaucaucuccaccgccgucaugaccuacaccaagcacuucgacgcccacggccgcaucaaggagauccaguacgagaucuuccgcucccucauguacuggaucaccauccaguacgacaacaugggccgcgucaccaagcgcgagaucaagaucggccccuucgccaacaccaccaaguacgccuacgaguacgacgucgacggccagcuccagaccgucuaccucaacgagaagaucauguggcgcuacaacuacgaccucaacggcaaccuccaccuccucaaccccuccaacuccgcccgccucaccccccuccgcuacgaccuccgcgaccgcaucacccgccucggcgacguccaguaccgccucgacgaggacggcuuccuccgccagcgcggcaccgagaucuucgaguacuccuccaagggccuccucacccgcgucuacuccaagggcuccggcuggaccgucaucuaccgcuacgacggccucggccgccgcgucuccuccaagaccucccucggccagcaccuccaguucuucuacgccgaccucaccuaccccacccgcaucacccacgucuacaaccacuccuccuccgagaucaccucccucuacuacgaccuccagggccaccucuucgccauggagaucuccuccggcgacgaguucuacaucgccuccgacaacaccggcaccccccucgccgucuucuccuccaacggccucaugcucaagcagauccaguacaccgccuacggcgagaucuacuucgacuccaacaucgacuuccagcucgucaucggcuuccacggcggccucuacgacccccucaccaagcucauccacuucggcgagcgcgacuacgacauccucgccggccgcuggaccacccccgacaucgagaucuggaagcgcaucggcaaggaccccgcccccuucaaccucuacauguuccgcaacaacaaccccgccuccaagauccacgacgucaaggacuacaucaccgacgucaacuccuggcucgucaccuucggcuuccaccuccacaacgccauccccggcuuccccguccccaaguucgaccucaccgagcccuccuacgagcucgucaagucccagcagugggacgacaucccccccaucuucggcguccagcagcaggucgcccgccaggccaaggccuuccucucccucggcaagauggccgagguccaggucucccgccgccgcgccggcggcgcccaguccuggcucugguucgccaccgucaagucccucaucggcaagggcgucaugcucgccgucucccagggccgcguccagaccaacguccucaacaucgccaacgaggacugcaucaaggucgccgccguccucaacaacgccuucuaccucgagaaccuccacuucaccaucgagggcaaggacacccacuacuucaucaagaccaccacccccgaguccgaccucggcacccuccgccucaccuccggccgcaaggcccucgagaacggcaucaacgucaccgucucccaguccaccaccgucgucaacggccgcacccgccgcuucgccgacgucgagaugcaguucggcgcccucgcccuccacguccgcuacggcaugacccucgacgaggagaaggcccgcauccucgagcaggcccgccagcgcgcccucgcccgcgccugggcccgcgagcagcagcgcguccgcgacggcgaggagggcgcccgccucuggaccgagggcgagaagcgccagcuccucuccgccggcaagguccagggcuacgacggcuacuacguccucuccgucgagcaguaccccgagcucgccgacuccgccaacaacauccaguuccuccgccaguccgagaucggccgccgcuga

SEQ ID NO: 50622 - RNA, 8310 nt, Artificial Sequence
  derived and/or modified sequence opt2 from TENM4__Homo_sapiens__NP_001092286
auggacgucaaggagcgcaagcccuaccgcucccucacccgccgccgcgacgccgagcgccgcuacaccuccuccuccgccgacuccgaggagggcaaggccccccagaaguccuacuccuccuccgagacccucaaggccuacgaccaggacgcccgccucgccuacggcucccgcgucaaggacaucgucccccaggaggccgaggaguucugccgcaccggcgccaacuucacccuccgcgagcucggccucgaggaggucacccccccccacggcacccucuaccgcaccgacaucggccucccccacugcggcuacuccaugggcgccggcuccgacgccgacauggaggccgacaccguccucucccccgagcaccccguccgccucuggggccgcuccacccgcuccggccgcuccuccugccucuccucccgcgccaacuccaaccucacccucaccgacaccgagcacgagaacaccgagaccgaccaccccggcggccuccagaaccacgcccgccuccgcacccccccccccccccucucccacgcccacacccccaaccagcaccacgccgccuccaucaacucccucaaccgcggcaacuucaccccccgcuccaaccccucccccgcccccaccgaccacucccucuccggcgagccccccgccggcggcgcccaggagcccgcccacgcccaggagaacuggcuccucaacuccaacaucccccucgagacccgcaaccucggcaagcagcccuuccucggcacccuccaggacaaccucaucgagauggacauccucggcgccucccgccacgacggcgccuacuccgacggccacuuccucuucaagcccggcggcaccuccccccucuucugcaccaccucccccggcuacccccucaccuccuccaccgucuacuccccccccccccgcccccucccccgcuccaccuucgcccgccccgccuucaaccucaagaagcccuccaaguacugcaacuggaagugcgccgcccucuccgccaucgucaucuccgccacccucgucauccuccucgccuacuucgucgccaugcaccucuucggccucaacuggcaccuccagcccauggagggccagauguacgagaucaccgaggacaccgccuccuccuggcccguccccaccgacgucucccucuaccccuccggcggcaccggccucgagacccccgaccgcaagggcaagggcaccaccgagggcaagcccuccuccuucuuccccgaggacuccuucaucgacuccggcgagaucgacgucggccgccgcgccucccagaagaucccccccggcaccuucuggcgcucccaggucuucaucgaccaccccguccaccucaaguucaacgucucccucggcaaggccgcccucgucggcaucuacggccgcaagggccucccccccucccacacccaguucgacuucgucgagcuccucgacggccgccgccuccucacccaggaggcccgcucccucgagggcaccccccgccagucccgcggcaccgucccccccuccucccacgagaccggcuucauccaguaccucgacuccggcaucuggcaccucgccuucuacaacgacggcaaggaguccgaggucgucuccuuccucaccaccgccaucgaguccgucgacaacugccccuccaacugcuacggcaacggcgacugcaucuccggcaccugccacugcuuccucggcuuccucggccccgacugcggccgcgccuccugccccguccucugcuccggcaacggccaguacaugaagggccgcugccucugccacuccggcuggaagggcgccgagugcgacguccccaccaaccagugcaucgacgucgccugcuccaaccacggcaccugcaucaccggcaccugcaucugcaaccccggcuacaagggcgaguccugcgaggaggucgacugcauggaccccaccugcuccggccgcggcgucugcguccgcggcgagugccacugcuccgucggcuggggcggcaccaacugcgagaccccccgcgccaccugccucgaccagugcuccggccacggcaccuuccuccccgacaccggccucugcuccugcgaccccuccuggaccggccacgacugcuccaucgagaucugcgccgccgacugcggcggccacggcgucugcgucggcggcaccugccgcugcgaggacggcuggaugggcgccgccugcgaccagcgcgccugccacccccgcugcgccgagcacggcaccugccgcgacggcaagugcgagugcucccccggcuggaacggcgagcacugcaccaucgcccacuaccucgaccgcgucgucaaggagggcugccccggccucugcaacggcaacggccgcugcacccucgaccucaacggcuggcacugcgucugccagcucggcuggcgcggcgccggcugcgacaccuccauggagaccgccugcggcgacuccaaggacaacgacggcgacggccucgucgacugcauggaccccgacugcugccuccagccccucugccacaucaacccccucugccucggcucccccaacccccucgacaucauccaggagacccagguccccgucucccagcagaaccuccacuccuucuacgaccgcaucaaguuccucgucggccgcgacuccacccacaucauccccggcgagaaccccuucgacggcggccacgccugcgucauccgcggccaggucaugaccuccgacggcaccccccucgucggcgucaacaucuccuucgucaacaacccccucuucggcuacaccaucucccgccaggacggcuccuucgaccucgucaccaacggcggcaucuccaucauccuccgcuucgagcgcgcccccuucaucacccaggagcacacccucuggcuccccugggaccgcuucuucgucauggagaccaucaucaugcgccacgaggagaacgagauccccuccugcgaccucuccaacuucgcccgccccaaccccgucgucucccccuccccccucaccuccuucgccuccuccugcgccgagaagggccccaucguccccgagauccaggcccuccaggaggagaucuccaucuccggcugcaagaugcgccucuccuaccucuccucccgcacccccggcuacaaguccguccuccgcaucucccucacccaccccaccauccccuucaaccucaugaagguccaccucauggucgccgucgagggccgccucuuccgcaagugguucgccgccgcccccgaccucuccuacuacuucaucugggacaagaccgacgucuacaaccagaaggucuucggccucuccgaggccuucgucuccgucggcuacgaguacgaguccugccccgaccucauccucugggagaagcgcaccaccguccuccagggcuacgagaucgacgccuccaagcucggcggcuggucccucgacaagcaccacgcccucaacauccaguccggcauccuccacaagggcaacggcgagaaccaguucgucucccagcagccccccgucaucggcuccaucaugggcaacggccgccgccgcuccaucuccugccccuccugcaacggccucgccgacggcaacaagcuccucgcccccgucgcccucaccugcggcuccgacggcucccucuacgucggcgacuucaacuacauccgccgcaucuuccccuccggcaacgucaccaacauccucgagcuccgcaacaaggacuuccgccacucccacucccccgcccacaaguacuaccucgccaccgaccccauguccggcgccgucuuccucuccgacuccaacucccgccgcgucuucaagaucaaguccaccgucgucgucaaggaccucgucaagaacuccgaggucgucgccggcaccggcgaccagugccuccccuucgacgacacccgcugcggcgacggcggcaaggccaccgaggccacccucaccaacccccgcggcaucaccgucgacaaguucggccucaucuacuucgucgacggcaccaugauccgccgcaucgaccagaacggcaucaucuccacccuccucggcuccaacgaccucaccuccgcccgcccccucuccugcgacuccgucauggacaucucccagguccaccucgaguggcccaccgaccucgccaucaaccccauggacaacucccucuacguccucgacaacaacgucguccuccagaucuccgagaaccaccagguccgcaucgucgccggccgccccaugcacugccagguccccggcaucgaccacuuccuccucuccaaggucgccauccacgccacccucgaguccgccaccgcccucgccgucucccacaacggcguccucuacaucgccgagaccgacgagaagaagaucaaccgcauccgccaggucaccaccuccggcgagaucucccucgucgccggcgcccccuccggcugcgacugcaagaacgacgccaacugcgacugcuucuccggcgacgacggcuacgccaaggacgccaagcucaacacccccuccucccucgccgucugcgccgacggcgagcucuacgucgccgaccucggcaacauccgcauccgcuucauccgcaagaacaagcccuuccucaacacccagaacauguacgagcucuccucccccaucgaccaggagcucuaccucuucgacaccaccggcaagcaccucuacacccagucccuccccaccggcgacuaccucuacaacuucaccuacaccggcgacggcgacaucacccucaucaccgacaacaacggcaacauggucaacguccgccgcgacuccaccggcaugccccucuggcucgucguccccgacggccaggucuacugggucaccaugggcaccaacuccgcccucaaguccgucaccacccagggccacgagcucgccaugaugaccuaccacggcaacuccggccuccucgccaccaaguccaacgagaacggcuggaccaccuucuacgaguacgacuccuucggccgccucaccaacgucaccuuccccaccggccaggucuccuccuuccgcuccgacaccgacuccuccguccacguccaggucgagaccuccuccaaggacgacgucaccaucaccaccaaccucuccgccuccggcgccuucuacacccuccuccaggaccagguccgcaacuccuacuacaucggcgccgacggcucccuccgccuccuccucgccaacggcauggaggucgcccuccagaccgagccccaccuccucgccggcaccgucaaccccaccgucggcaagcgcaacgucacccuccccaucgacaacggccucaaccucgucgaguggcgccagcgcaaggagcaggcccgcggccaggucaccgucuucggccgccgccuccgcguccacaaccgcaaccuccucucccucgacuucgaccgcgucacccgcaccgagaagaucuacgacgaccaccgcaaguucacccuccgcauccucuacgaccaggccggccgccccucccucuggucccccuccucccgccucaacggcgucaacgucaccuacucccccggcggcuacaucgccggcauccagcgcggcaucauguccgagcgcauggaguacgaccaggccggccgcaucaccucccgcaucuucgccgacggcaagaccugguccuacaccuaccucgagaaguccaugguccuccuccuccacucccagcgccaguacaucuucgaguucgacaagaacgaccgccucuccuccgucaccaugcccaacgucgcccgccagacccucgagaccauccgcuccgucggcuacuaccgcaacaucuaccagccccccgagggcaacgccuccgucauccaggacuucaccgaggacggccaccuccuccacaccuucuaccucggcaccggccgccgcgucaucuacaaguacggcaagcucuccaagcucgccgagacccucuacgacaccaccaaggucuccuucaccuacgacgagaccgccggcaugcucaagaccaucaaccuccagaacgagggcuucaccugcaccauccgcuaccgccagaucggcccccucaucgaccgccagaucuuccgcuucaccgaggagggcauggucaacgcccgcuucgacuacaacuacgacaacuccuuccgcgucaccuccaugcaggccgucaucaacgagaccccccuccccaucgaccucuaccgcuacgacgacgucuccggcaagaccgagcaguucggcaaguucggcgucaucuacuacgacaucaaccagaucaucaccaccgccgucaugacccacaccaagcacuucgacgccuacggccgcaugaaggagguccaguacgagaucuuccgcucccucauguacuggaugaccguccaguacgacaacaugggccgcgucgucaagaaggagcucaaggucggccccuacgccaacaccacccgcuacuccuacgaguacgacgccgacggccagcuccagaccgucuccaucaacgacaagccccucuggcgcuacuccuacgaccucaacggcaaccuccaccuccucucccccggcaacuccgcccgccucaccccccuccgcuacgacauccgcgaccgcaucacccgccucggcgacguccaguacaagauggacgaggacggcuuccuccgccagcgcggcggcgacaucuucgaguacaacuccgccggccuccucaucaaggccuacaaccgcgccggcuccugguccguccgcuaccgcuacgacggccucggccgccgcgucuccuccaaguccucccacucccaccaccuccaguucuucuacgccgaccucaccaaccccaccaaggucacccaccucuacaaccacuccuccuccgagaucaccucccucuacuacgaccuccagggccaccucuucgccauggagcucuccuccggcgacgaguucuacaucgccugcgacaacaucggcaccccccucgccgucuucuccggcaccggccucaugaucaagcagauccucuacaccgccuacggcgagaucuacauggacaccaaccccaacuuccagaucaucaucggcuaccacggcggccucuacgacccccucaccaagcucguccacaugggccgccgcgacuacgacguccucgccggccgcuggaccucccccgaccacgagcucuggaagcaccucuccuccuccaacgucaugcccuucaaccucuacauguucaagaacaacaaccccaucuccaacucccaggacaucaagugcuucaugaccgacgucaacuccuggcuccucaccuucggcuuccagcuccacaacgucauccccggcuaccccaagcccgacauggacgccauggagcccuccuacgagcucauccacacccagaugaagacccaggagugggacaacuccaaguccauccucggcguccagugcgagguccagaagcagcucaaggccuucgucacccucgagcgcuucgaccagcucuacggcuccaccaucaccuccugccagcaggcccccaagaccaagaaguucgccuccuccggcuccgucuucggcaagggcgucaaguucgcccucaaggacggccgcgucaccaccgacaucaucuccgucgccaacgaggacggccgccgcgucgccgccauccucaaccacgcccacuaccucgagaaccuccacuucaccaucgacggcgucgacacccacuacuucgucaagcccggccccuccgagggcgaccucgccauccucggccucuccggcggccgccgcacccucgagaacggcgucaacgucaccgucucccagaucaacaccguccucaacggccgcacccgccgcuacaccgacauccagcuccaguacggcgcccucugccucaacacccgcuacggcaccacccucgacgaggagaaggcccgcguccucgagcucgcccgccagcgcgccguccgccaggccugggcccgcgagcagcagcgccuccgcgagggcgaggagggccuccgcgccuggaccgagggcgagaagcagcagguccucuccaccggccgcguccagggcuacgacggcuucuucgucaucuccgucgagcaguaccccgagcucuccgacuccgccaacaacauccacuucaugcgccaguccgagaugggccgccgcuga

SEQ ID NO: 50623 - RNA, 7884 nt, Artificial Sequence
  derived and/or modified sequence opt2 from TEP1__Homo_sapiens__XP_005268084
auggagaagcuccacggccacgucuccgcccaccccgacauccucucccucgagaaccgcugccucgccaugcuccccgaccuccagccccucgagaagcuccaccagcacgucuccacccacuccgacauccucucccucaagaaccagugccucgccacccuccccgaccucaagaccauggagaagccccacggcuacgucuccgcccaccccgacauccucucccucgagaaccagugccucgccacccucuccgaccucaagaccauggagaagccccacggccacgucuccgcccaccccgacauccucucccucgagaaccgcugccucgccacccucuccucccucaaguccaccgucuccgccuccccccucuuccagucccuccagaucucccacaugacccaggccgaccucuaccgcgucaacaacuccaacugccuccucuccgagccccccuccuggcgcgcccagcacuucuccaagggccucgaccucuccaccugccccaucgcccucaaguccaucuccgccaccgagaccgcccaggaggccacccucggccgcugguucgacuccgaggagaagaagggcgccgagacccagaugcccuccuacucccucucccucggcgaggaggaggaggucgaggaccucgccgucaagcucaccuccggcgacuccgagucccaccccgagcccaccgaccacguccuccaggagaagaagauggcccuccucucccuccucugcuccacccucgucuccgaggucaacaugaacaacaccuccgaccccacccucgccgccaucuucgagaucugccgcgagcucgcccuccucgagcccgaguucauccucaaggccucccucuacgcccgccagcagcucaacguccgcaacgucgccaacaacauccucgccaucgccgccuuccuccccgccugccgcccccaccuccgccgcuacuucugcgccaucguccagcuccccuccgacuggauccaggucgccgagcucuaccagucccucgccgagggcgacaagaacaagcucgucccccuccccgccugccuccgcaccgccaugaccgacaaguucgcccaguucgacgaguaccagcucgccaaguacaacccccgcaagcaccgcgccaagcgccacccccgccgccccccccgcucccccggcauggagccccccuucucccaccgcugcuucccccgcuacaucggcuuccuccgcgaggagcagcgcaaguucgagaaggccggcgacaccgucuccgagaagaagaaccccccccgcuucacccucaagaagcucguccagcgccuccacauccacaagcccgcccagcacguccaggcccuccucggcuaccgcuaccccuccaaccuccagcucuucucccgcucccgccuccccggccccugggacuccucccgcgccggcaagcgcaugaagcucucccgccccgagaccugggagcgcgagcucucccuccgcggcaacaaggccuccgucugggaggagcucaucgagaacggcaagcuccccuucauggccaugcuccgcaaccucugcaaccuccuccgcgucggcaucuccucccgccaccacgagcucauccuccagcgccuccagcacgccaaguccgucauccacucccgccaguuccccuuccgcuuccucaacgcccacgacgccaucgacgcccucgaggcccagcuccgcaaccaggcccuccccuuccccuccaacaucacccucaugcgccgcauccucacccgcaacgagaagaaccgcccccgccgccgcuuccucugccaccucucccgccagcagcuccgcauggccaugcgcauccccguccucuacgagcagcucaagcgcgagaagcuccgcguccacaaggcccgccaguggaaguacgacggcgagaugcucaaccgcuaccgccaggcccucgagaccgccgucaaccucuccgucaagcacucccucccccuccuccccggccgcaccguccucgucuaccucaccgacgccaacgccgaccgccucugccccaaguccaacccccagggccccccccucaacuacgcccuccuccucaucggcaugaugaucacccgcgccgagcaggucgacgucguccucugcggcggcgacacccucaagaccgccguccucaaggccgaggagggcauccucaagaccgccaucaagcuccaggcccagguccaggaguucgacgagaacgacggcuggucccucaacaccuucggcaaguaccuccucucccucgccggccagcgcguccccgucgaccgcgucauccuccucggccaguccauggacgacggcaugaucaacgucgccaagcagcucuacuggcagcgcgucaacuccaagugccucuucgucggcauccuccuccgccgcguccaguaccucuccaccgaccucaaccccaacgacgucacccucuccggcugcaccgacgccauccucaaguucaucgccgagcacggcgccucccaccuccucgagcacgucggccagauggacaagaucuucaagaucccccccccccccggcaagaccggcguccagucccuccgcccccucgaggaggacacccccuccccccucgcccccgucucccagcagggcuggcgcuccauccgccucuucaucuccuccaccuuccgcgacaugcacggcgagcgcgaccuccuccuccgcuccguccuccccgcccuccaggcccgcgccgccccccaccgcaucucccuccacggcaucgaccuccgcuggggcgucaccgaggaggagacccgccgcaaccgccagcucgaggucugccucggcgaggucgagaacgcccagcucuucgucggcauccucggcucccgcuacggcuacaucccccccuccuacaaccuccccgaccacccccacuuccacugggcccagcaguaccccuccggccgcuccgucaccgagauggaggucaugcaguuccucaaccgcaaccagcgccuccagcccuccgcccaggcccucaucuacuuccgcgacuccuccuuccucuccuccguccccgacgccuggaaguccgacuucgucuccgaguccgaggaggccgcccgccgcaucuccgagcucaaguccuaccucucccgccagaagggcaucaccugccgccgcuaccccugcgaguggggcggcgucgccgccggccgccccuacgucggcggccucgaggaguucggccagcucguccuccaggacgucuggaacaugauccagaagcucuaccuccagcccggcgcccuccucgagcagcccgucuccauccccgacgacgaccucguccaggccaccuuccagcagcuccagaagccccccucccccgcccgcccccgccuccuccaggacaccguccagcgccucaugcucccccacggccgccucucccucgucaccggccaguccggccagggcaagaccgccuuccucgccucccucgucuccgcccuccaggcccccgacggcgccaaggucgccucccucgucuucuuccacuucuccggcgcccgccccgaccagggccucgcccucacccuccuccgccgccucugcaccuaccuccgcggccagcucaaggagcccggcgcccuccccuccaccuaccgcucccucgucugggagcuccagcagcgccuccuccccaaguccgccgagucccuccaccccggccagacccagguccucaucaucgacggcgccgaccgccucgucgaccagaacggccagcucaucuccgacuggauccccaagaagcucccccgcugcguccaccucguccucuccgucuccuccgacgccggccucggcgagacccucgagcagucccagggcgcccacguccucgcccucggcccccucgaggccuccgcccgcgcccgccucguccgcgaggagcucgcccucuacggcaagcgccucgaggagucccccuucaacaaccagaugcgccuccuccucgucaagcgcgaguccggccgcccccucuaccuccgccucgucaccgaccaccuccgccucuucacccucuacgagcaggucuccgagcgccuccgcacccuccccgccaccgucccccuccuccuccagcacauccucuccacccucgagaaggagcacggccccgacguccucccccaggcccucaccgcccucgaggucacccgcuccggccucaccgucgaccagcuccacggcguccucuccgucuggcgcacccuccccaagggcaccaaguccugggaggaggccgucgccgccggcaacuccggcgaccccuaccccaugggccccuucgccugccucguccagucccuccgcucccuccucggcgagggcccccucgagcgccccggcgcccgccucugccuccccgacggcccccuccgcaccgccgccaagcgcugcuacggcaagcgccccggccucgaggacaccgcccacauccucaucgccgcccagcucuggaagaccugcgacgccgacgccuccggcaccuuccgcuccugcccccccgaggcccucggcgaccuccccuaccaccuccuccaguccggcaaccgcggccuccucuccaaguuccucaccaaccuccacgucgucgccgcccaccucgagcucggccucgucucccgccuccucgaggcccacgcccucuacgccuccuccguccccaaggaggagcagaagcuccccgaggccgacgucgccgucuuccgcaccuuccuccgccagcaggccuccauccucucccaguacccccgccuccucccccagcaggccgccaaccagccccucgacuccccccucugccaccaggccucccuccucucccgccgcuggcaccuccagcacacccuccgcuggcucaacaagccccgcaccaugaagaaccagcaguccuccucccucucccucgccgucuccuccucccccaccgccgucgccuucuccaccaacggccagcgcgccgccgucggcaccgccaacggcaccgucuaccuccucgaccuccgcaccuggcaggaggagaaguccgucgucuccggcugcgacggcaucuccgccugccucuuccucuccgacgacacccucuuccucaccgccuucgacggccuccucgagcucugggaccuccagcacggcugccgcguccuccagaccaaggcccaccaguaccagaucaccggcugcugccucucccccgacugccgccuccucgccaccgucugccucggcggcugccucaagcucugggacaccguccgcggccagcucgccuuccagcacaccuaccccaagucccucaacugcgucgccuuccaccccgagggccaggucaucgccaccggcuccugggccggcuccaucuccuucuuccaggucgacggccucaaggucaccaaggaccucggcgcccccggcgccuccauccgcacccucgccuucaacguccccggcggcgucgucgccgucggccgccucgacuccauggucgagcucugggccuggcgcgagggcgcccgccucgccgccuuccccgcccaccacggcuucgucgccgccgcccucuuccuccacgccggcugccagcuccucaccgccggcgaggacggcaagguccaggucugguccggcucccucggccgcccccgcggccaccucggcucccucucccucucccccgcccucuccgucgcccucucccccgacggcgaccgcgucgccgucggcuaccgcgccgacggcauccgcaucuacaagaucuccuccggcucccagggcgcccagggccaggcccucgacgucgccgucuccgcccucgccuggcucucccccaagguccucgucuccggcgccgaggacggcucccuccagggcugggcccucaaggagugcucccuccagucccucuggcuccucucccgcuuccagaagcccguccucggccucgccaccucccaggagcuccucgccuccgccuccgaggacuucaccguccagcucuggccccgccagcuccucacccgcccccacaaggccgaggacuuccccugcggcaccgagcuccgcggccacgagggccccgucuccugcugcuccuucuccaccgacggcggcucccucgccaccggcggccgcgaccgcucccuccucugcugggacguccgcacccccaagacccccguccucauccacuccuuccccgccugccaccgcgacugggucaccggcugcgccuggaccaaggacaaccuccucaucuccugcuccuccgacggcuccgucggccucugggaccccgaguccggccagcgccucggccaguuccucggccaccaguccgccgucuccgccgucgccgccgucgaggagcacgucgucuccgucucccgcgacggcacccucaaggucugggaccaccagggcgucgagcucaccuccauccccgcccacuccggccccaucucccacugcgccgccgccauggagccccgcgccgccggccagcccggcuccgagcuccucgucgucaccgucggccucgacggcgccacccgccucuggcacccccuccucgucugccagacccacacccuccucggccacuccggccccguccgcgccgccgccgucuccgagaccuccggccucaugcucaccgccuccgaggacggcuccguccgccucuggcagguccccaaggaggccgacgacaccugcaucccccgcuccuccgccgccgucaccgccgucgccugggcccccgacggcuccauggccgucuccggcaaccaggccggcgagcucauccucuggcaggaggccaaggccgucgccaccgcccaggcccccggccacaucggcgcccucaucugguccuccgcccacaccuucuucguccucuccgccgacgagaagaucuccgaguggcaggucaagcuccgcaagggcuccgcccccggcaaccucucccuccaccucaaccgcauccuccaggaggaccucggcguccucaccucccucgacugggcccccgacggccacuuccucauccucgccaaggccgaccucaagcuccucugcaugaagcccggcgacgcccccuccgagaucugguccuccuacaccgagaaccccaugauccucuccacccacaaggaguacggcaucuucguccuccagcccaaggaccccggcguccucuccuuccuccgccagaaggaguccggcgaguucgaggagcgccucaacuucgacaucaaccucgagaaccccucccgcacccucaucuccaucacccaggccaagcccgaguccgaguccuccuuccucugcgccuccuccgacggcauccucuggaaccucgccaagugcucccccgagggcgaguggaccaccggcaacauguggcagaagaaggccaacacccccgagacccagacccccggcaccgaccccuccaccugccgcgaguccgacgccuccauggacuccgacgccuccauggacuccgagcccaccccccaccucaagacccgccagcgccgcaagauccacuccggcuccgucaccgcccuccacguccuccccgagcuccucgucaccgccuccaaggaccgcgacgucaagcucugggagcgccccuccaugcagcuccucggccucuuccgcugcgagggcuccgucuccugccucgagcccuggcucggcgccaacuccacccuccagcucgccgucggcgacguccagggcaacgucuacuuccucaacugggaguga

SEQ ID NO: 50624 - RNA, 897 nt, Artificial Sequence
  derived and/or modified sequence opt2 from TEPP__Homo_sapiens__NP_950247
augggcaucgucugcgcccagugcuccuucauccuccuccucuccaucauccgcgcccgccccccccccuuccucuucugcccccucuccucccagcgcaccgagucccccuacaagcccguccaccucggccucggccccaccgacaaggucgccgccaucgccauggcccgcaucaucgaccucguccccugggacgacggcuccacccacgucuacgccucccccgccauccuccuccccauggagcgccagcgcaaccagcucgccggcgucaagcagcagcucuaccaccccgcccuccccacccuccgccacauggaccgcgacaccgucaaggccugccuccccgacgagcacugccaguccaccaccuacugccgcaaggacgaguucgacaacgcccacuucacccuccucggcguccccaacaagccccuccagugccucgacaucaccgccaccggccagaagcuccgcaaccgcuaccacgagggcaagcucgcccccaucgcccccggcaucaaccgcgucgacuggcccugcuucacccgcgccaucgaggacuggucccacuucgucuccuccgccggcgaguucaagcuccccugccuccgcaagcgcgccgagggccucuccggcuacgccguccgcuaccucaagcccgacgucacccagaccuggcgccaggaggcccucugcggcgccugggccggccgccccugcucccccgacuccccccgccccuaccccugcugccccccccaguacugccucucccagaaccccucccucgaccgcuacggccagaagccccuccccuucgacucccucaacaccuuccgcuccuucggcuccuccuacucccgcgucaacuaccucacccccuggcacuga

SEQ ID NO: 50625 - RNA, 1260 nt, Artificial Sequence
  derived and/or modified sequence opt2 from TERF1__Homo_sapiens__NP_003209
auggccgaggacgucuccuccgccgcccccuccccccgcggcugcgccgacggccgcgacgccgaccccaccgaggagcagauggccgagaccgagcgcaacgacgaggagcaguucgagugccaggagcuccucgagugccagguccaggucggcgcccccgaggaggaggaggaggaggaggaggacgccggccucgucgccgaggccgaggccgucgccgccggcuggaugcucgacuuccucugccucucccucugccgcgccuuccgcgacggccgcuccgaggacuuccgccgcacccgcaacuccgccgaggccaucauccacggccucuccucccucaccgccugccagcuccgcaccaucuacaucugccaguuccucacccgcaucgccgccggcaagacccucgacgcccaguucgagaacgacgagcgcaucaccccccucgaguccgcccucaugaucuggggcuccaucgagaaggagcacgacaagcuccacgaggagauccagaaccucaucaagauccaggccaucgccgucugcauggagaacggcaacuucaaggaggccgaggaggucuucgagcgcaucuucggcgaccccaacucccacaugcccuucaaguccaagcuccucaugaucaucucccagaaggacaccuuccacuccuucuuccagcacuucuccuacaaccacaugauggagaagaucaaguccuacgucaacuacguccucuccgagaaguccuccaccuuccucaugaaggccgccgccaaggucgucgaguccaagcgcacccgcaccaucaccucccaggacaagcccuccggcaacgacgucgagauggagaccgaggccaaccucgacacccgcaagcgcucccacaagaaccucuuccucuccaagcuccagcacggcacccagcagcaggaccucaacaagaaggagcgccgcgucggcaccccccaguccaccaagaagaagaaggagucccgccgcgccaccgagucccgcauccccgucuccaagucccagcccgucacccccgagaagcaccgcgcccgcaagcgccaggccuggcucugggaggaggacaagaaccuccgcuccggcguccgcaaguacggcgagggcaacugguccaagauccuccuccacuacaaguucaacaaccgcaccuccgucaugcucaaggaccgcuggcgcaccaugaagaagcucaagcucaucuccuccgacuccgaggacuga

SEQ ID NO: 50626 - RNA, 1629 nt, Artificial Sequence
  derived and/or modified sequence opt2 from TERF2__Homo_sapiens__NP_005643
auggccgccggcgccggcaccgccggccccgccuccggccccggcgucguccgcgaccccgccgccucccagccccgcaagcgccccggccgcgagggcggcgagggcgcccgccgcuccgacaccauggccggcggcggcggcuccuccgacggcuccggccgcgccgccggccgccgcgccucccgcuccuccggccgcgcccgccgcggccgccacgagcccggccucggcggccccgccgagcgcggcgccggcgaggcccgccucgaggaggccgucaaccgcuggguccucaaguucuacuuccacgaggcccuccgcgccuuccgcggcucccgcuacggcgacuuccgccagauccgcgacaucaugcaggcccuccucguccgcccccucggcaaggagcacaccgucucccgccuccuccgcgucaugcagugccucucccgcaucgaggagggcgagaaccucgacugcuccuucgacauggaggccgagcucaccccccucgaguccgccaucaacguccucgagaugaucaagaccgaguucacccucaccgaggccgucgucgaguccucccgcaagcucgucaaggaggccgccgucaucaucugcaucaagaacaaggaguucgagaaggccuccaagauccucaagaagcacauguccaaggaccccaccacccagaagcuccgcaacgaccuccucaacaucauccgcgagaagaaccucgcccaccccgucauccagaacuucuccuacgagaccuuccagcagaagaugcuccgcuuccucgagucccaccucgacgacgccgagcccuaccuccucaccauggccaagaaggcccucaaguccgaguccgccgccuccuccaccggcaaggaggacaagcagcccgcccccggccccgucgagaagcccccccgcgagcccgcccgccagcuccgcaacccccccaccaccaucggcaugaugacccucaaggccgccuucaagacccucuccggcgcccaggacuccgaggccgccuucgccaagcucgaccagaaggaccucguccuccccacccaggcccuccccgccucccccgcccucaagaacaagcgcccccgcaaggacgagaacgaguccuccgcccccgccgacggcgagggcggcuccgagcuccagcccaagaacaagcgcaugaccaucucccgccucguccucgaggaggacucccaguccaccgagcccuccgccggccucaacuccucccaggaggccgccuccgccccccccuccaagcccaccguccucaaccagccccuccccggcgagaagaaccccaagguccccaagggcaaguggaacuccuccaacggcgucgaggagaaggagaccugggucgaggaggacgagcucuuccagguccaggccgcccccgacgaggacuccaccaccaacaucaccaagaagcagaaguggaccgucgaggaguccgagugggucaaggccggcguccagaaguacggcgagggcaacugggccgccaucuccaagaacuaccccuucgucaaccgcaccgccgucaugaucaaggaccgcuggcgcaccaugaagcgccucggcaugaacuga

SEQ ID NO: 50627 - RNA, 1200 nt, Artificial Sequence
  derived and/or modified sequence opt2 from TERF2IP__Homo_sapiens__NP_061848
auggccgaggccauggaccucggcaaggaccccaacggccccacccacuccuccacccucuucguccgcgacgacggcuccuccauguccuucuacguccgccccucccccgccaagcgccgccucuccacccucauccuccacggcggcggcaccgucugccgcguccaggagcccggcgccguccuccucgcccagcccggcgaggcccucgccgaggccuccggcgacuucaucuccacccaguacauccucgacugcgucgagcgcaacgagcgccucgagcucgaggccuaccgccucggccccgccuccgccgccgacaccggcuccgaggccaagcccggcgcccucgccgagggcgccgccgagcccgagccccagcgccacgccggccgcaucgccuucaccgacgccgacgacgucgccauccucaccuacgucaaggagaacgcccgcucccccuccuccgucaccggcaacgcccucuggaaggccauggagaaguccucccucacccagcacuccuggcagucccucaaggaccgcuaccucaagcaccuccgcggccaggagcacaaguaccuccucggcgacgcccccgucucccccuccucccagaagcucaagcgcaaggccgaggaggaccccgaggccgccgacuccggcgagccccagaacaagcgcacccccgaccuccccgaggaggaguacgucaaggaggagauccaggagaacgaggaggccgucaagaagaugcucgucgaggccacccgcgaguucgaggaggucgucgucgacgaguccccccccgacuucgagauccacaucaccaugugcgacgacgacccccccacccccgaggaggacuccgagacccagcccgacgaggaggaggaggaggaggaggagaaggucucccagcccgaggucggcgccgccaucaagaucauccgccagcucauggagaaguucaaccucgaccucuccaccgucacccaggccuuccucaagaacuccggcgagcucgaggccaccuccgccuuccucgccuccggccagcgcgccgacggcuaccccaucuggucccgccaggacgacaucgaccuccagaaggacgacgaggacacccgcgaggcccucgucaagaaguucggcgcccagaacgucgcccgccgcaucgaguuccgcaagaaguga

SEQ ID NO: 50628 - RNA, 3210 nt, Artificial Sequence
  derived and/or modified sequence opt2 from TERT__Homo_sapiens__NP_001180305
augccccgcgccccccgcugccgcgccguccgcucccuccuccgcucccacuaccgcgagguccucccccucgccaccuucguccgccgccucggcccccagggcuggcgccucguccagcgcggcgaccccgccgccuuccgcgcccucgucgcccagugccucgucugcguccccugggacgcccgccccccccccgccgcccccuccuuccgccaggucuccugccucaaggagcucgucgcccgcguccuccagcgccucugcgagcgcggcgccaagaacguccucgccuucggcuucgcccuccucgacggcgcccgcggcggcccccccgaggccuucaccaccuccguccgcuccuaccuccccaacaccgucaccgacgcccuccgcggcuccggcgccuggggccuccuccuccgccgcgucggcgacgacguccucguccaccuccucgcccgcugcgcccucuucguccucgucgcccccuccugcgccuaccaggucugcggccccccccucuaccagcucggcgccgccacccaggcccgcccccccccccacgccuccggcccccgccgccgccucggcugcgagcgcgccuggaaccacuccguccgcgaggccggcgucccccucggccuccccgcccccggcgcccgccgccgcggcggcuccgccucccgcucccucccccuccccaagcgcccccgccgcggcgccgcccccgagcccgagcgcacccccgucggccagggcuccugggcccaccccggccgcacccgcggccccuccgaccgcggcuucugcgucgucucccccgcccgccccgccgaggaggccaccucccucgagggcgcccucuccggcacccgccacucccaccccuccgucggccgccagcaccacgccggcccccccuccaccucccgccccccccgccccugggacacccccugcccccccgucuacgccgagaccaagcacuuccucuacuccuccggcgacaaggagcagcuccgccccuccuuccuccucuccucccuccgccccucccucaccggcgcccgccgccucgucgagaccaucuuccucggcucccgccccuggaugcccggcaccccccgccgccucccccgccucccccagcgcuacuggcagaugcgcccccucuuccucgagcuccucggcaaccacgcccagugccccuacggcguccuccucaagacccacugcccccuccgcgccgccgucacccccgccgccggcgucugcgcccgcgagaagccccagggcuccgucgccgcccccgaggaggaggacaccgacccccgccgccucguccagcuccuccgccagcacuccucccccuggcaggucuacggcuucguccgcgccugccuccgccgccucgucccccccggccucuggggcucccgccacaacgagcgccgcuuccuccgcaacaccaagaaguucaucucccucggcaagcacgccaagcucucccuccaggagcucaccuggaagauguccguccgcgacugcgccuggcuccgccgcucccccggcgucggcugcguccccgccgccgagcaccgccuccgcgaggagauccucgccaaguuccuccacuggcucauguccgucuacgucgucgagcuccuccgcuccuucuucuacgucaccgagaccaccuuccagaagaaccgccucuucuucuaccgcaaguccgucugguccaagcuccaguccaucggcauccgccagcaccucaagcgcguccagcuccgcgagcucuccgaggccgagguccgccagcaccgcgaggcccgccccgcccuccucaccucccgccuccgcuucauccccaagcccgacggccuccgccccaucgucaacauggacuacgucgucggcgcccgcaccuuccgccgcgagaagcgcgccgagcgccucaccucccgcgucaaggcccucuucuccguccucaacuacgagcgcgcccgccgccccggccuccucggcgccuccguccucggccucgacgacauccaccgcgccuggcgcaccuucguccuccgcguccgcgcccaggaccccccccccgagcucuacuucgucaaggucgacgucaccggcgccuacgacaccaucccccaggaccgccucaccgaggucaucgccuccaucaucaagccccagaacaccuacugcguccgccgcuacgccgucguccagaaggccgcccacggccacguccgcaaggccuucaagucccacgucuccacccucaccgaccuccagcccuacaugcgccaguucgucgcccaccuccaggagaccuccccccuccgcgacgccgucgucaucgagcaguccuccucccucaacgaggccuccuccggccucuucgacgucuuccuccgcuucaugugccaccacgccguccgcauccgcggcaaguccuacguccagugccagggcaucccccagggcuccauccucuccacccuccucugcucccucugcuacggcgacauggagaacaagcucuucgccggcauccgccgcgacggccuccuccuccgccucgucgacgacuuccuccucgucaccccccaccucacccacgccaagaccuuccucuccuacgcccgcaccuccauccgcgccucccucaccuucaaccgcggcuucaaggccggccgcaacaugcgccgcaagcucuucggcguccuccgccucaagugccacucccucuuccucgaccuccaggucaacucccuccagaccgucugcaccaacaucuacaagauccuccuccuccaggccuaccgcuuccacgccugcguccuccagcuccccuuccaccagcaggucuggaagaaccccaccuucuuccuccgcgucaucuccgacaccgccucccucugcuacuccauccucaaggccaagaacgccggcaugucccucggcgccaagggcgccgccggcccccuccccuccgaggccguccaguggcucugccaccaggccuuccuccucaagcucacccgccaccgcgucaccuacgucccccuccucggcucccuccgcaccgcccagacccagcucucccgcaagcuccccggcaccacccucaccgcccucgaggccgccgccaaccccgcccuccccuccgacuucaagaccauccucgacuga

SEQ ID NO: 50629 - RNA, 564 nt, Artificial Sequence
  derived and/or modified sequence opt2 from TESC__Homo_sapiens__NP_001161797
augggcgccgcccacuccgccuccgaggagguccgcgagcucgagggcaagaccggcuucuccuccgaccagaucgagcagcuccaccgccgcuucaagcagcucuccggcgaccagcccaccauccgcaaccuccgcaagggccccuccggccucgccgacgagaucaacuucgaggacuuccucaccaucauguccuacuuccgccccaucgacaccaccauggacgaggagcaggucgagcucucccgcaaggagaagcuccgcuuccucuuccacauguacgacuccgacuccgacggccgcaucacccucgaggaguaccgcaacgucgucgaggagcuccucuccggcaacccccacaucgagaaggaguccgcccgcuccaucgccgacggcgccaugauggaggccgccuccgucugcaugggccagauggagcccgaccaggucuacgagggcaucaccuucgaggacuuccucaagaucuggcagggcaucgacaucgagaccaagaugcacguccgcuuccucaacauggagaccauggcccucugccacuga

SEQ ID NO: 50630 - RNA, 1266 nt, Artificial Sequence
  derived and/or modified sequence opt2 from TES__Homo_sapiens__NP_056456
auggaccucgagaacaaggucaagaagaugggccucggccacgagcagggcuucggcgcccccugccucaagugcaaggagaagugcgagggcuucgagcuccacuucuggcgcaagaucugccgcaacugcaagugcggccaggaggagcacgacguccuccucuccaacgaggaggaccgcaaggucggcaagcucuucgaggacaccaaguacaccacccucaucgccaagcucaaguccgacggcauccccauguacaagcgcaacgucaugauccucaccaaccccgucgccgccaagaagaacgucuccaucaacaccgucaccuacgagugggccccccccguccagaaccaggcccucgcccgccaguacaugcagaugcuccccaaggagaagcagcccgucgccggcuccgagggcgcccaguaccgcaagaagcagcucgccaagcagcuccccgcccacgaccaggaccccuccaagugccacgagcucuccccccgcgaggucaaggagauggagcaguucgucaagaaguacaaguccgaggcccucggcgucggcgacgucaagcuccccugcgagauggacgcccagggccccaagcagaugaacauccccggcggcgaccgcuccacccccgccgccgucggcgccauggaggacaaguccgccgagcacaagcgcacccaguacuccugcuacugcugcaagcucuccaugaaggagggcgaccccgccaucuacgccgagcgcgccggcuacgacaagcucuggcaccccgccugcuucgucugcuccaccugccacgagcuccucgucgacaugaucuacuucuggaagaacgagaagcucuacugcggccgccacuacugcgacuccgagaagccccgcugcgccggcugcgacgagcucaucuucuccaacgaguacacccaggccgagaaccagaacuggcaccucaagcacuucugcugcuucgacugcgacuccauccucgccggcgagaucuacgucauggucaacgacaagcccgucugcaagcccugcuacgucaagaaccacgccgucgucugccagggcugccacaacgccaucgaccccgagguccagcgcgucaccuacaacaacuucuccuggcacgccuccaccgagugcuuccucugcuccugcugcuccaagugccucaucggccagaaguucaugcccgucgagggcauggucuucugcuccgucgagugcaagaagcgcauguccuga

SEQ ID NO: 50631 - RNA, 1566 nt, Artificial Sequence
  derived and/or modified sequence opt2 from TESPA1__Homo_sapiens__NP_001129502
auggaggccuccguccucucccccaccuccugggagaagcgccgcgccuggcuccgccagucccgcaacuggcagacccagguccucgaggaggaggccgccgccgcccuccaggacguccccgaccccgagcccuccucccucgacgacgucuuccaggagggcaaccccaucaacaagaucgaggacuggcuccaggacugcggcuacuccgaggagggcuucuccgaggaggccggccaguucaucuacaacggcuucugcucccacggcaccuccuucgaggacgaccucacccucggcgccgaggccacccuccucgccgccaacggcaagcucuucucccgcuccuuccucgagaccgcccgccccugccagcuccucgaccucggcugcucccucgccuccuccuccaugaccggcggcaccaacaagaccuccuccuccaucuccgagauccucgacaagguccaggaggacgccgaggacguccucuucucccucggcuucggccaggaggaccacaaggacaccucccgcauccccgcccgcuucuucaccacccccucccaggccaagggcaucgacuuccagcucuuccucaagucccagguccgccgcaucgagauggaggaccccugccucaugcucgccucccgcuucaagcagguccagacccucgccgucaccgccgacgccuucuucugccucuacuccuacgucuccaagacccccguccagaaguucacccccucccacauguucuggaacugcaaccaccccaccgacguccccuccauccgcauccucucccgcgagcccgagccccaguccccccgcgaccgccuccgcaaggccaucuccaagaugugccucuacaccugcccccgcgaccgccccccccccccccacaacacccccaagcgcaacucccucgaccaggucguccucgaggucauggacaaggucaaggaggagaagcaguuccuccagcaggacuccgaccucggccaguucucccaggaggaccccgucccccccgccgagggcaagaagcuccccaccucccccuaccccugcgucuucugcugcgaggaggagacccagcagcgcauguccaccguccucgcccccucccagacccucgacuccaaccccaagguccccugcugcacccacucccuccccaucgaggacccccagugguccaccgaccccgcccagauccgccgcgagcucugcucccuccccgccaccaacaccgagacccaccccgccaaggacgagaccuucuggaagcgcaagucccgcgcccgcaagucccucuuccagaagaaccucaugggccgcaaggucaagucccucgaccucuccaucacccagcagaaguggaagcaguccgucgaccgccccgagcuccgccgcucccucucccagcagccccaggacaccuucgaccucgaggagguccaguccaacuccgaggaggagcagucccagucccgcuggcccucccgcccccgccacccccaccaccaccagaccuucgccggcaaggacuccuga

SEQ ID NO: 50632 - RNA, 6411 nt, Artificial Sequence
  derived and/or modified sequence opt2 from TET1__Homo_sapiens__NP_085128
augucccgcucccgccacgcccgccccucccgccucguccgcaaggaggacgucaacaagaagaagaagaacucccagcuccgcaagaccaccaagggcgccaacaagaacgucgccuccgucaagacccucucccccggcaagcucaagcagcucauccaggagcgcgacgucaagaagaagaccgagcccaagccccccguccccguccgcucccuccucacccgcgccggcgccgcccgcaugaaccucgaccgcaccgagguccucuuccagaaccccgagucccucaccugcaacggcuucaccauggcccuccgcuccaccucccucucccgccgccucucccagcccccccucgucgucgccaaguccaagaaggucccccucuccaagggccucgagaagcagcacgacugcgacuacaagauccuccccgcccucggcgucaagcacuccgagaacgacuccguccccaugcaggacacccagguccuccccgacaucgagacccucaucggcguccagaaccccucccuccucaagggcaagucccaggagaccacccaguucuggucccagcgcgucgaggacuccaagaucaacauccccacccacuccggccccgccgccgagauccuccccggcccccucgagggcacccgcugcggcgagggccucuucuccgaggagacccucaacgacaccuccggcucccccaagauguucgcccaggacaccgucugcgcccccuucccccagcgcgccacccccaaggucaccucccagggcaaccccuccauccagcucgaggagcucggcucccgcgucgagucccucaagcucuccgacuccuaccucgaccccaucaaguccgagcacgacugcuaccccaccuccucccucaacaaggucauccccgaccucaaccuccgcaacugccucgcccucggcggcuccaccucccccaccuccgucaucaaguuccuccucgccggcuccaagcaggccacccucggcgccaagcccgaccaccaggaggccuucgaggccaccgccaaccagcaggaggucuccgacaccaccuccuuccucggccaggccuucggcgccaucccccaccagugggagcuccccggcgccgaccccguccacggcgaggcccucggcgagacccccgaccuccccgagauccccggcgccauccccguccagggcgaggucuucggcaccauccucgaccagcaggagacccucggcauguccggcuccgucguccccgaccuccccgucuuccuccccgucccccccaaccccaucgccaccuucaacgcccccuccaaguggcccgagccccaguccaccgucuccuacggccucgccguccagggcgccauccagauccucccccucggcuccggccacaccccccaguccuccuccaacuccgagaagaacucccucccccccgucauggccaucuccaacgucgagaacgagaagcagguccacaucuccuuccuccccgccaacacccagggcuucccccucgcccccgagcgcggccucuuccacgccucccucggcaucgcccagcucucccaggccggccccuccaaguccgaccgcggcuccucccaggucuccgucaccuccaccguccacgucgucaacaccaccgucgucaccaugcccguccccauggucuccaccuccuccuccuccuacaccacccuccuccccacccucgagaagaagaagcgcaagcgcugcggcgucugcgagcccugccagcagaagaccaacugcggcgagugcaccuacugcaagaaccgcaagaacucccaccagaucugcaagaagcgcaagugcgaggagcucaagaagaagcccuccgucgucgucccccucgaggucaucaaggagaacaagcgcccccagcgcgagaagaagcccaagguccucaaggccgacuucgacaacaagcccgucaacggccccaaguccgaguccauggacuacucccgcugcggccacggcgaggagcagaagcucgagcucaacccccacaccgucgagaacgucaccaagaacgaggacuccaugaccggcaucgaggucgagaaguggacccagaacaagaagucccagcucaccgaccacgucaagggcgacuucuccgccaacguccccgaggccgagaaguccaagaacuccgaggucgacaagaagcgcaccaagucccccaagcucuucguccagaccguccgcaacggcaucaagcacguccacugccuccccgccgagaccaacgucuccuucaagaaguucaacaucgaggaguucggcaagacccucgagaacaacuccuacaaguuccucaaggacaccgccaaccacaagaacgccauguccuccgucgccaccgacauguccugcgaccaccucaagggccgcuccaacguccucgucuuccagcagcccggcuucaacugcuccuccaucccccacuccucccacuccaucaucaaccaccacgccuccauccacaacgagggcgaccagcccaagacccccgagaacauccccuccaaggagcccaaggacggcucccccguccagcccucccuccucucccucaugaaggaccgccgccucacccucgagcaggucgucgccaucgaggcccucacccagcucuccgaggcccccuccgagaacuccucccccuccaaguccgagaaggacgaggaguccgagcagcgcaccgccucccuccucaacuccugcaaggccauccucuacaccguccgcaaggaccuccaggaccccaaccuccagggcgagccccccaagcucaaccacugccccucccucgagaagcaguccuccugcaacaccgucgucuucaacggccagaccaccacccucuccaacucccacaucaacuccgccaccaaccaggccuccaccaagucccacgaguacuccaaggucaccaacucccucucccucuucauccccaaguccaacuccuccaagaucgacaccaacaaguccaucgcccagggcaucaucacccucgacaacugcuccaacgaccuccaccagcuccccccccgcaacaacgaggucgaguacugcaaccagcuccucgacuccuccaagaagcucgacuccgacgaccucuccugccaggacgccacccacacccagaucgaggaggacgucgccacccagcucacccagcucgccuccaucaucaagaucaacuacaucaagcccgaggacaagaaggucgaguccacccccaccucccucgucaccugcaacguccagcagaaguacaaccaggagaagggcaccauccagcagaagccccccuccuccguccacaacaaccacggcuccucccucaccaagcagaagaaccccacccagaagaagaccaaguccacccccucccgcgaccgccgcaagaagaagcccaccgucgucuccuaccaggagaacgaccgccagaagugggagaagcucuccuacauguacggcaccaucugcgacaucuggaucgccuccaaguuccagaacuucggccaguucugcccccacgacuuccccaccgucuucggcaagaucuccuccuccaccaagaucuggaagccccucgcccagacccgcuccaucaugcagcccaagaccgucuuccccccccucacccagaucaagcuccagcgcuaccccgaguccgccgaggagaaggucaaggucgagccccucgacucccucucccucuuccaccucaagaccgaguccaacggcaaggccuucaccgacaaggccuacaacucccagguccagcucaccgucaacgccaaccagaaggcccacccccucacccagcccuccuccccccccaaccagugcgccaacgucauggccggcgacgaccagauccgcuuccagcaggucgucaaggagcagcucaugcaccagcgccuccccacccuccccggcaucucccacgagaccccccuccccgaguccgcccucacccuccgcaacgucaacgucgucugcuccggcggcaucaccgucgucuccaccaaguccgaggaggaggucugcuccuccuccuucggcaccuccgaguucuccaccgucgacuccgcccagaagaacuucaacgacuacgccaugaacuucuucaccaaccccaccaagaaccucgucuccaucaccaaggacuccgagcuccccaccugcuccugccucgaccgcgucauccagaaggacaagggccccuacuacacccaccucggcgccggccccuccgucgccgccguccgcgagaucauggagaaccgcuacggccagaagggcaacgccauccgcaucgagaucgucgucuacaccggcaaggagggcaaguccucccacggcugccccaucgccaaguggguccuccgccgcuccuccgacgaggagaagguccucugccucguccgccagcgcaccggccaccacugccccaccgccgucauggucguccucaucauggucugggacggcaucccccuccccauggccgaccgccucuacaccgagcucaccgagaaccucaaguccuacaacggccaccccaccgaccgccgcugcacccucaacgagaaccgcaccugcaccugccagggcaucgaccccgagaccugcggcgccuccuucuccuucggcugcuccugguccauguacuucaacggcugcaaguucggccgcucccccuccccccgccgcuuccgcaucgaccccuccuccccccuccacgagaagaaccucgaggacaaccuccagucccucgccacccgccucgcccccaucuacaagcaguacgcccccgucgccuaccagaaccaggucgaguacgagaacgucgcccgcgagugccgccucggcuccaaggagggccgccccuucuccggcgucaccgccugccucgacuucugcgcccacccccaccgcgacauccacaacaugaacaacggcuccaccgucgucugcacccucacccgcgaggacaaccgcucccucggcgucaucccccaggacgagcagcuccacguccucccccucuacaagcucuccgacaccgacgaguucggcuccaaggagggcauggaggccaagaucaaguccggcgccaucgagguccucgccccccgccgcaagaagcgcaccugcuucacccagcccgucccccgcuccggcaagaagcgcgccgccaugaugaccgagguccucgcccacaagauccgcgccgucgagaagaagcccaucccccgcaucaagcgcaagaacaacuccaccaccaccaacaacuccaagcccuccucccuccccacccucggcuccaacaccgagaccguccagcccgaggucaaguccgagaccgagccccacuucauccucaaguccuccgacaacaccaagaccuacucccucaugcccuccgccccccaccccgucaaggaggccucccccggcuucuccuggucccccaagaccgccuccgccacccccgccccccucaagaacgacgccaccgccuccugcggcuucuccgagcgcuccuccaccccccacugcaccaugcccuccggccgccucuccggcgccaacgccgccgccgccgacggccccggcaucucccagcucggcgaggucgccccccuccccacccucuccgcccccgucauggagccccucaucaacuccgagcccuccaccggcgucaccgagccccucaccccccaccagcccaaccaccagcccuccuuccucaccuccccccaggaccucgccuccucccccauggaggaggacgagcagcacuccgaggccgacgagccccccuccgacgagccccucuccgacgacccccucucccccgccgaggagaagcucccccacaucgacgaguacugguccgacuccgagcacaucuuccucgacgccaacaucggcggcgucgccaucgcccccgcccacggcuccguccucaucgagugcgcccgccgcgagcuccacgccaccacccccgucgagcaccccaaccgcaaccaccccacccgccucucccucgucuucuaccagcacaagaaccucaacaagccccagcacggcuucgagcucaacaagaucaaguucgaggccaaggaggccaagaacaagaagaugaaggccuccgagcagaaggaccaggccgccaacgagggccccgagcaguccuccgaggucaacgagcucaaccagauccccucccacaaggcccucacccucacccacgacaacgucgucaccgucucccccuacgcccucacccacgucgccggccccuacaaccacugggucuga

SEQ ID NO: 50633 - RNA, 6009 nt, Artificial Sequence
  derived and/or modified sequence opt2 from TET2__Homo_sapiens__NP_001120680
auggagcaggaccgcaccaaccacgucgagggcaaccgccucucccccuuccucauccccuccccccccaucugccagaccgagccccucgccaccaagcuccagaacggcuccccccuccccgagcgcgcccaccccgaggucaacggcgacaccaaguggcacuccuucaaguccuacuacggcauccccugcaugaagggcucccagaacucccgcgucucccccgacuucacccaggagucccgcggcuacuccaagugccuccagaacggcggcaucaagcgcaccgucuccgagcccucccucuccggccuccuccagaucaagaagcucaagcaggaccagaaggccaacggcgagcgccgcaacuucggcgucucccaggagcgcaaccccggcgaguccucccagcccaacgucuccgaccucuccgacaagaaggaguccgucuccuccgucgcccaggagaacgccgucaaggacuucaccuccuucuccacccacaacugcuccggccccgagaaccccgagcuccagauccucaacgagcaggagggcaaguccgccaacuaccacgacaagaacaucguccuccucaagaacaaggccguccucaugcccaacggcgccaccgucuccgccuccuccgucgagcacacccacggcgagcuccucgagaagacccucucccaguacuaccccgacugcgucuccaucgccguccagaagaccaccucccacaucaacgccaucaacucccaggccaccaacgagcucuccugcgagaucacccaccccucccacaccuccggccagaucaacuccgcccagaccuccaacuccgagcucccccccaagcccgccgccgucgucuccgaggccugcgacgccgacgacgccgacaacgccuccaagcucgccgccaugcucaacaccugcuccuuccagaagcccgagcagcuccagcagcagaaguccgucuucgagaucugccccucccccgccgagaacaacauccagggcaccaccaagcucgccuccggcgaggaguucugcuccggcuccuccuccaaccuccaggcccccggcggcuccuccgagcgcuaccucaagcagaacgagaugaacggcgccuacuucaagcaguccuccgucuucaccaaggacuccuucuccgccaccaccaccccccccccccccucccagcuccuccucucccccccccccccccucccccaggucccccagcuccccuccgagggcaaguccacccucaacggcggcguccucgaggagcaccaccacuaccccaaccaguccaacaccacccuccuccgcgaggucaagaucgagggcaagcccgaggccccccccucccagucccccaaccccuccacccacgucugcucccccucccccaugcucuccgagcgcccccagaacaacugcgucaaccgcaacgacauccagaccgccggcaccaugaccgucccccucugcuccgagaagacccgccccauguccgagcaccucaagcacaacccccccaucuucggcuccuccggcgagcuccaggacaacugccagcagcucaugcgcaacaaggagcaggagauccucaagggccgcgacaaggagcagacccgcgaccucgucccccccacccagcacuaccucaagcccggcuggaucgagcucaaggccccccgcuuccaccaggccgagucccaccucaagcgcaacgaggccucccuccccuccauccuccaguaccagcccaaccucuccaaccagaugaccuccaagcaguacaccggcaacuccaacaugcccggcggccucccccgccaggccuacacccagaagaccacccagcucgagcacaagucccagauguaccaggucgagaugaaccagggccagucccagggcaccgucgaccagcaccuccaguuccagaagcccucccaccagguccacuucuccaagaccgaccaccuccccaaggcccacguccagucccucugcggcacccgcuuccacuuccagcagcgcgccgacucccagaccgagaagcucaugucccccguccucaagcagcaccucaaccagcaggccuccgagaccgagcccuucuccaacucccaccuccuccagcacaagccccacaagcaggccgcccagacccagcccucccaguccucccaccucccccagaaccagcagcagcagcagaagcuccagaucaagaacaaggaggagauccuccagaccuucccccacccccaguccaacaacgaccagcagcgcgagggcuccuucuucggccagaccaaggucgaggagugcuuccacggcgagaaccaguacuccaaguccuccgaguucgagacccacaacguccagaugggccucgaggagguccagaacaucaaccgccgcaacucccccuacucccagaccaugaaguccuccgccugcaagauccaggucuccugcuccaacaacacccaccucgucuccgagaacaaggagcagaccacccaccccgagcucuucgccggcaacaagacccagaaccuccaccacaugcaguacuuccccaacaacgucauccccaagcaggaccuccuccaccgcugcuuccaggagcaggagcagaagucccagcaggccuccguccuccagggcuacaagaaccgcaaccaggacauguccggccagcaggccgcccagcucgcccagcagcgcuaccucauccacaaccacgccaacgucuuccccguccccgaccagggcggcucccacacccagacccccccccagaaggacacccagaagcacgccgcccuccgcuggcaccuccuccagaagcaggagcagcagcagacccagcagccccagaccgaguccugccacucccagaugcaccgccccaucaaggucgagcccggcugcaagccccacgccugcaugcacaccgccccccccgagaacaagaccuggaagaaggucaccaagcaggagaacccccccgccuccugcgacaacguccagcagaaguccaucaucgagaccauggagcagcaccucaagcaguuccacgccaagucccucuucgaccacaaggcccucacccucaagucccagaagcaggucaaggucgagauguccggccccgucaccguccucacccgccagaccaccgccgccgagcucgacucccacacccccgcccucgagcagcagaccaccuccuccgagaagacccccaccaagcgcaccgccgccuccguccucaacaacuucaucgagucccccuccaagcuccucgacacccccaucaagaaccuccucgacacccccgucaagacccaguacgacuuccccuccugccgcugcgucgagcagaucaucgagaaggacgagggccccuucuacacccaccucggcgccggccccaacgucgccgccauccgcgagaucauggaggagcgcuucggccagaagggcaaggccauccgcaucgagcgcgucaucuacaccggcaaggagggcaaguccucccagggcugccccaucgccaagugggucguccgccgcuccuccuccgaggagaagcuccucugccucguccgcgagcgcgccggccacaccugcgaggccgccgucaucgucauccucauccucgucugggagggcaucccccucucccucgccgacaagcucuacuccgagcucaccgagacccuccgcaaguacggcacccucaccaaccgccgcugcgcccucaacgaggagcgcaccugcgccugccagggccucgaccccgagaccugcggcgccuccuucuccuucggcugcuccugguccauguacuacaacggcugcaaguucgcccgcuccaagaucccccgcaaguucaagcuccucggcgacgaccccaaggaggaggagaagcucgagucccaccuccagaaccucuccacccucauggcccccaccuacaagaagcucgcccccgacgccuacaacaaccagaucgaguacgagcaccgcgcccccgagugccgccucggccucaaggagggccgccccuucuccggcgucaccgccugccucgacuucugcgcccacgcccaccgcgaccuccacaacaugcagaacggcuccacccucgucugcacccucacccgcgaggacaaccgcgaguucggcggcaagcccgaggacgagcagcuccacguccucccccucuacaaggucuccgacgucgacgaguucggcuccgucgaggcccaggaggagaagaagcgcuccggcgccauccagguccucuccuccuuccgccgcaagguccgcaugcucgccgagcccgucaagaccugccgccagcgcaagcucgaggccaagaaggccgccgccgagaagcucuccucccucgagaacuccuccaacaagaacgagaaggagaaguccgcccccucccgcaccaagcagaccgagaacgccucccaggccaagcagcucgccgagcuccuccgccucuccggccccgucaugcagcagucccagcagccccagccccuccagaagcagcccccccagccccagcagcagcagcgcccccagcagcagcagccccaccacccccagaccgaguccgucaacuccuacuccgccuccggcuccaccaaccccuacaugcgccgccccaaccccgucucccccuaccccaacuccucccacaccuccgacaucuacggcuccaccucccccaugaacuucuacuccaccuccucccaggccgccggcuccuaccucaacuccuccaaccccaugaaccccuaccccggccuccucaaccagaacacccaguaccccuccuaccagugcaacggcaaccucuccgucgacaacugcucccccuaccucggcuccuacuccccccagucccagcccauggaccucuaccgcuaccccucccaggacccccucuccaagcucucccucccccccauccacacccucuaccagccccgcuucggcaacucccaguccuucaccuccaaguaccucggcuacggcaaccagaacaugcagggcgacggcuucuccuccugcaccauccgccccaacguccaccacgucggcaagcucccccccuaccccacccacgagauggacggccacuucaugggcgccaccucccgccucccccccaaccucuccaaccccaacauggacuacaagaacggcgagcaccacucccccucccacaucauccacaacuacuccgccgcccccggcauguucaacuccucccuccacgcccuccaccuccagaacaaggagaacgacaugcucucccacaccgccaacggccucuccaagaugcuccccgcccucaaccacgaccgcaccgccugcguccagggcggccuccacaagcucuccgacgccaacggccaggagaagcagccccucgcccucguccagggcgucgccuccggcgccgaggacaacgacgaggucugguccgacuccgagcaguccuuccucgaccccgacaucggcggcgucgccgucgcccccacccacggcuccauccucaucgagugcgccaagcgcgagcuccacgccaccaccccccucaagaaccccaaccgcaaccaccccacccgcaucucccucgucuucuaccagcacaaguccaugaacgagcccaagcacggccucgcccucugggaggccaagauggccgagaaggcccgcgagaaggaggaggagugcgagaaguacggccccgacuacgucccccagaagucccacggcaagaaggucaagcgcgagcccgccgagccccacgagaccuccgagcccaccuaccuccgcuucaucaagucccucgccgagcgcaccauguccgucaccaccgacuccaccgucaccaccucccccuacgccuucacccgcgucaccggccccuacaaccgcuacaucuga

SEQ ID NO: 50634 - RNA, 5388 nt, Artificial Sequence
  derived and/or modified sequence opt2 from TET3__Homo_sapiens__XP_005264244
augucccaguuccaggucccccucgccguccagcccgaccuccccggccucuacgacuucccccagcgccaggucauggucggcuccuuccccggcuccggccucuccauggccggcuccgagucccagcuccgcggcggcggcgacggccgcaagaagcgcaagcgcugcggcaccugcgagcccugccgccgccucgagaacugcggcgccugcaccuccugcaccaaccgccgcacccaccagaucugcaagcuccgcaagugcgagguccucaagaagaaggucggccuccucaaggaggucgagaucaaggccggcgagggcgccggccccuggggccagggcgccgccgucaagaccggcuccgagcucucccccgucgacggccccguccccggccagauggacuccggccccgucuaccacggcgacucccgccagcucuccgccuccggcguccccgucaacggcgcccgcgagcccgccggccccucccuccucggcaccggcggccccuggcgcgucgaccagaagcccgacugggaggccgcccccggccccgcccacaccgcccgccucgaggacgcccacgaccucgucgccuucuccgccgucgccgaggccgucuccuccuacggcgcccucuccacccgccucuacgagaccuucaaccgcgagaugucccgcgaggccggcaacaacucccgcggcccccgccccggccccgagggcugcuccgccggcuccgaggaccucgacacccuccagaccgcccucgcccucgcccgccacggcaugaagccccccaacugcaacugcgacggccccgagugccccgacuaccucgaguggcucgagggcaagaucaaguccgucgucauggagggcggcgaggagcgcccccgccuccccggcccccucccccccggcgaggccggccuccccgcccccuccacccgcccccuccucuccuccgaggucccccagaucuccccccaggagggccucccccucucccaguccgcccucuccaucgccaaggagaagaacaucucccuccagaccgccaucgccaucgaggcccucacccagcucuccuccgcccucccccagcccucccacuccaccccccaggccuccugcccccuccccgaggcccucuccccccccgcccccuuccgcuccccccaguccuaccuccgcgcccccuccuggcccgucgucccccccgaggagcacuccuccuucgcccccgacuccuccgccuucccccccgccaccccccgcaccgaguuccccgaggccuggggcaccgacaccccccccgccaccccccgcuccuccuggcccaugccccgccccucccccgaccccauggccgagcucgagcagcuccucggcuccgccuccgacuacauccaguccgucuucaagcgccccgaggcccuccccaccaagcccaaggucaaggucgaggcccccuccuccucccccgcccccgcccccucccccguccuccagcgcgaggcccccacccccuccuccgagcccgacacccaccagaaggcccagaccgcccuccagcagcaccuccaccacaagcgcucccucuuccucgagcagguccacgacaccuccuuccccgcccccuccgagcccuccgcccccggcugguggcccccccccuccucccccgucccccgccuccccgaccgcccccccaaggagaagaagaagaagcuccccacccccgccggcggccccgucggcaccgagaaggccgcccccggcaucaagcccuccguccgcaagcccauccagaucaagaagucccgcccccgcgaggcccagccccucuucccccccguccgccagaucguccucgagggccuccgcucccccgccucccaggagguccaggcccacccccccgccccccuccccgccucccagggcuccgccgucccccucccccccgagcccucccucgcccucuucgcccccucccccucccgcgacucccuccucccccccacccaggagaugcgcucccccucccccaugaccgcccuccagcccggcuccaccggcccccucccccccgccgacgacaagcucgaggagcucauccgccaguucgaggccgaguucggcgacuccuucggccuccccggcccccccuccguccccauccaggaccccgagaaccagcagaccugccuccccgcccccgagucccccuucgccacccgcucccccaagcagaucaagaucgaguccuccggcgccgucaccguccucuccaccaccugcuuccacuccgaggagggcggccaggaggccacccccaccaaggccgagaacccccucacccccacccucuccggcuuccucgaguccccccucaaguaccucgacacccccaccaagucccuccucgacacccccgccaagcgcgcccaggccgaguuccccaccugcgacugcgucgagcagaucgucgagaaggacgagggccccuacuacacccaccucggcuccggccccaccgucgccuccauccgcgagcucauggaggagcgcuacggcgagaagggcaaggccauccgcaucgagaaggucaucuacaccggcaaggagggcaaguccucccgcggcugccccaucgccaagugggucauccgccgccacacccucgaggagaagcuccucugccucguccgccaccgcgccggccaccacugccagaacgccgucaucgucauccucauccucgccugggagggcaucccccgcucccucggcgacacccucuaccaggagcucaccgacacccuccgcaaguacggcaaccccaccucccgccgcugcggccucaacgacgaccgcaccugcgccugccagggcaaggaccccaacaccugcggcgccuccuucuccuucggcugcuccugguccauguacuucaacggcugcaaguacgcccgcuccaagaccccccgcaaguuccgccucgccggcgacaaccccaaggaggaggagguccuccgcaaguccuuccaggaccucgccaccgaggucgccccccucuacaagcgccucgccccccaggccuaccagaaccaggucaccaacgaggagaucgccaucgacugccgccucggccucaaggagggccgccccuucgccggcgucaccgccugcauggacuucugcgcccacgcccacaaggaccagcacaaccucuacaacggcugcaccgucgucugcacccucaccaaggaggacaaccgcugcgucggcaagauccccgaggacgagcagcuccacguccucccccucuacaagauggccaacaccgacgaguucggcuccgaggagaaccagaacgccaaggucggcuccggcgccauccagguccucaccgccuucccccgcgagguccgccgccuccccgagcccgccaaguccugccgccagcgccagcucgaggcccgcaaggccgccgccgagaagaagaagauccagaaggagaagcucuccacccccgagaagaucaagcaggaggcccucgagcucgccggcaucaccuccgaccccggccucucccucaagggcggccucucccagcagggccucaagcccucccucaaggucgagccccagaaccacuucuccuccuucaaguacuccggcaacgccgucgucgaguccuacuccguccucggcaacugccgccccuccgaccccuacuccaugaacuccgucuacuccuaccacuccuacuacgcccagcccucccucaccuccgucaacggcuuccacuccaaguacgcccuccccuccuucuccuacuacggcuuccccuccuccaaccccgucuuccccucccaguuccucggccccggcgccuggggccacuccggcuccuccggcuccuucgagaagaagcccgaccuccacgcccuccacaacucccucucccccgccuacggcggcgccgaguucgccgagcuccccucccaggccguccccaccgacgcccaccaccccaccccccaccaccagcagcccgccuaccccggccccaaggaguaccuccuccccaaggccccccuccuccacuccgucucccgcgaccccucccccuucgcccaguccuccaacugcuacaaccgcuccaucaagcaggagcccgucgacccccucacccaggccgagcccgucccccgcgacgccggcaagaugggcaagaccccccucuccgaggucucccagaacggcggccccucccaccucuggggccaguacuccggcggccccuccaugucccccaagcgcaccaacggcgucggcggcuccuggggcgucuucuccuccggcgagucccccgccaucguccccgacaagcucuccuccuucggcgccuccugccucgcccccucccacuucaccgacggccaguggggccucuuccccggcgagggccagcaggccgccucccacuccggcggccgccuccgcggcaagcccuggucccccugcaaguucggcaacuccaccuccgcccucgccggccccucccucaccgagaagcccugggcccucggcgccggcgacuucaacuccgcccucaagggcucccccggcuuccaggacaagcucuggaaccccaugaagggcgaggagggccgcauccccgccgccggcgccucccagcucgaccgcgccuggcaguccuucggccucccccucggcuccuccgagaagcucuucggcgcccucaaguccgaggagaagcucugggaccccuucucccucgaggagggccccgccgaggagccccccuccaagggcgccgucaaggaggagaagggcggcggcggcgccgaggaggaggaggaggagcucugguccgacuccgagcacaacuuccucgacgagaacaucggcggcgucgccgucgcccccgcccacggcuccauccucaucgagugcgcccgccgcgagcuccacgccaccaccccccucaagaagcccaaccgcugccaccccacccgcaucucccucgucuucuaccagcacaagaaccucaaccagcccaaccacggccucgcccucugggaggccaagaugaagcagcucgccgagcgcgcccgcgcccgccaggaggaggccgcccgccucggccucggccagcaggaggccaagcucuacggcaagaagcgcaaguggggcggcaccgucgucgccgagccccagcagaaggagaagaagggcgucguccccacccgccaggcccucgccguccccaccgacuccgccgucaccgucuccuccuacgccuacaccaaggucaccggccccuacucccgcuggaucuga

SEQ ID NO: 50635 - RNA, 750 nt, Artificial Sequence
  derived and/or modified sequence opt2 from TEX101__Homo_sapiens__NP_001123483
augggcaccccccgcauccagcaccuccucauccuccucguccucggcgccucccuccucaccuccggccucgagcucuacugccagaagggccucuccaugaccgucgaggccgaccccgccaacauguucaacuggaccaccgaggaggucgagaccugcgacaagggcgcccucugccaggagaccauccucaucaucaaggccggcaccgagaccgccauccucgccaccaagggcugcauccccgagggcgaggaggccaucaccaucguccagcacuccuccccccccggccucaucgucaccuccuacuccaacuacugcgaggacuccuucugcaacgacaaggacucccucucccaguucugggaguucuccgagaccaccgccuccaccgucuccaccacccuccacugccccaccugcgucgcccucggcaccugcuucuccgcccccucccuccccugccccaacggcaccacccgcugcuaccagggcaagcucgagaucaccggcggcggcaucgaguccuccgucgaggucaagggcugcaccgccaugaucggcugccgccucauguccggcauccucgccgucggccccauguucguccgcgaggccugcccccaccagcuccucacccagccccgcaagaccgagaacggcgccaccugccuccccauccccgucuggggccuccagcuccuccucccccuccuccuccccuccuucauccacuucuccuga

SEQ ID NO: 50636 - RNA, 2823 nt, Artificial Sequence
  derived and/or modified sequence opt2 from TEX11__Homo_sapiens__NP_001003811
augaucuccgcccacugcaaccuccgccuccucugcuccuccgacuccuccgccuccgccucccaggucgccggcaccaccgaggucgucgagaaccucgucaccaacgacaacucccccaacauccccgaggccaucgaccgccucuucuccgacaucgccaacaucaaccgcgaguccauggccgagaucaccgacauccagaucgaggagauggccgucaaccucuggaacugggcccucaccaucggcggcggcuggcucgucaacgaggagcagaagauccgccuccacuacgucgccugcaagcuccucuccaugugcgaggccuccuucgccuccgagcaguccauccagcgccucaucaugaugaacaugcgcaucggcaaggaguggcucgacgccggcaacuuccucaucgccgacgagugcuuccaggccgccgucgccucccucgagcagcucuacgucaagcucauccagcgcuccucccccgaggccgaccucaccauggagaagaucaccgucgaguccgaccacuuccgcguccucuccuaccaggccgaguccgccgucgcccagggcgacuuccagcgcgccuccaugugcguccuccagugcaaggacaugcucaugcgccucccccagaugaccuccucccuccaccaccucugcuacaacuucggcgucgagacccagaagaacaacaaguacgaggaguccuccuucuggcucucccaguccuacgacaucggcaagauggacaagaaguccaccggccccgagaugcucgccaagguccuccgccuccucgccaccaacuaccucgacugggacgacaccaaguacuacgacaaggcccucaacgccgucaaccucgccaacaaggagcaccucuccucccccggccucuuccucaagaugaagauccuccucaagggcgagaccuccaacgaggagcuccucgaggccgucauggagauccuccaccucgacaugccccucgacuucugccucaacaucgccaagcuccucauggaccacgagcgcgaguccgucggcuuccacuuccucaccaucauccacgagcgcuucaaguccuccgagaacaucggcaagguccucauccuccacaccgacaugcuccuccagcgcaaggaggagcuccucgccaaggagaagaucgaggagaucuuccucgcccaccagaccggccgccagcucaccgccgaguccaugaacuggcuccacaacauccucuggcgccaggccgccuccuccuucgagguccagaacuacaccgacgcccuccagugguacuacuacucccuccgcuucuacuccaccgacgagauggaccucgacuucaccaagcuccagcgcaacauggccugcugcuaccucaaccuccagcagcucgacaaggccaaggaggccgucgccgaggccgagcgccacgacccccgcaacgucuucacccaguucuacaucuucaagaucgccgucaucgagggcaacuccgagcgcgcccuccaggccaucaucacccucgagaacauccucaccgacgaggaguccgaggacaacgaccucgucgccgagcgcggcucccccaccaugcuccucucccucgccgcccaguucgcccucgagaacggccagcagaucgucgccgagaaggcccucgaguaccucgcccagcacuccgaggaccaggagcagguccucaccgccgucaagugccuccuccgcuuccuccuccccaagaucgccgagaugcccgaguccgaggacaagaagaaggagauggaccgccuccucaccugccucaaccgcgccuucgucaagcucucccagcccuucggcgaggaggcccucucccucgagucccgcgccaacgaggcccagugguuccgcaagaccgccuggaaccucgccguccagugcgacaaggaccccgucaugaugcgcgaguucuucauccucuccuacaagaugucccaguucugccccuccgaccaggucauccucaucgcccgcaagaccugccuccucauggccgucgccgucgaccucgagcagggccgcaaggccuccaccgccuucgagcagaccauguuccucucccgcgcccucgaggagauccagaccugcaacgacauccacaacuuccucaagcagaccggcaccuucuccaacgacuccugcgagaagcuccuccuccucuacgaguucgagguccgcgccaagcucaacgacccccuccucgaguccuuccucgaguccgucugggagcucccccaccucgagaccaagaccuucgagaccaucgccaucaucgccauggagaagcccgcccacuacccccucaucgcccucaaggcccucaagaaggcccuccuccucuacaagaaggaggagcccaucgacaucucccaguacuccaagugcaugcacaaccucgucaaccucuccguccccgacggcgccuccaacgucgagcucugcccccucgaggaggucuggggcuacuucgaggacgcccucucccacaucucccgcaccaaggacuaccccgagauggagauccucuggcucauggucaaguccuggaacaccggcguccucauguucucccgcuccaaguacgccuccgccgagaaguggugcggccucgcccuccgcuuccucaaccaccucaccuccuucaaggaguccuacgagacccagaugaacaugcucuacucccagcucgucgaggcccucuccaacaacaagggccccgucuuccacgagcacggcuacugguccaaguccgacuga

SEQ ID NO: 50637 - RNA, 4494 nt, Artificial Sequence
  derived and/or modified sequence opt2 from TEX14__Homo_sapiens__NP_001188386
augucccgcgccguccgccuccccguccccugccccguccagcucggcacccuccgcaacgacucccucgaggcccagcuccacgaguacgucaagcagggcaacuacgucaaggucaagaagauccucaagaagggcaucuacgucgacgccgucaacucccucggccagaccgcccucuucgucgccgcccuccucggccuccgcaaguucgucgacguccucgucgacuacggcuccgaccccaaccaccgcugcuucgacggcuccacccccguccacgccgccgccuucuccggcaaccaguggauccucuccaagcuccucgacgccggcggcgaccuccgccuccacgacgagcgcggccagaaccccaagaccugggcccucaccgccggcaaggagcgcuccacccagaucgucgaguucaugcagcgcugcgccucccacaugcaggccaucauccagggcuucuccuacgaccuccucaagaagaucgacuccccccagcgccucgucuacucccccuccuggugcggcggccucguccagggcaaccccaacggcucccccaaccgccuccucaaggccggcgucaucuccgcccagaacaucuacuccuucggcuucggcaaggccaugcccugguuccaguucuaccucaccggcgccacccagauggccuaccucggcucccuccccgucaucggcgagaaggaggucauccaggccgacgacgagcccaccuucuccuucuucuccggccccuacauggucaugaccaaccucgucuggaacggcucccgcgucaccgucaaggagcucaaccuccccacccacccccacugcucccgccuccgccucgccgaccuccucaucgccgagcaggagcacuccuccaagcuccgccaccccuaccuccuccagcucauggccgucugccucucccaggaccucgagaagacccgccucgucuacgagcgcaucaccaucggcacccucuucuccguccuccacgagcgccgcucccaguuccccguccuccacauggaggucaucguccaccuccuccuccagaucuccgacgcccuccgcuaccuccacuuccagggcuucauccaccgcucccucuccuccuacgccguccacaucaucucccccggcgaggcccgccucaccaaccucgaguacaugcucgaguccgaggaccgcggcguccagcgcgaccucacccgcgucccccuccccacccagcucuacaacugggccgcccccgaggucauccuccagaaggccgccaccgucaaguccgacaucuacuccuucuccaugaucaugcaggagauccucaccgacgacauccccuggaagggccucgacggcuccgucgucaagaaggccgucgucuccggcaacuaccucgaggccgacguccgccuccccaagcccuacuacgacaucgucaaguccggcauccacgucaagcagaaggaccgcaccaugaaccuccaggacauccgcuacauccucaagaacgaccucaaggacuucaccggcgcccagcgcacccagcccaccgaguccccccgcguccagcgcuacggccuccaccccgacgucaacgucuaccucggccucaccuccgagcacccccgcgagacccccgacauggagaucaucgagcucaaggagaugggcucccagccccacuccccccgcguccacucccucuucaccgagggcacccucgacccccaggcccccgaccccugccucauggcccgcgagacccagaaccaggacgcccccugccccgcccccuucauggccgaggaggccuccucccccuccaccggccagcccucccucugcuccuucgagaucaacgagaucuacuccggcugccucauccucgaggacgacaucgaggagccccccggcgccgccuccucccucgaggccgacggccccaaccaggucgacgagcucaaguccauggaggaggagcucgacaagauggagcgcgaggccugcugcuucggcuccgaggacgaguccuccuccaaggccgagaccgaguacuccuucgacgacugggacuggcagaacggcucccucuccucccucucccuccccgaguccacccgcgaggccaaguccaaccucaacaacauguccaccaccgaggaguaccucaucuccaagugcguccucgaccucaagaucaugcagaccaucaugcacgagaacgacgaccgccuccgcaacaucgagcagauccucgacgaggucgagaugaagcagaaggagcaggaggagcgcaugucccucugggccaccucccgcgaguucaccaacgccuacaagcucccccucgccgucggcccccccucccucaacuacaucccccccguccuccagcucuccggcggccagaagcccgacaccuccggcaacuaccccacccucccccgcuucccccgcaugcuccccacccucugcgaccccggcaagcagaacaccgacgagcaguuccagugcacccagggcgccaaggacucccucgagaccucccgcauccagaacaccuccucccagggccgcccccgcgaguccaccgcccaggccaaggccacccaguucaacuccgcccucuucacccucuccucccaccgccagggccccuccgccucccccuccugccacugggacuccacccgcauguccgucgagcccgucuccuccgagaucuacaacgccgagucccgcaacaaggacgacggcaagguccaccucaaguggaagauggaggucaaggagauggccaagaaggccgccaccggccagcucaccgucccccccuggcacccccaguccucccucacccucgaguccgaggccgagaacgagcccgacgcccuccuccagccccccauccgcucccccgagaacaccgacuggcagcgcgucaucgaguaccaccgcgagaacgacgagccccgcggcaacggcaaguucgacaagaccggcaacaacgacugcgacuccgaccagcacggccgccagccccgccucggcuccuucaccuccauccgccaccccuccccccgccagaaggagcagcccgagcacuccgaggccuuccaggccuccuccgacacccucgucgccgucgagaaguccuacucccaccaguccaugcaguccaccugcucccccgaguccuccgaggacaucaccgacgaguuccucacccccgacggcgaguacuucuacuccuccaccgcccaggagaaccucgcccucgagaccuccucccccaucgaggaggacuucgagggcauccagggcgccuucgcccagccccaggucuccggcgaggagaaguuccagaugcgcaagauccucggcaagaacgccgagauccucccccgcucccaguuccagcccguccgcuccaccgaggacgagcaggaggagaccuccaaggagucccccaaggagcucaaggagaaggacaucucccucaccgacauccaggaccucuccuccaucuccuacgagcccgacuccuccuucaaggaggccuccugcaagacccccaagaucaaccacgcccccaccuccgucuccaccccccucucccccggcuccgucuccuccgccgccucccaguacaaggacugccucgaguccaucaccuuccaggucaagaccgaguucgccuccugcuggaacucccaggaguucauccagacccucuccgacgacuucaucuccguccgcgagcgcgccaagaagcucgacucccuccucaccuccuccgagaccccccccucccgccucaccggccucaagcgccucuccuccuucaucggcgccggcucccccucccucgucaaggccugcgacuccucccccccccacgccacccagcgccgcucccuccccaaggucgaggccuucucccagcaccacaucgacgagcuccccccccccucccaggagcuccucgacgacaucgagcuccucaagcagcagcagggcuccuccaccguccuccacgagaacaccgccuccgacggcggcggcaccgccaacgaccagcgccaccucgaggagcaggagaccgacuccaagaaggaggacuccuccaugcuccucuccaaggagaccgaggaccucggcgaggacaccgagcgcgcccacuccacccucgacgaggaccucgagcgcuggcuccagccccccgaggaguccgucgagcuccaggaccuccccaagggcuccgagcgcgagaccaacaucaaggaccagaaggucggcgaggagaagcgcaagcgcgaggacuccaucacccccgagcgccgcaaguccgagggcguccucggcaccuccgaggaggacgagcucaaguccugcuucuggaagcgccucggcugguccgaguccucccgcaucaucguccucgaccaguccgaccucuccgacuga

SEQ ID NO: 50638 - RNA, 8370 nt, Artificial Sequence
  derived and/or modified sequence opt2 from TEX15__Homo_sapiens__NP_112561
augcccuccgacgccaaggacuccgucaacggcgaccuccuccucaacuggaccucccucaagaacauccucuccggccucaacgccuccuucccccuccacaacaacaccggcuccuccaccgucaccaccuccaaguccaucaaggacccccgccucaugcgccgcgaggaguccaugggcgagcaguccuccaccgccggccucaacgagguccuccaguucgagaaguccuccgacaacgucaacuccgagaucaaguccacccccuccaacuccgccuccuccuccgaggucguccccggcgacugcgccguccucaccaacggccucgacacccccugcuucaagaccuccgucaacgacucccaguccugggcccacaacaugggcuccgaggacuacgacugcaucccccccaacaaggucaccauggccggccagugcaaggaccagggcaacuucuccuuccccaucuccgucuccaacgucgucuccgaggucgagaaccagaaccacuccgaggagaaggcccagcgcgcccagcaggaguccggcaacgccuacaccaaggaguacuccucccacaucuuccaggacucccaguccuccgaccucaagaccaucuaccagaccggcugccagaccuccaccgucuucccccucaagaagaaggucuccaucgacgaguaccuccagaacaccggcaagaugaagaacuucgccgaccucgaggacuccuccaagcacgaggagaagcagaccuccuggaaggagaucgacaacgacuucaccaacgagaccaagaucucccccaucgacaacuacaucguccuccaccaggaguacaaggaguccgagucccacaacuccuucggcaaguccugcgacaagauccucaucacccaggagcucgagaucaccaaguccuccaccuccaccaucaaggacaaggacgagcucgaccaccucgcccucgaguggcagaucacccccuccuucgagucccucucccagaagcacccccagcacuccgucgaguacgagggcaacauccacaccucccucgccaucgcccagaagcucauggagcucaagcucggcaagaucaaccagaacuacgccuccaucaucaccgaggccuuccccaagcccaaggacaucccccaggccaaggagauguucaucgacaccgucaucuccuccuacaacaucgagaccgcccacgacuccuccaacugcuccaucacccgcgagcacaucugcguccaccgcaagaacgagaacgagcccgucucccucgagaacauccagcgcgacuacaaggagaccgccuacgucgaggaccgcggccaggaccacaaccucuucugcaacucccagcucuccaacgacaucuggcucaacgucaacuucaagaagcagaccgaccgcgagaaccagaacgaggccaaggagaacuccgccuccugcgucgagaacaacaucgagaacaucuacggcgacaagaagcaggacucccacaccaacgagaacuucuccaacaucgacgagaaggaggacaagaacuaccacaacaucgagauccucuccuccgaggaguucuccaccaaguucaaccucaucugccgcgaggacaacgccgucuccgccgccaccgcccuccucgaguccgaggaggacaccaucuccgccgucaagcagaaggacaccgagaacaccggccgcuccgucgagcaccucgccuccaccaccuuccccaagaccgccuccuccuccgucugcgucgccuccaacgccgccauccagaucgccuccgccaccaugcccgcccucucccucaacaacgacgaccaccagaucuaccaguucaaggagaccugcuccuccgagucccccgacuucggccuccucgucaagcaccgcgucuccgacugcgagaucgacaccgacaagaacaagucccaggaguccuuccaccaguccaucaacgagaaccucguccuccaguccaucgagcucgaguccgagaucgagaucgagcucgaggacugcgacgacgccuucaucuuccagcaggacacccacucccacgagaacaugcucugcgaggaguucgucaccuccuacaaggcccucaagucccgcaucuccugggagggccuccucgcccucgacaacggcgagauggagguccucgaguccaccaccggccgcgagaacuccgaccagcacuacuccaaggaguccaacuacuucuacuccuccacccagaacaacgagaccgagcucaccucccccauccuccuccccgaccuccagaucaagaucaccaacaucuuccgccccggcuucucccccaccgccgacucccucgcccucaaggacuccuucugcacccacgucaccgaggccaccaagcccgagaucaacaaggaggacggcgagauccucggcuucgacaucuacucccagcccuucggcgagaacgccgacuaccccugcgaggacaaggucgacaacauccgccaggaguccggccccgucuccaacuccgagaucucccucuccuucgaccucucccgcaacaccgacgucaaccacaccuccgagaaccagaacuccgagucccucuucaccgagcccuccaacgucaccaccaucgacgacggcucccgcugcuucuucaccaaguccaagaccgacuacaacgacaccaagaacaagaaggaggucgagucccgcaucuccaagcgcaagcuccacaucuccucccgcgaccagaacaucccccacaaggaccuccgccgccacaagaucuacggccgcaagcgccgccucaccucccaggacuccuccgagugcuucuccucccucucccagggccgcaucaagaccuucucccaguccgagaagcacaucaaguccguccucaacauccucuccgacgaggccucccucugcaaguccaagugccucucccgcaagcucgacaaggccgucguccaccucaagaaggcccaccgccgcguccacaccucccuccagcucaucaccaaggucggcgaggagcgcaagggcccccuccccaaguccuacgccaucaucugcaacaacuucugggaguccugcgaccuccagggcuacuccuccgucucccagcgcaaguacuacuccaccaagcacuucuccuccaagcgcaaguacgacaagcgccgcaagaagcgcgcccccaaggccgacaucuccaagucccucacccacgucuccaagcacaaguccuacaagaccuccggcgagaagaagugccucucccgcaaguccauggccuccuccgucuccaagucccaccccaccaccucccacaugggcgaguucugcaaccaggagcaccccgagucccagcuccccgucuccuccaccucccaguccaccucccaguccgucuacuacaacuccuccgucuccaaccccucccucuccgaggagcaccagcccuucuccggcaagaccgccuaccucuucucccccgaccacuccgacgagaagcucaucgagaaggagaaccagaucgacaccgccuuccucuccuccaccuccaaguacgagaagcucgagaagcacuccgccaaccacaacgucaaggacgccaccaaggagaacuccugcgacgccaacgaggucaucaacgaguccaacuccgucucccucuccugcaucaaggagaacaucaacuccuccaccggcaacgacugcgacgccaccugcaucggccacaccaaggccaagaccgacguccucaucuccguccucgacuccaacgucaagcacuuccucaacgaccucuaccagcagggcaaccucauccucuccgacugcaagcgcaaccucgaggucaaguggaccgaccccaucgagcgccccaagcagaacaucaucaccggcaacuuccucaugggcccccucaaccucacccucaucgccuccaagaaguacuccaucccccagcucuccgccgccgccgucaccgacuccgagggcgaguccuccaaguccuaccucgacaagcagcgcauccucaccgucgacuccuucgccgccuccuccaccgucccccacugcgagcaguccugccgcgagaaggagcuccucaagaccgagcagugcuccuccggcaacugccuccacaccgacggcaacgagaccaacgucaccgagaacuacgagcucgacgucgccuccggcaccgaggaggacaaguccuacggcgagaacaucgucgagcucuccuccuccgacuccucccuccuccucaaggacaacgucaagggcuccuccuccgagaccugcaucgucaagaaggacaccgaggaccgcaucaccuggaaggucaagcaggccgagaaggccaaggacuccgucuacaagcgcuccaugaccgagggcuccaccgucaacaccgaguacaagaaccagaagaaccagaucuccgaggaguccugccucaacgagaagaucaucaccaccaaccucaucgacucccaccucuccaccaagaacaccaccaccgaguccgucccccucaagaacaccgucuccaacccccucaacaagcgcgagaagaagggcgagaucaaggucuccaaggacucccaguccgaccucacccuccacuccgagaucgccuacaucuccaagcccggcauccucggcgucaaccacacccccauccuccccgcccacuccgagaccugcaagguccccacccuccucaagaagcccgccuccuacgucuccgacuucaaggagaagcacugcuccgccaaccacaccgcccucaucgccaaccucucccagauccuccagcgcgccgacgaggccuccucccuccagauccuccaggaggagaccaaggucugccucaacauccucccccucuucgucgaggccuucgagcgcaagcaggagugcuccgucgagcagauccucaucucccgcgagcuccucgucgaccagaaccucuggaacaacugcaagcacacccucaagcccugcgccgucgacacccucgucgagcuccagaugaugauggagaccauccaguucaucgagaacaagaagcgccaccucgagggcgagcccacccuccgcucccuccucugguacgacgagacccucuacgccgagcuccucggcaagccccgcggcuuccagcagcaguccaacuucuaccccggcuuccagggccgccucaaguacaacgccuucugcgagcuccagaccuaccacgaccagcucgucgagcuccucgaggagaccaagcgcgagaagaacuccuacuacgucuuccucaaguacaagcgccaggucaacgagugcgaggccaucauggagcacugcuccgacugcuucgacuucucccucuccguccccuucaccugcggcgucaacuucggcgacucccucgaggaccucgagauccuccgcaaguccacccucaagcucaucaacgucugcggcgacucccccaagguccacuccuaccccggcaagcaggaccaccucuggaucaucaucgagaugaucuccuccaaggucaacuucaucaagaacaacgaggccguccgcgucaagaucucccucuacggccucgagcacaucuucuucgacgccgccaagaaccucgucuggaaggagcgcacccaguccuucuccaagaaguacucccagaagaaggacgaggagcgccuccuccgcgucaacaagugcgccuucuccaagcuccagaagaucuacgacacccucuccaaggaccucaacaacgagcccaucucccccaucggccucgaggaggacaccaucaucgccucccgcaaguccgaccaccccaucaacgaggccaccaucuccaucgagaacuccaaguucaacuccaaccuccucgcccaccccgacaucugcugcaucuccgagauccucgaccaggccgaguucgccgaccucaagaagcuccaggaccucacccuccgcugcaccgaccaccucgagauccucaagaaguacuuccagaugcuccaggacaacaacauggacaacaucuucaucaccgaggagaacguccucgacgucgucaucaaccacucccacgaggccaucauccucaagcccgaggccaucgagauguacaucgagaucgucauggucuccgagaccauccacuuccucaagaacuccaucgccaagaagcucgacaagcagcgcuuccgcggcaugcucugguucgaccucucccuccuccccgagcucguccagugccaggagaagauggccuccuucuccuuccucaaggacaacuccaccgacgucugccucuggaaggucaucgagaccgccgucuccgagcucaagaaggaccucgacaucaucugcaaguacaacgaggccgucaacugcuccuacgccauccaccuccucucccgcgagcuccaggagcucuccgagaucaagaagcuccucaagaaguccaaguacuucaucuccaccuacaucgacuucguccccuacaucgccuccaucaacuacggcuccaccgucaccgagcucgaguacaacuacaaccaguucuccacccuccucaagaacgucauguccgccccccgcaaggaccucggcaagauggcccacauccgcaaggucaugaagaccaucgagcacaugaagaugaucugcaccaagaacgccgagcucaccaucuccuucuuccucugccagaugcucuacaaccgccgcaagauccuccagcucaagcgcaaggagaagaugaacauccacaucgucaagcccggcgagaacaacaacaaguucuccaucuccaccaugcucccccccgucuccgagugcaucaacaagaacaucuccaacuccuccaagaagcgccccuccaccgucgacaagugcgaggacucccaggagcagcagcaggacaccaccgucuccuccugcaagaagcucaaggucgacaugaaggacgucaccaagaucaaccgcgagaaggccaccuucaagcacccccgcaccaccggcucccaccccaaguccgagaacaagaucguccccuccuccugcgacucccucaagcgcaaccaccucacccccaagaaggucgagaugcagcgcucccuccccggcucccuccucccccucgagaaccccaaggacaccugcgccuccaaguccgaguccaagaucgaccucaccgucuccuccgaccacuucuccggccagcaggagaaccucaacuccaugaagaagcgcaacgucaacuucuccgccgccgagaccaaguccgacaagaaggacugcgccgccuucgccaucugcgaccagaaguccguccacggcaccuucucccccgaccacggcacccuccuccagaaguuccucaagaacucccccgaccccacccagaaguccugccucuccgacaucaaccccgagaccgacgucucccucguccccgacgccuccguccucuccaagcccaucuucugcuucgucaaggacguccaccccgaccucgagaugaacgacaccgucuucgagcuccaggacaacgacaucgucaacuccuccaucaagaacuccuccugcaugaccucccccgagcccaucugcauccagaacaagauccccacccuccagaucaacaagcuccagcccaccgagaccgaguccgaggacaaguacaugaaggacacccucaaccccaacaccguccacaccuucggcgccuccggccacaucacccucaacgucaaccagggcgccgaguacucccucuccgagcagcagaacgacaagaacuccaagguccucaugcagaacgccgccaccuacuggaacgagcucccccaguccgccugcaaccccaccuacaacuccuccgagcaccucuucggcaccuccuaccccuacuccgccuggugcgucuaccaguacuccaacuccaacggcaacgccaucacccagaccuaccagggcaucaccuccuacgagguccagcccucccccuccggccuccucaccaccgucgccuccaccgcccagggcacccacuccaaccuccucuacucccaguacuucaccuacuucgccggcgagccccaggccaacggcuucguccccgucaacggcuacuuccagucccagauccccgccuccaacuuccgccagcccaucuucucccaguacgccucccaccagccccucccccaggccaccuaccccuaccuccccaaccgcuucgucccccccgagguccccugggucuacgcccccuggcaccaggaguccuuccaccccggccacuga

SEQ ID NO: 50639 - RNA, 942 nt, Artificial Sequence
  derived and/or modified sequence opt2 from TEX264__Homo_sapiens__NP_001230655
auguccgaccuccuccuccucggccucaucggcggccucacccuccuccuccuccucacccuccucgccuucgccggcuacuccggccuccucgccggcgucgaggucuccgccggcuccccccccauccgcaacgucaccgucgccuacaaguuccacaugggccucuacggcgagaccggccgccucuucaccgaguccugcuccaucucccccaagcuccgcuccaucgccgucuacuacgacaacccccacauggucccccccgacaagugccgcugcgccgucggcuccauccucuccgagggcgaggagucccccucccccgagcucaucgaccucuaccagaaguucggcuucaaggucuucuccuuccccgcccccucccacgucgucaccgccaccuuccccuacaccaccauccucuccaucuggcucgccacccgccgcguccaccccgcccucgacaccuacaucaaggagcgcaagcucugcgccuacccccgccucgagaucuaccaggaggaccagauccacuucaugugcccccucgcccgccagggcgacuucuacguccccgagaugaaggagaccgaguggaaguggcgcggccucgucgaggccaucgacacccaggucgacggcaccggcgccgacaccauguccgacaccuccuccgucucccucgaggucucccccggcucccgcgagaccuccgccgccacccucucccccggcgccuccucccgcggcugggacgacggcgacacccgcuccgagcacuccuacuccgaguccggcgccuccggcuccuccuucgaggagcucgaccucgagggcgagggcccccucggcgagucccgccucgaccccggcaccgagccccucggcaccaccaaguggcucugggagcccaccgcccccgagaagggcaaggaguga

SEQ ID NO: 50640 - RNA, 456 nt, Artificial Sequence
  derived and/or modified sequence opt2 from TEX29__Homo_sapiens__NP_689537
auggaguacguccucgaggucaagaacuccccccgccaccuccucaagcaguucaccgucugcgacgucccccucuacgacaucugcgacuacaacgucucccgcgaccgcugccaggagcucggcugcugcuucuacgagggcgucugcuacaagaaggccguccccaucuacauccacgucuucuccgcccucaucgucaucaucgccggcgccuucgucaucaccaucaucuaccgcgucauccaggagucccgcaaggagaaggccauccccgucgacgucgcccucccccagaaguccuccgagaaggccgagcucgccuccuccuccuccaagcucggccucaagcccgccucccccggcccccccuccgccggccccuccaugaaguccgacgaggacaaggacgacgucaccggcaccaucaccgaggccgaggagaccgaggacuga

SEQ ID NO: 50641 - RNA, 561 nt, Artificial Sequence
  derived and/or modified sequence opt2 from TEX30__Homo_sapiens__NP_001273705
augaaccucccccaccucaugucccucgccucccaccucgccucccacggcuucuucugccuccgcuucaccugcaagggccucaacaucguccaccgcaucaaggccuacaaguccguccucaacuaccucaagaccuccggcgaguacaagcucgccggcgucuuccucggcggccgcuccaugggcucccgcgccgccgccuccgucaugugccacaucgagcccgacgacggcgacgacuucguccgcggccucaucugcaucuccuacccccuccaccaccccaagcagcagcacaagcuccgcgacgaggaccucuuccgccucaaggagcccguccucuucgucuccggcuccgccgacgagaugugcgagaagaaccuccucgagaaggucgcccagaagaugcaggccccccacaagauccacuggaucgagaaggccaaccacuccauggccgucaagggccgcuccaccaacgacgucuucaaggagaucaacacccagauccucuucuggauccaggagaucaccgagauggacaagaagugccacuga

SEQ ID NO: 50642 - RNA, 648 nt, Artificial Sequence
  derived and/or modified sequence opt2 from TEX35__Homo_sapiens__NP_001164193
auguccgccaagcgcgccgagcucaagaagacccaccucgucaaggagcgccacugcuggaccuccaagaacuacaaggccgucugccucgagcucaagcccgagcccaccaagaccuucgacuacaaggccgucaagcaggagggccgcuucaccaaggccggcgucacccaggaccucaagaacgagcuccgcgagguccgcgaggagcucaaggagaagauggaggagaucaagcagaucaaggaccucauggacaaggacuucgacaagcuccacgaguucgucgagaucaugaaggagaugcagaaggacauggacgagaagauggacauccucaucaacacccagaagaacuacaagcucccccuccgccgcgcccccaaggagcagcaggagcuccgccucaugggcaagacccaccgcgagccccagcuccgccccaagaagauggacggcgccuccggcgucaacggcgcccccugcgcccuccacaagaagaccauggccccccagaagaccaagcagggcucccucgacccccuccaccacugcggcaccugcugcgagaagugccuccucugcgcccucaagaacaacuacaaccgcggcaucuacgccgccgucggccuccucgaccucugguga

SEQ ID NO: 50643 - RNA, 603 nt, Artificial Sequence
  derived and/or modified sequence opt2 from TEX40__Homo_sapiens__NP_001034585
auggaggagaagcccuccaaggucucccucaaguccuccgaccgccagggcuccgacgaggaguccguccacuccgacacccgcgaccucuggaccaccaccacccucucccaggcccagcucaacaugccccucuccgaggucugcgagggcuucgacgaggagggccgcaacaucuccaagacccgcggcuggcacucccccggccgcggcucccucgacgagggcuacaaggccucccacaagcccgaggagcucgacgagcacgcccucgucgagcucgagcuccaccgcggcuccuccauggagaucaaccucggcgagaaggacaccgccucccagaucgaggccgagaaguccuccuccauguccucccucaacaucgccaagcacaugccccaccgcgccuacugggccgagcagcagucccgccucccccucccccucauggagcucauggagaacgaggcccucgagauccucaccaaggcccuccgcuccuaccagcucggcaucggccgcgaccacuuccucaccaaggagcuccagcgcuacaucgagggccucaagaagcgccgcuccaagcgccucuacgucaacuga

SEQ ID NO: 50644 - RNA, 645 nt, Artificial Sequence
  derived and/or modified sequence opt2 from TFAM__Homo_sapiens__NP_001257711
auggccuuccuccgcuccauguggggcguccucuccgcccucggccgcuccggcgccgagcucugcaccggcugcggcucccgccuccgcucccccuucuccuucgucuaccucccccgcugguucuccuccguccucgccuccugccccaagaagcccgucuccuccuaccuccgcuucuccaaggagcagcuccccaucuucaaggcccagaaccccgacgccaagaccaccgagcucauccgccgcaucgcccagcgcuggcgcgagcuccccgacuccaagaagaagaucuaccaggacgccuaccgcgccgaguggcaggucuacaaggaggagaucucccgcuucaaggagcagcucacccccucccagaucaugucccucgagaaggagaucauggacaagcaccucaagcgcaaggccaugaccaagaagaaggagaagcucaagaccgucaaggagaacuggaagaaccucuccgacuccgagaaggagcucuacauccagcacgccaaggaggacgagacccgcuaccacaacgagaugaaguccugggaggagcagaugaucgaggucggccgcaaggaccuccuccgccgcaccaucaagaagcagcgcaaguacggcgccgaggagugcuga

SEQ ID NO: 50645 - RNA, 1296 nt, Artificial Sequence
  derived and/or modified sequence opt2 from TFAP2A__Homo_sapiens__NP_001027451
augcucguccacuccuucuccgccauggaccgccacgacggcaccuccaacggcaccgcccgccucccccagcucggcaccgucggccagucccccuacaccuccgcccccccccucucccacacccccaacgccgacuuccagccccccuacuuccccccccccuaccagcccaucuacccccagucccaggaccccuacucccacgucaacgaccccuacucccucaacccccuccacgcccagccccagccccagcaccccggcuggcccggccagcgccagucccaggaguccggccuccuccacacccaccgcggccucccccaccagcucuccggccucgacccccgccgcgacuaccgccgccacgaggaccuccuccacggcccccacgcccucuccuccggccucggcgaccucuccauccacucccucccccacgccaucgaggaggucccccacgucgaggaccccggcaucaacauccccgaccagaccgucaucaagaagggccccgucucccucuccaaguccaacuccaacgccgucuccgccauccccaucaacaaggacaaccucuucggcggcgucgucaaccccaacgaggucuucugcuccguccccggccgccucucccuccucuccuccaccuccaaguacaaggucaccgucgccgagguccagcgccgccucuccccccccgagugccucaacgccucccuccucggcggcguccuccgccgcgccaaguccaagaacggcggccgcucccuccgcgagaagcucgacaagaucggccucaaccuccccgccggccgccgcaaggccgccaacgucacccuccucaccucccucgucgagggcgaggccguccaccucgcccgcgacuucggcuacgucugcgagaccgaguuccccgccaaggccgucgccgaguuccucaaccgccagcacuccgaccccaacgagcaggucacccgcaagaacaugcuccucgccaccaagcagaucugcaaggaguucaccgaccuccucgcccaggaccgcuccccccucggcaacucccgccccaaccccauccucgagcccggcauccaguccugccucacccacuucaaccucaucucccacggcuucggcucccccgccgucugcgccgccgucaccgcccuccagaacuaccucaccgaggcccucaaggccauggacaagauguaccucuccaacaaccccaacucccacaccgacaacaacgccaaguccuccgacaaggaggagaagcaccgcaaguga

SEQ ID NO: 50646 - RNA, 1383 nt, Artificial Sequence
  derived and/or modified sequence opt2 from TFAP2B__Homo_sapiens__NP_003212
augcacucccccccccgcgaccaggccgccaucaugcucuggaagcucgucgagaacgucaaguacgaggacaucuacgaggaccgccacgacggcguccccucccacuccucccgccucucccagcucggcuccgucucccagggccccuacuccuccgcccccccccucucccacacccccuccuccgacuuccagccccccuacuuccccccccccuaccagccccuccccuaccaccagucccaggaccccuacucccacgucaacgaccccuacucccucaacccccuccaccagccccagcagcaccccuggggccagcgccagcgccaggaggucggcuccgaggccggcucccuccucccccagccccgcgccgcccucccccagcucuccggccucgacccccgccgcgacuaccacuccguccgccgccccgacguccuccuccacuccgcccaccacggccucgacgccggcaugggcgacucccucucccuccacggccucggccaccccggcauggaggacguccaguccgucgaggacgccaacaacuccggcaugaaccuccucgaccaguccgucaucaagaagguccccgucccccccaaguccgucaccucccucaugaugaacaaggacggcuuccucggcggcauguccgucaacaccggcgaggucuucugcuccguccccggccgccucucccuccucuccuccaccuccaaguacaaggucaccgucggcgagguccagcgccgccucuccccccccgagugccucaacgccucccuccucggcggcguccuccgccgcgccaaguccaagaacggcggccgcucccuccgcgagcgccucgagaagaucggccucaaccuccccgccggccgccgcaaggccgccaacgucacccuccucaccucccucgucgagggcgaggccguccaccucgcccgcgacuucggcuacaucugcgagaccgaguuccccgccaaggccgucuccgaguaccucaaccgccagcacaccgaccccuccgaccuccacucccgcaagaacaugcuccucgccaccaagcagcucugcaaggaguucaccgaccuccucgcccaggaccgcacccccaucggcaacucccgccccucccccauccucgagcccggcauccaguccugccucacccacuucucccucaucacccacggcuucggcgcccccgccaucugcgccgcccucaccgcccuccagaacuaccucaccgaggcccucaagggcauggacaagauguuccucaacaacaccaccaccaaccgccacaccuccggcgagggccccggcuccaagaccggcgacaaggaggagaagcaccgcaaguga

SEQ ID NO: 50647 - RNA, 1353 nt, Artificial Sequence
  derived and/or modified sequence opt2 from TFAP2C__Homo_sapiens__NP_003213
augcucuggaagaucaccgacaacgucaaguacgaggaggacugcgaggaccgccacgacggcuccuccaacggcaacccccgcgucccccaccucuccuccgccggccagcaccucuacucccccgcccccccccucucccacaccggcgucgccgaguaccagcccccccccuacuuccccccccccuaccagcagcucgccuacucccaguccgccgaccccuacucccaccucggcgaggccuacgccgccgccaucaacccccuccaccagcccgcccccaccggcucccagcagcaggccuggcccggccgccagucccaggagggcgccggccuccccucccaccacggccgccccgccggccuccucccccaccucuccggccucgaggccggcgccgucuccgcccgccgcgacgccuaccgccgcuccgaccuccuccucccccacgcccacgcccucgacgccgccggccucgccgagaaccucggccuccacgacaugccccaccagauggacgagguccagaacgucgacgaccagcaccuccuccuccacgaccagaccgucauccgcaagggccccaucuccaugaccaagaacccccucaaccuccccugccagaaggagcucgucggcgccgucaugaaccccaccgaggucuucugcuccguccccggccgccucucccuccucuccuccaccuccaaguacaaggucaccgucgccgagguccagcgccgccucuccccccccgagugccucaacgccucccuccucggcggcguccuccgccgcgccaaguccaagaacggcggccgcucccuccgcgagaagcucgacaagaucggccucaaccuccccgccggccgccgcaaggccgcccacgucacccuccucaccucccucgucgagggcgaggccguccaccucgcccgcgacuucgccuacgucugcgaggccgaguuccccuccaagcccgucgccgaguaccucacccgcccccaccucggcggccgcaacgagauggccgcccgcaagaacaugcuccucgccgcccagcagcucugcaaggaguucaccgagcuccucucccaggaccgcaccccccacggcaccucccgccucgcccccguccucgagaccaacauccagaacugccucucccacuucucccucaucacccacggcuucggcucccaggccaucugcgccgccgucuccgcccuccagaacuacaucaaggaggcccucaucgucaucgacaaguccuacaugaaccccggcgaccagucccccgccgacuccaacaagacccucgagaagauggagaagcaccgcaaguga

SEQ ID NO: 50648 - RNA, 1017 nt, Artificial Sequence
  derived and/or modified sequence opt2 from TFAP4__Homo_sapiens__NP_003214
auggaguacuucaugguccccacccagaagguccccucccuccagcacuuccgcaagaccgagaaggaggucaucggcggccucugcucccucgccaacaucccccucacccccgagacccagcgcgaccaggagcgccgcauccgccgcgagaucgccaacuccaacgagcgccgccgcaugcaguccaucaacgccggcuuccagucccucaagacccucaucccccacaccgacggcgagaagcucuccaaggccgccauccuccagcagaccgccgaguacaucuucucccucgagcaggagaagacccgccuccuccagcagaacacccagcucaagcgcuucauccaggagcucuccggcuccucccccaagcgccgccgcgccgaggacaaggacgagggcaucggcucccccgacaucugggaggacgagaaggccgaggaccuccgccgcgagaugaucgagcuccgccagcagcucgacaaggagcgcuccguccgcaugaugcucgaggagcagguccgcucccucgaggcccacauguaccccgagaagcucaaggucaucgcccagcagguccagcuccagcagcagcaggagcagguccgccuccuccaccaggagaagcucgagcgcgagcagcagcagcuccgcacccagcuccuccccccccccgcccccacccaccaccccaccgucaucguccccgcccccccccccccccccucccaccacaucaacgucgucaccaugggccccuccuccgucaucaacuccgucuccaccucccgccagaaccucgacaccaucguccaggccauccagcacaucgagggcacccaggagaagcaggagcucgaggaggagcagcgccgcgccgucaucgucaagcccguccgcuccugccccgaggcccccaccuccgacaccgccuccgacuccgaggccuccgacuccgacgccauggaccagucccgcgaggagcccuccggcgacggcgagcuccccuga

SEQ ID NO: 50649 - RNA, 1041 nt, Artificial Sequence
  derived and/or modified sequence opt2 from TFB1M__Homo_sapiens__NP_057104
auggccgccuccggcaagcucuccaccugccgccuccccccccuccccaccauccgcgagaucaucaagcuccuccgccuccaggccgccaagcagcucucccagaacuuccuccucgaccuccgccucaccgacaagaucguccgcaaggccggcaaccucaccaacgccuacgucuacgaggucggccccggccccggcggcaucacccgcuccauccucaacgccgacgucgccgagcuccucgucgucgagaaggacacccgcuucauccccggccuccagaugcucuccgacgccgcccccggcaagcuccgcaucguccacggcgacguccucaccuucaaggucgagaaggccuucuccgagucccucaagcgccccugggaggacgacccccccaacguccacaucaucggcaaccuccccuucuccgucuccaccccccucaucaucaaguggcucgagaacaucuccugccgcgacggccccuucgucuacggccgcacccagaugacccucaccuuccagaaggaggucgccgagcgccucgccgccaacaccggcuccaagcagcgcucccgccucuccgucauggcccaguaccucugcaacguccgccacaucuucaccauccccggccaggccuucguccccaagcccgaggucgacgucggcgucguccacuucaccccccucauccagcccaagaucgagcagcccuucaagcucgucgagaaggucguccagaacgucuuccaguuccgccgcaaguacugccaccgcggccuccgcaugcucuuccccgaggcccagcgccucgaguccaccggccgccuccucgagcucgccgacaucgaccccacccuccgcccccgccagcucuccaucucccacuucaagucccucugcgacgucuaccgcaagaugugcgacgaggacccccagcucuucgccuacaacuuccgcgaggagcucaagcgccgcaaguccaagaacgaggagaaggaggaggacgacgccgagaacuaccgccucuga

SEQ ID NO: 50650 - RNA, 1191 nt, Artificial Sequence
  derived and/or modified sequence opt2 from TFB2M__Homo_sapiens__NP_071761
auguggauccccgucgucggccucccccgccgccuccgccucuccgcccucgccggcgccggccgcuucugcauccucggcuccgaggccgccacccgcaagcaccuccccgcccgcaaccacugcggccucuccgacuccuccccccagcucuggcccgagcccgacuuccgcaaccccccccgcaaggccuccaaggccucccucgacuucaagcgcuacgucaccgaccgccgccucgccgagacccucgcccagaucuaccucggcaagcccucccgccccccccaccuccuccucgagugcaaccccggccccggcauccucacccaggcccuccucgaggccggcgccaaggucgucgcccucgaguccgacaagaccuucaucccccaccucgagucccucggcaagaaccucgacggcaagcuccgcgucauccacugcgacuucuucaagcucgacccccgcuccggcggcgucaucaagccccccgccauguccucccgcggccucuucaagaaccucggcaucgaggccguccccuggaccgccgacaucccccucaaggucgucggcauguuccccucccgcggcgagaagcgcgcccucuggaagcucgccuacgaccucuacuccugcaccuccaucuacaaguucggccgcaucgaggucaacauguucaucggcgagaaggaguuccagaagcucauggccgaccccggcaaccccgaccucuaccacguccucuccgucaucuggcagcucgccugcgagaucaagguccuccacauggagcccugguccuccuucgacaucuacacccgcaagggcccccucgagaaccccaagcgccgcgagcuccucgaccagcuccagcagaagcucuaccucauccagaugaucccccgccagaaccucuucaccaagaaccucacccccaugaacuacaacaucuucuuccaccuccucaagcacugcuucggccgccgcuccgccaccgucaucgaccaccuccgcucccucaccccccucgacgcccgcgacauccucaugcagaucggcaagcaggaggacgagaaggucgucaacaugcacccccaggacuucaagacccucuucgagaccaucgagcgcuccaaggacugcgccuacaaguggcucuacgacgagacccucgaggaccgcuga

SEQ ID NO: 50651 - RNA, 1353 nt, Artificial Sequence
  derived and/or modified sequence opt2 from TFCP2__Homo_sapiens__NP_001166924
auggccugggcccucaagcucccccucgccgacgaggucaucgaguccggccucguccaggacuucgacgccucccucuccggcaucggccaggagcucggcgccggcgccuacuccauguccgacguccucgcccuccccaucuucaagcaggaggaguccucccucccccccgacaacgagaacaagauccuccccuuccaguacguccucugcgccgccaccucccccgccgucaagcuccacgacgagacccucaccuaccucaaccagggccaguccuacgagauccgcaugcucgacaaccgcaagcucggcgagcuccccgagaucaacggcaagcucgucaaguccaucuuccgcgucgucuuccacgaccgccgccuccaguacaccgagcaccagcagcucgagggcuggcgcuggaaccgccccggcgaccgcauccucgacaucgacauccccauguccgucggcaucaucgacccccgcgccaaccccacccagcucaacaccgucgaguuccucugggaccccgccaagcgcaccuccgucuucauccagcccaagggcgccgaccgcaagcagaagaccgaccgcgagaagauggagaagcgcaccccccacgagaaggagaaguaccagcccuccuacgagaccaccauccucaccgagugcucccccuggcccgagaucaccuacgucaacaacucccccucccccggcuucaacuccucccacuccuccuucucccucggcgagggcaacggcucccccaaccaccagcccgagccccccccccccgucaccgacaaccuccuccccaccaccaccccccaggaggcccagcaguggcuccaccgcaaccgcuucuccaccuucacccgccucuucaccaacuucuccggcgccgaccuccucaagcucacccgcgacgacgucauccagaucugcggccccgccgacggcauccgccucuucaacgcccucaagggccgcaugguccgcccccgccucaccaucuacgucugccaggagucccuccagcuccgcgagcagcagcagcagcagcagcagcagcagcagaagcacgaggacggcgacuccaacggcaccuucuucgucuaccacgccaucuaccucgaggagcucaccgccgucgagcucaccgagaagaucgcccagcucuucuccaucucccccugccagaucucccagaucuacaagcagggccccaccggcauccacguccucaucuccgacgagaugauccagaacuuccaggaggaggccugcuucauccucgacaccaugaaggagaccaacgacuccuaccacaucauccucaaguga

SEQ ID NO: 50652 - RNA, 1233 nt, Artificial Sequence
  derived and/or modified sequence opt2 from TFDP1__Homo_sapiens__XP_005268384
auggccaaggacgccggccucaucgaggccaacggcgagcucaaggucuucaucgaccagaaccucucccccggcaagggcgucgucucccucgucgccguccaccccuccaccgucaacccccucggcaagcagcuccuccccaagaccuucggccaguccaacgucaacaucgcccagcaggucgucaucggcaccccccagcgccccgccgccuccaacacccucgucgucggcuccccccacacccccuccacccacuucgccucccagaaccagcccuccgacuccucccccugguccgccggcaagcgcaaccgcaagggcgagaagaacggcaagggccuccgccacuucuccaugaaggucugcgagaagguccagcgcaagggcaccaccuccuacaacgaggucgccgacgagcucgucgccgaguucuccgccgccgacaaccacauccuccccaacgaguccgccuacgaccagaagaacauccgccgccgcgucuacgacgcccucaacguccucauggccaugaacaucaucuccaaggagaagaaggagaucaaguggaucggccuccccaccaacuccgcccaggagugccagaaccucgaggucgagcgccagcgccgccucgagcgcaucaagcagaagcagucccagcuccaggagcucauccuccagcagaucgccuucaagaaccucguccagcgcaaccgccacgccgagcagcaggccucccgcccccccccccccaacuccgucauccaccuccccuucaucaucgucaacaccuccaagaagaccgucaucgacugcuccaucuccaacgacaaguucgaguaccucuucaacuucgacaacaccuucgagauccacgacgacaucgagguccucaagcgcaugggcauggccugcggccucgaguccggcuccugcuccgccgaggaccucaagauggcccgcucccucguccccaaggcccucgagcccuacgucaccgagauggcccagggcaccgucggcggcgucuucaucaccaccgccggcuccaccuccaacggcacccgcuucuccgccuccgaccucaccaacggcgccgacggcaugcucgccaccuccuccaacggcucccaguacuccggcucccgcgucgagacccccgucuccuacgucggcgaggacgacgaggaggacgacgacuucaacgagaacgacgaggacgacuga

SEQ ID NO: 50653 - RNA, 1161 nt, Artificial Sequence
  derived and/or modified sequence opt2 from TFDP2__Homo_sapiens__NP_001171609
augaucaucuccaccccccagcgccucaccuccuccggcuccguccucaucggcucccccuacacccccgcccccgccauggucacccagacccacaucgccgaggccaccggcuggguccccggcgaccgcaagcgcgcccgcaaguucaucgacuccgacuucuccgaguccaagcgcuccaagaagggcgacaagaacggcaagggccuccgccacuucuccaugaaggucugcgagaagguccagcgcaagggcaccaccuccuacaacgaggucgccgacgagcucgucuccgaguucaccaacuccaacaaccaccucgccgccgacucccaggccuacgaccagaagaacauccgccgccgcgucuacgacgcccucaacguccucauggccaugaacaucaucuccaaggagaagaaggagaucaaguggaucggccuccccaccaacuccgcccaggagugccagaaccucgagaucgagaagcagcgccgcaucgagcgcaucaagcagaagcgcgcccagcuccaggagcuccuccuccagcagaucgccuucaagaaccucguccagcgcaaccgccagaacgagcagcagaaccagggcccccccgcccucaacuccaccauccagcuccccuucaucaucaucaacaccucccgcaagaccgucaucgacugcuccaucuccuccgacaaguucgaguaccucuucaacuucgacaacaccuucgagauccacgacgacaucgagguccucaagcgcaugggcauguccuucggccucgaguccggcaagugcucccucgaggaccucaagcucgccaagucccucguccccaaggcccucgagggcuacaucaccgacaucuccaccggccccuccuggcucaaccagggccuccuccucaacuccacccaguccgucuccaaccucgaccucaccaccggcgccacccucccccaguccuccgucaaccagggccucugccucgacgccgaggucgcccucgccaccggccaguuccucgcccccaacucccaccaguccuccuccgccgccucccacugcuccgagucccgcggcgagacccccugcuccuucaacgacgaggacgaggaggacgacgaggaggacuccuccucccccgaguga

SEQ ID NO: 50654 - RNA, 1218 nt, Artificial Sequence
  derived and/or modified sequence opt2 from TFDP3__Homo_sapiens__NP_057605
auggccaaguacgucucccucaccgaggccaacgaggagcucaagguccucauggacgagaaccagaccucccgccccgucgccguccacaccuccaccgucaacccccucggcaagcagcuccuccccaagaccuucggccaguccuccgucaacaucgaccagcaggucgucaucggcaugccccagcgccccgccgccuccaacauccccgucgucggcucccccaacccccccuccacccacuucgccucccagaaccagcacuccuacuccuccccccccugggccggccagcacaaccgcaagggcgagaagaacggcaugggccucugccgccucuccaugaaggucugggagaccguccagcgcaagggcaccaccuccugccaggaggucgucggcgagcucgucgccaaguuccgcgccgccuccaaccacgccucccccaacgaguccgccuacgacgucaagaacaucaagcgccgcaccuacgacgcccucaacguccucauggccaugaacaucaucucccgcgagaagaagaagaucaaguggaucggccucaccaccaacuccgcccagaacugccagaaccuccgcgucgagcgccagaagcgccucgagcgcaucaagcagaagcaguccgagcuccagcagcucauccuccagcagaucgccuucaagaaccucguccuccgcaaccaguacgucgaggagcaggucucccagcgcccccuccccaacuccgucauccacguccccuucaucaucaucuccuccuccaagaagaccgucaucaacugcuccaucuccgacgacaaguccgaguaccucuucaaguucaacuccuccuucgagauccacgacgacaccgagguccucauguggaugggcaugaccuucggccucgaguccggcuccugcuccgccgaggaccucaagauggcccgcaaccucguccccaaggcccucgagcccuacgucaccgagauggcccagggcaccuucggcggcgucuucaccaccgccggcucccgcuccaacggcaccuggcucuccgccuccgaccucaccaacaucgccaucggcaugcucgccaccuccuccggcggcucccaguacuccggcucccgcgucgagacccccgccgucgaggaggaggaggaggaggacaacaacgacgacgaccucuccgagaacgacgaggacgacuga

SEQ ID NO: 50655 - RNA, 1728 nt, Artificial Sequence
  derived and/or modified sequence opt2 from TFE3__Homo_sapiens__NP_006512
augucccacgccgccgagcccgcccgcgacggcgucgaggccuccgccgagggcccccgcgccgucuucguccuccucgaggagcgccgccccgccgacuccgcccagcuccucucccucaacucccuccuccccgaguccggcaucgucgccgacaucgagcucgagaacguccucgaccccgacuccuucuacgagcucaagucccagccccucccccuccgcuccucccuccccaucucccuccaggccacccccgccacccccgccacccucuccgccuccuccuccgccggcggcucccgcacccccgccauguccuccuccuccuccucccgcguccuccuccgccagcagcucaugcgcgcccaggcccaggagcaggagcgccgcgagcgccgcgagcaggccgccgccgcccccuuccccucccccgcccccgccucccccgccaucuccgucgucggcgucuccgccggcggccacacccucucccgccccccccccgcccaggucccccgcgagguccucaagguccagacccaccucgagaaccccacccgcuaccaccuccagcaggcccgccgccagcaggucaagcaguaccucuccaccacccucggccccaagcucgccucccaggcccucacccccccccccggccccgccuccgcccagccccuccccgcccccgaggccgcccacaccaccggccccaccggcuccgcccccaacucccccauggcccuccucaccaucggcuccuccuccgagaaggagaucgacgacgucaucgacgagaucaucucccucgaguccuccuacaacgacgagaugcucuccuaccuccccggcggcaccaccggccuccagcuccccuccacccuccccgucuccggcaaccuccucgacgucuacuccucccagggcgucgccacccccgccaucaccgucuccaacuccugccccgccgagcuccccaacaucaagcgcgagaucuccgagaccgaggccaaggcccuccucaaggagcgccagaagaaggacaaccacaaccucaucgagcgccgccgccgcuucaacaucaacgaccgcaucaaggagcucggcacccucauccccaaguccuccgaccccgagaugcgcuggaacaagggcaccauccucaaggccuccgucgacuacauccgcaagcuccagaaggagcagcagcgcuccaaggaccucgagucccgccagcgcucccucgagcaggccaaccgcucccuccagcuccgcauccaggagcucgagcuccaggcccagauccacggccuccccgucccccccacccccggccuccucucccucgccaccaccuccgccuccgacucccucaagcccgagcagcucgacaucgaggaggagggccgccccggcgccgccaccuuccacgucggcggcggccccgcccagaacgccccccaccagcagccccccgccccccccuccgacgcccuccucgaccuccacuuccccuccgaccaccucggcgaccucggcgaccccuuccaccucggccucgaggacauccucauggaggaggaggagggcgucgucggcggccucuccggcggcgcccucuccccccuccgcgccgccuccgacccccuccucuccuccgucucccccgccgucuccaaggccuccucccgccgcuccuccuucuccauggaggaggaguccuga

SEQ ID NO: 50656 - RNA, 1473 nt, Artificial Sequence
  derived and/or modified sequence opt2 from TFEB__Homo_sapiens__NP_001161299
augaccgccuccuccggcugggagcccgcccccgccgccaccauggccucccgcaucggccuccgcaugcagcucaugcgcgagcaggcccagcaggaggagcagcgcgagcgcaugcagcagcaggccgucaugcacuacaugcagcagcagcagcagcagcagcagcagcagcucggcggcccccccacccccgccaucaacacccccguccacuuccagucccccccccccguccccggcgagguccucaagguccaguccuaccucgagaaccccaccuccuaccaccuccagcagucccagcaccagaagguccgcgaguaccucuccgagaccuacggcaacaaguucgccgcccacaucucccccgcccagggcucccccaagcccccccccgccgccucccccggcguccgcgccggccacguccucuccuccuccgccggcaacuccgcccccaacucccccauggccaugcuccacaucggcuccaaccccgagcgcgagcucgacgacgucaucgacaacaucaugcgccucgacgacguccucggcuacaucaaccccgagaugcagaugcccaacacccucccccucuccuccucccaccucaacgucuacuccuccgacccccaggucaccgccucccucgucggcgucaccuccuccuccugccccgccgaccucacccagaagcgcgagcucaccgacgccgagucccgcgcccucgccaaggagcgccagaagaaggacaaccacaaccucaucgagcgccgccgccgcuucaacaucaacgaccgcaucaaggagcucggcaugcucauccccaaggccaacgaccucgacguccgcuggaacaagggcaccauccucaaggccuccgucgacuacauccgccgcaugcagaaggaccuccagaagucccgcgagcucgagaaccacucccgccgccucgagaugaccaacaagcagcucuggcuccgcauccaggagcucgagaugcaggcccgcguccacggccuccccaccaccucccccuccggcaugaacauggccgagcucgcccagcaggucgucaagcaggagcuccccuccgaggagggccccggcgaggcccucaugcucggcgccgagguccccgaccccgagccccuccccgcccuccccccccaggccccccucccccuccccacccagccccccucccccuuccaccaccucgacuucucccacucccucuccuucggcggccgcgaggacgagggcccccccggcuaccccgagccccucgcccccggccacggcucccccuuccccucccucuccaagaaggaccucgaccucaugcuccucgacgacucccuccucccccucgccuccgacccccuccucuccaccaugucccccgaggccuccaaggccuccucccgccgcuccuccuucuccauggaggagggcgacguccucuga

SEQ ID NO: 50657 - RNA, 957 nt, Artificial Sequence
  derived and/or modified sequence opt2 from TFEC__Homo_sapiens__NP_001018068
augacccucgaccaccagaucaucaaccccacccucaaguggucccagcccgccguccccuccggcggcccccucguccagcacgcccacaccacccucgacuccgacgccggccucaccgagaacccccucaccaagcuccucgccaucggcaaggaggacgacaacgcccaguggcaccucuccggcuccauccucgacgucuacuccggcgagcagggcaucucccccaucaacaugggccucaccuccgccuccugccccuccucccuccccaugaagcgcgagaucaccgagaccgacacccgcgcccucgccaaggagcgccagaagaaggacaaccacaaccucaucgagcgccgccgccgcuacaacaucaacuaccgcaucaaggagcucggcacccucauccccaaguccaacgaccccgacaugcgcuggaacaagggcaccauccucaaggccuccgucgaguacaucaaguggcuccagaaggagcagcagcgcgcccgcgagcucgagcaccgccagaagaagcucgagcaggccaaccgccgccuccuccuccgcauccaggagcucgagauccaggcccgcacccacggccuccccacccucgccucccucggcaccgucgaccucggcgcccacgucaccaagcagcagucccaccccgagcagaacuccgucgacuacugccagcagcucaccgucucccagggccccucccccgagcucugcgaccaggccaucgccuucuccgacccccucuccuacuucaccgaccucuccuucuccgccgcccucaaggaggagcagcgccucgacggcaugcuccucgacgacaccaucucccccuucggcaccgacccccuccucuccgccaccucccccgccgucuccaaggaguccucccgccgcuccuccuucuccuccgacgacggcgacgagcucuga

SEQ ID NO: 50658 - RNA, 255 nt, Artificial Sequence
  derived and/or modified sequence opt2 from TFF1__Homo_sapiens__NP_003216
auggccaccauggagaacaaggucaucugcgcccucguccucgucuccaugcucgcccucggcacccucgccgaggcccagaccgagaccugcaccgucgccccccgcgagcgccagaacugcggcuuccccggcgucacccccucccagugcgccaacaagggcugcugcuucgacgacaccguccgcggcguccccuggugcuucuaccccaacaccaucgacgucccccccgaggaggagugcgaguucuga

SEQ ID NO: 50659 - RNA, 390 nt, Artificial Sequence
  derived and/or modified sequence opt2 from TFF2__Homo_sapiens__NP_005414
augggccgccgcgacgcccagcuccucgccgcccuccucguccucggccucugcgcccucgccggcuccgagaagcccucccccugccagugcucccgccucuccccccacaaccgcaccaacugcggcuuccccggcaucaccuccgaccagugcuucgacaacggcugcugcuucgacuccuccgucaccggcguccccuggugcuuccacccccuccccaagcaggaguccgaccagugcgucauggaggucuccgaccgccgcaacugcggcuaccccggcaucucccccgaggagugcgccucccgcaagugcugcuucuccaacuucaucuucgagguccccuggugcuucuuccccaaguccgucgaggacugccacuacuga

SEQ ID NO: 50660 - RNA, 285 nt, Artificial Sequence
  derived and/or modified sequence opt2 from TFF3__Homo_sapiens__NP_003217
augaagcgcguccucuccugcguccccgagcccaccgucgucauggccgcccgcgcccucugcaugcucggccucguccucgcccuccucuccuccuccuccgccgaggaguacgucggccucuccgccaaccagugcgccguccccgccaaggaccgcgucgacugcggcuacccccacgucacccccaaggagugcaacaaccgcggcugcugcuucgacucccgcauccccggcguccccuggugcuucaagccccuccaggaggccgagugcaccuucuga

SEQ ID NO: 50661 - RNA, 1203 nt, Artificial Sequence
  derived and/or modified sequence opt2 from TFG__Homo_sapiens__NP_001007566
augaacggccagcucgaccucuccggcaagcucaucaucaaggcccagcucggcgaggacauccgccgcauccccauccacaacgaggacaucaccuacgacgagcucguccucaugaugcagcgcgucuuccgcggcaagcuccucuccaacgacgaggucaccaucaaguacaaggacgaggacggcgaccucaucaccaucuucgacuccuccgaccucuccuucgccauccagugcucccgcauccucaagcucacccucuucgucaacggccagccccgcccccucgaguccucccaggucaaguaccuccgccgcgagcucaucgagcuccgcaacaaggucaaccgccuccucgacucccucgagccccccggcgagcccggccccuccaccaacauccccgagaacgacaccgucgacggccgcgaggagaaguccgccuccgacuccuccggcaagcaguccacccaggucauggccgccuccauguccgccuucgacccccucaagaaccaggacgagaucaacaagaacgucauguccgccuucggccucaccgacgaccaggucuccggcccccccuccgcccccgccgaggaccgcuccggcacccccgacuccaucgccuccuccuccuccgccgcccacccccccggcguccagccccagcagccccccuacaccggcgcccagacccaggccggccagaucgagggccagauguaccagcaguaccagcagcaggccggcuacggcgcccagcagccccaggcccccccccagcagccccagcaguacggcauccaguacuccgccuccuacucccagcagaccggcccccagcagccccagcaguuccagggcuacggccagcagcccaccucccaggcccccgcccccgccuucuccggccagccccagcagcuccccgcccagcccccccagcaguaccaggccuccaacuaccccgcccagaccuacaccgcccagaccucccagcccaccaacuacaccgucgcccccgccucccagcccggcauggcccccucccagcccggcgccuaccagccccgccccggcuucaccucccuccccggcuccaccaugacccccccccccuccggccccaaccccuacgcccgcaaccgcccccccuucggccagggcuacacccagcccggccccggcuaccgcuga

SEQ ID NO: 50662 - RNA, 2097 nt, Artificial Sequence
  derived and/or modified sequence opt2 from TF__Homo_sapiens__XP_011511402
augcgccucgccgucggcgcccuccucgucugcgccguccucggccucugccucgccguccccgacaagaccguccgcuggugcgccgucuccgagcacgaggccaccaagugccaguccuuccgcgaccacaugaaguccgucauccccuccgacggccccuccgucgccugcgucaagaaggccuccuaccucgacugcauccgcgccaucgccgccaacgaggccgacgccgucacccucgacgccggccucgucuacgacgccuaccucgcccccaacaaccucaagcccgucgucgccgaguucuacggcuccaaggaggacccccagaccuucuacuacgccgucgccgucgucaagaaggacuccggcuuccagaugaaccagcuccgcggcaagaaguccugccacaccggccucggccgcuccgccggcuggaacauccccaucggccuccucuacugcgaccuccccgagccccgcaagccccucgagaaggccgucgccaacuucuucuccggcuccugcgcccccugcgccgacggcaccgacuucccccagcucugccagcucugccccggcugcggcugcuccacccucaaccaguacuucggcuacuccggcgccuucaagugccucaaggacggcgccggcgacgucgccuucgucaagcacuccaccaucuucgagaaccucgccaacaaggccgaccgcgaccaguacgagcuccucugccucgacaacacccgcaagcccgucgacgaguacaaggacugccaccucgcccagguccccucccacaccgucgucgcccgcuccaugggcggcaaggaggaccucaucugggagcuccucaaccaggcccaggagcacuucggcaaggacaaguccaaggaguuccagcucuucuccuccccccacggcaaggaccuccucuucaaggacuccgcccacggcuuccucaagguccccccccgcauggacgccaagauguaccucggcuacgaguacgucaccgccauccgcaaccuccgcgagggcaccugccccgaggcccccaccgacgagugcaagcccgucaaguggugcgcccucucccaccacgagcgccucaagugcgacgagugguccgucaacuccgucggcaagaucgagugcgucuccgccgagaccaccgaggacugcaucgccaagaucaugaacggcgaggccgacgccaugucccucgacggcggcuucgucuacaucgccggcaagugcggccucguccccguccucgccgagaacuacaacaaguccgacaacugcgaggacacccccgaggccggcuacuucgccaucgccgucgucaagaaguccgccuccgaccucaccugggacaaccucaagggcaagaaguccugccacaccgccgucggccgcaccgccggcuggaacauccccaugggccuccucuacaacaagaucaaccacugccgcuucgacgaguucuucuccgagggcugcgcccccggcuccaagaaggacuccucccucugcaagcucugcaugggcuccggccucaaccucugcgagcccaacaacaaggagggcuacuacggcuacaccggcgccuuccgcugccucgucgagaagggcgacgucgccuucgucaagcaccagaccgucccccagaacaccggcggcaagaaccccgaccccugggccaagaaccucaacgagaaggacuacgagcuccucugccucgacggcacccgcaagcccgucgaggaguacgccaacugccaccucgcccgcgcccccaaccacgccgucgucacccgcaaggacaaggaggccugcguccacaagauccuccgccagcagcagcaccucuucggcuccaacgucaccgacugcuccggcaacuucugccucuuccgcuccgagaccaaggaccuccucuuccgcgacgacaccgucugccucgccaagcuccacgaccgcaacaccuacgagaaguaccucggcgaggaguacgucaaggccgucggcaaccuccgcaagugcuccaccuccucccuccucgaggccugcaccuuccgccgccccuga

SEQ ID NO: 50663 - RNA, 2514 nt, Artificial Sequence
  derived and/or modified sequence opt2 from TFIP11__Homo_sapiens__XP_011528381
augucccucucccaccucuaccgcgacggcgagggccgcaucgacgacgacgacgacgagcgcgagaacuucgagaucaccgacugggaccuccagaacgaguucaaccccaaccgccagcgccacuggcagaccaaggaggaggccaccuacggcgucugggccgagcgcgacuccgacgacgagcgccccuccuucggcggcaagcgcgcccgcgacuacuccgcccccgucaacuucaucuccgccggccucaagaagggcgccgccgaggaggccgagcucgaggacuccgacgacgaggagaagcccgucaagcaggacgacuuccccaaggacuucggcccccgcaagcucaagaccggcggcaacuucaagcccucccagaagggcuucgccggcggcaccaaguccuucauggacuucggcuccugggagcgccacaccaagggcaucggccagaagcuccuccagaagaugggcuacguccccggccgcggccucggcaagaacgcccagggcaucaucaaccccaucgaggccaagcagcgcaagggcaagggcgccgucggcgccuacggcuccgagcgcaccacccaguccaugcaggacuuccccgucgucgacuccgaggaggaggccgaggaggaguuccagaaggagcucucccaguggcgcaaggaccccuccggcuccaagaagaagcccaaguacuccuacaagaccgucgaggagcucaaggccaagggccgcaucuccaagaagcucaccgccccccagaaggagcucucccaggucaaggucaucgacaugaccggccgcgagcagaaggucuacuacuccuacucccagaucucccacaagcacaacguccccgacgacggccucccccuccagucccagcagcucccccaguccggcaaggaggccaaggcccccggcuucgcccuccccgagcucgagcacaaccuccagcuccucaucgaccucaccgagcaggagaucauccagaacgaccgccagcuccaguacgagcgcgacauggucgucaaccucuuccacgagcucgagaagaugaccgagguccucgaccacgaggagcgcgucaucuccaaccucuccaagguccucgagauggucgaggagugcgagcgccgcaugcagcccgacugcuccaacccccucacccucgacgagugcgcccgcaucuucgagacccuccaggacaaguacuacgaggaguaccgcauguccgaccgcgucgaccucgccgucgccaucgucuacccccucaugaaggaguacuucaaggagugggacccccucaaggacugcaccuacggcaccgagaucaucuccaaguggaagucccuccucgagaacgaccagcuccucucccacggcggccaggaccucuccgccgacgccuuccaccgccucaucugggaggucuggaugcccuucguccgcaacaucgucacccaguggcagccccgcaacugcgaccccauggucgacuuccucgacuccuggguccacaucauccccgucuggauccucgacaacauccucgaccagcucaucuuccccaagcuccagaaggaggucgagaacuggaacccccucaccgacaccguccccauccacuccuggauccaccccuggcucccccucaugcaggcccgccucgagccccucuacucccccauccgcuccaagcucuccuccgcccuccagaaguggcaccccuccgacuccuccgccaagcucauccuccagcccuggaaggacgucuucacccccggcuccugggaggccuucauggucaagaacaucguccccaagcucggcaugugccucggcgagcucgucaucaacccccaccagcagcacauggacgccuucuacugggucaucgacugggagggcaugaucuccgucuccucccucgucggccuccucgagaagcacuucuuccccaaguggcuccagguccucugcuccuggcucuccaacucccccaacuacgaggagaucaccaagugguaccucggcuggaaguccauguucuccgaccagguccucgcccaccccuccgucaaggacaaguucaacgaggcccucgacaucaugaaccgcgccgucuccuccaacgucggcgccuacaugcagcccggcgcccgcgagaacaucgccuaccucacccacaccgagcgccgcaaggacuuccaguacgaggccaugcaggagcgccgcgaggccgagaacauggcccagcgcggcaucggcgucgccgccuccuccguccccaugaacuucaaggaccucaucgagaccaaggccgaggagcacaacaucgucuucaugcccgucaucggcaagcgccacgagggcaagcagcucuacaccuucggccgcaucgucaucuacaucgaccgcggcgucgucuucguccagggcgagaagaccuggguccccaccucccuccagucccucaucgacauggccaaguga

SEQ ID NO: 50664 - RNA, 561 nt, Artificial Sequence
  derived and/or modified sequence opt2 from TFPI2__Homo_sapiens__NP_001257933
auggaccccgcccgcccccucggccucuccauccuccuccucuuccucaccgaggccgcccucggcgacgccgcccaggagcccaccggcaacaacgccgagaucugccuccucccccucgacuacggccccugccgcgcccuccuccuccgcuacuacuacgaccgcuacacccaguccugccgccaguuccucuacggcggcugcgagggcaacgccaacaacuucuacaccugggaggccugcgacgacgccugcuggcgcaucgagaagguccccaaggucugccgccuccaggucuccgucgacgaccagugcgagggcuccaccgagaaguacuucuucaaccucuccuccaugaccugcgagaaguucuucuccggcggcugccaccgcaaccgcaucgagaaccgcuuccccgacgaggccaccugcaugggcuucugcgcccccaagaagaacaccgagcccgucaugcucucccccauccucgccgucgagggcaugaccaucacccuccucgccggccgcaucgccaacguccacguccagaagcucuga

SEQ ID NO: 50665 - RNA, 756 nt, Artificial Sequence
  derived and/or modified sequence opt2 from TFPI__Homo_sapiens__NP_001027452
augaucuacaccaugaagaagguccacgcccucugggccuccgucugccuccuccucaaccucgcccccgccccccucaacgccgacuccgaggaggacgaggagcacaccaucaucaccgacaccgagcuccccccccucaagcucaugcacuccuucugcgccuucaaggccgacgacggccccugcaaggccaucaugaagcgcuucuucuucaacaucuucacccgccagugcgaggaguucaucuacggcggcugcgagggcaaccagaaccgcuucgagucccucgaggagugcaagaagaugugcacccgcgacaacgccaaccgcaucaucaagaccacccuccagcaggagaagcccgacuucugcuuccucgaggaggaccccggcaucugccgcggcuacaucacccgcuacuucuacaacaaccagaccaagcagugcgagcgcuucaaguacggcggcugccucggcaacaugaacaacuucgagacccucgaggagugcaagaacaucugcgaggacggccccaacggcuuccaggucgacaacuacggcacccagcucaacgccgucaacaacucccucaccccccaguccaccaagguccccucccucuucgucaccaaggagggcaccaacgacggcuggaagaacgccgcccacaucuaccaggucuuccucaacgccuucugcauccacgccuccauguucuuccucggccucgacuccaucuccugccucugcuga

SEQ ID NO: 50666 - RNA, 762 nt, Artificial Sequence
  derived and/or modified sequence opt2 from TFPT__Homo_sapiens__NP_037474
auggagcucgagcagcgcgagggcaccauggccgccgucggcuucgaggaguucuccgccccccccggcuccgagcucgcccuccccccccucuucggcggccacauccucgaguccgagcucgagaccgaggucgaguucgucuccggcggccucggcggcuccggccuccgcgagcgcgacgaggaggaggaggccgcccgcggccgccgccgccgccagcgcgagcucaaccgccgcaaguaccaggcccucggccgccgcugccgcgagaucgagcaggucaacgagcgcguccucaaccgccuccaccagguccagcgcaucacccgccgccuccagcaggagcgccgcuuccucaugcgcguccucgacuccuacggcgacgacuaccgcgccucccaguucaccaucguccucgaggacgagggcucccagggcaccgacgcccccacccccggcaacgccgagaacgagccccccgagaaggagacccucucccccccccgccgcacccccgccccccccgagcccggcucccccgcccccggcgagggccccuccggccgcaagcgccgccgcgucccccgcgacggccgccgcgccggcaacgcccucacccccgagcucgcccccguccagaucaaggucgaggaggacuucggcuucgaggccgacgaggcccucgacuccuccugggucucccgcggccccgacaagcuccuccccuaccccacccucgccucccccgccuccgacuga

SEQ ID NO: 50667 - RNA, 1893 nt, Artificial Sequence
  derived and/or modified sequence opt2 from TFR2__Homo_sapiens__NP_001193784
auggccgcccucacccaggacauccgcgccgcccucucccgccagaagcucgaccacgucuggaccgacacccacuacgucggccuccaguuccccgaccccgcccaccccaacacccuccacugggucgacgaggccggcaaggucggcgagcagcucccccucgaggaccccgacgucuacugccccuacuccgccaucggcaacgucaccggcgagcucgucuacgcccacuacggccgccccgaggaccuccaggaccuccgcgcccgcggcgucgaccccgucggccgccuccuccucguccgcgucggcgucaucuccuucgcccagaaggucaccaacgcccaggacuucggcgcccagggcguccucaucuaccccgagcccgccgacuucucccaggacccccccaagcccucccucuccucccagcaggccgucuacggccacguccaccucggcaccggcgaccccuacacccccggcuuccccuccuucaaccagacccaguucccccccgucgccuccuccggccuccccuccauccccgcccagcccaucuccgccgacaucgccucccgccuccuccgcaagcucaagggccccgucgccccccaggaguggcagggcucccuccucggcucccccuaccaccucggccccggcccccgccuccgccucgucgucaacaaccaccgcaccuccacccccaucaacaacaucuucggcugcaucgagggccgcuccgagcccgaccacuacgucgucaucggcgcccagcgcgacgccuggggccccggcgccgccaaguccgccgucggcaccgccauccuccucgagcucguccgcaccuucuccuccauggucuccaacggcuuccgcccccgccgcucccuccucuucaucuccugggacggcggcgacuucggcuccgucggcuccaccgaguggcucgagggcuaccucuccguccuccaccucaaggccgucgucuacgucucccucgacaacgccguccucggcgacgacaaguuccacgccaagaccuccccccuccucaccucccucaucgaguccguccucaagcaggucgacucccccaaccacuccggccagacccucuacgagcaggucgucuucaccaaccccuccugggacgccgaggucauccgcccccuccccauggacuccuccgccuacuccuucaccgccuucgucggcguccccgccgucgaguucuccuucauggaggacgaccaggccuaccccuuccuccacaccaaggaggacaccuacgagaaccuccacaagguccuccagggccgccuccccgccgucgcccaggccgucgcccagcucgccggccagcuccucauccgccucucccacgaccgccuccucccccucgacuucggccgcuacggcgacgucguccuccgccacaucggcaaccucaacgaguucuccggcgaccucaaggcccgcggccucacccuccagugggucuacuccgcccgcggcgacuacauccgcgccgccgagaagcuccgccaggagaucuacuccuccgaggagcgcgacgagcgccucacccgcauguacaacguccgcaucaugcgcgucgaguucuacuuccucucccaguacgucucccccgccgacucccccuuccgccacaucuucaugggccgcggcgaccacacccucggcgcccuccucgaccaccuccgccuccuccgcuccaacuccuccggcacccccggcgccaccuccuccaccggcuuccaggagucccgcuuccgccgccagcucgcccuccucaccuggacccuccagggcgccgccaacgcccucuccggcgacgucuggaacaucgacaacaacuucuga

SEQ ID NO: 50668 - RNA, 2283 nt, Artificial Sequence
  derived and/or modified sequence opt2 from TFRC__Homo_sapiens__NP_003225
augauggaccaggcccgcuccgccuucuccaaccucuucggcggcgagccccucuccuacacccgcuucucccucgcccgccaggucgacggcgacaacucccacgucgagaugaagcucgccgucgacgaggaggagaacgccgacaacaacaccaaggccaacgucaccaagcccaagcgcugcuccggcuccaucugcuacggcaccaucgccgucaucgucuucuuccucaucggcuucaugaucggcuaccucggcuacugcaagggcgucgagcccaagaccgagugcgagcgccucgccggcaccgagucccccguccgcgaggagcccggcgaggacuuccccgccgcccgccgccucuacugggacgaccucaagcgcaagcucuccgagaagcucgacuccaccgacuucaccggcaccaucaagcuccucaacgagaacuccuacgucccccgcgaggccggcucccagaaggacgagaaccucgcccucuacgucgagaaccaguuccgcgaguucaagcucuccaaggucuggcgcgaccagcacuucgucaagauccaggucaaggacuccgcccagaacuccgucaucaucgucgacaagaacggccgccucgucuaccucgucgagaaccccggcggcuacgucgccuacuccaaggccgccaccgucaccggcaagcucguccacgccaacuucggcaccaagaaggacuucgaggaccucuacacccccgucaacggcuccaucgucaucguccgcgccggcaagaucaccuucgccgagaaggucgccaacgccgagucccucaacgccaucggcguccucaucuacauggaccagaccaaguuccccaucgucaacgccgagcucuccuucuucggccacgcccaccucggcaccggcgaccccuacacccccggcuuccccuccuucaaccacacccaguucccccccucccgcuccuccggccuccccaacauccccguccagaccaucucccgcgccgccgccgagaagcucuucggcaacauggagggcgacugccccuccgacuggaagaccgacuccaccugccgcauggucaccuccgaguccaagaacgucaagcucaccgucuccaacguccucaaggagaucaagauccucaacaucuucggcgucaucaagggcuucgucgagcccgaccacuacgucgucgucggcgcccagcgcgacgccuggggccccggcgccgccaaguccggcgucggcaccgcccuccuccucaagcucgcccagauguucuccgacaugguccucaaggacggcuuccagcccucccgcuccaucaucuucgccuccugguccgccggcgacuucggcuccgucggcgccaccgaguggcucgagggcuaccucuccucccuccaccucaaggccuucaccuacaucaaccucgacaaggccguccucggcaccuccaacuucaaggucuccgccuccccccuccucuacacccucaucgagaagaccaugcagaacgucaagcaccccgucaccggccaguuccucuaccaggacuccaacugggccuccaaggucgagaagcucacccucgacaacgccgccuuccccuuccucgccuacuccggcauccccgccgucuccuucugcuucugcgaggacaccgacuaccccuaccucggcaccaccauggacaccuacaaggagcucaucgagcgcauccccgagcucaacaaggucgcccgcgccgccgccgaggucgccggccaguucgucaucaagcucacccacgacgucgagcucaaccucgacuacgagcgcuacaacucccagcuccucuccuucguccgcgaccucaaccaguaccgcgccgacaucaaggagaugggccucucccuccaguggcucuacuccgcccgcggcgacuucuuccgcgccaccucccgccucaccaccgacuucggcaacgccgagaagaccgaccgcuucgucaugaagaagcucaacgaccgcgucaugcgcgucgaguaccacuuccucucccccuacgucucccccaaggagucccccuuccgccacgucuucuggggcuccggcucccacacccuccccgcccuccucgagaaccucaagcuccgcaagcagaacaacggcgccuucaacgagacccucuuccgcaaccagcucgcccucgccaccuggaccauccagggcgccgccaacgcccucuccggcgacgucugggacaucgacaacgaguucuga

SEQ ID NO: 50669 - RNA, 480 nt, Artificial Sequence
  derived and/or modified sequence opt2 from TGFA__Homo_sapiens__NP_001093161
augguccccuccgccggccagcucgcccucuucgcccucggcaucguccucgccgccugccaggcccucgagaacuccaccuccccccucuccgacccccccgucgccgccgccgucgucucccacuucaacgacugccccgacucccacacccaguucugcuuccacggcaccugccgcuuccucguccaggaggacaagcccgccugcgucugccacuccggcuacgucggcgcccgcugcgagcacgccgaccuccucgccgucgucgccgccucccagaagaagcaggccaucaccgcccucgucgucgucuccaucgucgcccucgccguccucaucaucaccugcguccucauccacugcugccagguccgcaagcacugcgaguggugccgcgcccucaucugccgccacgagaagcccuccgcccuccucaagggccgcaccgccugcugccacuccgagaccgucgucuga

SEQ ID NO: 50670 - RNA, 1173 nt, Artificial Sequence
  derived and/or modified sequence opt2 from TGFB1__Homo_sapiens__NP_000651
augccccccuccggccuccgccuccucccccuccuccucccccuccucuggcuccucguccucacccccggccgccccgccgccggccucuccaccugcaagaccaucgacauggagcucgucaagcgcaagcgcaucgaggccauccgcggccagauccucuccaagcuccgccucgccuccccccccucccagggcgaggucccccccggcccccuccccgaggccguccucgcccucuacaacuccacccgcgaccgcgucgccggcgaguccgccgagcccgagcccgagcccgaggccgacuacuacgccaaggaggucacccgcguccucauggucgagacccacaacgagaucuacgacaaguucaagcaguccacccacuccaucuacauguucuucaacaccuccgagcuccgcgaggccguccccgagcccguccuccucucccgcgccgagcuccgccuccuccgccucaagcucaaggucgagcagcacgucgagcucuaccagaaguacuccaacaacuccuggcgcuaccucuccaaccgccuccucgcccccuccgacucccccgaguggcucuccuucgacgucaccggcgucguccgccaguggcucucccgcggcggcgagaucgagggcuuccgccucuccgcccacugcuccugcgacucccgcgacaacacccuccaggucgacaucaacggcuucaccaccggccgccgcggcgaccucgccaccauccacggcaugaaccgccccuuccuccuccucauggccaccccccucgagcgcgcccagcaccuccaguccucccgccaccgccgcgcccucgacaccaacuacugcuucuccuccaccgagaagaacugcugcguccgccagcucuacaucgacuuccgcaaggaccucggcuggaaguggauccacgagcccaagggcuaccacgccaacuucugccucggccccugccccuacaucuggucccucgacacccaguacuccaagguccucgcccucuacaaccagcacaaccccggcgccuccgccgcccccugcugcgucccccaggcccucgagccccuccccaucgucuacuacgucggccgcaagcccaaggucgagcagcucuccaacaugaucguccgcuccugcaagugcuccuga

SEQ ID NO: 50671 - RNA, 1386 nt, Artificial Sequence
  derived and/or modified sequence opt2 from TGFB1I1__Homo_sapiens__NP_001035919
auggaggaccucgacgcccuccucuccgaccucgagaccaccaccucccacaugccccgcuccggcgcccccaaggagcgccccgccgagccccucacccccccccccuccuacggccaccagccccagaccggcuccggcgaguccuccggcgccuccggcgacaaggaccaccucuacuccaccgucugcaagccccgcucccccaagcccgccgcccccgccgccccccccuucuccuccuccuccggcguccucggcaccggccucugcgagcucgaccgccuccuccaggagcucaacgccacccaguucaacaucaccgacgagaucaugucccaguuccccuccuccaaggucgccuccggcgagcagaaggaggaccaguccgaggacaagaagcgccccucccuccccuccucccccucccccggccuccccaaggccuccgccaccuccgccacccucgagcucgaccgccucauggccucccucuccgacuuccgcguccagaaccaccuccccgccuccggccccacccagccccccgucgucuccuccaccaacgagggcucccccuccccccccgagcccaccggcaagggcucccucgacaccaugcucggccuccuccaguccgaccucucccgccgcggcguccccacccaggccaagggccucugcggcuccugcaacaagcccaucgccggccaggucgucaccgcccucggccgcgccuggcaccccgagcacuucgucugcggcggcugcuccaccgcccucggcggcuccuccuucuucgagaaggacggcgcccccuucugccccgagugcuacuucgagcgcuucuccccccgcugcggcuucugcaaccagcccauccgccacaagauggucaccgcccucggcacccacuggcaccccgagcacuucugcugcgucuccugcggcgagcccuucggcgacgagggcuuccacgagcgcgagggccgccccuacugccgccgcgacuuccuccagcucuucgccccccgcugccagggcugccagggccccauccucgacaacuacaucuccgcccucuccgcccucuggcaccccgacugcuucgucugccgcgagugcuucgcccccuucuccggcggcuccuucuucgagcacgagggccgcccccucugcgagaaccacuuccacgcccgccgcggcucccucugcgccaccugcggccuccccgucaccggccgcugcgucuccgcccucggccgccgcuuccaccccgaccacuucaccugcaccuucugccuccgcccccucaccaagggcuccuuccaggagcgcgccggcaagcccuacugccagcccugcuuccucaagcucuucggcuga

SEQ ID NO: 50672 - RNA, 1329 nt, Artificial Sequence
  derived and/or modified sequence opt2 from TGFB2__Homo_sapiens__NP_001129071
augcacuacugcguccucuccgccuuccucauccuccaccucgucaccgucgcccucucccucuccaccugcuccacccucgacauggaccaguucaugcgcaagcgcaucgaggccauccgcggccagauccucuccaagcucaagcucaccuccccccccgaggacuaccccgagcccgaggaggucccccccgaggucaucuccaucuacaacuccacccgcgaccuccuccaggagaaggccucccgccgcgccgccgccugcgagcgcgagcgcuccgacgaggaguacuacgccaaggaggucuacaagaucgacaugccccccuucuuccccuccgagaccgucugccccgucgucaccacccccuccggcuccgucggcucccucugcucccgccagucccagguccucugcggcuaccucgacgccaucccccccaccuucuaccgccccuacuuccgcaucguccgcuucgacgucuccgccauggagaagaacgccuccaaccucgucaaggccgaguuccgcgucuuccgccuccagaaccccaaggcccgcguccccgagcagcgcaucgagcucuaccagauccucaaguccaaggaccucaccucccccacccagcgcuacaucgacuccaaggucgucaagacccgcgccgagggcgaguggcucuccuucgacgucaccgacgccguccacgaguggcuccaccacaaggaccgcaaccucggcuucaagaucucccuccacugccccugcugcaccuucguccccuccaacaacuacaucauccccaacaaguccgaggagcucgaggcccgcuucgccggcaucgacggcaccuccaccuacaccuccggcgaccagaagaccaucaaguccacccgcaagaagaacuccggcaagaccccccaccuccuccucaugcuccuccccuccuaccgccucgagucccagcagaccaaccgccgcaagaagcgcgcccucgacgccgccuacugcuuccgcaacguccaggacaacugcugccuccgcccccucuacaucgacuucaagcgcgaccucggcuggaaguggauccacgagcccaagggcuacaacgccaacuucugcgccggcgccugccccuaccucugguccuccgacacccagcacucccgcguccucucccucuacaacaccaucaaccccgaggccuccgccucccccugcugcgucucccaggaccucgagccccucaccauccucuacuacaucggcaagacccccaagaucgagcagcucuccaacaugaucgucaaguccugcaagugcuccuga

SEQ ID NO: 50673 - RNA, 1239 nt, Artificial Sequence
  derived and/or modified sequence opt2 from TGFB3__Homo_sapiens__NP_003230
augaagaugcaccuccagcgcgcccucgucguccucgcccuccucaacuucgccaccgucucccucucccucuccaccugcaccacccucgacuucggccacaucaagaagaagcgcgucgaggccauccgcggccagauccucuccaagcuccgccucaccuccccccccgagcccaccgucaugacccacguccccuaccagguccucgcccucuacaacuccacccgcgagcuccucgaggagaugcacggcgagcgcgaggagggcugcacccaggagaacaccgaguccgaguacuacgccaaggagauccacaaguucgacaugauccagggccucgccgagcacaacgagcucgccgucugccccaagggcaucaccuccaaggucuuccgcuucaacgucuccuccgucgagaagaaccgcaccaaccucuuccgcgccgaguuccgcguccuccgcguccccaaccccuccuccaagcgcaacgagcagcgcaucgagcucuuccagauccuccgccccgacgagcacaucgccaagcagcgcuacaucggcggcaagaaccuccccacccgcggcaccgccgaguggcucuccuucgacgucaccgacaccguccgcgaguggcuccuccgccgcgaguccaaccucggccucgagaucuccauccacugccccugccacaccuuccagcccaacggcgacauccucgagaacauccacgaggucauggagaucaaguucaagggcgucgacaacgaggacgaccacggccgcggcgaccucggccgccucaagaagcagaaggaccaccacaacccccaccucauccucaugaugauccccccccaccgccucgacaaccccggccagggcggccagcgcaagaagcgcgcccucgacaccaacuacugcuuccgcaaccucgaggagaacugcugcguccgcccccucuacaucgacuuccgccaggaccucggcuggaaguggguccacgagcccaagggcuacuacgccaacuucugcuccggccccugccccuaccuccgcuccgccgacaccacccacuccaccguccucggccucuacaacacccucaaccccgaggccuccgccucccccugcugcgucccccaggaccucgagccccucaccauccucuacuacgucggccgcacccccaaggucgagcagcucuccaacauggucgucaaguccugcaagugcuccuga

SEQ ID NO: 50674 - RNA, 2052 nt, Artificial Sequence
  derived and/or modified sequence opt2 from TGFBI__Homo_sapiens__NP_000349
auggcccucuucguccgccuccucgcccucgcccucgcccucgcccucggccccgccgccacccucgccggccccgccaagucccccuaccagcucguccuccagcacucccgccuccgcggccgccagcacggccccaacgucugcgccguccagaaggucaucggcaccaaccgcaaguacuucaccaacugcaagcagugguaccagcgcaagaucugcggcaaguccaccgucaucuccuacgagugcugccccggcuacgagaagguccccggcgagaagggcugccccgccgcccucccccucuccaaccucuacgagacccucggcgucgucggcuccaccaccacccagcucuacaccgaccgcaccgagaagcuccgccccgagauggagggccccggcuccuucaccaucuucgcccccuccaacgaggccugggccucccuccccgccgagguccucgacucccucgucuccaacgucaacaucgagcuccucaacgcccuccgcuaccacauggucggccgccgcguccucaccgacgagcucaagcacggcaugacccucaccuccauguaccagaacuccaacauccagauccaccacuaccccaacggcaucgucaccgucaacugcgcccgccuccucaaggccgaccaccacgccaccaacggcgucguccaccucaucgacaaggucaucuccaccaucaccaacaacauccagcagaucaucgagaucgaggacaccuucgagacccuccgcgccgccgucgccgccuccggccucaacaccaugcucgagggcaacggccaguacacccuccucgcccccaccaacgaggccuucgagaagauccccuccgagacccucaaccgcauccucggcgaccccgaggcccuccgcgaccuccucaacaaccacauccucaaguccgccaugugcgccgaggccaucgucgccggccucuccgucgagacccucgagggcaccacccucgaggucggcugcuccggcgacaugcucaccaucaacggcaaggccaucaucuccaacaaggacauccucgccaccaacggcgucauccacuacaucgacgagcuccucauccccgacuccgccaagacccucuucgagcucgccgccgaguccgacgucuccaccgccaucgaccucuuccgccaggccggccucggcaaccaccucuccggcuccgagcgccucacccuccucgccccccucaacuccgucuucaaggacggcaccccccccaucgacgcccacacccgcaaccuccuccgcaaccacaucaucaaggaccagcucgccuccaaguaccucuaccacggccagacccucgagacccucggcggcaagaagcuccgcgucuucgucuaccgcaacucccucugcaucgagaacuccugcaucgccgcccacgacaagcgcggccgcuacggcacccucuucaccauggaccgcguccucaccccccccaugggcaccgucauggacguccucaagggcgacaaccgcuucuccaugcucgucgccgccauccaguccgccggccucaccgagacccucaaccgcgagggcgucuacaccgucuucgcccccaccaacgaggccuuccgcgcccuccccccccgcgagcgcucccgccuccucggcgacgccaaggagcucgccaacauccucaaguaccacaucggcgacgagauccucgucuccggcggcaucggcgcccucguccgccucaagucccuccagggcgacaagcucgaggucucccucaagaacaacgucgucuccgucaacaaggagcccgucgccgagcccgacaucauggccaccaacggcgucguccacgucaucaccaacguccuccagccccccgccaaccgcccccaggagcgcggcgacgagcucgccgacuccgcccucgagaucuucaagcaggccuccgccuucucccgcgccucccagcgcuccguccgccucgcccccgucuaccagaagcuccucgagcgcaugaagcacuga

SEQ ID NO: 50675 - RNA, 1281 nt, Artificial Sequence
  derived and/or modified sequence opt2 from TGFBR1__Homo_sapiens__NP_001124388
auggaggccgccgucgccgccccccgcccccgccuccuccuccucguccucgccgccgccgccgccgccgccgccgcccuccuccccggcgccaccgcccuccagugcuucugccaccucugcaccaaggacaacuucaccugcgucaccgacggccucugcuucgucuccgucaccgagaccaccgacaaggucauccacaacuccaugugcaucgccgagaucgaccucaucccccgcgaccgccccuucgucugcgcccccuccuccaagaccggcuccgucaccaccaccuacugcugcaaccaggaccacugcaacaagaucgagcuccccaccaccggccucccccuccucguccagcgcaccaucgcccgcaccaucguccuccaggaguccaucggcaagggccgcuucggcgaggucuggcgcggcaaguggcgcggcgaggaggucgccgucaagaucuucuccucccgcgaggagcgcuccugguuccgcgaggccgagaucuaccagaccgucaugcuccgccacgagaacauccucggcuucaucgccgccgacaacaaggacaacggcaccuggacccagcucuggcucgucuccgacuaccacgagcacggcucccucuucgacuaccucaaccgcuacaccgucaccgucgagggcaugaucaagcucgcccucuccaccgccuccggccucgcccaccuccacauggagaucgucggcacccagggcaagcccgccaucgcccaccgcgaccucaaguccaagaacauccucgucaagaagaacggcaccugcugcaucgccgaccucggccucgccguccgccacgacuccgccaccgacaccaucgacaucgcccccaaccaccgcgucggcaccaagcgcuacauggcccccgagguccucgacgacuccaucaacaugaagcacuucgaguccuucaagcgcgccgacaucuacgccaugggccucgucuucugggagaucgcccgccgcugcuccaucggcggcauccacgaggacuaccagcuccccuacuacgaccucguccccuccgaccccuccgucgaggagaugcgcaaggucgucugcgagcagaagcuccgccccaacauccccaaccgcuggcaguccugcgaggcccuccgcgucauggccaagaucaugcgcgagugcugguacgccaacggcgccgcccgccucaccgcccuccgcaucaagaagacccucucccagcucucccagcaggagggcaucaagauguga

SEQ ID NO: 50676 - RNA, 1779 nt, Artificial Sequence
  derived and/or modified sequence opt2 from TGFBR2__Homo_sapiens__NP_001020018
augggccgcggccuccuccgcggccucuggccccuccacaucguccucuggacccgcaucgccuccaccauccccccccacguccagaaguccgacgucgagauggaggcccagaaggacgagaucaucugccccuccugcaaccgcaccgcccacccccuccgccacaucaacaacgacaugaucgucaccgacaacaacggcgccgucaaguucccccagcucugcaaguucugcgacguccgcuucuccaccugcgacaaccagaaguccugcauguccaacugcuccaucaccuccaucugcgagaagccccaggaggucugcgucgccgucuggcgcaagaacgacgagaacaucacccucgagaccgucugccacgaccccaagcuccccuaccacgacuucauccucgaggacgccgccucccccaagugcaucaugaaggagaagaagaagcccggcgagaccuucuucaugugcuccugcuccuccgacgagugcaacgacaacaucaucuucuccgaggaguacaacaccuccaaccccgaccuccuccucgucaucuuccaggucaccggcaucucccuccuccccccccucggcgucgccaucuccgucaucaucaucuucuacugcuaccgcgucaaccgccagcagaagcucuccuccaccugggagaccggcaagacccgcaagcucauggaguucuccgagcacugcgccaucauccucgaggacgaccgcuccgacaucuccuccaccugcgccaacaacaucaaccacaacaccgagcuccuccccaucgagcucgacacccucgucggcaagggccgcuucgccgaggucuacaaggccaagcucaagcagaacaccuccgagcaguucgagaccgucgccgucaagaucuuccccuacgaggaguacgccuccuggaagaccgagaaggacaucuucuccgacaucaaccucaagcacgagaacauccuccaguuccucaccgccgaggagcgcaagaccgagcucggcaagcaguacuggcucaucaccgccuuccacgccaagggcaaccuccaggaguaccucacccgccacgucaucuccugggaggaccuccgcaagcucggcuccucccucgcccgcggcaucgcccaccuccacuccgaccacacccccugcggccgccccaagaugcccaucguccaccgcgaccucaaguccuccaacauccucgucaagaacgaccucaccugcugccucugcgacuucggccucucccuccgccucgaccccacccucuccgucgacgaccucgccaacuccggccaggucggcaccgcccgcuacauggcccccgagguccucgagucccgcaugaaccucgagaacgucgaguccuucaagcagaccgacgucuacuccauggcccucguccucugggagaugaccucccgcugcaacgccgucggcgaggucaaggacuacgagccccccuucggcuccaagguccgcgagcaccccugcgucgaguccaugaaggacaacguccuccgcgaccgcggccgccccgagauccccuccuucuggcucaaccaccagggcauccagauggucugcgagacccucaccgagugcugggaccacgaccccgaggcccgccucaccgcccagugcgucgccgagcgcuucuccgagcucgagcaccucgaccgccucuccggccgcuccugcuccgaggagaagauccccgaggacggcucccucaacaccaccaaguga

SEQ ID NO: 50677 - RNA, 2583 nt, Artificial Sequence
  derived and/or modified sequence opt2 from TGFBRAP1__Homo_sapiens__NP_001136093
augauguccaucaaggccuucacccucgucuccgccgucgagcgcgagcuccucaugggcgacaaggagcgcgucaacaucgagugcgucgagugcugcggccgcgaccucuacgucggcaccaacgacugcuucgucuaccacuuccuccucgaggagcgccccguccccgccggccccgccaccuucaccgccaccaagcagcuccagcgccaccucggcuucaagaagcccgucaacgagcuccgcgccgccuccgcccucaaccgccuccucguccucugcgacaacuccaucucccucgucaacaugcucaaccucgagcccguccccuccggcgcccgcaucaagggcgccgccaccuucgcccucaacgagaaccccgucuccggcgaccccuucugcgucgaggucugcaucaucuccgucaagcgccgcaccauccagauguuccucgucuacgaggaccgcguccagaucgucaaggaggucuccaccgccgagcagccccucgccgucgccgucgacggccacuuccucugccucgcccucaccacccaguacaucauccacaacuacuccaccggcgucucccaggaccucuuccccuacugcuccgaggagcgcccccccaucgucaagcgcaucggccgccaggaguuccuccucgccggccccggcggccucggcauguucgccaccgucgccggcaucucccagcgcgcccccguccacugguccgagaacgucaucggcgccgccgucuccuuccccuacgucaucgcccucgacgacgaguucaucaccguccacuccaugcucgaccagcagcagaagcagacccuccccuucaaggagggccacauccuccaggacuucgagggccgcgucaucgucgccaccuccaagggcgucuacauccucgucccccucccccucgagaagcagauccaggaccuccucgccucccgccgcgucgaggaggcccucguccucgccaagggcgcccgccgcaacauccccaaggagaaguuccaggucauguaccgccgcauccuccagcaggccggcuucauccaguucgcccagcuccaguuccucgaggccaaggagcucuuccgcuccggccagcucgacguccgcgagcucaucucccucuaccccuuccuccuccccaccuccuccuccuucacccgcucccaccccccccuccacgaguacgccgaccucaaccagcucacccagggcgaccaggagaagauggccaagugcaagcgcuuccucauguccuaccucaacgagguccgcuccaccgaggucgccaacggcuacaaggaggacaucgacaccgcccuccucaagcucuacgccgaggccgaccacgacucccuccucgaccuccucgucaccgagaacuucugccuccucaccgacuccgccgccuggcucgagaagcacaagaaguacuucgcccucggccuccucuaccacuacaacaaccaggacgccgccgccguccagcucugggucaacaucgucaacggcgacguccaggacuccacccgcuccgaccucuacgaguacaucgucgacuuccucaccuacugccucgacgaggagcucgucugggccuacgccgacuggguccuccagaaguccgaggaggucggcguccaggucuucaccaagcgcccccucgacgagcagcagaagaacuccuucaaccccgacgacaucaucaacugccucaagaaguaccccaaggcccucgucaaguaccucgagcaccucgucaucgacaagcgccuccagaaggaggaguaccacacccaccucgccguccucuaccucgaggagguccuccuccagcgcgccuccgccuccggcaagggcgccgaggccaccgagacccaggccaagcuccgccgccuccuccagaaguccgaccucuaccgcguccacuuccuccucgagcgccuccagggcgccggccuccccauggaguccgccauccuccacggcaagcucggcgagcacgagaaggcccuccacauccucguccacgagcuccaggacuucgccgccgccgaggacuacugccucuggugcuccgagggccgcgaccccccccaccgccagcagcucuuccacacccuccucgccaucuaccuccacgccggccccaccgcccacgagcucgccgucgccgccgucgaccuccucaaccgccacgccaccgaguucgacgccgcccagguccuccagaugcuccccgacaccugguccguccagcuccucugccccuuccucaugggcgccaugcgcgacuccauccacgcccgccgcaccaugcaggucgcccucggccucgcccgcuccgagaaccucaucuacaccuacgacaagaugaagcucaagggcuccuccauccagcucuccgacaagaagcucugccagaucugccagaaccccuucugcgagcccgucuucguccgcuaccccaacggcggccucguccacacccacugcgccgccucccgccacaccaaccccuccuccuccucccccggcacccgcaccuga

SEQ ID NO: 50678 - RNA, 8307 nt, Artificial Sequence
  derived and/or modified sequence opt2 from TG__Homo_sapiens__NP_003226
auggcccucguccucgagaucuucacccuccucgccuccaucugcugggucuccgccaacaucuucgaguaccaggucgacgcccagccccuccgccccugcgagcuccagcgcgagaccgccuuccucaagcaggccgacuacgucccccagugcgccgaggacggcuccuuccagaccguccagugccagaacgacggccgcuccugcuggugcgucggcgccaacggcuccgagguccucggcucccgccagcccggccgccccgucgccugccucuccuucugccagcuccagaagcagcagauccuccucuccggcuacaucaacuccaccgacaccuccuaccucccccagugccaggacuccggcgacuacgcccccguccagugcgacguccagcagguccagugcuggugcgucgacgccgagggcauggaggucuacggcacccgccagcucggccgccccaagcgcugcccccgcuccugcgagauccgcaaccgccgccuccuccacggcgucggcgacaagucccccccccagugcuccgccgagggcgaguucaugcccguccagugcaaguucgucaacaccaccgacaugaugaucuucgaccucguccacuccuacaaccgcuuccccgacgccuucgucaccuucuccuccuuccagcgccgcuuccccgaggucuccggcuacugccacugcgccgacucccagggccgcgagcucgccgagaccggccucgagcuccuccucgacgagaucuacgacaccaucuucgccggccucgaccuccccuccaccuucaccgagaccacccucuaccgcauccuccagcgccgcuuccucgccguccaguccgucaucuccggccgcuuccgcugccccaccaagugcgaggucgagcgcuucaccgccaccuccuucggccaccccuacguccccuccugccgccgcaacggcgacuaccaggccguccagugccagaccgagggccccugcuggugcgucgacgcccagggcaaggagaugcacggcacccgccagcagggcgagccccccuccugcgccgagggccaguccugcgccuccgagcgccagcaggcccucucccgccucuacuucggcaccuccggcuacuucucccagcacgaccucuucuccucccccgagaagcgcugggccuccccccgcgucgcccgcuucgccaccuccugcccccccaccaucaaggagcucuucgucgacuccggccuccuccgccccauggucgagggccagucccagcaguucuccgucuccgagaaccuccucaaggaggccauccgcgccaucuuccccucccgcggccucgcccgccucgcccuccaguucaccaccaaccccaagcgccuccagcagaaccucuucggcggcaaguuccucgucaacgucggccaguucaaccucuccggcgcccucggcacccgcggcaccuucaacuucucccaguucuuccagcagcucggccucgccuccuuccucaacggcggccgccaggaggaccucgccaagccccucuccgucggccucgacuccaacuccuccaccggcacccccgaggccgccaagaaggacggcaccaugaacaagcccaccgucggcuccuucggcuucgagaucaaccuccaggagaaccagaacgcccucaaguuccucgccucccuccucgagcuccccgaguuccuccucuuccuccagcacgccaucuccguccccgaggacgucgcccgcgaccucggcgacgucauggagaccguccucuccucccagaccugcgagcagacccccgagcgccucuucguccccuccugcaccaccgagggcuccuacgaggacguccagugcuucuccggcgagugcuggugcgucaacuccuggggcaaggagcuccccggcucccgcguccgcggcggccagccccgcugccccaccgacugcgagaagcagcgcgcccgcaugcagucccucaugggcucccagcccgccggcuccacccucuucguccccgccugcaccuccgagggccacuuccuccccguccagugcuucaacuccgagugcuacugcgucgacgccgagggccaggccauccccggcacccgcuccgccaucggcaagcccaagaagugccccacccccugccagcuccaguccgagcaggccuuccuccgcaccguccaggcccuccucuccaacuccuccaugcuccccacccucuccgacaccuacaucccccagugcuccaccgacggccaguggcgccagguccagugcaacggcccccccgagcaggucuucgagcucuaccagcgcugggaggcccagaacaagggccaggaccucacccccgccaagcuccucgucaagaucauguccuaccgcgaggccgccuccggcaacuucucccucuucauccagucccucuacgaggccggccagcaggacgucuuccccguccucucccaguaccccucccuccaggacgucccccucgccgcccucgagggcaagcgcccccagccccgcgagaacauccuccucgagcccuaccucuucuggcagauccucaacggccagcucucccaguaccccggcuccuacuccgacuucuccaccccccucgcccacuucgaccuccgcaacugcuggugcgucgacgaggccggccaggagcucgagggcaugcgcuccgagcccuccaagcuccccaccugccccggcuccugcgaggaggccaagcuccgcguccuccaguucauccgcgagaccgaggagaucgucuccgccuccaacuccucccgcuucccccucggcgaguccuuccucgucgccaagggcauccgccuccgcaacgaggaccucggccuccccccccucuuccccccccgcgaggccuucgccgagcaguuccuccgcggcuccgacuacgccauccgccucgccgcccaguccacccucuccuucuaccagcgccgccgcuucucccccgacgacuccgccggcgccuccgcccuccuccgcuccggccccuacaugccccagugcgacgccuucggcuccugggagcccguccagugccacgccggcaccggccacugcuggugcgucgacgagaagggcggcuucauccccggcucccucaccgcccgcucccuccagaucccccagugccccaccaccugcgagaagucccgcaccuccggccuccucuccuccuggaagcaggcccgcucccaggagaaccccucccccaaggaccucuucguccccgccugccucgagaccggcgaguacgcccgccuccaggccuccggcgccggcaccuggugcgucgaccccgccuccggcgaggagcuccgccccggcuccuccuccuccgcccagugccccucccucugcaacguccucaaguccggcguccucucccgccgcgucucccccggcuacguccccgccugccgcgccgaggacggcggcuucucccccguccagugcgaccaggcccagggcuccugcuggugcgucauggacuccggcgaggagguccccggcacccgcgucaccggcggccagcccgccugcgaguccccccgcugcccccuccccuucaacgccuccgaggucgucggcggcaccauccucugcgagaccaucuccggccccaccggcuccgccaugcagcagugccagcuccucugccgccagggcuccugguccgucuucccccccggcccccucaucugcucccucgaguccggccgcugggagucccagcucccccagccccgcgccugccagcgcccccagcucuggcagaccauccagacccagggccacuuccagcuccagcucccccccggcaagaugugcuccgccgacuacgccgaccuccuccagaccuuccaggucuucauccucgacgagcucaccgcccgcggcuucugccagauccaggucaagaccuucggcacccucgucuccauccccgucugcaacaacuccuccguccaggucggcugccucacccgcgagcgccucggcgucaacgucaccuggaagucccgccucgaggacauccccgucgccucccuccccgaccuccacgacaucgagcgcgcccucgucggcaaggaccuccucggccgcuucaccgaccucauccaguccggcuccuuccagcuccaccucgacuccaagaccuuccccgccgagaccauccgcuuccuccagggcgaccacuucggcaccuccccccgcaccugguucggcugcuccgagggcuucuaccagguccucaccuccgaggccucccaggacggccucggcugcgucaagugccccgagggcuccuacucccaggacgaggagugcauccccugccccgucggcuucuaccaggagcaggccggcucccucgccugcguccccugccccgucggccgcaccaccaucuccgccggcgccuucucccagacccacugcgucaccgacugccagcgcaacgaggccggccuccagugcgaccagaacggccaguaccgcgccucccagaaggaccgcggcuccggcaaggccuucugcgucgacggcgagggccgccgccuccccuggugggagaccgaggccccccucgaggacucccagugccucaugaugcagaaguucgagaagguccccgaguccaaggucaucuucgacgccaacgcccccgucgccguccgcuccaagguccccgacuccgaguuccccgucaugcagugccucaccgacugcaccgaggacgaggccugcuccuucuucaccgucuccaccaccgagcccgagaucuccugcgacuucuacgccuggaccuccgacaacgucgccugcaugaccuccgaccagaagcgcgacgcccucggcaacuccaaggccaccuccuucggcucccuccgcugccaggucaagguccgcucccacggccaggacucccccgccgucuaccucaagaagggccagggcuccaccaccacccuccagaagcgcuucgagcccaccggcuuccagaacaugcucuccggccucuacaaccccaucgucuucuccgccuccggcgccaaccucaccgacgcccaccucuucugccuccucgccugcgaccgcgaccucugcugcgacggcuucguccucacccagguccagggcggcgccaucaucugcggccuccucuccucccccuccguccuccucugcaacgucaaggacuggauggaccccuccgaggccugggccaacgccaccugccccggcgucaccuacgaccaggagucccaccaggucauccuccgccucggcgaccaggaguucaucaagucccucaccccccucgagggcacccaggacaccuucaccaacuuccagcaggucuaccucuggaaggacuccgacaugggcucccgccccgaguccaugggcugccgcaaggacaccgucccccgccccgccucccccaccgaggccggccucaccaccgagcucuucucccccgucgaccucaaccaggucaucgucaacggcaaccagucccucuccucccagaagcacuggcucuucaagcaccucuucuccgcccagcaggccaaccucuggugccucucccgcugcguccaggagcacuccuucugccagcucgccgagaucaccgaguccgccucccucuacuucaccugcacccucuaccccgaggcccaggucugcgacgacaucauggaguccaacgcccagggcugccgccucauccucccccagaugcccaaggcccucuuccgcaagaaggucauccucgaggacaaggucaagaacuucuacacccgccuccccuuccagaagcucaugggcaucuccauccgcaacaagguccccauguccgagaaguccaucuccaacggcuucuucgagugcgagcgccgcugcgacgccgaccccugcugcaccggcuucggcuuccucaacgucucccagcucaagggcggcgaggucaccugccucacccucaacucccucggcauccagaugugcuccgaggagaacggcggcgccuggcgcauccucgacugcggcucccccgacaucgagguccacaccuaccccuucggcugguaccagaagcccaucgcccagaacaacgcccccuccuucugcccccucgucguccuccccucccucaccgagaaggucucccucgacuccuggcagucccucgcccucuccuccgucgucgucgaccccuccauccgccacuucgacgucgcccacgucuccaccgccgccaccuccaacuucuccgccguccgcgaccucugccucuccgagugcucccagcacgaggccugccucaucaccacccuccagacccagcccggcgccguccgcugcauguucuacgccgacacccaguccugcacccacucccuccagggccagaacugccgccuccuccuccgcgaggaggccacccacaucuaccgcaagcccggcaucucccuccucuccuacgaggccuccguccccuccguccccaucuccacccacggccgccuccucggccgcucccaggccauccaggucggcaccuccuggaagcaggucgaccaguuccucggcguccccuacgccgcccccccccucgccgagcgccgcuuccaggcccccgagccccucaacuggaccggcuccugggacgccuccaagccccgcgccuccugcuggcagcccggcacccgcaccuccaccucccccggcgucuccgaggacugccucuaccucaacgucuucaucccccagaacgucgcccccaacgccuccguccucgucuucuuccacaacaccauggaccgcgaggaguccgagggcuggcccgccaucgacggcuccuuccucgccgccgucggcaaccucaucgucgucaccgccuccuaccgcgucggcgucuucggcuuccucuccuccggcuccggcgaggucuccggcaacuggggccuccucgaccaggucgccgcccucaccuggguccagacccacauccgcggcuucggcggcgacccccgccgcgucucccucgccgccgaccgcggcggcgccgacgucgccuccauccaccuccucaccgcccgcgccaccaacucccagcucuuccgccgcgccguccucaugggcggcuccgcccucucccccgccgccgucaucucccacgagcgcgcccagcagcaggccaucgcccucgccaaggaggucuccugccccauguccuccucccaggaggucgucuccugccuccgccagaagcccgccaacguccucaacgacgcccagaccaagcuccucgccgucuccggccccuuccacuacuggggccccgucaucgacggccacuuccuccgcgagccccccgcccgcgcccucaagcgcucccucugggucgaggucgaccuccucaucggcuccucccaggacgacggccucaucaaccgcgccaaggccgucaagcaguucgaggagucccgcggccgcaccuccuccaagaccgccuucuaccaggcccuccagaacucccucggcggcgaggacuccgacgcccgcgucgaggccgccgccaccugguacuacucccucgagcacuccaccgacgacuacgccuccuucucccgcgcccucgagaacgccacccgcgacuacuucaucaucugccccaucaucgacauggccuccgccugggccaagcgcgcccgcggcaacgucuucauguaccacgcccccgagaacuacggccacggcucccucgagcuccucgccgacguccaguucgcccucggccuccccuucuaccccgccuacgagggccaguucucccucgaggagaagucccucucccucaagaucaugcaguacuucucccacuucauccgcuccggcaaccccaacuaccccuacgaguucucccgcaagguccccaccuucgccacccccuggcccgacuucgucccccgcgccggcggcgagaacuacaaggaguucuccgagcuccuccccaaccgccagggccucaagaaggccgacugcuccuucugguccaaguacaucuccucccucaagaccuccgccgacggcgccaagggcggccaguccgccgaguccgaggaggaggagcucaccgccggcuccggccuccgcgaggaccuccucucccuccaggagcccggcuccaagaccuacuccaaguga

SEQ ID NO: 50679 - RNA, 828 nt, Artificial Sequence
  derived and/or modified sequence opt2 from TGIF1__Homo_sapiens__NP_001265611
auggccgccgcccacuccggccgcuccaucgucgccgccuccggcuccgagaccgaggacgaggacuccauggacaucccccucgaccucuccuccuccgccggcuccggcaagcgccgccgccgcggcaaccuccccaaggaguccguccagauccuccgcgacuggcucuacgagcaccgcuacaacgccuaccccuccgagcaggagaaggcccuccucucccagcagacccaccucuccacccuccaggucugcaacugguucaucaacgcccgccgccgccuccuccccgacaugcuccgcaaggacggcaaggaccccaaccaguucaccaucucccgccgcggcgccaagaucuccgagaccuccuccgucgaguccgucaugggcaucaagaacuucaugcccgcccucgaggagacccccuuccacuccugcaccgccggccccaaccccacccucggccgcccccucucccccaagcccuccucccccggcuccguccucgcccgccccuccgucaucugccacaccaccgucaccgcccucaaggacguccccuucucccucugccaguccgucggcgucggccagaacaccgacauccagcagaucgccgccaagaacuucaccgacaccucccucauguaccccgaggacaccugcaaguccggccccuccaccaacacccaguccggccucuucaacacccccccccccaccccccccgaccucaaccaggacuucuccggcuuccagcuccucgucgacgucgcccucaagcgcgccgccgagauggagcuccaggccaagcucaccgccuga

SEQ ID NO: 50680 - RNA, 468 nt, Artificial Sequence
  derived and/or modified sequence opt2 from TGIF2-C20orf24__Homo_sapiens__NP_001186464
auguccgacuccgaccucggcgaggacgagggccuccucucccucgccggcaagcgcaagcgccgcggcaaccuccccaaggaguccgucaagauccuccgcgacuggcucuaccuccaccgcuacaacgccuaccccuccgagcaggagaagcucucccucuccggccagaccaaccucuccguccuccaggacgaguuccucgacgucaucuacugguuccgccagaucaucgccgucguccucggcgucaucuggggcguccucccccuccgcggcuuccucggcaucgccggcuucugccucaucaacgccggcguccucuaccucuacuucuccaacuaccuccagaucgacgaggaggaguacggcggcaccugggagcucaccaaggagggcuucaugaccuccuucgcccucuucauggucaucuggaucaucuucuacaccgccauccacuacgacuga

SEQ ID NO: 50681 - RNA, 714 nt, Artificial Sequence
  derived and/or modified sequence opt2 from TGIF2__Homo_sapiens__NP_001186444
auguccgacuccgaccucggcgaggacgagggccuccucucccucgccggcaagcgcaagcgccgcggcaaccuccccaaggaguccgucaagauccuccgcgacuggcucuaccuccaccgcuacaacgccuaccccuccgagcaggagaagcucucccucuccggccagaccaaccucuccguccuccagaucugcaacugguucaucaacgcccgccgccgccuccuccccgacaugcuccgcaaggacggcaaggaccccaaccaguucaccaucucccgccgcggcggcaaggccuccgacgucgcccucccccgcggcuccucccccuccguccucgccgucuccguccccgcccccaccaacguccucucccucuccgucugcuccaugccccuccacuccggccagggcgagaagcccgccgcccccuucccccgcggcgagcucgagucccccaagccccucgucacccccggcuccacccucacccuccucacccgcgccgaggccggcucccccaccggcggccucuucaacacccccccccccaccccccccgagcaggacaaggaggacuucuccuccuuccagcuccucgucgaggucgcccuccagcgcgccgccgagauggagcuccagaagcagcaggaccccucccucccccuccuccacacccccaucccccucgucuccgagaacccccaguga

SEQ ID NO: 50682 - RNA, 726 nt, Artificial Sequence
  derived and/or modified sequence opt2 from TGIF2LX__Homo_sapiens__NP_620410
auggaggccgccgccgacggccccgccgagacccagucccccgucgagaaggacucccccgccaagacccagucccccgcccaggacaccuccaucaugucccgcaacaacgccgacaccggccgcguccucgcccuccccgagcacaagaagaagcgcaagggcaaccuccccgccgaguccgucaagauccuccgcgacuggauguacaagcaccgcuucaaggccuaccccuccgaggaggagaagcagaugcucuccgagaagaccaaccucucccuccuccagaucuccaacugguucaucaacgcccgccgccgcauccuccccgacaugcuccagcagcgccgcaacgaccccaucaucggccacaagaccggcaaggacgcccacgccacccaccuccaguccaccgaggccuccguccccgccaaguccggccccuccggccccgacaacguccagucccucccccucuggccccuccccaagggccagaugucccgcgagaagcagcccgaccccgaguccgcccccucccagaagcucaccggcaucgcccagcccaagaagaaggucaaggucuccgucaccucccccuccucccccgagcucgucucccccgaggagcacgccgacuucuccuccuuccuccuccucgucgacgccgccguccagcgcgccgccgagcucgagcucgagaagaagcaggagcccaaccccuga

SEQ ID NO: 50683 - RNA, 2454 nt, Artificial Sequence
  derived and/or modified sequence opt2 from TGM1__Homo_sapiens__NP_000350
augauggacggcccccgcuccgacgucggccgcuggggcggcaacccccuccagccccccaccacccccucccccgagcccgagcccgagcccgacggccgcucccgccgcggcggcggccgcuccuucugggcccgcugcugcggcugcugcuccugccgcaacgccgccgacgacgacuggggccccgagcccuccgacucccgcggccgcggcuccuccuccggcacccgccgccccggcucccgcggcuccgacucccgccgccccgucucccgcggcuccggcgucaacgccgccggcgacggcaccauccgcgagggcaugcucgucgucaacggcgucgaccuccucuccucccgcuccgaccagaaccgccgcgagcaccacaccgacgaguacgaguacgacgagcucaucguccgccgcggccagcccuuccacaugcuccuccuccucucccgcaccuacgaguccuccgaccgcaucacccucgagcuccucaucggcaacaaccccgaggucggcaagggcacccacgucaucauccccgucggcaagggcggcuccggcggcuggaaggcccaggucgucaaggccuccggccagaaccucaaccuccgcguccacaccucccccaacgccaucaucggcaaguuccaguucaccguccgcacccaguccgacgccggcgaguuccagcuccccuucgacccccgcaacgagaucuacauccucuucaaccccuggugccccgaggacaucgucuacgucgaccacgaggacuggcgccaggaguacguccucaacgaguccggccgcaucuacuacggcaccgaggcccagaucggcgagcgcaccuggaacuacggccaguucgaccacggcguccucgacgccugccucuacauccucgaccgccgcggcaugcccuacggcggccgcggcgaccccgucaacgucucccgcgucaucuccgccauggucaacucccucgacgacaacggcguccucaucggcaacugguccggcgacuacucccgcggcaccaaccccuccgccugggucggcuccgucgagauccuccucuccuaccuccgcaccggcuacuccguccccuacggccagugcugggucuucgccggcgucaccaccaccguccuccgcugccucggccucgccacccgcaccgucaccaacuucaacuccgcccacgacaccgacaccucccucaccauggacaucuacuucgacgagaacaugaagccccucgagcaccucaaccacgacuccgucuggaacuuccacgucuggaacgacugcuggaugaagcgccccgaccuccccuccggcuucgacggcuggcaggucgucgacgccaccccccaggagaccuccuccggcaucuucugcugcggccccugcuccgucgaguccaucaagaacggccucgucuacaugaaguacgacacccccuucaucuucgccgaggucaacuccgacaaggucuacuggcagcgccaggacgacggcuccuucaagaucgucuacgucgaggagaaggccaucggcacccucaucgucaccaaggccaucuccuccaacaugcgcgaggacaucaccuaccucuacaagcaccccgagggcuccgacgccgagcgcaaggccgucgagaccgccgccgcccacggcuccaagcccaacgucuacgccaaccgcggcuccgccgaggacgucgccaugcaggucgaggcccaggacgccgucaugggccaggaccucauggucuccgucaugcucaucaaccacuccuccucccgccgcaccgucaagcuccaccucuaccucuccgucaccuucuacaccggcgucuccggcaccaucuucaaggagaccaagaaggaggucgagcucgcccccggcgccuccgaccgcgucaccaugcccgucgccuacaaggaguaccgcccccaccucgucgaccagggcgccaugcuccucaacgucuccggccacgucaaggaguccggccagguccucgccaagcagcacaccuuccgccuccgcacccccgaccucucccucacccuccucggcgccgccgucgucggccaggagugcgagguccagaucgucuucaagaacccccuccccgucacccucaccaacgucgucuuccgccucgagggcuccggccuccagcgccccaagauccucaacgucggcgacaucggcggcaacgagaccgucacccuccgccaguccuucguccccguccgccccggcccccgccagcucaucgccucccucgacuccccccagcucucccagguccacggcgucauccaggucgacgucgcccccgcccccggcgacggcggcuucuucuccgacgccggcggcgacucccaccucggcgagaccauccccauggccucccgcggcggcgccuga

SEQ ID NO: 50684 - RNA, 1647 nt, Artificial Sequence
  derived and/or modified sequence opt2 from TGM2__Homo_sapiens__NP_945189
auggccgaggagcucguccucgagcgcugcgaccucgagcucgagaccaacggccgcgaccaccacaccgccgaccucugccgcgagaagcucgucguccgccgcggccagcccuucuggcucacccuccacuucgagggccgcaacuacgaggccuccgucgacucccucaccuucuccgucgucaccggccccgcccccucccaggaggccggcaccaaggcccgcuucccccuccgcgacgccgucgaggagggcgacuggaccgccaccgucgucgaccagcaggacugcacccucucccuccagcucaccacccccgccaacgcccccaucggccucuaccgccucucccucgaggccuccaccggcuaccagggcuccuccuucguccucggccacuucauccuccucuucaacgccuggugccccgccgacgccgucuaccucgacuccgaggaggagcgccaggaguacguccucacccagcagggcuucaucuaccagggcuccgccaaguucaucaagaacauccccuggaacuucggccaguucgaggacggcauccucgacaucugccucauccuccucgacgucaaccccaaguuccucaagaacgccggccgcgacugcucccgccgcuccucccccgucuacgucggccgcgucgucuccggcauggucaacugcaacgacgaccagggcguccuccucggccgcugggacaacaacuacggcgacggcgucucccccauguccuggaucggcuccgucgacauccuccgccgcuggaagaaccacggcugccagcgcgucaaguacggccagugcugggucuucgccgccgucgccugcaccguccuccgcugccucggcauccccacccgcgucgucaccaacuacaacuccgcccacgaccagaacuccaaccuccucaucgaguacuuccgcaacgaguucggcgagauccagggcgacaaguccgagaugaucuggaacuuccacugcugggucgaguccuggaugacccgccccgaccuccagcccggcuacgagggcuggcaggcccucgaccccaccccccaggagaaguccgagggcaccuacugcugcggccccguccccguccgcgccaucaaggagggcgaccucuccaccaaguacgacgcccccuucgucuucgccgaggucaacgccgacgucgucgacuggauccagcaggacgacggcuccguccacaaguccaucaaccgcucccucaucgucggccucaagaucuccaccaaguccgucggccgcgacgagcgcgaggacaucacccacaccuacaaguaccccgagggcuccuccgaggagcgcgaggccuucacccgcgccaaccaccucaacaagcucgccgagaaggaggagaccggcauggccaugcgcauccgcgucggccaguccaugaacaugggcuccgacuucgacgucuucgcccacaucaccaacaacaccgccgaggaguacgucugccgccuccuccucugcgcccgcaccgucuccuacaacggcauccucggccccgagugcggcaccaaguaccuccucaaccucaaccucgagcccuucuccggcaaggcccucugcuccugguccaucugcuga

SEQ ID NO: 50685 - RNA, 2082 nt, Artificial Sequence
  derived and/or modified sequence opt2 from TGM3__Homo_sapiens__NP_003236
auggccgcccucggcguccaguccaucaacuggcagaccgccuucaaccgccaggcccaccacaccgacaaguucuccucccaggagcucauccuccgccgcggccagaacuuccagguccucaugaucaugaacaagggccucggcuccaacgagcgccucgaguucaucgucuccaccggccccuaccccuccgaguccgccaugaccaaggccgucuucccccucuccaacggcuccuccggcggcugguccgccguccuccaggccuccaacggcaacacccucaccaucuccaucuccucccccgccuccgcccccaucggccgcuacaccauggcccuccagaucuucucccagggcggcaucuccuccgucaagcucggcaccuucauccuccucuucaaccccuggcucaacgucgacuccgucuucaugggcaaccacgccgagcgcgaggaguacguccaggaggacgccggcaucaucuucgucggcuccaccaaccgcaucggcaugaucggcuggaacuucggccaguucgaggaggacauccucuccaucugccucuccauccucgaccgcucccucaacuuccgccgcgacgccgccaccgacgucgccucccgcaacgaccccaaguacgucggccgcguccucuccgccaugaucaacuccaacgacgacaacggcguccucgccggcaacugguccggcaccuacaccggcggccgcgacccccgcuccuggaacggcuccgucgagauccucaagaacuggaagaaguccggcuucucccccguccgcuacggccagugcugggucuucgccggcacccucaacaccgcccuccgcucccucggcauccccucccgcgucaucaccaacuucaacuccgcccacgacaccgaccgcaaccucuccgucgacgucuacuacgaccccaugggcaacccccucgacaagggcuccgacuccgucuggaacuuccacgucuggaacgagggcugguucguccgcuccgaccucggccccuccuacggcggcuggcagguccucgacgccaccccccaggagcgcucccagggcgucuuccagugcggccccgccuccgucaucggcguccgcgagggcgacguccagcucaacuucgacaugcccuucaucuucgccgaggucaacgccgaccgcaucaccuggcucuacgacaacaccaccggcaagcaguggaagaacuccgucaacucccacaccaucggccgcuacaucuccaccaaggccgucggcuccaacgcccgcauggacgucaccgacaaguacaaguaccccgagggcuccgaccaggagcgccaggucuuccagaaggcccucggcaagcucaagcccaacacccccuucgccgccaccuccuccaugggccucgagaccgaggagcaggagcccuccaucaucggcaagcucaaggucgccggcaugcucgccgucggcaaggaggucaaccucguccuccuccucaagaaccucucccgcgacaccaagaccgucaccgucaacaugaccgccuggaccaucaucuacaacggcacccucguccacgaggucuggaaggacuccgccaccaugucccucgaccccgaggaggaggccgagcaccccaucaagaucuccuacgcccaguacgagaaguaccucaaguccgacaacaugauccgcaucaccgccgucugcaagguccccgacgaguccgaggucgucgucgagcgcgacaucauccucgacaaccccacccucacccucgagguccucaacgaggcccgcguccgcaagcccgucaacguccagaugcucuucuccaacccccucgacgagcccguccgcgacugcguccucauggucgagggcuccggccuccuccucggcaaccucaagaucgacguccccacccucggccccaaggagggcucccgcguccgcuucgacauccuccccucccgcuccggcaccaagcagcuccucgccgacuucuccugcaacaaguuccccgccaucaaggccaugcucuccaucgacgucgccgaguga

SEQ ID NO: 50686 - RNA, 2055 nt, Artificial Sequence
  derived and/or modified sequence opt2 from TGM4__Homo_sapiens__NP_003232
augauggacgccuccaaggagcuccagguccuccacaucgacuuccucaaccaggacaacgccgucucccaccacaccugggaguuccagaccuccucccccgucuuccgccgcggccaggucuuccaccuccgccucguccucaaccagccccuccaguccuaccaccagcucaagcucgaguucuccaccggccccaaccccuccaucgccaagcacacccucgucguccucgacccccgcacccccuccgaccacuacaacuggcaggccacccuccagaacgaguccggcaaggaggucaccgucgccgucaccuccucccccaacgccauccucggcaaguaccagcucaacgucaagaccggcaaccacauccucaaguccgaggagaacauccucuaccuccucuucaaccccuggugcaaggaggacauggucuucaugcccgacgaggacgagcgcaaggaguacauccucaacgacaccggcugccacuacgucggcgccgcccgcuccaucaagugcaagcccuggaacuucggccaguucgagaagaacguccucgacugcugcaucucccuccucaccgaguccucccucaagcccaccgaccgccgcgaccccguccucgucugccgcgccaugugcgccaugauguccuucgagaagggccagggcguccucaucggcaacuggaccggcgacuacgagggcggcaccgcccccuacaaguggaccggcuccgcccccauccuccagcaguacuacaacaccaagcaggccgucugcuucggccagugcugggucuucgccggcauccucaccaccguccuccgcgcccucggcauccccgcccgcuccgucaccggcuucgacuccgcccacgacaccgagcgcaaccucaccgucgacaccuacgucaacgagaacggcgagaagaucaccuccaugacccacgacuccgucuggaacuuccacgucuggaccgacgccuggaugaagcgccccgaccuccccaagggcuacgacggcuggcaggccgucgacgccaccccccaggagcgcucccagggcgucuucugcugcggccccuccccccucaccgccauccgcaagggcgacaucuucaucgucuacgacacccgcuucgucuucuccgaggucaacggcgaccgccucaucuggcucgucaagauggucaacggccaggaggagcuccacgucaucuccauggagaccaccuccaucggcaagaacaucuccaccaaggccgucggccaggaccgccgccgcgacaucaccuacgaguacaaguaccccgagggcuccuccgaggagcgccaggucauggaccacgccuuccuccuccucuccuccgagcgcgagcaccgccgccccgucaaggagaacuuccuccacauguccguccaguccgacgacguccuccucggcaacuccgucaacuucaccgucauccucaagcgcaagaccgccgcccuccagaacgucaacauccucggcuccuucgagcuccagcucuacaccggcaagaagauggccaagcucugcgaccucaacaagaccucccagauccagggccaggucuccgaggucacccucacccucgacuccaagaccuacaucaacucccucgccauccucgacgacgagcccgucauccgcggcuucaucaucgccgagaucgucgaguccaaggagaucauggccuccgaggucuucaccuccuuccaguaccccgaguucuccaucgagcuccccaacaccggccgcaucggccagcuccucgucugcaacugcaucuucaagaacacccucgccaucccccucaccgacgucaaguucucccucgagucccucggcaucuccucccuccagaccuccgaccacggcaccguccagcccggcgagaccauccagucccagaucaagugcacccccaucaagaccggccccaagaaguucaucgucaagcucuccuccaagcaggucaaggagaucaacgcccagaagaucguccucaucaccaaguga

SEQ ID NO: 50687 - RNA, 1917 nt, Artificial Sequence
  derived and/or modified sequence opt2 from TGM5__Homo_sapiens__NP_004236
auggcccagggccucgaggucgcccucaccgaccuccaguccucccgcaacaacguccgccaccacaccgaggagaucaccgucgaccaccuccucguccgccgcggccaggccuucaaccucacccucuacuuccgcaaccgcuccuuccagcccggccucgacaacaucaucuucgucgucgagaccgaggacgccgucuaccucgacuccgagccccagcgccaggaguacgucaugaacgacuacggcuucaucuaccagggcuccaagaacuggauccgccccugccccuggaacuacggccaguucgaggacaagaucaucgacaucugccucaagcuccucgacaagucccuccacuuccagaccgaccccgccaccgacugcgcccuccgcggcucccccgucuacgucucccgcgucgucugcgccaugaucaacuccaacgacgacaacggcguccucaacggcaacugguccgagaacuacaccgacggcgccaaccccgccgaguggaccggcuccgucgccauccucaagcaguggaacgccaccggcugccagcccguccgcuacggccagugcugggucuucgccgccgucaugugcaccgucaugcgcugccucggcauccccacccgcgucaucaccaacuucgacuccggccacgacaccgacggcaaccucaucaucgacgaguacuacgacaacaccggccgcauccucggcaacaagaagaaggacaccaucuggaacuuccacgucuggaacgagugcuggauggcccgcaaggaccucccccccgccuacggcggcuggcagguccucgacgccaccccccaggagauguccaacggcgucuacugcugcggccccgccuccguccgcgccaucaaggagggcgaggucgaccucaacuacgacacccccuucgucuucuccauggucaacgccgacugcauguccuggcucguccagggcggcaaggagcagaagcuccaccaggacaccuccuccgucggcaacuucaucuccaccaaguccauccaguccgacgagcgcgacgacaucaccgagaacuacaaguacgaggagggcucccuccaggagcgccaggucuuccucaaggcccuccagaagcucaaggcccgcuccuuccacggcucccagcgcggcgccgagcuccagcccucccgccccaccucccucucccaggacuccccccgcucccuccacacccccucccuccgccccuccgacgucguccaggucucccucaaguucaagcuccucgacccccccaacaugggccaggacaucugcuucguccuccucgcccucaacauguccucccaguucaaggaccucaaggucaaccucuccgcccagucccuccuccacgacggcuccccccucucccccuucuggcaggacaccgccuucaucacccucucccccaaggaggccaagaccuaccccugcaagaucuccuacucccaguacucccaguaccucuccaccgacaagcucauccgcaucuccgcccucggcgaggagaaguccucccccgagaagauccucgucaacaagaucaucacccucuccuaccccuccaucaccaucaacguccucggcgccgccgucgucaaccagccccucuccauccaggucaucuucuccaacccccucuccgagcaggucgaggacugcguccucaccgucgagggcuccggccucuucaagaagcagcagaaggucuuccucggcguccucaagccccagcaccaggccuccaucauccucgagaccguccccuucaaguccggccagcgccagauccaggccaacaugcgcuccaacaaguucaaggacaucaagggcuaccgcaacgucuacgucgacuucgcccucuga

SEQ ID NO: 50688 - RNA, 1878 nt, Artificial Sequence
  derived and/or modified sequence opt2 from TGM6__Homo_sapiens__NP_001241663
auggccggcauccgcgucaccaaggucgacuggcagcgcucccgcaacggcgccgcccaccacacccaggaguaccccugccccgagcucgucguccgccgcggccaguccuucucccucacccucgagcucucccgcgcccucgacugcgaggagauccucaucuucaccauggagaccggcccccgcgccuccgaggcccuccacaccaaggccgucuuccagaccuccgagcucgagcgcggcgagggcuggaccgccgcccgcgaggcccagauggagaagacccucaccgucucccucgccuccccccccuccgccgucaucggccgcuaccuccucuccauccgccucuccucccaccgcaagcacuccaaccgccgccucggcgaguucguccuccucuucaaccccuggugcgccgaggacgacgucuuccucgccuccgaggaggagcgccaggaguacguccucuccgacuccggcaucaucuuccgcggcgucgagaagcacauccgcgcccagggcuggaacuacggccaguucgaggaggacauccucaacaucugccucuccauccucgaccgcucccccggccaccagaacaaccccgccaccgacgucuccugccgccacaaccccaucuacgucacccgcgucaucuccgccauggucaacuccaacaacgaccgcggcgucguccagggccaguggcagggcaaguacggcggcggcaccuccccccuccacuggcgcggcuccgucgccauccuccagaaguggcucaagggccgcuacaagcccgucaaguacggccagugcugggucuucgccggcguccucugcaccguccuccgcugccucggcaucgccacccgcgucgucuccaacuucaacuccgcccacgacaccgaccagaaccucuccgucgacaaguacgucgacuccuucggccgcacccucgaggaccucaccgaggacuccauguggaacuuccacgucuggaacgaguccugguucgcccgccaggaccucggccccuccuacaacggcuggcagguccucgacgccaccccccaggaggaguccgagggcgucuuccgcugcggccccgccuccgucaccgccauccgcgagggcgacguccaccucgcccacgacggccccuucgucuucgccgaggucaacgccgacuacaucaccuggcucuggcacgaggacgagucccgcgagcgcgucuacuccaacaccaagaagaucggccgcugcaucuccaccaaggccgucggcuccgacucccgcgucgacaucaccgaccucuacaaguaccccgagggcucccgcaaggagcgccaggucuacuccaaggccgucaaccgccucuucggcgucgaggccuccggccgccgcaucuggauccgccgcgccggcggccgcugccucuggcgcgacgaccuccucgagcccgccaccaagcccuccaucgccggcaaguucaagguccucgagccccccaugcucggccacgaccuccgccucgcccucugccucgccaaccucaccucccgcgcccagcgcguccgcgucaaccucuccggcgccaccauccucuacacccgcaagcccgucgccgagauccuccacgagucccacgccguccgccucggcccccaggaggagaagcgcauccccaucaccaucuccuacuccaaguacaaggaggaccucaccgaggacaagaagauccuccucgccgccaugugccucgucaccaagggcgagaagcuccucgucgagaaggacaucacccucgaggacuucaucaccaucaagcgcgccuaccccggcgccuccggcgagggccucucccccgucuga

SEQ ID NO: 50689 - RNA, 2133 nt, Artificial Sequence
  derived and/or modified sequence opt2 from TGM7__Homo_sapiens__NP_443187
auggaccaggucgccacccuccgccucgaguccgucgaccuccaguccucccgcaacaacaaggagcaccacacccaggagaugggcgucaagcgccucaccguccgccgcggccagcccuucuaccuccgccucuccuucucccgccccuuccagucccagaacgaccacaucaccuucgucgccgagaccggccccaagcccuccgagcuccucggcacccgcgccaccuucuuccucacccgcguccagcccggcaacgucugguccgccuccgacuucaccaucgacuccaacucccuccaggucucccucuucacccccgccaacgccgucaucggccacuacacccucaagaucgagaucucccagggccagggccacuccgucaccuacccccucggcaccuucauccuccucuucaaccccuggucccccgaggacgacgucuaccuccccuccgagauccuccuccaggaguacaucaugcgcgacuacggcuucgucuacaagggccacgagcgcuucaucaccuccuggcccuggaacuacggccaguucgaggaggacaucaucgacaucugcuucgagauccucaacaagucccucuaccaccucaagaaccccgccaaggacugcucccagcgcaacgacgucgucuacgucugccgcgucgucuccgccaugaucaacuccaacgacgacaacggcguccuccagggcaacuggggcgaggacuacuccaagggcgucuccccccucgaguggaagggcuccgucgccauccuccagcagugguccgcccgcggcggccagcccgucaaguacggccagugcugggucuucgccuccgucaugugcaccgucaugcgcugccucggcguccccacccgcgucgucuccaacuuccgcuccgcccacaacgucgaccgcaaccucaccaucgacaccuacuacgaccgcaacgccgagaugcucuccacccagaagcgcgacaagaucuggaacuuccacgucuggaacgagugcuggaugauccgcaaggaccucccccccggcuacaacggcuggcagguccucgaccccaccccccagcagaccuccuccggccucuucugcugcggccccgccuccgucaaggccauccgcgagggcgacguccaccucgccuacgacacccccuucgucuacgccgaggucaacgccgacgaggucaucuggcuccucggcgacggccaggcccaggagauccucgcccacaacaccuccuccaucggcaaggagaucuccaccaagauggucggcuccgaccagcgccaguccaucaccuccuccuacaaguaccccgagggcucccccgaggagcgcgccgucuucaugaaggccucccgcaagaugcucggcccccagcgcgccucccuccccuuccucgaccuccucgaguccggcggccuccgcgaccagcccgcccagcuccagcuccaccucgcccgcauccccgaguggggccaggaccuccagcuccuccuccgcauccagcgcguccccgacuccacccacccccgcggccccaucggccucgucguccgcuucugcgcccaggcccuccuccacggcggcggcacccagaagcccuucuggcgccacaccguccgcaugaaccucgacuucggcaaggagacccaguggccccuccuccuccccuacuccaacuaccgcaacaagcucaccgacgagaagcucauccgcgucuccggcaucgccgaggucgaggagaccggccgcuccaugcucguccucaaggacaucugccucgagcccccccaccucuccaucgaggucuccgagcgcgccgaggucggcaaggcccuccgcguccacgucacccucaccaacacccucauggucgcccucuccuccugcaccaugguccucgagggcuccggccucaucaacggccagaucgccaaggaccucggcacccucgucgccggccacacccuccagauccagcucgaccucuaccccaccaaggccggcccccgccagcuccagguccucaucuccuccaacgaggucaaggagaucaagggcuacaaggacaucuucgucaccgucgccggcgcccccuga

SEQ ID NO: 50690 - RNA, 1362 nt, Artificial Sequence
  derived and/or modified sequence opt2 from TGOLN2__Homo_sapiens__NP_001193770
augcgcuucgucgucgcccucguccuccucaacgucgccgccgccggcgccgucccccuccucgccaccgaguccgucaagcaggaggaggccggcguccgccccuccgccggcaacgucuccacccaccccucccucucccagcgccccggcggcuccaccaagucccaccccgagccccagacccccaaggacucccccuccaaguccuccgccgaggcccagacccccgaggacacccccaacaaguccggcgccgaggccaagacccagaaggacuccuccaacaaguccggcgccgaggccaagacccagaagggcuccaccuccaaguccggcuccgaggcccagaccaccaaggacuccaccuccaagucccaccccgagcuccagacccccaaggacuccaccggcaaguccggcgccgaggcccagacccccgaggacucccccaaccgcuccggcgccgaggccaagacccagaaggacucccccuccaaguccggcuccgaggcccagaccaccaaggacguccccaacaaguccggcgccgacggccagacccccaaggacggcuccuccaaguccggcgccgaggaccagacccccaaggacguccccaacaaguccggcgccgagaagcagacccccaaggacggcuccaacaaguccggcgccgaggagcagggccccaucgacggccccuccaaguccggcgccgaggagcagaccuccaaggacucccccaacaaggucguccccgagcagcccucccgcaaggaccacuccaagcccaucuccaaccccuccgacaacaaggagcuccccaaggccgacaccaaccagcucgccgacaagggcaagcucuccccccacgccuucaagaccgaguccggcgaggagaccgaccucaucucccccccccaggaggaggucaaguccuccgagcccaccgaggacgucgagcccaaggaggccgaggacgacgacaccggccccgaggagggcuccccccccaaggaggagaaggagaagauguccggcuccgccuccuccgagaaccgcgagggcacccucuccgacuccaccggcuccgagaaggacgaccucuaccccaacggcuccggcaacggcuccgccgaguccucccacuucuucgccuaccucgucaccgccgccauccucgucgccguccucuacaucgcccaccacaacaagcgcaagaucaucgccuucguccucgagggcaagcgcuccaaggucacccgccgccccaaggccuccgacuaccagcgccucgaccagaagaucuucuucccccccucccccaaccgcauggucuacuccuccggcaagcgcuga

SEQ ID NO: 50691 - RNA, 2562 nt, Artificial Sequence
  derived and/or modified sequence opt2 from TGS1__Homo_sapiens__NP_079107
augugcugcgagaaguggucccgcgucgccgagauguuccucuucaucgaggagcgcgaggacugcaagauccucugccucugcucccgcgccuucgucgaggaccgcaagcucuacaaccucggccucaagggcuacuacauccgcgacuccggcaacaacuccggcgaccaggccaccgaggaggaggagggcggcuacuccugcggcaccgccgagucccacgacuccaagggcaucggccucgacgaguccgagcucgacuccgaggccgagcucaugcgcuccaugggccucccccuccaguucggccgcaucaccgcccacaaggacuucgaggucuccaugaacacccgcaacaaggucaagaucaagaagaagaagcaccagaagaaguaccucgacgagaucguccaggaguccuggcgcaaggaguacgaggaggacgacauccucgccuccgacgaccccuccuccaucgagcaguacgagaacacccgcaccuacgagcuccaguccaagaaggacaccgagaccgagaacccccccgucgagaacacccucucccccaagcucgagaucaccgagaagugggagaaguacuggaacgaguacggcggcggccuccucuggcaguccuggcaggagaagcaccccggccaggcccucuccuccgagcccuggaacuuccccgacaccaaggaggagugggagcagcacuacucccagcucuacugguacuaccucgagcaguuccaguacugggaggcccagggcuggaccuucgacgccucccaguccugcgacaccgacaccuacaccuccaagaccgaggccgacgacaagaacgacgagaagugcaugaaggucgaccucgucuccuuccccuccucccccaucauggucgacaacgacuccuccggcaccuccgacaaggaccacuccgagauccucgacggcaucuccaacaucaagcucaacuccgaggaggucacccagucccagcucgacuccugcaccucccacgacggccaccagcagcucuccgaggucuccuccaagcgcgagugccccgccuccggccaguccgagccccgcaacggcggcaccaacgaggaguccaacuccuccggcaacaccaacaccgacccccccgccgaggacucccagaaguccuccggcgccaacaccuccaaggaccgcccccacgccuccggcaccgacggcgacgaguccgaggaggacccccccgagcacaagcccuccaagcucaagcgcucccacgagcucgacaucgacgagaaccccgccuccgacuucgacgacuccggcucccuccucggcuucaaguacggcuccggccagaaguacggcggcauccccaacuucucccaccgccagguccgcuaccucgagaagaacgucaagcucaaguccaaguaccucgacaugcgccgccagaucaagaugaagaacaagcacaucuucuucaccaaggaguccgagaagcccuucuucaagaaguccaagauccucuccaaggucgagaaguuccucaccugggucaacaagcccauggacgaggaggccucccaggaguccuccucccacgacaacguccacgacgccuccaccuccuccgacuccgaggagcaggacauguccgucaagaagggcgacgaccuccucgagaccaacaaccccgagcccgagaagugccaguccgucuccuccgccggcgagcucgagaccgagaacuacgagcgcgacucccuccucgccaccguccccgacgagcaggacugcgucacccaggagguccccgacucccgccaggccgagaccgaggccgaggucaagaagaagaagaacaagaagaagaacaagaaggucaacggccucccccccgagaucgccgccguccccgagcucgccaaguacugggcccagcgcuaccgccucuucucccgcuucgacgacggcaucaagcucgaccgcgagggcugguucuccgucacccccgagaagaucgccgagcacaucgccggccgcgucucccaguccuucaagugcgacgucgucgucgacgccuucugcggcgucggcggcaacaccauccaguucgcccucaccggcaugcgcgucaucgccaucgacaucgaccccgucaagaucgcccucgcccgcaacaacgccgaggucuacggcaucgccgacaagaucgaguucaucugcggcgacuuccuccuccucgccuccuuccucaaggccgacgucgucuuccucuccccccccuggggcggccccgacuacgccaccgccgagaccuucgacauccgcaccaugaugucccccgacggcuucgagaucuuccgccucuccaagaagaucaccaacaacaucgucuacuuccucccccgcaacgccgacaucgaccaggucgccucccucgccggccccggcggccaggucgagaucgagcagaacuuccucaacaacaagcucaagaccaucaccgccuacuucggcgaccucauccgccgccccgccuccgagaccuga

SEQ ID NO: 50692 - RNA, 5862 nt, Artificial Sequence
  derived and/or modified sequence opt2 from THADA__Homo_sapiens__NP_001077422
augggcgucaagaagaagaaggagaugcaggucgccgcccucaccaucugccaccaggaccucgagacccucaaguccuucgccgacgucgagggcaagaaccucgccucccuccuccuccacugcguccagcucaccgacggcgucucccagauccacuacaucaagcagaucgucccccuccucgagaaggccgacaagaacggcaugugcgaccccaccauccaguccugccucgacauccucgccggcaucuaccucucccucucccucaagaacccccucaagaagguccucgccuccucccucaacucccuccccgacuucuuccuccccgaggccaugcaccgcuucaccucccgccuccaggaggagcucaacaccaccgaccucuacuccuaccgcaaggucaccgacaacaucuccuccugcauggagaacuucaaccucggccgcgccuccgucaacaaccuccucaagaacguccuccacuuccuccagaagucccucaucgagauccucgaggagaaccgcaagugcgccggcaaccacaucauccagacccagcucaugaacgaccuccucgucggcauccgcgucuccaugaugcucguccagaagguccaggacuuccagggcaaccucuggaagaccuccgacucccccaucuggcagaacaugugcggccuccucuccaucuucaccaagguccucuccgacgacgaccuccuccagaccguccaguccaccuccggccucgccaucauccucuucaucaagaccauguuccaccccuccgagaagaucccccaccucaucuccuccguccuccuccgcuccgucgacugcaccuccguccccgagugguucauguccuccugccgcucccucugcugcggcgacaucucccaguccgccguccucuuccucugccagggcacccucgccaugcucgacuggcagaacggcuccaugggccgcuccggcgaggcccuccuccucgacaccgcccacguccucuucacccucuccucccagaucaaggagcccacccucgagauguuccucucccgcauccucgccuccuggaccaacuccgccauccagguccucgaguccuccucccccucccucaccgacucccucaacggcaacuccuccaucgucggccgccuccucgaguacgucuacacccacugggagcacccccucgacgcccuccgccaccagaccaagaucauguucaagaaccuccuccagaugcaccgccucaccgucgagggcgccgacuucguccccgaccccuucuucgucgagcucaccgagucccuccuccgccucgaguggcacaucaagggcaaguacaccugccucggcugccucgucgagugcaucggcgucgagcacauccucgccaucgacaagaccauccccucccagauccucgaggucaugggcgaccagucccucguccccuacgccuccgaccuccucgagaccauguuccgcaaccacaagucccaccucaagucccagaccgccgaguccuccuggaucgaccaguggcacgagaccugggucuccccccuccucuucauccucugcgagggcaaccucgaccagaaguccuacgucaucgacuacuaccuccccaagcuccucuccuacucccccgagucccuccaguacauggucaagauccuccagaccuccaucgacgccaagaccggccaggagcaguccuuccccucccucggcuccugcaacucccgcggcgcccucggcgcccucauggccugccuccgcaucgcccgcgcccacggccaccuccaguccgccaccgacaccugggagaaccucgucuccgacgcccgcaucaagcagggccucauccaccagcacugccagguccgcaucgacacccucggccuccucugcgaguccaaccgcuccaccgagaucgucuccauggaggagaugcaguggauccaguucuucaucaccuacaaccucaacucccagucccccggcguccgccagcagaucugcucccuccucaagaagcucuucugccgcauccaggaguccucccagguccucuacaagcucgagcaguccaaguccaagcgcgagcccgagaacgagcucaccaagcagcaccccuccgucucccuccagcaguacaagaacuucauguccuccaucugcaacucccucuucgaggcccucuuccccggcuccuccuacuccacccgcuucuccgcccucaccauccucggcuccaucgccgaggucuuccacguccccgagggccgcaucuacaccgucuaccagcucucccacgacaucgacgucggccgcuuccagacccucauggagugcuucaccuccaccuucgaggacgucaagauccucgccuucgaccuccucaugaagcucuccaagaccgccguccacuuccaggacuccggcaagcuccagggccucuuccaggccgcccucgagcucuccaccuccaccaagcccuacgacugcgucaccgccuccuaccuccucaacuuccucaucuggcaggacgcccuccccuccucccucuccgccuaccucacccagcaggucgccugcgacaacggcgaccgccccgccgccgucgucgagcgcaacacccucauggucaucaagugccucauggagaaccucgaggaggaggucucccaggccgagaacucccuccuccaggccgccgccgccuuccccauguacggccgcguccacugcaucaccggcgcccuccagaagcucucccucaacucccuccagcucgucuccgaguggcgccccgucgucgagaagcuccuccucauguccuaccgccucuccaccgucgucucccccgucauccaguccuccucccccgagggccucauccccauggacaccgacuccgaguccgccucccgccuccagaugauccucaacgagauccagccccgcgacaccaacgacuacuucaaccaggccaagauccucaaggagcacgacuccuucgacaugaaggaccucaacgccuccgucgucaacaucgacaccuccaccgagaucaagggcaaggaggucaagaccugcgacgucaccgcccagaugguccucgucugcugcuggcgcuccaugaaggaggucgcccuccuccucggcaugcucugccagcuccuccccaugcagcccguccccgaguccuccgacggccuccucaccgucgagcaggucaaggagaucggcgacuacuucaagcagcaccuccuccagucccgccaccgcggcgccuucgagcucgccuacaccggcuucgucaagcucaccgagguccucaaccgcugccccaacgucucccuccagaagcuccccgagcaguggcucugguccguccucgaggagaucaagugcuccgaccccuccuccaagcucugcgccacccgccgcuccgccggcauccccuucuacauccaggcccuccucgccuccgagcccaagaagggccgcauggaccuccucaagaucaccaugaaggagcucaucucccucgccggccccaccgacgacauccaguccaccgucccccagguccacgcccucaacauccuccgcgcccucuuccgcgacacccgccucggcgagaacaucauccccuacgucgccgacggcgccaaggccgccauccucggcuucaccucccccgucugggccguccgcaacuccuccacccuccucuucuccgcccucaucacccgcaucuucggcgucaagcgcgccaaggacgagcacuccaagaccaaccgcaugaccggccgcgaguucuucucccgcuuccccgagcucuaccccuuccuccucaagcagcucgagaccgucgccaacaccgucgacuccgacaugggcgagcccaaccgccaccccuccauguuccuccuccuccucguccucgagcgccucuacgccucccccauggacggcaccuccuccgcccucuccaugggccccuucguccccuucaucaugcgcugcggccacucccccgucuaccacucccgcgagauggccgcccgcgcccucguccccuucgucaugaucgaccacauccccaacaccauccgcacccuccucuccacccuccccuccugcaccgaccagugcuuccgccagaaccacauccacggcacccuccuccaggucuuccaccuccuccaggccuacuccgacuccaagcacggcaccaacuccgacuuccagcacgagcucaccgacaucaccgucugcaccaaggccaagcucuggcucgccaagcgccagaaccccugccucgucacccgcgccgucuacaucgacauccucuuccuccucaccugcugccucaaccgcuccgccaaggacaaccagcccguccucgagucccucggcuucugggaggagguccgcggcaucaucuccggcuccgagcucaucaccggcuuccccugggccuucaagguccccggccucccccaguaccuccagucccucacccgccucgccaucgccgccgucugggccgccgccgccaaguccggcgagcgcgagaccaacguccccaucuccuucucccagcuccucgaguccgccuuccccgagguccgcucccucacccucgaggcccuccucgagaaguuccucgccgccgccuccggccucggcgagaagggcguccccccccuccucugcaacaugggcgagaaguuccuccuccucgccaugaaggagaaccaccccgagugcuucugcaagauccucaagauccuccacugcauggaccccggcgaguggcucccccagaccgagcacugcguccaccucacccccaaggaguuccucaucuggaccauggacaucgccuccaacgagcgcuccgagauccaguccgucgcccuccgccucgccuccaaggucaucucccaccacaugcagaccugcgucgagaaccgcgagcucaucgccgccgagcucaagcaguggguccagcucgucauccucuccugcgaggaccaccuccccaccgagucccgccucgccgucgucgagguccucaccuccaccaccccccucuuccucaccaacccccaccccauccucgagcuccaggacacccucgcccucuggaagugcguccucacccuccuccaguccgaggagcaggccguccgcgacgccgccaccgagaccgucaccaccgccaugucccaggagaacaccugccaguccaccgaguucgccuucugccaggucgacgccuccaucgcccucgcccucgcccucgccguccucugcgaccuccuccagcagugggaccagcucgcccccggccuccccauccuccucggcuggcuccucggcgaguccgacgaccucgucgccugcgucgaguccaugcaccaggucgaggaggacuaccucuucgagaaggccgaggucaacuucugggccgagacccucaucuucgucaaguaccucugcaagcaccucuucugccuccucuccaaguccggcuggcgcccccccucccccgagaugcucugccaccuccagcgcauggucuccgagcagugccaccuccucucccaguucuuccgcgagcucccccccgccgccgaguucgucaagaccgucgaguucacccgccuccgcauccaggaggagcgcacccucgccugccuccgccuccucgccuuccucgagggcaaggagggcgaggacacccucguccucuccgucugggacuccuacgccgagucccgccagcucacccucccccgcaccgaggccgccugcuga

SEQ ID NO: 50693 - RNA, 774 nt, Artificial Sequence
  derived and/or modified sequence opt2 from THAP10__Homo_sapiens__NP_064532
augcccgcccgcugcgucgccgcccacugcggcaacaccaccaaguccggcaagucccucuuccgcuuccccaaggaccgcgccguccgccuccucugggaccgcuucguccgcggcugccgcgccgacugguacggcggcaacgaccgcuccgucaucugcuccgaccacuucgcccccgccugcuucgacgucuccuccgucauccagaagaaccuccgcuucucccagcgccuccgccucgucgccggcgccguccccacccuccaccgcguccccgcccccgcccccaagcgcggcgaggagggcgaccaggccggccgccucgacacccgcggcgagcuccaggccgcccgccacuccgaggccgcccccggccccgucuccugcacccgcccccgcgccggcaagcaggccgccgccucccagaucaccugcgagaacgagcucguccagacccagccccacgccgacaaccccuccaacaccgucaccuccguccccacccacugcgaggagggccccguccacaaguccacccagaucucccucaagcgcccccgccaccgcuccgucggcauccaggccaaggucaaggccuucggcaagcgccucugcaacgccaccacccagaccgaggagcucuggucccgcaccuccucccucuucgacaucuacuccuccgacuccgagaccgacaccgacugggacaucaaguccgagcaguccgaccucuccuacauggccguccaggucaaggaggagaccugcuga

SEQ ID NO: 50694 - RNA, 945 nt, Artificial Sequence
  derived and/or modified sequence opt2 from THAP11__Homo_sapiens__NP_065190
augcccggcuucaccugcugcguccccggcugcuacaacaacucccaccgcgacaaggcccuccacuucuacaccuuccccaaggacgccgagcuccgccgccucuggcucaagaacgucucccgcgccggcgucuccggcugcuucuccaccuuccagcccaccaccggccaccgccucugcuccguccacuuccagggcggccgcaagaccuacaccguccgcguccccaccaucuucccccuccgcggcgucaacgagcgcaaggucgcccgccgccccgccggcgccgccgccgcccgccgccgccagcagcagcagcagcagcagcagcagcagcagcagcagcagcagcagcagcagcagcagcagcagcagcagcagcagcagcagcaguccucccccuccgccuccaccgcccagaccgcccagcuccagcccaaccucgucuccgccuccgccgccguccuccucacccuccaggccaccgucgacuccucccaggcccccggcuccguccagcccgcccccaucacccccaccggcgaggacgucaagcccaucgaccucaccguccaggucgaguucgccgccgccgagggcgccgccgccgccgccgccgccuccgagcuccaggccgccaccgccggccucgaggccgccgagugccccaugggcccccagcucgucgucgucggcgaggagggcuuccccgacaccggcuccgaccacuccuacucccucuccuccggcaccaccgaggaggagcuccuccgcaagcucaacgagcagcgcgacauccucgcccucauggaggucaagaugaaggagaugaagggcuccauccgccaccuccgccucaccgaggccaagcuccgcgaggagcuccgcgagaaggaccgccuccucgccauggccgucauccgcaagaagcacggcauguga

SEQ ID NO: 50695 - RNA, 642 nt, Artificial Sequence
  derived and/or modified sequence opt2 from THAP1__Homo_sapiens__NP_060575
augguccaguccugcuccgccuacggcugcaagaaccgcuacgacaaggacaagcccgucuccuuccacaaguucccccucacccgccccucccucugcaaggagugggaggccgccguccgccgcaagaacuucaagcccaccaaguacuccuccaucugcuccgagcacuucacccccgacugcuucaagcgcgagugcaacaacaagcuccucaaggagaacgccguccccaccaucuuccucugcaccgagccccacgacaagaaggaggaccuccucgagccccaggagcagcuccccccccccccccuccccccccccgucucccaggucgacgccgccaucggccuccucaugcccccccuccagacccccgucaaccucuccgucuucugcgaccacaacuacaccgucgaggacaccaugcaccagcgcaagcgcauccaccagcucgagcagcaggucgagaagcuccgcaagaagcucaagaccgcccagcagcgcugccgccgccaggagcgccagcucgagaagcucaaggaggucguccacuuccagaaggagaaggacgacgucuccgagcgcggcuacgucauccuccccaacgacuacuucgagaucgucgagguccccgccuga

SEQ ID NO: 50696 - RNA, 687 nt, Artificial Sequence
  derived and/or modified sequence opt2 from THAP2__Homo_sapiens__NP_113623
augcccaccaacugcgccgccgccggcugcgccaccaccuacaacaagcacaucaacaucuccuuccaccgcuucccccucgaccccaagcgccgcaaggaguggguccgccucguccgccgcaagaacuucguccccggcaagcacaccuuccucugcuccaagcacuucgaggccuccugcuucgaccucaccggccagacccgccgccucaagauggacgccguccccaccaucuucgacuucugcacccacaucaaguccaugaagcucaagucccgcaaccuccucaagaagaacaacuccugcucccccgccggccccuccaaccucaaguccaacaucuccucccagcagguccuccucgagcacuccuacgccuuccgcaaccccauggaggccaagaagcgcaucaucaagcucgagaaggagaucgccucccuccgccgcaagaugaagaccugccuccagaaggagcgccgcgccacccgccgcuggaucaaggccaccugccucgucaagaaccucgaggccaacuccguccuccccaagggcaccuccgagcacaugcuccccaccgcccucuccucccucccccucgaggacuucaagauccucgagcaggaccagcaggacaagacccuccucucccucaaccucaagcagaccaaguccaccuucaucuga

SEQ ID NO: 50697 - RNA, 669 nt, Artificial Sequence
  derived and/or modified sequence opt2 from THAP6__Homo_sapiens__NP_653322
auggucaagugcugcuccgccaucggcugcgccucccgcugccuccccaacuccaagcucaagggccucaccuuccacgucuuccccaccgacgagaacaucaagcgcaaguggguccucgccaugaagcgccucgacgucaacgccgccggcaucugggagcccaagaagggcgacguccucugcucccgccacuucaagaagaccgacuucgaccgcuccgcccccaacaucaagcucaagcccggcgucauccccuccaucuucgacucccccuaccaccuccagggcaagcgcgagaagcuccacugccgcaagaacuucacccucaagaccguccccgccaccaacuacaaccaccaccucgucggcgccuccuccugcaucgaggaguuccagucccaguucaucuucgagcacuccuacuccgucauggacucccccaagaagcucaagcacaagcucgaccacgucaucggcgagcucgaggacaccaaggagucccuccgcaacguccucgaccgcgagaagcgcuuccagaagucccuccgcaagaccauccgcgagcucaaggacgagugccucaucucccaggagaccgccaaccgccucgacaccuucugcugggacugcugccaggaguccaucgagcaggacuacaucuccuga

SEQ ID NO: 50698 - RNA, 1728 nt, Artificial Sequence
  derived and/or modified sequence opt2 from THBD__Homo_sapiens__NP_000352
augcucggcguccucguccucggcgcccucgcccucgccggccucggcuuccccgcccccgccgagccccagcccggcggcucccagugcgucgagcacgacugcuucgcccucuaccccggccccgccaccuuccucaacgccucccagaucugcgacggccuccgcggccaccucaugaccguccgcuccuccgucgccgccgacgucaucucccuccuccucaacggcgacggcggcgucggccgccgccgccucuggaucggccuccagcucccccccggcugcggcgaccccaagcgccucggcccccuccgcggcuuccagugggucaccggcgacaacaacaccuccuacucccgcugggcccgccucgaccucaacggcgccccccucugcggcccccucugcgucgccgucuccgccgccgaggccaccguccccuccgagcccaucugggaggagcagcagugcgaggucaaggccgacggcuuccucugcgaguuccacuuccccgccaccugccgcccccucgccgucgagcccggcgccgccgccgccgccgucuccaucaccuacggcacccccuucgccgcccgcggcgccgacuuccaggcccuccccgucggcuccuccgccgccgucgccccccucggccuccagcucaugugcaccgccccccccggcgccguccagggccacugggcccgcgaggcccccggcgccugggacugcuccgucgagaacggcggcugcgagcacgccugcaacgccauccccggcgccccccgcugccagugccccgccggcgccgcccuccaggccgacggccgcuccugcaccgccuccgccacccaguccugcaacgaccucugcgagcacuucugcguccccaaccccgaccagcccggcuccuacuccugcaugugcgagaccggcuaccgccucgccgccgaccagcaccgcugcgaggacgucgacgacugcauccucgagcccucccccugcccccagcgcugcgucaacacccagggcggcuucgagugccacugcuaccccaacuacgaccucgucgacggcgagugcgucgagcccgucgaccccugcuuccgcgccaacugcgaguaccagugccagccccucaaccagaccuccuaccucugcgucugcgccgagggcuucgcccccaucccccacgagccccaccgcugccagauguucugcaaccagaccgccugccccgccgacugcgaccccaacacccaggccuccugcgagugccccgagggcuacauccucgacgacggcuucaucugcaccgacaucgacgagugcgagaacggcggcuucugcuccggcgucugccacaaccuccccggcaccuucgagugcaucugcggccccgacuccgcccucgcccgccacaucggcaccgacugcgacuccggcaaggucgacggcggcgacuccggcuccggcgagcccccccccucccccacccccggcuccacccucaccccccccgccgucggccucguccacuccggccuccucaucggcaucuccaucgccucccucugccucgucgucgcccuccucgcccuccucugccaccuccgcaagaagcagggcgccgcccgcgccaagauggaguacaagugcgccgcccccuccaaggaggucguccuccagcacguccgcaccgagcgcaccccccagcgccucuga

SEQ ID NO: 50699 - RNA, 3513 nt, Artificial Sequence
  derived and/or modified sequence opt2 from THBS1__Homo_sapiens__NP_003237
augggccucgccuggggccucggcguccucuuccucaugcacgucugcggcaccaaccgcauccccgaguccggcggcgacaacuccgucuucgacaucuucgagcucaccggcgccgcccgcaagggcuccggccgccgccucgucaagggccccgaccccuccucccccgccuuccgcaucgaggacgccaaccucaucccccccguccccgacgacaaguuccaggaccucgucgacgccguccgcgccgagaagggcuuccuccuccucgccucccuccgccagaugaagaagacccgcggcacccuccucgcccucgagcgcaaggaccacuccggccaggucuucuccgucgucuccaacggcaaggccggcacccucgaccucucccucaccguccagggcaagcagcacgucgucuccgucgaggaggcccuccucgccaccggccaguggaaguccaucacccucuucguccaggaggaccgcgcccagcucuacaucgacugcgagaagauggagaacgccgagcucgacguccccauccaguccgucuucacccgcgaccucgccuccaucgcccgccuccgcaucgccaagggcggcgucaacgacaacuuccagggcguccuccagaacguccgcuucgucuucggcaccacccccgaggacauccuccgcaacaagggcugcuccuccuccaccuccguccuccucacccucgacaacaacgucgucaacggcuccucccccgccauccgcaccaacuacaucggccacaagaccaaggaccuccaggccaucugcggcaucuccugcgacgagcucuccuccaugguccucgagcuccgcggccuccgcaccaucgucaccacccuccaggacuccauccgcaaggucaccgaggagaacaaggagcucgccaacgagcuccgccgccccccccucugcuaccacaacggcguccaguaccgcaacaacgaggaguggaccgucgacuccugcaccgagugccacugccagaacuccgucaccaucugcaagaaggucuccugccccaucaugcccugcuccaacgccaccguccccgacggcgagugcugcccccgcugcuggcccuccgacuccgccgacgacggcuggucccccugguccgaguggaccuccugcuccaccuccugcggcaacggcauccagcagcgcggccgcuccugcgacucccucaacaaccgcugcgagggcuccuccguccagacccgcaccugccacauccaggagugcgacaagcgcuucaagcaggacggcggcuggucccacuggucccccugguccuccugcuccgucaccugcggcgacggcgucaucacccgcauccgccucugcaacucccccuccccccagaugaacggcaagcccugcgagggcgaggcccgcgagaccaaggccugcaagaaggacgccugccccaucaacggcggcuggggccccuggucccccugggacaucugcuccgucaccugcggcggcggcguccagaagcgcucccgccucugcaacaaccccaccccccaguucggcggcaaggacugcgucggcgacgucaccgagaaccagaucugcaacaagcaggacugccccaucgacggcugccucuccaaccccugcuucgccggcgucaagugcaccuccuaccccgacggcuccuggaagugcggcgccugcccccccggcuacuccggcaacggcauccagugcaccgacgucgacgagugcaaggagguccccgacgccugcuucaaccacaacggcgagcaccgcugcgagaacaccgaccccggcuacaacugccuccccugccccccccgcuucaccggcucccagcccuucggccagggcgucgagcacgccaccgccaacaagcaggucugcaagccccgcaaccccugcaccgacggcacccacgacugcaacaagaacgccaagugcaacuaccucggccacuacuccgaccccauguaccgcugcgagugcaagcccggcuacgccggcaacggcaucaucugcggcgaggacaccgaccucgacggcuggcccaacgagaaccucgucugcgucgccaacgccaccuaccacugcaagaaggacaacugccccaaccuccccaacuccggccaggaggacuacgacaaggacggcaucggcgacgccugcgacgacgacgacgacaacgacaagauccccgacgaccgcgacaacugccccuuccacuacaaccccgcccaguacgacuacgaccgcgacgacgucggcgaccgcugcgacaacugccccuacaaccacaaccccgaccaggccgacaccgacaacaacggcgagggcgacgccugcgccgccgacaucgacggcgacggcauccucaacgagcgcgacaacugccaguacgucuacaacgucgaccagcgcgacaccgacauggacggcgucggcgaccagugcgacaacugcccccucgagcacaaccccgaccagcucgacuccgacuccgaccgcaucggcgacaccugcgacaacaaccaggacaucgacgaggacggccaccagaacaaccucgacaacugccccuacguccccaacgccaaccaggccgaccacgacaaggacggcaagggcgacgccugcgaccacgacgacgacaacgacggcauccccgacgacaaggacaacugccgccucguccccaaccccgaccagaaggacuccgacggcgacggccgcggcgacgccugcaaggacgacuucgaccacgacuccguccccgacaucgacgacaucugccccgagaacgucgacaucuccgagaccgacuuccgccgcuuccagaugaucccccucgaccccaagggcaccucccagaacgaccccaacugggucguccgccaccagggcaaggagcucguccagaccgucaacugcgaccccggccucgccgucggcuacgacgaguucaacgccgucgacuucuccggcaccuucuucaucaacaccgagcgcgacgacgacuacgccggcuucgucuucggcuaccaguccuccucccgcuucuacgucgucauguggaagcaggucacccaguccuacugggacaccaaccccacccgcgcccagggcuacuccggccucuccgucaaggucgucaacuccaccaccggccccggcgagcaccuccgcaacgcccucuggcacaccggcaacacccccggccagguccgcacccucuggcacgacccccgccacaucggcuggaaggacuucaccgccuaccgcuggcgccucucccaccgccccaagaccggcuucauccgcgucgucauguacgagggcaagaagaucauggccgacuccggccccaucuacgacaagaccuacgccggcggccgccucggccucuucgucuucucccaggagauggucuucuucuccgaccucaaguacgagugccgcgaccccuga

SEQ ID NO: 50700 - RNA, 3519 nt, Artificial Sequence
  derived and/or modified sequence opt2 from THBS2__Homo_sapiens__NP_003238
auggucuggcgccucguccuccucgcccucugggucuggcccuccacccaggccggccaccaggacaaggacaccaccuucgaccucuucuccaucuccaacaucaaccgcaagaccaucggcgccaagcaguuccgcggccccgaccccggcguccccgccuaccgcuucguccgcuucgacuacaucccccccgucaacgccgacgaccucuccaagaucaccaagaucaugcgccagaaggagggcuucuuccucaccgcccagcucaagcaggacggcaagucccgcggcacccuccucgcccucgagggccccggccucucccagcgccaguucgagaucgucuccaacggccccgccgacacccucgaccucaccuacuggaucgacggcacccgccacgucgucucccucgaggacgucggccucgccgacucccaguggaagaacgucaccguccaggucgccggcgagaccuacucccuccacgucggcugcgaccucaucgacuccuucgcccucgacgagcccuucuacgagcaccuccaggccgagaagucccgcauguacgucgccaagggcuccgcccgcgagucccacuuccgcggccuccuccagaacguccaccucgucuucgagaacuccgucgaggacauccucuccaagaagggcugccagcagggccagggcgccgagaucaacgccaucuccgagaacaccgagacccuccgccucggcccccacgucaccaccgaguacgucggccccuccuccgagcgccgccccgaggucugcgagcgcuccugcgaggagcucggcaacaugguccaggagcucuccggccuccacguccucgucaaccagcucuccgagaaccucaagcgcgucuccaacgacaaccaguuccucugggagcucaucggcggcccccccaagacccgcaacauguccgccugcuggcaggacggccgcuucuucgccgagaacgagaccugggucgucgacuccugcaccaccugcaccugcaagaaguucaagaccaucugccaccagaucaccugcccccccgccaccugcgccucccccuccuucgucgagggcgagugcugccccuccugccuccacuccgucgacggcgaggagggcuggucccccugggccgaguggacccagugcuccgucaccugcggcuccggcacccagcagcgcggccgcuccugcgacgucaccuccaacaccugccucggccccuccauccagacccgcgccugcucccucuccaagugcgacacccgcauccgccaggacggcggcuggucccacuggucccccugguccuccugcuccgucaccugcggcgucggcaacaucacccgcauccgccucugcaacucccccgucccccagaugggcggcaagaacugcaagggcuccggccgcgagaccaaggccugccagggcgcccccugccccaucgacggccgcuggucccccuggucccccugguccgccugcaccgucaccugcgccggcggcauccgcgagcgcacccgcgucugcaacucccccgagccccaguacggcggcaaggccugcgucggcgacguccaggagcgccagaugugcaacaagcgcuccugccccgucgacggcugccucuccaaccccugcuuccccggcgcccagugcuccuccuuccccgacggcuccugguccugcggcuccugccccgucggcuuccucggcaacggcacccacugcgaggaccucgacgagugcgcccucguccccgacaucugcuucuccaccuccaaggucccccgcugcgucaacacccagcccggcuuccacugccuccccugccccccccgcuaccgcggcaaccagcccgucggcgucggccucgaggccgccaagaccgagaagcaggucugcgagcccgagaaccccugcaaggacaagacccacaacugccacaagcacgccgagugcaucuaccucggccacuucuccgaccccauguacaagugcgagugccagaccggcuacgccggcgacggccucaucugcggcgaggacuccgaccucgacggcuggcccaaccucaaccucgucugcgccaccaacgccaccuaccacugcaucaaggacaacugcccccaccuccccaacuccggccaggaggacuucgacaaggacggcaucggcgacgccugcgacgacgacgacgacaacgacggcgucaccgacgagaaggacaacugccagcuccucuucaacccccgccaggccgacuacgacaaggacgaggucggcgaccgcugcgacaacugccccuacguccacaaccccgcccagaucgacaccgacaacaacggcgagggcgacgccugcuccgucgacaucgacggcgacgacgucuucaacgagcgcgacaacugccccuacgucuacaacaccgaccagcgcgacaccgacggcgacggcgucggcgaccacugcgacaacugcccccucguccacaaccccgaccagaccgacgucgacaacgaccucgucggcgaccagugcgacaacaacgaggacaucgacgacgacggccaccagaacaaccaggacaacugccccuacaucuccaacgccaaccaggccgaccacgaccgcgacggccagggcgacgccugcgaccccgacgacgacaacgacggcguccccgacgaccgcgacaacugccgccucgucuucaaccccgaccaggaggaccucgacggcgacggccgcggcgacaucugcaaggacgacuucgacaacgacaacauccccgacaucgacgacgucugccccgagaacaacgccaucuccgagaccgacuuccgcaacuuccagauggucccccucgaccccaagggcaccacccagaucgaccccaacugggucauccgccaccagggcaaggagcucguccagaccgccaacuccgaccccggcaucgccgucggcuucgacgaguucggcuccgucgacuucuccggcaccuucuacgucaacaccgaccgcgacgacgacuacgccggcuucgucuucggcuaccaguccuccucccgcuucuacgucgucauguggaagcaggucacccagaccuacugggaggaccagcccacccgcgccuacggcuacuccggcgucucccucaaggucgucaacuccaccaccggcaccggcgagcaccuccgcaacgcccucuggcacaccggcaacacccccggccagguccgcacccucuggcacgacccccgcaacaucggcuggaaggacuacaccgccuaccgcuggcaccucacccaccgccccaagaccggcuacauccgcguccucguccacgagggcaagcaggucauggccgacuccggccccaucuacgaccagaccuacgccggcggccgccucggccucuucgucuucucccaggagauggucuacuucuccgaccucaaguacgagugccgcgacaucuga

SEQ ID NO: 50701 - RNA, 2511 nt, Artificial Sequence
  derived and/or modified sequence opt2 from THBS3__Homo_sapiens__NP_001239537
auggagacccaggagcuccgcggcgcccucgcccuccuccuccucugcuucuucaccuccgccucccaggaccuccaggucaucgaccuccucaccgucggcgagucccgccagauggucgccgucgccgagaagauccgcaccgcccuccucaccgccggcgacaucuaccuccucuccaccuuccgccucccccccaagcagggcggcguccucuucggccucuacucccgccaggacaacacccgcuggcucgaggccuccgucgucggcaagaucaacaaggucaccaacgcccuccacuccauccucggcgagcagaccaaggcccucgucacccagcucacccucuucaaccagauccucgucgagcuccgcgacgacauccgcgaccaggucaaggagaugucccucauccgcaacaccaucauggagugccaggucugcggcuuccacgagcagcgcucccacugcucccccaaccccugcuuccgcggcgucgacugcauggaggucuacgaguaccccggcuaccgcugcggccccugcccccccggccuccagggcaacggcacccacugcuccgacaucaacgagugcgcccacgccgaccccugcuuccccggcuccuccugcaucaacaccaugcccggcuuccacugcgaggccugcccccgcggcuacaagggcacccaggucuccggcgucggcaucgacuacgcccgcgccuccaagcaggucugcaacgacaucgacgagugcaacgacggcaacaacggcggcugcgaccccaacuccaucugcaccaacaccgucggcuccuucaagugcggccccugccgccucggcuuccucggcaaccagucccagggcugccuccccgcccgcaccugccacucccccgcccacucccccugccacauccacgcccacugccucuucgagcgcaacggcgccgucuccugccagugcaacgucggcugggccggcaacggcaacgucugcggcaccgacaccgacaucgacggcuaccccgaccaggcccuccccugcauggacaacaacaagcacugcaagcaggacaacugccuccucacccccaacuccggccaggaggacgccgacaacgacggcgucggcgaccagugcgacgacgacgccgacggcgacggcaucaagaacgucgaggacaacugccgccucuuccccaacaaggaccagcagaacuccgacaccgacuccuucggcgacgccugcgacaacugccccaacguccccaacaacgaccagaaggacaccgacggcaacggcgagggcgacgccugcgacaacgacgucgacggcgacggcauccccaacggccucgacaacugccccaagguccccaacccccuccagaccgaccgcgacgaggacggcgucggcgacgccugcgacuccugccccgagauguccaaccccacccagaccgacgccgacuccgaccucgucggcgacgucugcgacaccaacgaggacuccgacggcgacggccaccaggacaccaaggacaacugcccccagcuccccaacuccucccagcucgacuccgacaacgacggccucggcgacgagugcgacggcgacgacgacaacgacggcauccccgacuacgucccccccggccccgacaacugccgccucguccccaaccccaaccagaaggacuccgacggcaacggcgucggcgacgucugcgaggacgacuucgacaacgacgccgucgucgacccccucgacgucugccccgaguccgccgaggucacccucaccgacuuccgcgccuaccagaccgucguccucgaccccgagggcgacgcccagaucgaccccaacugggucguccucaaccagggcauggagaucguccagaccaugaacuccgaccccggccucgccgucggcuacaccgccuucaacggcgucgacuucgagggcaccuuccacgucaacaccgucaccgacgacgacuacgccggcuuccucuucuccuaccaggacuccggccgcuucuacgucgucauguggaagcagaccgagcagaccuacuggcaggccacccccuuccgcgccgucgcccagcccggccuccagcucaaggccgucaccuccgucuccggccccggcgagcaccuccgcaacgcccucuggcacaccggccacacccccgaccagguccgccuccucuggaccgacccccgcaacgucggcuggcgcgacaagaccuccuaccgcuggcagcuccuccaccgcccccaggucggcuacauccgcgucaagcucuacgagggcccccagcucgucgccgacuccggcgucaucaucgacaccuccaugcgcggcggccgccucggcgucuucugcuucucccaggagaacaucaucugguccaaccuccaguaccgcugcaacgacaccguccccgaggacuucgagcccuuccgccgccagcuccuccagggccgcgucuga

SEQ ID NO: 50702 - RNA, 2886 nt, Artificial Sequence
  derived and/or modified sequence opt2 from THBS4__Homo_sapiens__NP_003239
augcucgccccccgcggcgccgccguccuccuccuccaccucguccuccagcgcuggcucgccgccggcgcccaggccaccccccaggucuucgaccuccuccccuccuccucccagcgccucaaccccggcgcccuccuccccguccucaccgaccccgcccucaacgaccucuacgucaucuccaccuucaagcuccagaccaaguccuccgccaccaucuucggccucuacuccuccaccgacaacuccaaguacuucgaguucaccgucaugggccgccucaacaaggccauccuccgcuaccucaagaacgacggcaagguccaccucgucgucuucaacaaccuccagcucgccgacggccgccgccaccgcauccuccuccgccucuccaaccuccagcgcggcgccggcucccucgagcucuaccucgacugcauccaggucgacuccguccacaaccucccccgcgccuucgccggccccucccagaagcccgagaccaucgagcuccgcaccuuccagcgcaagccccaggacuuccucgaggagcucaagcucgucguccgcggcucccucuuccaggucgccucccuccaggacugcuuccuccagcaguccgagccccucgccgccaccggcaccggcgacuucaaccgccaguuccucggccagaugacccagcucaaccagcuccucggcgaggucaaggaccuccuccgccagcaggucaaggagaccuccuuccuccgcaacaccaucgccgagugccaggccugcggcccccucaaguuccagucccccacccccuccaccgucgucccccccgccccccccgccccccccacccgccccccccgccgcugcgacuccaaccccugcuuccgcggcguccagugcaccgacucccgcgacggcuuccagugcggccccugccccgagggcuacaccggcaacggcaucaccugcaucgacgucgacgagugcaaguaccaccccugcuaccccggcguccacugcaucaaccucucccccggcuuccgcugcgacgccugccccgucggcuucaccggccccaugguccagggcgucggcaucuccuucgccaaguccaacaagcaggucugcaccgacaucgacgagugccgcaacggcgccugcguccccaacuccaucugcgucaacacccucggcuccuaccgcugcggccccugcaagcccggcuacaccggcgaccagauccgcggcugcaaggccgagcgcaacugccgcaaccccgagcucaaccccugcuccgucaacgcccagugcaucgaggagcgccagggcgacgucaccugcgucugcggcgucggcugggccggcgacggcuacaucugcggcaaggacgucgacaucgacuccuaccccgacgaggagcuccccugcuccgcccgcaacugcaagaaggacaacugcaaguacguccccaacuccggccaggaggacgccgaccgcgacggcaucggcgacgccugcgacgaggacgccgacggcgacggcauccucaacgagcaggacaacugcguccucauccacaacgucgaccagcgcaacuccgacaaggacaucuucggcgacgccugcgacaacugccucuccguccucaacaacgaccagaaggacaccgacggcgacggccgcggcgacgccugcgacgacgacauggacggcgacggcaucaagaacauccucgacaacugccccaaguuccccaaccgcgaccagcgcgacaaggacggcgacggcgucggcgacgccugcgacuccugccccgacgucuccaaccccaaccaguccgacgucgacaacgaccucgucggcgacuccugcgacaccaaccaggacuccgacggcgacggccaccaggacuccaccgacaacugccccaccgucaucaacuccgcccagcucgacaccgacaaggacggcaucggcgacgagugcgacgacgacgacgacaacgacggcauccccgaccucgucccccccggccccgacaacugccgccucguccccaaccccgcccaggaggacuccaacuccgacggcgucggcgacaucugcgaguccgacuucgaccaggaccaggucaucgaccgcaucgacgucugccccgagaacgccgaggucacccucaccgacuuccgcgccuaccagaccgucguccucgaccccgagggcgacgcccagaucgaccccaacugggucguccucaaccagggcauggagaucguccagaccaugaacuccgaccccggccucgccgucggcuacaccgccuucaacggcgucgacuucgagggcaccuuccacgucaacacccagaccgacgacgacuacgccggcuucaucuucggcuaccaggacuccuccuccuucuacgucgucauguggaagcagaccgagcagaccuacuggcaggccacccccuuccgcgccgucgccgagcccggcauccagcucaaggccgucaaguccaagaccggccccggcgagcaccuccgcaacucccucuggcacaccggcgacaccuccgaccagguccgccuccucuggaaggacucccgcaacgucggcuggaaggacaaggucuccuaccgcugguuccuccagcaccgcccccaggucggcuacauccgcguccgcuucuacgagggcuccgagcucgucgccgacuccggcgucaccaucgacaccaccaugcgcggcggccgccucggcgucuucugcuucucccaggagaacaucaucugguccaaccucaaguaccgcugcaacgacaccauccccgaggacuuccaggaguuccagacccagaacuucgaccgcuucgacaacuga

SEQ ID NO: 50703 - RNA, 1140 nt, Artificial Sequence
  derived and/or modified sequence opt2 from THEG__Homo_sapiens__NP_057669
augggcgacucccgccgccgcucccucggcaaccagcccuccuccgaggccgccggccgcuccgagcgcgagcaggacggcgacccccgcggccuccaguccuccgucuacgagucccgccgcgucaccgaccccgagcgccaggaccucgacaacgccgagcucggccccgaggaccccgaggaggagcucccccccgaggaggucgccggcgaggaguuccccgagacccucgaccccaaggaggcccucuccgagcucgagcgcguccucgacaaggaccucgaggaggacauccccgagaucucccgccucuccaucucccagaagcuccccuccaccaccaugaccaaggcccgcaagcgccgccgccgccgccgccucauggagcucgccgagcccaagaucaacuggcagguccucaaggaccgcaagggccgcugcggcaagggcuacgccuggaucucccccugcaagaugucccuccacuucugccucugcuggcccuccgucuacuggaccgagcgcuuccucgaggacaccacccucaccaucaccguccccgccgucucccgccgcgucgaggagcucucccgccccaagcgcuucuaccucgaguacuacaacaacaaccgcaccacccccgucuggcccaucccccgcuccucccucgaguaccgcgccuccucccgccucaaggagcucgccgcccccaagauccgcgacaacuucugguccaugcccauguccgaggucucccaggucucccgcgccgcccagauggccguccccuccucccgcauccuccagcucuccaagcccaaggcccccgccacccuccucgaggagugggaccccguccccaagcccaagccccacgucuccgaccacaaccgccuccuccaccucgcccgccccaaggcccaguccgacaagugcguccccgaccgcgacccccgcugggagguccucgacgucaccaagaaggucgucgccuccccccgcaucaucucccucgccaagcccaagguccgcaagggccucaacgagggcuacgaccgccgcccccucgccuccaugucccuccccccccccaaggccucccccgagaagugcgaccagccccgccccggccucuga

SEQ ID NO: 50704 - RNA, 723 nt, Artificial Sequence
  derived and/or modified sequence opt2 from THEM4__Homo_sapiens__NP_444283
augcuccgcuccugcgccgcccgccuccgcacccucggcgcccucugccucccccccgucggccgccgccuccccggcuccgagccccgccccgagcuccgcuccuucuccuccgaggaggucauccucaaggacugcuccguccccaaccccuccuggaacaaggaccuccgccuccucuucgaccaguucaugaagaagugcgaggacggcuccuggaagcgccuccccuccuacaagcgcacccccaccgaguggauccaggacuucaagacccacuuccucgaccccaagcucaugaaggaggagcagaugucccaggcccagcucuucacccgcuccuucgacgacggccucggcuucgaguacgucauguucuacaacgacaucgagaagcgcauggucugccucuuccagggcggccccuaccucgagggcccccccggcuucauccacggcggcgccaucgccaccaugaucgacgccaccgucggcaugugcgccaugauggccggcggcaucgucaugaccgccaaccucaacaucaacuacaagcgccccaucccccucugcuccgucgucaugaucaacucccagcucgacaaggucgagggccgcaaguucuucgucuccugcaacguccaguccgucgacgagaagacccucuacuccgaggccaccucccucuucaucaagcucaaccccgccaagucccucaccuga

SEQ ID NO: 50705 - RNA, 744 nt, Artificial Sequence
  derived and/or modified sequence opt2 from THEM5__Homo_sapiens__NP_872384
augauccgccgcugcuuccaggucgccgcccgccucggccaccaccgcggccuccucgaggccccccgcauccucccccgccucaaccccgccuccgccuucggcuccuccaccgacuccauguucucccgcuuccuccccgagaagaccgaccucaaggacuacgcccuccccaacgccuccuggugcuccgacaugcucucccucuaccaggaguuccucgagaagaccaaguccuccggcuggaucaagcuccccuccuucaaguccaaccgcgaccacauccgcggccucaagcuccccuccggccucgccgucuccuccgacaagggcgacugccgcaucuucacccgcugcauccaggucgagggccagggcuucgaguacgucaucuucuuccagcccacccagaagaaguccgucugccucuuccagcccggcuccuaccucgagggcccccccggcuucgcccacggcggcucccucgccgccaugauggacgagaccuucuccaagaccgccuuccucgccggcgagggccucuucacccucucccucaacauccgcuucaagaaccucauccccgucgacucccucgucgucauggacgucgaggucgacaagaucgaggaccagaagcucuacauguccugcaucgcccacucccgcgaccagcagaccgucuacgccaaguccuccggcgucuuccuccagcuccagcucgaggaggaguccccccaguga

SEQ ID NO: 50706 - RNA, 627 nt, Artificial Sequence
  derived and/or modified sequence opt2 from THEM6__Homo_sapiens__NP_057731
augcucggccuccucgucgcccuccucgcccucggccucgccgucuucgcccuccucgacgucugguaccucguccgccuccccugcgccguccuccgcgcccgccuccuccagccccgcguccgcgaccuccucgccgagcagcgcuuccccggccgcguccuccccuccgaccucgaccuccuccuccacaugaacaacgcccgcuaccuccgcgaggccgacuucgcccgcgucgcccaccucacccgcugcggcguccucggcgcccuccgcgagcuccgcgcccacaccguccucgccgccuccugcgcccgccaccgccgcucccuccgccuccucgagcccuucgagguccgcacccgccuccucggcugggacgaccgcgccuucuaccucgaggcccgcuucgucucccuccgcgacggcuucgucugcgcccuccuccgcuuccgccagcaccuccucggcaccucccccgagcgcgucguccagcaccucugccagcgccgcgucgagccccccgagcuccccgccgaccuccagcacuggaucuccuacaacgaggccuccucccagcuccuccgcauggaguccggccucuccgacgucaccaaggaccaguga

SEQ ID NO: 50707 - RNA, 1791 nt, Artificial Sequence
  derived and/or modified sequence opt2 from THEMIS2__Homo_sapiens__XP_011540747
auggagcccgucccccuccaggacuucguccgcgcccucgaccccgccucccucccccgcguccuccgcgucugcuccggcgucuacuucgagggcuacuucaccccccucaacaccccccaguccuacgagacccucgaggagcucgucuccgccaccacccaguccuccaagcagcuccccaccugcuucauguccacccaccgcaucgucaccgagggccgcgucgucaccgaggaccagcuccucaugcucgaggccgucgucaugcaccucggcauccgcuccgcccgcugcguccucggcauggagggccagcaggucauccuccaccucccccucucccagaagggccccuucuggaccugggagcccuccgccccccgcacccuccuccagguccuccaggaccccgcccucaaggaccucguccucaccugccccacccuccccuggcacucccucauccuccgcccccaguacgagauccaggccaucaugcacaugcgccgcaccaucgucaagauccccuccacccucgaggucgacgucgaggacgucaccgccuccucccgccacguccacuucaucaagccccuccuccucuccgagguccucgccugggagggccccuucccccucuccauggagauccucgagguccccgagggccgccccaucuuccucucccccugggucggcucccuccagaagggccagcgccucugcgucuacggccucgccuccccccccuggcgcguccucgccuccuccaagggccgcaaggucccccgccacuuccucgucuccggcggcuaccagggcaagcuccgccgccgcccccgcgaguuccccaccgccuacgaccuccucggcgccuuccagcccggccgcccccuccgcgucgucgccaccaaggacugcgagggcgagcgcgaggagaaccccgaguucaccucccucgccgucggcgaccgccucgagguccucggccccggccaggcccacggcgcccagggcuccgacgucgacguccucgucugccagcgccucuccgaccaggccggcgaggacgaggaggaggagugcaaggaggaggccgagucccccgagcgcguccuccuccccuuccacuuccccggcuccuucgucgaggagauguccgacucccgccgcuacucccucgccgaccucaccgcccaguucucccuccccugcgaggucaaggucgucgccaaggacaccucccaccccaccgacccccucaccuccuuccucggccuccgccucgaggagaagaucaccgagcccuuccucgucgucucccucgacuccgagcccggcaugugcuucgagauccccccccgcuggcucgaccucaccgucgucaaggccaagggccagcccgaccuccccgagggcucccuccccaucgccaccgucgaggagcucaccgacaccuucuacuaccgccuccgcaagcuccccgccugcgagauccaggccccccccccccgcccccccaagaaccagggccucuccaagcagcgccgccacuccuccgagggcggcgucaaguccucccagguccucggccuccagcagcacgcccgccuccccaagcccaaggccaagacccuccccgaguucaucaaggacggcuccuccaccuacuccaagauccccgcccaccgcaagggccaccgccccgccaagccccagcgccaggaccucgacgacgacgagcacgacuacgaggagauccucgagcaguuccagaagaccaucuga

SEQ ID NO: 50708 - RNA, 1926 nt, Artificial Sequence
  derived and/or modified sequence opt2 from THEMIS__Homo_sapiens__NP_001010923
auggcccucucccucgaggaguucguccacucccucgaccuccgcacccucccccgcguccucgagauccaggccggcaucuaccucgagggcuccaucuacgagauguucggcaacgagugcugcuucuccaccggcgaggucaucaagaucaccggccucaaggucaagaagaucaucgccgagaucugcgagcagaucgagggcugcgagucccuccagcccuucgagcuccccaugaacuuccccggccucuucaagaucgucgccgacaagacccccuaccucaccauggaggagaucacccgcaccauccacaucggccccucccgccucggccaccccugcuucuaccaccagaaggacaucaagcucgagaaccucaucaucaagcagggcgagcagaucaugcucaacuccgucgaggagaucgacggcgagaucauggucuccugcgccgucgcccgcaaccaccagacccacuccuucaaccucccccucucccaggagggcgaguucuacgagugcgaggacgagcgcaucuacacccucaaggagaucgucgaguggaagauccccaagaaccgcacccgcaccgucaaccucaccgacuucuccaacaagugggacuccaccaaccccuuccccaaggacuucuacggcacccucauccucaagcccgucuacgagauccagggcgucaugaaguuccgcaaggacaucauccgcauccuccccucccucgacgucgaggucaaggacaucaccgacuccuacgacgccaacugguuccuccagcuccucuccaccgaggaccucuucgagaugaccuccaaggaguuccccaucgucaccgaggucaucgaggcccccgagggcaaccaccucccccaguccauccuccagcccggcaagaccaucgucauccacaagaaguaccaggccucccgcauccucgccuccgagauccgcuccaacuuccccaagcgccacuuccucauccccaccuccuacaagggcaaguucaagcgccgcccccgcgaguuccccaccgccuacgaccucgagaucgccaaguccgagaaggagccccuccacgucgucgccaccaaggccuuccacuccccccacgacaagcucuccuccgucuccgucggcgaccaguuccucguccaccaguccgagaccaccgagguccucugcgagggcaucaagaaggucgucaacguccucgccugcgagaagauccucaagaaguccuacgaggccgcccuccucccccucuacauggagggcggcuucgucgaggucauccacgacaagaagcaguaccccaucuccgagcucugcaagcaguuccgccuccccuucaacgucaaggucuccguccgcgaccucuccaucgaggaggacguccucgccgccacccccggccuccagcucgaggaggacaucaccgacuccuaccuccucaucuccgacuucgccaaccccaccgagugcugggagauccccgucggccgccucaacaugaccguccagcucgucuccaacuucucccgcgacgccgagcccuuccucguccgcacccucgucgaggagaucaccgaggagcaguacuacaugaugcgccgcuacgaguccuccgccucccacccccccccccgcccccccaagcaccccuccgucgaggagaccaagcucacccuccucacccucgccgaggagcgcaccgucgaccuccccaagucccccaagcgccaccacgucgacaucaccaagaagcuccaccccaaccaggccggccucgacuccaagguccucaucggcucccagaacgaccucgucgacgaggagaaggagcgcuccaaccgcggcgccaccgccaucgccgagaccuucaagaacgagaagcaccagaaguga

SEQ ID NO: 50709 - RNA, 897 nt, Artificial Sequence
  derived and/or modified sequence opt2 from THG1L__Homo_sapiens__NP_060342
auguggggcgccugcaaggucaagguccacgacucccucgccaccaucuccaucacccuccgccgcuaccuccgccucggcgccaccauggccaaguccaaguucgaguacguccgcgacuucgaggccgacgacaccugccucgcccacugcugggucgucguccgccucgacggccgcaacuuccaccgcuucgccgagaagcacaacuucgccaagcccaacgacucccgcgcccuccagcucaugaccaagugcgcccagaccgucauggaggagcucgaggacaucgucaucgccuacggccaguccgacgaguacuccuucgucuucaagcgcaagaccaacugguucaagcgccgcgccuccaaguucaugacccacgucgccucccaguucgccuccuccuacgucuucuacuggcgcgacuacuucgaggaccagccccuccucuacccccccggcuucgacggccgcgucgucgucuaccccuccaaccagacccucaaggacuaccucuccuggcgccaggccgacugccacaucaacaaccucuacaacaccgucuucugggcccucauccagcaguccggccucacccccguccaggcccagggccgccuccagggcacccucgccgccgacaagaacgagauccucuucuccgaguucaacaucaacuacaacaacgagcuccccauguaccgcaagggcaccguccucaucuggcagaaggucgacgaggucaugaccaaggagaucaagcuccccaccgagauggagggcaagaagauggccgucacccgcacccgcaccaagcccgucccccuccacugcgacaucaucggcgacgccuucuggaaggagcaccccgagauccucgacgaggacuccuga

SEQ ID NO: 50710 - RNA, 1494 nt, Artificial Sequence
  derived and/or modified sequence opt2 from TH__Homo_sapiens__NP_000351
augcccacccccgacgccaccaccccccaggccaagggcuuccgccgcgccgucuccgagcucgacgccaagcaggccgaggccaucauguccccccgcuucaucggccgccgccagucccucaucgaggacgcccgcaaggagcgcgaggccgccgucgccgccgccgccgccgccguccccuccgagcccggcgacccccucgaggccgucgccuucgaggagaaggagggcaaggccguccucaaccuccucuucuccccccgcgccaccaagcccuccgcccucucccgcgccgucaaggucuucgagaccuucgaggccaagauccaccaccucgagacccgccccgcccagcgcccccgcgccggcggcccccaccucgaguacuucguccgccucgagguccgccgcggcgaccucgccgcccuccucuccggcguccgccaggucuccgaggacguccgcucccccgccggccccaagguccccugguucccccgcaaggucuccgagcucgacaagugccaccaccucgucaccaaguucgaccccgaccucgaccucgaccaccccggcuucuccgaccaggucuaccgccagcgccgcaagcucaucgccgagaucgccuuccaguaccgccacggcgaccccaucccccgcgucgaguacaccgccgaggagaucgccaccuggaaggaggucuacaccacccucaagggccucuacgccacccacgccugcggcgagcaccucgaggccuucgcccuccucgagcgcuucuccggcuaccgcgaggacaacaucccccagcucgaggacgucucccgcuuccucaaggagcgcaccggcuuccagcuccgccccgucgccggccuccucuccgcccgcgacuuccucgccucccucgccuuccgcgucuuccagugcacccaguacauccgccacgccuccucccccaugcacucccccgagcccgacugcugccacgagcuccucggccacguccccaugcucgccgaccgcaccuucgcccaguucucccaggacaucggccucgccucccucggcgccuccgacgaggagaucgagaagcucuccacccucuacugguucaccgucgaguucggccucugcaagcagaacggcgaggucaaggccuacggcgccggccuccucuccuccuacggcgagcuccuccacugccucuccgaggagcccgagauccgcgccuucgaccccgaggccgccgccguccagcccuaccaggaccagaccuaccaguccgucuacuucgucuccgaguccuucuccgacgccaaggacaagcuccgcuccuacgccucccgcauccagcgccccuucuccgucaaguucgaccccuacacccucgccaucgacguccucgacuccccccaggccguccgccgcucccucgagggcguccaggacgagcucgacacccucgcccacgcccucuccgccaucggcuga

SEQ ID NO: 50711 - RNA, 2232 nt, Artificial Sequence
  derived and/or modified sequence opt2 from THNSL1__Homo_sapiens__NP_079114
augcuccacuucaaccgcugccaccaccucaagaagaucacccagaagugcuucuccuccauccacgucaagaccgacaagcacgcccagcgcuuccucucccgcaccuucgcccucgccgagcuccgcaaguccugguacuccacccacucccucgucggcgacaagaacaucauccucaugggcccccccggcgccggcaagaccaccgucggccgcaucaucggccagaagcucggcugcugcgucaucgacgucgacgacgacauccucgagaagaccuggaacauguccgucuccgagaagcuccaggacgucggcaacgagcaguuccucgaggaggagggcaaggccguccucaacuucuccgccuccggcuccgucaucucccucaccggcuccaaccccaugcacgacgccuccauguggcaccucaagaagaacggcaucaucgucuaccucgacgucccccuccucgaccucaucugccgccucaagcucaugaagaccgaccgcaucgucggccagaacuccggcaccuccaugaaggaccuccucaaguuccgccgccaguacuacaagaagugguacgacgcccgcgucuucugcgaguccggcgccucccccgaggaggucgccgacaagguccucaacgccaucaagcgcuaccaggacgucgacuccgagaccuucaucuccacccgccacgucuggcccgaggacugcgagcagaaggucuccgccaaguucuucuccgaggccgucaucgagggccucgccuccgacggcggccucuucguccccgccaaggaguuccccaagcucuccugcggcgaguggaagucccucgucggcgccaccuacgucgagcgcgcccagauccuccucgagcgcugcauccaccccgccgacauccccgccgcccgccucggcgagaugaucgagaccgccuacggcgagaacuucgccugcuccaagaucgcccccguccgccaccucuccggcaaccaguucauccucgagcucuuccacggccccaccggcuccuucaaggaccucucccuccagcucaugccccacaucuucgcccacugcaucccccccuccugcaacuacaugauccucgucgccaccuccggcgacaccggcuccgccguccucaacggcuucucccgccucaacaagaacgacaagcagcgcaucgccgucgucgccuucuuccccgagaacggcgucuccgacuuccagaaggcccagaucaucggcucccagcgcgagaacggcugggccgucggcgucgaguccgacuucgacuucugccagaccgccaucaagcgcaucuucaacgacuccgacuucaccggcuuccucaccgucgaguacggcaccauccucuccuccgccaacuccaucaacuggggccgccuccucccccaggucgucuaccacgccuccgccuaccucgaccucgucucccagggcuucaucuccuucggcucccccgucgacgucugcauccccaccggcaacuucggcaacauccucgccgccgucuacgccaagaugaugggcauccccauccgcaaguucaucugcgccuccaaccagaaccacguccucaccgacuucaucaagaccggccacuacgaccuccgcgagcgcaagcucgcccagaccuucucccccuccaucgacauccucaaguccuccaaccucgagcgccaccuccaccucauggccaacaaggacggccagcucaugaccgagcucuucaaccgccucgagucccagcaccacuuccagaucgagaaggcccucgucgagaagcuccagcaggacuucgucgccgacuggugcuccgagggcgagugccucgccgccaucaacuccaccuacaacaccuccggcuacauccucgacccccacaccgccgucgccaaggucgucgccgaccgcguccaggacaagaccugccccgucaucaucuccuccaccgcccacuacuccaaguucgcccccgccaucaugcaggcccucaagaucaaggagaucaacgagaccuccuccucccagcucuaccuccucggcuccuacaacgcccuccccccccuccacgaggcccuccucgagcgcaccaagcagcaggagaagauggaguaccaggucugcgccgccgacaugaacguccucaagucccacgucgagcagcucguccagaaccaguucaucuga

SEQ ID NO: 50712 - RNA, 1218 nt, Artificial Sequence
  derived and/or modified sequence opt2 from THNSL2__Homo_sapiens__NP_001231605
augugguacgucuccacccgcggcgucgccccccgcgucaacuucgagggcgcccucuucuccggcuacgcccccgacggcggccucuucaugcccgaggagcucccccagcucgaccgcggcacccucugccagugguccacccucuccuaccccggccucgucaaggagcucugcgcccucuucaucggcuccgagcuccuccccaaggacgagcucaacgaccucaucgaccgcgccuucucccgcuuccgccaccgcgaggucguccaccucucccgccuccgcaacggccucaacguccucgagcucuggcacggcgucaccuacgccuucaaggaccucucccucuccugcaccacccaguuccuccaguacuuccucgagaagcgcgagaagcacgucaccgucgucgucggcaccuccggcgacaccggcuccgccgccaucgaguccguccagggcgccaagaacauggacaucaucguccuccuccccaagggccacugcaccaagauccaggagcuccagaugaccaccguccucaagcagaacguccacgucuucggcgucgagggcaacuccgacgagcucgacgagcccaucaagaccgucuucgccgacgucgccuucgucaagaagcacaaccucaugucccucaacuccaucaacuggucccgcguccucguccagauggcccaccacuucuucgccuacuuccagugcacccccucccucgacacccacccccucccccucgucgaggucgucguccccaccggcgccgccggcaaccucgccgccggcuacaucgcccagaagaucggccuccccauccgccucgucgucgccgucaaccgcaacgacaucauccaccgcaccguccagcagggcgacuucucccucuccgaggccgucaaguccacccucgccuccgccauggacauccagguccccuacaacauggagcgcgucuucuggcuccucuccggcuccgacucccaggucacccgcgcccucauggagcaguucgagcgcacccaguccgucaaccuccccaaggagcuccacuccaagugggagcgccaggacuacgagaagauggccgucauggagugcgacggcugcugcgucgagcucugccucggcaacugcggcccccgccgcggcuccgucaccgacauccccggcaccgccaugguccgcggcggcggcuga

SEQ ID NO: 50713 - RNA, 1974 nt, Artificial Sequence
  derived and/or modified sequence opt2 from THOC1__Homo_sapiens__NP_005122
augucccccacccccccccucuucucccuccccgaggcccgcacccgcuucaccaaguccacccgcgaggcccucaacaacaagaacaucaagccccuccucuccaccuucucccagguccccggcuccgagaacgagaagaagugcacccucgaccaggccuuccgcggcauccucgaggaggagaucaucaaccacuccuccugcgagaacguccucgccaucaucucccucgccaucggcggcgucaccgagggcaucugcaccgccuccacccccuucguccuccucggcgacguccucgacugccucccccucgaccagugcgacaccaucuucaccuucgucgagaagaacgucgccaccuggaaguccaacaccuucuacuccgccggcaagaacuaccuccuccgcaugugcaacgaccuccuccgccgccucuccaagucccagaacaccgucuucugcggccgcauccagcucuuccucgcccgccucuucccccucuccgagaaguccggccucaaccuccagucccaguucaaccucgagaacgucaccgucuucaacaccaacgagcaggaguccacccucggccagaagcacaccgaggaccgcgaggagggcauggacgucgaggagggcgagaugggcgacgaggaggcccccaccaccugcuccauccccaucgacuacaaccucuaccgcaaguucuggucccuccaggacuacuuccgcaaccccguccagugcuacgagaagaucuccuggaagaccuuccucaaguacuccgaggagguccucgccgucuucaaguccuacaagcucgacgacacccaggccucccgcaagaagauggaggagcucaagaccggcggcgagcacgucuacuucgccaaguuccucaccuccgagaagcucauggaccuccagcucuccgacuccaacuuccgccgccacauccuccuccaguaccucauccucuuccaguaccucaagggccaggucaaguucaaguccuccaacuacguccucaccgacgagcagucccucuggaucgaggacaccaccaaguccgucuaccagcuccucuccgagaacccccccgacggcgagcgcuucuccaagauggucgagcacauccucaacaccgaggagaacuggaacuccuggaagaacgagggcugccccuccuucgucaaggagcgcaccuccgacaccaagcccacccgcaucauccgcaagcgcaccgcccccgaggacuuccucggcaagggccccaccaagaagauccucaugggcaacgaggagcucacccgccucuggaaccucugccccgacaacauggaggccugcaaguccgagacccgcgagcacaugcccacccucgaggaguucuucgaggaggccaucgagcaggccgaccccgagaacauggucgagaacgaguacaaggccgucaacaacuccaacuacggcuggcgcgcccuccgccuccucgcccgccgcuccccccacuucuuccagcccaccaaccagcaguucaagucccuccccgaguaccucgagaacauggucaucaagcucgccaaggagcuccccccccccuccgaggagaucaagaccggcgaggacgaggacgaggaggacaacgacgcccuccucaaggagaacgagucccccgacguccgccgcgacaagcccgucaccggcgagcagaucgaggucuucgccaacaagcucggcgagcaguggaagauccucgcccccuaccucgagaugaaggacuccgagauccgccagaucgagugcgacuccgaggacaugaagaugcgcgccaagcagcuccucgucgccuggcaggaccaggagggcguccacgccacccccgagaaccucaucaacgcccucaacaaguccggccucuccgaccucgccgagucccucaccaacgacaacgagaccaacuccuga

SEQ ID NO: 50714 - RNA, 4782 nt, Artificial Sequence
  derived and/or modified sequence opt2 from THOC2__Homo_sapiens__NP_001075019
auggccgccgccgccgucgucguccccgccgaguggaucaagaacugggagaaguccggccgcggcgaguuccuccaccucugccgcauccucuccgagaacaagucccacgacuccuccaccuaccgcgacuuccagcaggcccucuacgagcucuccuaccacgucaucaagggcaaccucaagcacgagcaggccuccaacguccucuccgacaucuccgaguuccgcgaggacaugcccuccauccucgccgacgucuucugcauccucgacaucgagaccaacugccucgaggagaaguccaagcgcgacuacuucacccagcucguccucgccugccucuaccucgucuccgacaccguccucaaggagcgccucgaccccgagacccucgagucccucggccucaucaagcagucccagcaguucaaccagaaguccgucaagaucaagaccaagcucuucuacaagcagcagaaguucaaccuccuccgcgaggagaacgagggcuacgccaagcucaucgccgagcucggccaggaccucuccggcuccaucaccuccgaccucauccucgagaacaucaagucccucaucggcugcuucaaccucgaccccaaccgcguccucgacgucauccucgaggucuucgagugccgccccgagcacgacgacuucuucaucucccuccucgaguccuacauguccaugugcgagccccagacccucugccacauccucggcuucaaguucaaguucuaccaggagcccaacggcgagacccccuccucccucuaccgcgucgccgccguccuccuccaguucaaccucaucgaccucgacgaccucuacguccaccuccuccccgccgacaacugcaucauggacgagcacaagcgcgagaucgccgaggccaagcagaucguccgcaagcucaccauggucguccucuccuccgagaagauggacgagcgcgagaaggagaaggagaaggaggaggagaaggucgagaagccccccgacaaccagaagcucggccuccucgaggcccuccucaagaucggcgacuggcagcacgcccagaacaucauggaccagaugccccccuacuacgccgccucccacaagcucaucgcccucgccaucugcaagcucauccacaucaccaucgagccccucuaccgccgcgucggcguccccaagggcgccaagggcucccccgucaacgcccuccagaacaagcgcgcccccaagcaggccgaguccuucgaggaccuccgccgcgacgucuucaacauguucugcuaccucggcccccaccucucccacgaccccauccucuucgccaaggucguccgcaucggcaaguccuucaugaaggaguuccaguccgacggcuccaagcaggaggacaaggagaagaccgaggucauccucuccugccuccucuccaucaccgaccagguccuccuccccucccucucccucauggacugcaacgccugcauguccgaggagcucuggggcauguucaagaccuuccccuaccagcaccgcuaccgccucuacggccaguggaagaacgagaccuacaacucccacccccuccucgucaaggucaaggcccagaccaucgaccgcgccaaguacaucaugaagcgccucaccaaggagaacgucaagcccuccggccgccagaucggcaagcucucccacuccaaccccaccauccucuucgacuacauccucucccagauccagaaguacgacaaccucaucacccccgucgucgacucccucaaguaccucaccucccucaacuacgacguccucgccuacugcaucaucgaggcccucgccaaccccgagaaggagcgcaugaagcacgacgacaccaccaucuccuccuggcuccagucccucgccuccuucugcggcgccgucuuccgcaaguaccccaucgaccucgccggccuccuccaguacgucgccaaccagcucaaggccggcaaguccuucgaccuccucauccucaaggaggucguccagaagauggccggcaucgagaucaccgaggagaugaccauggagcagcucgaggccaugaccggcggcgagcagcucaaggccgagggcggcuacuucggccagauccgcaacaccaagaaguccucccagcgccucaaggacgcccuccucgaccacgaccucgcccucccccucugccuccucauggcccagcagcgcaacggcgucaucuuccaggagggcggcgagaagcaccucaagcucgucggcaagcucuacgaccagugccacgacacccucguccaguucggcggcuuccucgccuccaaccucuccaccgaggacuacaucaagcgcguccccuccaucgacguccucugcaacgaguuccacaccccccacgacgccgccuucuuccucucccgccccauguacgcccaccacaucuccuccaaguacgacgagcucaagaaguccgagaagggcuccaagcagcagcacaagguccacaaguacaucaccuccugcgagauggucauggcccccguccacgaggccgucgucucccuccacgucuccaaggucugggacgacaucuccccccaguucuacgccaccuucuggucccucaccauguacgaccucgccgucccccacaccuccuacgagcgcgaggucaacaagcucaagguccagaugaaggccaucgacgacaaccaggagaugccccccaacaagaagaagaaggagaaggagcgcugcaccgcccuccaggacaagcuccucgaggaggagaagaagcagauggagcacguccagcgcguccuccagcgccucaagcucgagaaggacaacuggcuccucgccaaguccaccaagaacgagaccaucaccaaguuccuccagcucugcaucuucccccgcugcaucuucuccgccaucgacgccgucuacugcgcccgcuucgucgagcucguccaccagcagaagacccccaacuucuccacccuccucugcuacgaccgcgucuucuccgacaucaucuacaccgucgccuccugcaccgagaacgaggccucccgcuacggccgcuuccucugcugcaugcucgagaccgucacccgcuggcacuccgaccgcgccaccuacgagaaggagugcggcaacuaccccggcuuccucaccauccuccgcgccaccggcuucgacggcggcaacaaggccgaccagcucgacuacgagaacuuccgccacgucguccacaaguggcacuacaagcucaccaaggccuccguccacugccucgagaccggcgaguacacccacauccgcaacauccucaucguccucaccaagauccuccccugguaccccaagguccucaaccucggccaggcccucgagcgccgcguccacaagaucugccaggaggagaaggagaagcgccccgaccucuacgcccucgccaugggcuacuccggccagcucaagucccgcaaguccuacaugauccccgagaacgaguuccaccacaaggacccccccccccgcaacgccgucgccuccguccagaacggccccggcggcggccccuccuccuccuccaucggcuccgccuccaaguccgacgaguccuccaccgaggagaccgacaagucccgcgagcgcucccagugcggcgucaaggccgucaacaaggccuccuccaccacccccaagggcaacuccuccaacggcaacuccggcuccaacuccaacaaggccgucaaggagaacgacaaggagaagggcaaggagaaggagaaggagaagaaggagaagacccccgccaccacccccgaggcccgcguccucggcaaggacggcaaggagaagcccaaggaggagcgccccaacaaggacgagaaggcccgcgagaccaaggagcgcacccccaaguccgacaaggagaaggagaaguucaagaaggaggagaaggccaaggacgagaaguucaagaccaccguccccaacgccgaguccaaguccacccaggagcgcgagcgcgagaaggagcccucccgcgagcgcgacaucgccaaggagaugaaguccaaggagaacgucaagggcggcgagaagacccccgucuccggcucccucaagucccccgucccccgcuccgacauccccgagcccgagcgcgagcagaagcgccgcaagaucgacacccaccccucccccucccacuccuccaccgucaaggacucccucaucgagcucaaggaguccuccgccaagcucuacaucaaccacaccccccccccccucuccaaguccaaggagcgcgagauggacaagaaggaccucgacaagucccgcgagcgcucccgcgagcgcgagaagaaggacgagaaggaccgcaaggagcgcaagcgcgaccacuccaacaacgaccgcgaggucccccccgaccucaccaagcgccgcaaggaggagaacggcaccaugggcgucuccaagcacaaguccgagucccccugcgagucccccuaccccaacgagaaggacaaggagaagaacaaguccaaguccuccggcaaggagaagggcuccgacuccuucaaguccgagaagauggacaagaucuccuccggcggcaagaaggagucccgccacgacaaggagaagaucgagaagaaggagaagcgcgacuccuccggcggcaaggaggagaagaagcaccacaaguccuccgacaagcaccgcuga

SEQ ID NO: 50715 - RNA, 2052 nt, Artificial Sequence
  derived and/or modified sequence opt2 from THOC5__Homo_sapiens__NP_001002878
auguccuccgaguccuccaagaagcgcaagcccaaggucauccgcuccgacggcgcccccgccgagggcaagcgcaaccgcuccgacaccgagcaggagggcaaguacuacuccgaggaggccgaggucgaccuccgcgaccccggccgcgacuacgagcucuacaaguacaccugccaggagcuccagcgccucauggccgagauccaggaccucaagucccgcggcggcaaggacgucgccaucgagaucgaggagcgccgcauccaguccugcguccacuucaugacccucaagaagcucaaccgccucgcccacauccgccucaagaagggccgcgaccagacccacgaggccaagcagaaggucgacgccuaccaccuccagcuccagaaccuccucuacgaggucaugcaccuccagaaggagaucaccaagugccucgaguucaaguccaagcacgaggagaucgaccucgucucccucgaggaguucuacaaggaggccccccccgacaucuccaaggccgaggucaccaugggcgacccccaccagcagacccucgcccgccucgacugggagcucgagcagcgcaagcgccucgccgagaaguaccgcgagugccucuccaacaaggagaagauccucaaggagaucgaggucaagaaggaguaccucuccucccuccagccccgccucaacuccaucaugcaggccucccuccccguccaggaguaccucuucaugcccuucgaccaggcccacaagcaguacgagaccgcccgccaccucccccccccccucuacguccucuucguccaggccaccgccuacggccaggccugcgacaagacccucuccgucgccaucgagggcuccgucgacgaggccaaggcccucuucaagccccccgaggacucccaggacgacgaguccgacuccgacgccgaggaggagcagaccaccaagcgccgccgccccacccucggcguccagcucgacgacaagcgcaaggagaugcucaagcgccacccccucuccgucaugcucgaccucaagugcaaggacgacuccguccuccaccucaccuucuacuaccucaugaaccucaacaucaugaccgucaaggccaaggucaccaccgccauggagcucaucacccccaucuccgccggcgaccuccucucccccgacuccguccucuccugccucuaccccggcgaccacggcaagaagacccccaaccccgccaaccaguaccaguucgacaaggucggcauccucacccucuccgacuacguccucgagcucggccaccccuaccucuggguccagaagcucggcggccuccacuuccccaaggagcagccccagcagaccgucaucgccgaccacucccucuccgccucccacauggagaccaccaugaagcuccucaagacccgcguccagucccgccucgcccuccacaagcaguucgccucccucgagcacggcaucguccccgucaccuccgacugccaguaccucuuccccgccaaggucgucucccgccucgucaagugggucaccgucgcccacgaggacuacauggagcuccacuucaccaaggacaucgucgacgccggccucgccggcgacaccaaccucuacuacauggcccucaucgagcgcggcaccgccaagcuccaggccgccgucguccucaaccccggcuacuccuccaucccccccgucuuccagcucugccucaacuggaagggcgagaagaccaacuccaacgacgacaacauccgcgccauggagggcgaggucaacgucugcuacaaggagcucugcggccccuggcccucccaccagcuccucaccaaccagcuccagcgccucugcguccuccucgacgucuaccucgagaccgagucccacgacgacuccgucgagggccccaaggaguucccccaggagaagaugugccuccgccucuuccgcggccccucccgcaugaagcccuucaaguacaaccacccccagggcuucuucucccaccgcuga

SEQ ID NO: 50716 - RNA, 891 nt, Artificial Sequence
  derived and/or modified sequence opt2 from THOC6__Homo_sapiens__NP_001135822
auggagcgcgccgucccccucgccgucccccucggccagaccgaggucuuccaggcccuccagcgccuccacaugaccaucuucucccaguccgucucccccugcggcaaguuccucgccgccggcaacaacuacggccagaucgccaucuucucccucuccuccgcccucuccuccgaggccaaggaggaguccaagaagcccgucgucaccuuccaggcccacgacggccccgucuacuccauggucuccaccgaccgccaccuccucuccgccggcgacggcgaggucaaggccuggcucugggccgagaugcucaagaagggcugcaaggagcucuggcgccgccagccccccuaccgcaccucccucgagguccccgagaucaacgcccuccuccucguccccaaggagaacucccucauccucgccggcggcgacugccagcuccacaccauggaccucgagaccggcaccuucacccgcguccuccgcggccacaccgacuacauccacugccucgcccuccgcgagcgcucccccgagguccucuccggcggcgaggacggcgccguccgccucugggaccuccgcaccgccaaggagguccagaccaucgaggucuacaagcacgaggagugcucccgcccccacaacggccgcuggaucggcugccucgccaccgacuccgacuggauggucugcggcggcggccccgcccucacccucuggcaccuccgcuccuccacccccaccaccaucuuccccauccgcgccccccagaagcacgucaccuucuaccaggaccucguccucaccgccgccggcaacuccugccgcgucgacgucuucaccaaccucggcuaccgcgccuucucccucuccuucuga

SEQ ID NO: 50717 - RNA, 1134 nt, Artificial Sequence
  derived and/or modified sequence opt2 from T__Homo_sapiens__NP_001257413
auguccucccccggcaccgaguccgccggcaagucccuccaguaccgcgucgaccaccuccucuccgccgucgagaacgagcuccaggccggcuccgagaagggcgaccccaccgagcgcgagcuccgcgucggccucgaggaguccgagcucuggcuccgcuucaaggagcucaccaacgagaugaucgucaccaagaacggccgccgcauguuccccguccucaaggucaacgucuccggccucgaccccaacgccauguacuccuuccuccucgacuucgucgccgccgacaaccaccgcuggaaguacgucaacggcgaguggguccccggcggcaagcccgagccccaggcccccuccugcgucuacauccaccccgacucccccaacuucggcgcccacuggaugaaggcccccgucuccuucuccaaggucaagcucaccaacaagcucaacggcggcggccagaucaugcucaacucccuccacaaguacgagccccgcauccacaucguccgcgucggcggcccccagcgcaugaucaccucccacugcuuccccgagacccaguucaucgccgucaccgccuaccagaacgaggagaucaccgcccucaagaucaaguacaaccccuucgccaaggccuuccucgacgccaaggagcgcuccgaccacaaggagaugauggaggagcccggcgacucccagcagcccggcuacucccaguccuacuccgacaacucccccgccugccucuccaugcuccagucccacgacaacugguccucccucggcaugcccgcccaccccuccaugcuccccgucucccacaacgccuccccccccaccuccuccucccaguaccccucccucugguccgucuccaacggcgccgucacccccggcucccaggccgccgccgucuccaacggccucggcgcccaguucuuccgcggcucccccgcccacuacaccccccucacccaccccgucuccgcccccuccuccuccggcuccccccucuacgagggcgccgccgccgccaccgacaucgucgacucccaguacgacgccgccgcccagggccgccucaucgccuccuggacccccgucuccccccccuccauguga

SEQ ID NO: 50718 - RNA, 2070 nt, Artificial Sequence
  derived and/or modified sequence opt2 from THOP1__Homo_sapiens__NP_003240
augaagccccccgccgccugcgccggcgacauggccgacgccgccucccccugcuccgucgucaacgaccuccgcugggaccucuccgcccagcagaucgaggagcgcacccgcgagcucaucgagcagaccaagcgcgucuacgaccaggucggcacccaggaguucgaggacgucuccuacgaguccacccucaaggcccucgccgacgucgaggucaccuacaccguccagcgcaacauccucgacuucccccagcacgucucccccuccaaggacauccgcaccgccuccaccgaggccgacaagaagcucuccgaguucgacgucgagauguccaugcgcgaggacgucuaccagcgcaucgucuggcuccaggagaagguccagaaggacucccuccgccccgaggccgcccgcuaccucgagcgccucaucaagcucggccgccgcaacggccuccaccucccccgcgagacccaggagaacaucaagcgcaucaagaagaagcucucccuccucugcaucgacuucaacaagaaccucaacgaggacaccaccuuccuccccuucacccuccaggagcucggcggccuccccgaggacuuccucaacucccucgagaagauggaggacggcaagcucaaggucacccucaaguacccccacuacuucccccuccucaagaagugccacguccccgagacccgccgcaaggucgaggaggccuucaacugccgcugcaaggaggagaacugcgccauccucaaggagcucgucacccuccgcgcccagaagucccgccuccucggcuuccacacccacgccgacuacguccucgagaugaacauggccaagaccucccagaccgucgccaccuuccucgacgagcucgcccagaagcucaagccccucggcgagcaggagcgcgccgucauccucgagcucaagcgcgccgagugcgagcgccgcggccuccccuucgacggccgcauccgcgccugggacaugcgcuacuacaugaaccaggucgaggagacccgcuacugcgucgaccagaaccuccucaaggaguacuuccccguccaggucgucacccacggccuccucggcaucuaccaggagcuccucggccucgccuuccaccacgaggagggcgccuccgccuggcacgaggacguccgccucuacaccgcccgcgacgccgccuccggcgaggucgucggcaaguucuaccucgaccucuacccccgcgagggcaaguacggccacgccgccugcuucggccuccagcccggcugccuccgccaggacggcucccgccagaucgccaucgccgccauggucgccaacuucaccaagcccaccgccgacgcccccucccuccuccagcacgacgaggucgagaccuacuuccacgaguucggccacgucaugcaccagcucugcucccaggccgaguucgccauguucuccggcacccacgucgagcgcgacuucgucgaggcccccucccagaugcucgagaacugggucugggagcaggagccccuccuccgcaugucccgccacuaccgcaccggcuccgccgucccccgcgagcuccucgagaagcucaucgagucccgccaggccaacaccggccucuucaaccuccgccagaucguccucgccaaggucgaccaggcccuccacacccagaccgacgccgaccccgccgaggaguacgcccgccucugccaggagauccucggcguccccgccacccccggcaccaacaugcccgccaccuucggccaccucgccggcggcuacgacgcccaguacuacggcuaccucugguccgaggucuacuccauggacauguuccacacccgcuucaagcaggagggcguccucaacuccaaggucggcauggacuaccgcuccugcauccuccgccccggcggcuccgaggacgccuccgccaugcuccgccgcuuccucggccgcgaccccaagcaggacgccuuccuccucuccaagggccuccaggucggcggcugcgagcccgagccccaggucugcuga

SEQ ID NO: 50719 - RNA, 1482 nt, Artificial Sequence
  derived and/or modified sequence opt2 from THPO__Homo_sapiens__NP_001276932
auggacccccccauccagaucuucuccgucgucugcgucggcggcggcgucgaccccggccccggccgcggcucccgcgaggagaaggccucccuccccggcgccuucaccuccgucugguggcuccccucccucaucggccagaaguggccccgccaggccuacgaccuccuccucuggcgcggcugcgccccccccccccacgucuuccuccccaucugcucccccgagggcugccuccucugcaccuggguccucgagcccuucuccacccgcaucgacuccuccccccucgcccgccucugccccacccuccucugccccgagguccaggagcccaagcccccccccuggccccaggagggcuuccgcggcgaggcccccaaccgcgagccccgccagcccgacacccccgcccgcauggagcucaccgagcuccuccucgucgucaugcuccuccucaccgcccgccucacccucuccucccccgccccccccgccugcgaccuccgcguccucuccaagcuccuccgcgacucccacguccuccacucccgccucucccagugccccgagguccacccccuccccacccccguccuccuccccgccgucgacuucucccucggcgaguggaagacccagauggaggagaccaaggcccaggacauccucggcgccgucacccuccuccucgagggcgucauggccgcccgcggccagcucggccccaccugccucuccucccuccucggccagcucuccggccagguccgccuccuccucggcgcccuccagucccuccucggcacccagcuccccccccagggccgcaccaccgcccacaaggaccccaacgccaucuuccucuccuuccagcaccuccuccgcggcaagguccgcuuccucaugcucgucggcggcuccacccucugcguccgccgcgccccccccaccaccgccguccccucccgcaccucccucguccucacccucaacgagcuccccaaccgcaccuccggccuccucgagaccaacuucaccgccuccgcccgcaccaccggcuccggccuccucaaguggcagcagggcuuccgcgccaagauccccggccuccucaaccagaccucccgcucccucgaccagauccccggcuaccucaaccgcauccacgagcuccucaacggcacccgcggccucuuccccggccccucccgccgcacccucggcgcccccgacaucuccuccggcaccuccgacaccggcucccucccccccaaccuccagcccggcuacucccccucccccacccacccccccaccggccaguacacccucuucccccucccccccacccuccccacccccgucguccagcuccacccccuccuccccgaccccuccgcccccacccccacccccaccuccccccuccucaacaccuccuacacccacucccagaaccucucccaggagggcuga

SEQ ID NO: 50720 - RNA, 1356 nt, Artificial Sequence
  derived and/or modified sequence opt2 from THRA__Homo_sapiens__NP_001177847
auggagcagaagcccuccaaggucgagugcggcuccgaccccgaggagaacuccgcccgcucccccgacggcaagcgcaagcgcaagaacggccagugcucccucaagaccuccauguccggcuacauccccuccuaccucgacaaggacgagcagugcgucgucugcggcgacaaggccaccggcuaccacuaccgcugcaucaccugcgagggcugcaagggcuucuuccgccgcaccauccagaagaaccuccaccccaccuacuccugcaaguacgacuccugcugcgucaucgacaagaucacccgcaaccagugccagcucugccgcuucaagaagugcaucgccgucggcauggccauggaccucguccucgacgacuccaagcgcgucgccaagcgcaagcucaucgagcagaaccgcgagcgccgccgcaaggaggagaugauccgcucccuccagcagcgccccgagcccacccccgaggagugggaccucauccacaucgccaccgaggcccaccgcuccaccaacgcccagggcucccacuggaagcagcgccgcaaguuccuccccgacgacaucggccagucccccaucgucuccaugcccgacggcgacaaggucgaccucgaggccuucuccgaguucaccaagaucaucacccccgccaucacccgcgucgucgacuucgccaagaagcuccccauguucuccgagcuccccugcgaggaccagaucauccuccucaagggcugcugcauggagaucaugucccuccgcgccgccguccgcuacgaccccgaguccgacacccucacccucuccggcgagauggccgucaagcgcgagcagcucaagaacggcggccucggcgucgucuccgacgccaucuucgagcucggcaagucccucuccgccuucaaccucgacgacaccgaggucgcccuccuccaggccguccuccucauguccaccgaccgcuccggccuccucugcgucgacaagaucgagaagucccaggaggccuaccuccucgccuucgagcacuacgucaaccaccgcaagcacaacaucccccacuucuggcccaagcuccucaugaagggcccccagguccgccagcucgagcagcagcucggcgaggccggcucccuccagggccccguccuccagcaccagucccccaaguccccccagcagcgccuccucgagcuccuccaccgcuccggcauccuccacgcccgcgccgucugcggcgaggacgacuccuccgaggccgacucccccuccuccuccgaggaggagcccgaggucugcgaggaccucgccggcaacgccgccucccccuga

SEQ ID NO: 50721 - RNA, 1386 nt, Artificial Sequence
  derived and/or modified sequence opt2 from THRB__Homo_sapiens__NP_001239563
augacccccaacuccaugaccgagaacggccucaccgccugggacaagcccaagcacugccccgaccgcgagcacgacuggaagcucgucggcauguccgaggccugccuccaccgcaagucccacuccgagcgccgcuccacccucaagaacgagcaguccuccccccaccucauccagaccaccuggaccuccuccaucuuccaccucgaccacgacgacgucaacgaccaguccgucuccuccgcccagaccuuccagaccgaggagaagaagugcaagggcuacauccccuccuaccucgacaaggacgagcucugcgucgucugcggcgacaaggccaccggcuaccacuaccgcugcaucaccugcgagggcugcaagggcuucuuccgccgcaccauccagaagaaccuccaccccuccuacuccugcaaguacgagggcaagugcgucaucgacaaggucacccgcaaccagugccaggagugccgcuucaagaagugcaucuacgucggcauggccaccgaccucguccucgacgacuccaagcgccucgccaagcgcaagcucaucgaggagaaccgcgagaagcgccgccgcgaggagcuccagaaguccaucggccacaagcccgagcccaccgacgaggagugggagcucaucaagaccgucaccgaggcccacgucgccaccaacgcccagggcucccacuggaagcagaagcgcaaguuccuccccgaggacaucggccaggcccccaucgucaacgcccccgagggcggcaaggucgaccucgaggccuucucccacuucaccaagaucaucacccccgccaucacccgcgucgucgacuucgccaagaagcuccccauguucugcgagcuccccugcgaggaccagaucauccuccucaagggcugcugcauggagaucaugucccuccgcgccgccguccgcuacgaccccgaguccgagacccucacccucaacggcgagauggccgucacccgcggccagcucaagaacggcggccucggcgucgucuccgacgccaucuucgaccucggcaugucccucuccuccuucaaccucgacgacaccgaggucgcccuccuccaggccguccuccucauguccuccgaccgccccggccucgccugcgucgagcgcaucgagaaguaccaggacuccuuccuccucgccuucgagcacuacaucaacuaccgcaagcaccacgucacccacuucuggcccaagcuccucaugaaggucaccgaccuccgcaugaucggcgccugccacgccucccgcuuccuccacaugaaggucgagugccccaccgagcucuuccccccccucuuccucgaggucuucgaggacuga

SEQ ID NO: 50722 - RNA, 441 nt, Artificial Sequence
  derived and/or modified sequence opt2 from THRSP__Homo_sapiens__NP_003242
augcagguccucaccaagcgcuaccccaagaacugccuccucaccgucauggaccgcuacgccgccgagguccacaacauggagcaggucgucaugauccccucccuccuccgcgacguccagcucuccggccccggcggccaggcccaggccgaggcccccgaccucuacaccuacuucaccaugcucaaggccaucugcgucgacgucgaccacggccuccucccccgcgaggaguggcaggccaaggucgccggcuccgaggagaacggcaccgccgagaccgaggaggucgaggacgaguccgccuccggcgagcucgaccucgaggcccaguuccaccuccacuucuccucccuccaccacauccucaugcaccucaccgagaaggcccaggaggucacccgcaaguaccaggagaugaccggccaggucugguga

SEQ ID NO: 50723 - RNA, 2559 nt, Artificial Sequence
  derived and/or modified sequence opt2 from THSD1__Homo_sapiens__NP_061146
augaagcccaugcucaaggacuucuccaaccuccuccucgucguccucugcgacuacguccucggcgaggccgaguaccuccuccuccgcgagcccggccacgucgcccucuccaacgacaccgucuacgucgacuuccaguacuucgacggcgccaacggcacccuccgcaacgucuccguccuccuccucgaggccaacaccaaccagaccgucaccaccaaguaccuccucaccaaccagucccagggcacccucaaguucgagugcuucuacuucaaggaggccggcgacuacugguucaccaugacccccgaggccaccgacaacuccacccccuuccccuggugggagaaguccgccuuccucaaggucgaguggcccgucuuccacgucgaccucaaccgcuccgccaaggccgccgagggcaccuuccaggucggccucuucaccucccagccccucugccccuuccccgucgacaagcccaacaucgucgucgacgucaucuucaccaacucccuccccgaggcccgccgcaacucccgccagccccucgagauccgcaccuccaagcgcaccgagcucgcccagggccagugggucgaguucggcugcgccccccucggccccgaggccuacgucaccgucguccucaagcuccucggccgcgacuccgucaucaccuccaccggccccaucgaccucgcccagaaguucggcuacaagcucgucaugguccccgagcucaccugcgaguccggcgucgaggucaccguccuccccccccccugcaccuucguccagggcgucgucaccgucuucaaggaggccccccgcuaccccggcaagcgcaccauccaccucgccgagaacucccucccccucggcgagcgccgcaccaucuucaacugcacccucuucgacaugggcaagaacaaguacugcuucgacuucggcaucuccucccgcucccacuucuccgccaaggaggagugcaugcucauccagcgcaacaccgagaccuggggccucuggcagcccuggucccagugcuccgccaccugcggcgacggcguccgcgagcgccgccgcgucugccucaccuccuuccccuccucccccgucugccccggcaugucccucgaggccucccucugcucccucgaggagugcgccgccuuccagcccuccucccccuccccccuccagccccagggccccgucaaguccaacaacaucgucaccgucaccggcaucucccucugccucuucaucaucaucgccaccguccucaucacccucuggcgccgcuucggccgccccgccaagugcuccacccccgcccgccacaacuccauccacucccccuccuuccgcaagaacuccgacgaggagaacaucugcgagcucuccgagcagcgcggcuccuucuccgacggcggcgacggccccaccggcucccccggcgacaccggcaucccccucaccuaccgccgcuccggccccgucccccccgaggacgacgccuccggcuccgaguccuuccaguccaacgcccagaagaucauccccccccucuucuccuaccgccucgcccagcagcagcucaaggagaugaagaagaagggccucaccgagaccaccaaggucuaccacgucucccaguccccccucaccgacaccgccaucgacgccgcccccuccgccccccucgaccucgagucccccgaggaggccgccgccaacaaguuccgcaucaagucccccuuccccgagcagcccgccgucuccgccggcgagcgcccccccucccgccucgaccucaacgucacccaggccuccugcgccaucucccccucccagacccucauccgcaagucccaggcccgccacgucggcucccgcggcggccccuccgagcgcucccacgcccgcaacgcccacuuccgccgcaccgccuccuuccacgaggcccgccaggcccgccccuuccgcgagcgcuccauguccacccucaccccccgccaggcccccgccuacuccucccgcacccgcaccugcgagcaggccgaggaccgcuuccgcccccagucccgcggcgcccaccucuuccccgagaagcucgagcacuuccaggaggccuccggcacccgcggcccccucaacccccuccccaaguccuacacccucggccagccccuccgcaagcccgaccucggcgaccaccaggccggccucgucgccggcaucgagcgcaccgagccccaccgcgcccgccgcggccccucccccucccacaaguccgucucccgcaagcaguccucccccaucucccccaaggacaacuaccagcgcgucuccucccucucccccucccagugccgcaaggacaagugccaguccuuccccacccaccccgaguucgccuucuacgacaacaccuccuucggccucaccgaggccgagcagcgcaugcucgaccuccccggcuacuucggcuccaacgaggaggacgagaccaccuccacccucuccgucgagaagcucgucaucuga

SEQ ID NO: 50724 - RNA, 1977 nt, Artificial Sequence
  derived and/or modified sequence opt2 from THSD4__Homo_sapiens__NP_001273358
auguucgucuccuaccucauccucacccuccuccacguccagaccgccguccucgcccgccccggcggcgaguccaucggcugcgacgacuaccucggcuccgacaaggucgucgacaagugcggcgucugcggcggcgacaacaccggcugccaggucgucuccggcgucuucaagcacgcccucaccucccucggcuaccaccgcgucgucgagauccccgagggcgccaccaagaucaacaucaccgagauguacaaguccaacaacuaccucgcccuccgcucccgcuccggccgcuccaucaucaacggcaacugggccaucgaccgccccggcaaguacgagggcggcggcaccauguucaccuacaagcgccccaacgagaucuccuccaccgccggcgaguccuuccucgccgagggccccaccaacgagauccucgacgucuacaugauccaccagcagcccaaccccggcguccacuacgaguacgucaucaugggcaccaacgccaucuccccccagguccccccccaccgccgccccggcgagcccuucaacggccagauggucaccgagggccgcucccaggaggagggcgagcagaagggccgcaacgaggagaaggaggaccuccgcggcgaggcccccgagauguucaccuccgaguccgcccagaccuuccccguccgccaccccgaccgcuucuccccccaccgccccgacaaccucgucccccccgccccccagcccccccgccgcucccgcgaccacaacuggaagcagcucggcaccaccgagugcuccaccaccugcggcaagggcucccaguaccccaucuuccgcugcguccaccgcuccacccacgaggaggcccccgaguccuacugcgacuccuccaugaagcccacccccgaggaggagcccugcaacaucuuccccugccccgccuucugggacaucggcgagugguccgagugcuccaagaccugcggccucggcaugcagcaccgccagguccucugccgccaggucuacgccaaccgcucccucaccguccagcccuaccgcugccagcaccucgagaagcccgagaccaccuccaccugccagcucaagaucugcuccgaguggcagauccgcaccgacuggaccuccugcuccguccccugcggcgucggccagcgcacccgcgacgucaagugcgucuccaacaucggcgacgucgucgacgacgaggagugcaacaugaagcuccgccccaacgacaucgagaacugcgacaugggccccugcgccaaguccugguuccucaccgagugguccgagcgcugcuccgccgagugcggcgccggcguccgcacccgcuccgucgucugcaugaccaaccacgucuccucccucccccucgagggcugcggcaacaaccgccccgccgaggccacccccugcgacaacggccccugcaccggcaaggucgagugguucgccggcuccuggucccagugcuccaucgagugcggcuccggcacccagcagcgcgaggucaucugcguccgcaagaacgccgacaccuucgagguccucgaccccuccgagugcuccuuccucgagaagccccccucccagcaguccugccaccucaagcccugcggcgccaagugguucuccaccgagugguccaugugcuccaaguccugccagggcggcuuccgcguccgcgagguccgcugccucuccgacgacaugacccucuccaaccucugcgacccccagcucaagcccgaggagcgcgaguccugcaacccccaggacugcguccccgaggucgacgagaacugcaaggacaaguacuacaacugcaacgucgucguccaggcccgccucugcgucuacaacuacuacaagaccgccugcugcgccuccugcacccgcgucgccaaccgccagaccggcuuccucggcucccgcuga

SEQ ID NO: 50725 - RNA, 4974 nt, Artificial Sequence
  derived and/or modified sequence opt2 from THSD7A__Homo_sapiens__NP_056019
augggccuccaggcccgccgcugggccuccggcucccgcggcgccgccggcccccgccgcggcguccuccagcuccucccccucccccucccccucccccuccuccuccuccuccuccuccgccccggcgccggccgcgccgccgcccagggcgaggccgaggcccccacccucuaccucuggaagaccggccccuggggccgcugcaugggcgacgagugcggccccggcggcauccagacccgcgccgucuggugcgcccacgucgagggcuggaccacccuccacaccaacugcaagcaggccgagcgccccaacaaccagcagaacugcuucaaggucugcgacuggcacaaggagcucuacgacuggcgccucggccccuggaaccagugccagcccgucaucuccaagucccucgagaagccccucgagugcaucaagggcgaggagggcauccagguccgcgagaucgccugcauccagaaggacaaggacauccccgccgaggacaucaucugcgaguacuucgagcccaagccccuccucgagcaggccugccucauccccugccagcaggacugcaucgucuccgaguucuccgccugguccgagugcuccaagaccugcggcuccggccuccagcaccgcacccgccacgucgucgcccccccccaguucggcggcuccggcugccccaaccucaccgaguuccaggucugccaguccucccccugcgaggccgaggagcuccgcuacucccuccacgucggccccugguccaccugcuccaugccccacucccgccagguccgccaggcccgccgccgcggcaagaacaaggagcgcgagaaggaccgcuccaagggcgucaaggaccccgaggcccgcgagcucaucaagaagaagcgcaaccgcaaccgccagaaccgccaggagaacaaguacugggacauccagaucggcuaccagacccgcgaggucaugugcaucaacaagaccggcaaggccgccgaccucuccuucugccagcaggagaagcuccccaugaccuuccaguccugcgucaucaccaaggagugccaggucuccgagugguccgaguggucccccugcuccaagaccugccacgacauggucucccccgccggcacccgcguccgcacccgcaccauccgccaguuccccaucggcuccgagaaggagugccccgaguucgaggagaaggagcccugccucucccagggcgacggcgucguccccugcgccaccuacggcuggcgcaccaccgaguggaccgagugccgcgucgacccccuccucucccagcaggacaagcgccgcggcaaccagaccgcccucugcggcggcggcauccagacccgcgaggucuacugcguccaggccaacgagaaccuccucucccagcucuccacccacaagaacaaggaggccuccaagcccauggaccucaagcucugcaccggccccauccccaacaccacccagcucugccacauccccugccccaccgagugcgaggucucccccugguccgccuggggccccugcaccuacgagaacugcaacgaccagcagggcaagaagggcuucaagcuccgcaagcgccgcaucaccaacgagcccaccggcggcuccggcgucaccggcaacugcccccaccuccucgaggccauccccugcgaggagcccgccugcuacgacuggaaggccguccgccucggcaacugcgagcccgacaacggcaaggagugcggccccggcacccagguccaggaggucgucugcaucaacuccgacggcgaggaggucgaccgccagcucugccgcgacgccaucuuccccauccccgucgccugcgacgcccccugccccaaggacugcguccucuccaccugguccaccugguccuccugcucccacaccugcuccggcaagaccaccgagggcaagcagauccgcgcccgcuccauccucgccuacgccggcgaggagggcggcauccgcugccccaacuccuccgcccuccaggagguccgcuccugcaacgagcaccccugcaccgucuaccacuggcagaccggccccuggggccagugcaucgaggacaccuccgucuccuccuucaacaccaccaccaccuggaacggcgaggccuccugcuccgucggcaugcagacccgcaaggucaucugcguccgcgucaacgucggccaggucggccccaagaagugccccgagucccuccgccccgagaccguccgccccugccuccuccccugcaagaaggacugcaucgucacccccuacuccgacuggaccuccugccccuccuccugcaaggagggcgacuccuccauccgcaagcagucccgccaccgcgucaucauccagcuccccgccaacggcggccgcgacugcaccgacccccucuacgaggagaaggccugcgaggccccccaggccugccaguccuaccgcuggaagacccacaaguggcgccgcugccagcucguccccugguccguccagcaggacucccccggcgcccaggagggcugcggccccggccgccaggcccgcgccaucaccugccgcaagcaggacggcggccaggccggcauccacgagugccuccaguacgccggccccguccccgcccucacccaggccugccagauccccugccaggacgacugccagcucaccuccugguccaaguucuccuccugcaacggcgacugcggcgccguccgcacccgcaagcgcacccucgucggcaaguccaagaagaaggagaagugcaagaacucccaccucuacccccucaucgagacccaguacugccccugcgacaaguacaacgcccagcccgucggcaacugguccgacugcauccuccccgagggcaaggucgagguccuccucggcaugaagguccagggcgacaucaaggagugcggccagggcuaccgcuaccaggccauggccugcuacgaccagaacggccgccucgucgagaccucccgcugcaacucccacggcuacaucgaggaggccugcaucauccccugccccuccgacugcaagcucuccgagugguccaacuggucccgcugcuccaaguccugcggcuccggcgucaagguccgcuccaaguggcuccgcgagaagcccuacaacggcggccgccccugccccaagcucgaccacgucaaccaggcccaggucuacgaggucguccccugccacuccgacugcaaccaguaccucugggucaccgagcccugguccaucugcaaggucaccuucgucaacaugcgcgagaacugcggcgagggcguccagacccgcaagguccgcugcaugcagaacaccgccgacggccccuccgagcacgucgaggacuaccucugcgaccccgaggagaugccccucggcucccgcgucugcaagcuccccugccccgaggacugcgucaucuccgaguggggccccuggacccagugcguccuccccugcaaccaguccuccuuccgccagcgcuccgccgaccccauccgccagcccgccgacgagggccgcuccugccccaacgccgucgagaaggagcccugcaaccucaacaagaacugcuaccacuacgacuacaacgucaccgacugguccaccugccagcucuccgagaaggccgucugcggcaacggcaucaagacccgcaugcucgacugcguccgcuccgacggcaaguccgucgaccucaaguacugcgaggcccucggccucgagaagaacuggcagaugaacaccuccugcauggucgagugccccgucaacugccagcucuccgacuggucccccugguccgagugcucccagaccugcggccucaccggcaagaugauccgccgccgcaccgucacccagcccuuccagggcgacggccgccccugccccucccucauggaccaguccaagcccugccccgucaagcccugcuaccgcuggcaguacggccaguggucccccugccagguccaggaggcccagugcggcgagggcacccgcacccgcaacaucuccugcgucgucuccgacggcuccgccgacgacuucuccaaggucgucgacgaggaguucugcgccgacaucgagcucaucaucgacggcaacaagaacaugguccucgaggaguccugcucccagcccugccccggcgacugcuaccucaaggacugguccuccuggucccucugccagcucaccugcgucaacggcgaggaccucggcuucggcggcauccagguccgcucccgccccgucaucauccaggagcucgagaaccagcaccucugccccgagcagaugcucgagaccaaguccugcuacgacggccagugcuacgaguacaaguggauggccuccgccuggaagggcuccucccgcaccgucuggugccagcgcuccgacggcaucaacgucaccggcggcugccucgucaugucccagcccgacgccgaccgcuccugcaacccccccugcucccagccccacuccuacugcuccgagaccaagaccugccacugcgaggagggcuacaccgaggucauguccuccaacuccacccucgagcagugcacccucauccccgucgucguccuccccaccauggaggacaagcgcggcgacgucaagaccucccgcgccguccaccccacccagcccuccuccaaccccgccggccgcggccgcaccugguuccuccagcccuucggccccgacggccgccucaagaccugggucuacggcgucgccgccggcgccuucguccuccucaucuucaucgucuccaugaucuaccucgccugcaagaagcccaagaagccccagcgccgccagaacaaccgccucaagccccucacccucgccuacgacggcgacgccgacauguga

SEQ ID NO: 50726 - RNA, 501 nt, Artificial Sequence
  derived and/or modified sequence opt2 from THYN1__Homo_sapiens__NP_001032381
augucccgcccccgcaagcgccucgccggcaccuccggcuccgacaagggccucuccggcaagcgcaccaagaccgagaacuccggcgaggcccucgccaaggucgaggacuccaacccccagaagaccuccgccaccaagaacugccucaagaaccucuccucccacuggcucaugaaguccgagcccgagucccgccucgagaagggcgucgacgucaaguucuccaucgaggaccucaaggcccagcccaagcagaccaccugcugggacggcguccgcaacuaccaggcccgcaacuuccuccgcgccaugaagcucggcgaggaggccuucuucuaccacuccaacugcaaggagcccggcaucgccggccucaugaagaucgucaaggaggccuaccccgaccacacccaguucgagaagaacaacccccacuacgaccccuccuccaaggaggacaaccccaagugguccaugaagucccucauccucuucuga

SEQ ID NO: 50727 - RNA, 1128 nt, Artificial Sequence
  derived and/or modified sequence opt2 from TIA1__Homo_sapiens__NP_071320
auggaggacgagaugcccaagacccucuacgucggcaaccucucccgcgacgucaccgaggcccucauccuccagcucuucucccagaucggccccugcaagaacugcaagaugaucauggacaccgccggcaacgaccccuacugcuucgucgaguuccacgagcaccgccacgccgccgccgcccucgccgccaugaacggccgcaagaucaugggcaaggaggucaaggucaacugggccaccacccccuccucccagaagaaggacaccuccaaccacuuccacgucuucgucggcgaccucucccccgagaucaccaccgaggacaucaaggccgccuucgcccccuucggccgcaucuccgacgcccgcgucgucaaggacauggccaccggcaaguccaagggcuacggcuucgucuccuucuucaacaagugggacgccgagaacgccauccagcagaugggcggccaguggcucggcggccgccagauccgcaccaacugggccacccgcaagccccccgcccccaaguccaccuacgaguccaacaccaagcagcucuccuacgacgaggucgucaaccaguccucccccuccaacugcaccgucuacugcggcggcgucaccuccggccucaccgagcagcucaugcgccagaccuucucccccuucggccagaucauggagauccgcgucuuccccgacaagggcuacuccuucguccgcuucaacucccacgaguccgccgcccacgccaucgucuccgucaacggcaccaccaucgagggccacgucgucaagugcuacuggggcaaggagacccucgacaugaucaaccccguccagcagcagaaccagaucggcuacccccagcccuacggccaguggggccagugguacggcaacgcccagcagaucggccaguacaugcccaacggcuggcagguccccgccuacggcauguacggccaggccuggaaccagcagggcuucaaccagacccaguccuccgcccccuggaugggccccaacuacggcguccagcccccccagggccagaacggcuccaugcuccccaaccagcccuccggcuaccgcgucgccggcuacgagacccaguga

SEQ ID NO: 50728 - RNA, 348 nt, Artificial Sequence
  derived and/or modified sequence opt2 from TIAF1__Homo_sapiens__NP_004731
auguccucccccuccucccccuuccgcgagcaguccuuccucugcgccgccggcgacgccggcgaggagucccgcguccagguccucaagaacgagguccgccgcggcucccccguccuccucggcugggucgagcaggccuacgccgacaagugcgucugcggccccuccgccccccccgcccccaccccccccucccucucccagcgcgucaugugcaacgaccucuucaaggucaaccccuuccagcuccagcaguuccgcgccgaccccuccaccgccucccuccuccucugccccggcggccucgaccacaagcucaaccuccgcggcaaggccuggggcuga

SEQ ID NO: 50729 - RNA, 1179 nt, Artificial Sequence
  derived and/or modified sequence opt2 from TIAL1__Homo_sapiens__NP_001029097
augauggaggacgacggccagccccgcacccucuacgucggcaaccucucccgcgacgucaccgagguccucauccuccagcucuucucccagaucggccccugcaaguccugcaagaugaucaccgagcagcccgacucccgccgcgucaacuccuccgucggcuucuccguccuccagcacaccuccaacgaccccuacugcuucgucgaguucuacgagcaccgcgacgccgccgccgcccucgccgccaugaacggccgcaagauccucggcaaggaggucaaggucaacugggccaccacccccuccucccagaagaaggacaccuccaaccacuuccacgucuucgucggcgaccucucccccgagaucaccaccgaggacaucaaguccgccuucgcccccuucggcaagaucuccgacgcccgcgucgucaaggacauggccaccggcaaguccaagggcuacggcuucgucuccuucuacaacaagcucgacgccgagaacgccaucguccacaugggcggccaguggcucggcggccgccagauccgcaccaacugggccacccgcaagccccccgcccccaaguccacccaggagaacaacaccaagcagcuccgcuucgaggacgucgucaaccaguccucccccaagaacugcaccgucuacugcggcggcaucgccuccggccucaccgaccagcucaugcgccagaccuucucccccuucggccagaucauggagauccgcgucuuccccgagaagggcuacuccuucguccgcuucuccacccacgaguccgccgcccacgccaucgucuccgucaacggcaccaccaucgagggccacgucgucaagugcuacuggggcaaggagucccccgacaugaccaagaacuuccagcaggucgacuacucccaguggggccaguggucccaggucuacggcaacccccagcaguacggccaguacauggccaacggcuggcaggucccccccuacggcgucuacggccagcccuggaaccagcagggcuucggcgucgaccagucccccuccgccgccuggaugggcggcuucggcgcccagcccccccagggccaggcccccccccccgucauccccccccccaaccaggccggcuacggcauggccuccuaccagacccaguga

SEQ ID NO: 50730 - RNA, 4776 nt, Artificial Sequence
  derived and/or modified sequence opt2 from TIAM1__Homo_sapiens__XP_005261095
augggcaacgccgagucccagcacgucgagcacgaguucuacggcgagaagcacgccucccucggccgcaagcacaccucccgcucccuccgccucucccacaagacccgccgcacccgccacgccuccuccggcaaggucauccaccgcaacuccgaggucuccacccgcuccuccuccacccccuccaucccccagucccucgccgagaacggccucgagcccuucucccaggacggcacccucgaggacuucggcucccccaucugggucgaccgcgucgacaugggccuccgccccgucuccuacaccgacuccuccgucacccccuccgucgacuccuccaucguccucaccgccgccuccguccaguccaugcccgacaccgaggagucccgccucuacggcgacgacgccaccuaccucgccgagggcggccgccgccagcacuccuacaccuccaacggccccaccuucauggagaccgccuccuucaagaagaagcgcuccaaguccgccgacaucuggcgcgaggacucccucgaguucucccucuccgaccucucccaggagcaccucaccuccaacgaggagauccucggcuccgccgaggagaaggacugcgaggaggcccgcggcauggagacccgcgccuccccccgccagcucuccaccugccagcgcgccaacucccucggcgaccucuacgcccagaagaacuccggcgucaccgccaacggcggccccggcuccaaguucgccggcuacugccgcaaccucgucuccgacauccccaaccucgccaaccacaagaugccccccgccgccgccgaggagaccccccccuacuccaacuacaacacccuccccugccgcaagucccacugccucuccgagggcgccaccaacccccagaucucccacuccaacuccaugcagggccgccgcgccaagaccacccaggacgucaacgccggcgagggcuccgaguucgccgacuccggcaucgagggcgccaccaccgacaccgaccuccucucccgccgcuccaacgccaccaacuccuccuacucccccaccaccggccgcgccuucgucggcuccgacuccggcuccuccuccaccggcgacgccgcccgccagggcgucuacgagaacuuccgccgcgagcucgagauguccaccaccaacuccgagucccucgaggaggccggcuccgcccacuccgacgagcaguccuccggcacccucuccucccccggccaguccgacauccuccucaccgccgcccagggcaccguccgcaaggccggcgcccucgccgucaagaacuuccucguccacaagaagaacaagaaggucgaguccgccacccgccgcaaguggaagcacuacugggucucccucaagggcugcacccucuucuucuacgaguccgacggccgcuccggcaucgaccacaacuccauccccaagcacgccgucugggucgagaacuccaucguccaggccguccccgagcaccccaagaaggacuucgucuucugccucuccaacucccucggcgacgccuuccucuuccagaccaccucccagaccgagcucgagaacuggaucaccgccauccacuccgccugcgccaccgccgucgcccgccaccaccacaaggaggacacccuccgccuccucaaguccgagaucaagaagcucgagcagaagaucgacauggacgagaagaugaagaagaugggcgagaugcagcucuccuccgucaccgacuccaagaagaagaagaccauccucgaccagaucuucgucugggagcagaaccucgagcaguuccagauggaccucuuccgcuuccgcugcuaccucgccucccuccagggcggcgagcuccccaaccccaagcgccuccucgccuucgccucccgccccaccaaggucgccaugggccgccucggcaucuucuccgucuccuccuuccacgcccucgucgccgcccgcaccggcgagaccggcguccgccgccgcacccaggccaugucccgcuccgccuccaagcgccgcucccgcuucuccucccucuggggccucgacaccaccuccaagaagaagcagggccgccccuccaucaaccaggucuucggcgagggcaccgaggccgucaagaagucccucgagggcaucuucgacgacaucguccccgacggcaagcgcgagaaggaggucguccuccccaacguccaccagcacaaccccgacugcgacaucuggguccacgaguacuucacccccuccugguucugccuccccaacaaccagcccgcccucaccgucguccgccccggcgacaccgcccgcgacacccucgagcucaucugcaagacccaccagcucgaccacuccgcccacuaccuccgccucaaguuccucaucgagaacaagaugcagcucuacgucccccagcccgaggaggacaucuacgagcuccucuacaaggagaucgagaucugccccaaggucacccaguccauccacaucgagaaguccgacaccgccgccgacaccuacggcuucucccucuccuccgucgaggaggacggcauccgccgccucuacgucaacuccgucaaggagaccggccucgccuccaagaagggccucaaggccggcgacgagauccucgagaucaacaaccgcgccgccgacgcccucaacuccuccaugcucaaggacuuccucucccagcccucccucggccuccucguccgcaccuaccccgagcucgaggagggcgucgagcuccucgagucccccccccaccgcgucgacggccccgccgaccucggcgaguccccccucgccuuccucaccuccaaccccggccacucccucugcuccgagcagggcuccuccgccgagaccgcccccgaggagaccgagggccccgaccucgaguccuccgacgagaccgaccacuccuccaaguccaccgagcaggucgccgccuucugccgcucccuccacgagaugaaccccuccgaccagucccccuccccccaggacuccaccggcccccagcucgccaccaugcgccagcucuccgacgccgacaagcuccgcaaggucaucugcgagcuccucgagaccgagcgcaccuacgucaaggaccucaacugccucauggagcgcuaccucaagccccuccagaaggagaccuuccucacccaggacgagcucgacguccucuucggcaaccucaccgagauggucgaguuccaggucgaguuccucaagacccucgaggacggcguccgccucguccccgaccucgagaagcucgagaaggucgaccaguucaagaagguccucuucucccucggcggcuccuuccucuacuacgccgaccgcuucaagcucuacuccgccuucugcgccucccacaccaagguccccaagguccucgucaaggccaagaccgacaccgccuucaaggccuuccucgacgcccagaaccccaagcagcagcacuccuccacccucgaguccuaccucaucaagcccauccagcgcauccucaaguacccccuccuccuccgcgagcucuucgcccucaccgacgccgaguccgaggagcacuaccaccucgacgucgccaucaagaccaugaacaaggucgccucccacaucaacgagaugcagaagauccacgaggaguucggcgccgucuucgaccagcucaucgccgagcagaccggcgagaagaaggaggucgccgaccucuccaugggcgaccuccuccuccacaccaccgucaucuggcucaacccccccgccucccucggcaaguggaagaaggagcccgagcucgccgccuucgucuucaagaccgccgucguccucgucuacaaggacggcuccaagcagaagaagaagcucgucggcucccaccgccucuccaucuacgaggacugggaccccuuccgcuuccgccacaugauccccaccgaggcccuccagguccgcgcccucgccuccgccgacgccgaggccaacgccgucugcgagaucguccacgucaaguccgaguccgagggccgccccgagcgcgucuuccaccucugcugcuccucccccgagucccgcaaggacuuccucaaggccguccacuccauccuccgcgacaagcaccgccgccagcuccucaagaccgagucccuccccuccucccagcaguacguccccuucggcggcaagcgccucugcgcccucaagggcgcccgccccgccaugucccgcgccgucuccgcccccuccaagucccucggccgccgccgccgccgccucgcccgcaaccgcuucaccaucgacuccgacgccgucuccgccuccucccccgagaaggagucccagcagccccccggcggcggcgacaccgaccgcugggucgaggagcaguucgaccucgcccaguacgaggagcaggacgacaucaaggagaccgacauccucuccgacgacgacgaguucugcgaguccgucaagggcgccuccgucgaccgcgaccuccaggagcgccuccaggccaccuccaucucccagcgcgagcgcggccgcaagacccucgacucccacgccucccgcauggcccagcucaagaagcaggccgcccucuccggcaucaacggcggccucgaguccgccuccgaggaggucaucuggguccgccgcgaggacuucgcccccucccgcaagcucaacaccgagaucuga

SEQ ID NO: 50731 - RNA, 5106 nt, Artificial Sequence
  derived and/or modified sequence opt2 from TIAM2__Homo_sapiens__NP_036586
augggcaacuccgacucccaguacacccuccagggcuccaagaaccacuccaacaccaucaccggcgccaagcagauccccugcucccucaagauccgcggcauccacgccaaggaggagaagucccuccacggcuggggccacggcuccaacggcgccggcuacaagucccgcucccucgcccgcuccugccucucccacuucaaguccaaccagcccuacgccucccgccucggcggccccaccugcaaggucucccgcggcgucgccuacuccacccaccgcaccaacgcccccggcaaggacuuccagggcaucuccgccgccuucuccaccgagaacggcuuccacuccgucggccacgagcucgccgacaaccacaucaccucccgcgacugcaacggccaccuccucaacugcuacggccgcaacgaguccaucgccuccaccccccccggcgaggaccgcaaguccccccgcguccucaucaagacccucggcaagcucgacggcugccuccgcgucgaguuccacaacggcggcaaccccuccaagguccccgccgaggacugcuccgagcccguccagcuccuccgcuacucccccacccucgccuccgagaccucccccguccccgaggcccgccgcggcuccuccgccgacucccuccccucccaccgccccucccccaccgacucccgccuccgcuccuccaagggcuccucccucuccuccgaguccuccugguacgacucccccuggggcaacgccggcgagcucuccgaggccgagggcuccuuccucgcccccggcaugcccgaccccucccuccacgccuccuucccccccggcgacgccaagaagcccuucaaccaguccuccucccucuccucccuccgcgagcucuacaaggacgccaaccucggcucccucucccccuccggcauccgccucuccgacgaguacaugggcacccacgccucccucuccaaccgcgucuccuucgccuccgacaucgacguccccucccgcgucgcccacggcgaccccauccaguacuccuccuucacccuccccugccgcaagcccaaggccuucgucgaggacaccgccaagaaggacucccucaaggcccgcaugcgccgcaucuccgacuggaccggcucccucucccgcaagaagcgcaagcuccaggagccccgcuccaaggagggcuccgacuacuucgacucccgcuccgacggccucaacaccgacguccagggcuccucccaggccuccgccuuccucugguccggcggcuccacccagauccucucccagcgcuccgaguccacccacgccaucggcuccgacccccuccgccagaacaucuacgagaacuucaugcgcgagcucgagaugucccgcaccaacaccgagaacaucgagaccuccaccgagaccgccgaguccuccuccgagucccucuccucccucgagcagcucgaccuccucuucgagaaggagcagggcgucguccgcaaggccggcuggcucuucuucaagccccucgucaccguccagaaggagcgcaagcucgagcucgucgcccgccgcaaguggaagcaguacugggucacccucaagggcugcacccuccucuucuacgagaccuacggcaagaacuccauggaccaguccuccgccccccgcugcgcccucuucgccgaggacuccaucguccaguccguccccgagcaccccaagaaggagaacgucuucugccucuccaacuccuucggcgacgucuaccucuuccaggccaccucccagaccgaccucgagaacugggucaccgccguccacuccgccugcgccucccucuucgccaagaagcacggcaaggaggacacccuccgccuccucaagaaccagaccaagaaccuccuccagaagaucgacauggacuccaagaugaagaagauggccgagcuccagcucuccgucgucuccgaccccaagaaccgcaaggccaucgagaaccagauccagcagugggagcagaaccucgagaaguuccacauggaccucuuccgcaugcgcugcuaccucgccucccuccagggcggcgagcuccccaaccccaagucccuccucgccgccgccucccgccccuccaagcucgcccucggccgccucggcauccucuccgucuccuccuuccacgcccucgucugcucccgcgacgacuccgcccuccgcaagcgcacccucucccucacccagcgcggccgcaacaagaagggcaucuucuccucccucaagggccucgacacccucgcccgcaagggcaaggagaagcgccccuccaucacccaggucgacgagcuccuccacaucuacggcuccaccgucgacggcgucccccgcgacaacgccugggagauccagaccuacguccacuuccaggacaaccacggcgucaccgucggcaucaagcccgagcaccgcgucgaggacauccucacccucgccugcaagaugcgccagcucgagcccucccacuacggccuccagcuccgcaagcucgucgacgacaacgucgaguacugcauccccgcccccuacgaguacaugcagcagcaggucuacgacgagaucgaggucuucccccucaacgucuacgacguccagcucaccaagaccggcuccgucugcgacuucggcuucgccgucaccgcccaggucgacgagcgccagcaccucucccgcaucuucaucuccgacguccuccccgacggccucgccuacggcgagggccuccgcaagggcaacgagaucaugacccucaacggcgaggccgucuccgaccucgaccucaagcagauggaggcccucuucuccgagaaguccgucggccucacccucaucgcccgcccccccgacaccaaggccacccucugcaccuccugguccgacuccgaccucuucucccgcgaccagaagucccuccuccccccccccaaccagucccagcuccucgaggaguuccucgacaacuucaagaagaacaccgccaacgacuucuccaacguccccgacaucaccaccggccucaagcgcucccagaccgacggcacccucgaccaggucucccaccgcgagaagauggagcagaccuuccgcuccgccgagcagaucaccgcccucugccgcuccuucaacgacucccaggccaacggcauggagggcccccgcgagaaccaggacccccccccccgcccccucgcccgccaccucuccgacgccgaccgccuccgcaaggucauccaggagcucgucgacaccgagaaguccuacgucaaggaccucuccugccucuucgagcucuaccucgagccccuccagaacgagaccuuccucacccaggacgagauggagucccucuucggcucccuccccgagaugcucgaguuccagaaggucuuccucgagacccucgaggacggcaucuccgccuccuccgacuucaacacccucgagacccccucccaguuccgcaagcuccucuucucccucggcggcuccuuccucuacuacgccgaccacuucaagcucuacuccggcuucugcgccaaccacaucaagguccagaagguccucgagcgcgccaagaccgacaaggccuucaaggccuuccucgacgcccgcaaccccaccaagcagcacuccuccacccucgaguccuaccucaucaagcccguccagcgcguccucaaguacccccuccuccucaaggagcucgucucccucaccgaccaggaguccgaggagcacuaccaccucaccgaggcccucaaggccauggagaaggucgccucccacaucaacgagaugcagaagaucuacgaggacuacggcaccgucuucgaccagcucgucgccgagcaguccggcaccgagaaggaggucaccgagcucuccaugggcgagcuccucaugcacuccaccgucuccuggcucaaccccuuccucucccucggcaaggcccgcaaggaccucgagcucaccgucuucgucuucaagcgcgccgucauccucgucuacaaggagaacugcaagcucaagaagaagcuccccuccaacucccgccccgcccacaacuccaccgaccucgaccccuucaaguuccgcuggcucauccccaucuccgcccuccagguccgccucggcaaccccgccggcaccgagaacaacuccaucugggagcucauccacaccaaguccgagaucgagggccgccccgagaccaucuuccagcucugcugcuccgacuccgaguccaagaccaacaucgucaaggucauccgcuccauccuccgcgagaacuuccgccgccacaucaagugcgagcucccccucgagaagaccugcaaggaccgccucgucccccucaagaaccgcguccccgucuccgccaagcucgccuccucccgcucccucaagguccucaagaacuccuccuccaacgaguggaccggcgagaccggcaagggcacccuccucgacuccgacgagggcucccucuccuccggcacccaguccuccggcugccccaccgccgagggccgccaggacuccaaguccaccucccccggcaaguacccccaccccggccucgccgacuucgccgacaaccucaucaaggaguccgacauccucuccgacgaggacgacgaccaccgccagaccgucaagcagggcucccccaccaaggacaucgagauccaguuccagcgccuccgcaucuccgaggaccccgacguccaccccgaggccgagcagcagcccggccccgaguccggcgagggccagaagggcggcgagcagcccaagcucguccgcggccacuucugccccaucaagcgcaaggccaacuccaccaagcgcgaccgcggcacccuccucaaggcccagauccgccaccagucccucgacucccaguccgagaacgccaccaucgaccucaacuccguccucgagcgcgaguucuccguccagucccucaccuccgucgucuccgaggagugcuucuacgagaccgagucccacggcaaguccuga

SEQ ID NO: 50732 - RNA, 2139 nt, Artificial Sequence
  derived and/or modified sequence opt2 from TICAM1__Homo_sapiens__NP_891549
auggccugcaccggccccucccuccccuccgccuucgacauccucggcgccgccggccaggacaagcuccucuaccucaagcacaagcucaagaccccccgccccggcugccagggccaggaccuccuccacgccaugguccuccucaagcucggccaggagaccgaggcccgcaucucccucgaggcccucaaggccgacgccgucgcccgccucgucgcccgccagugggccggcgucgacuccaccgaggaccccgaggagccccccgacgucuccugggccgucgcccgccucuaccaccuccucgccgaggagaagcucugccccgccucccuccgcgacgucgccuaccaggaggccguccgcacccucuccucccgcgacgaccaccgccucggcgagcuccaggacgaggcccgcaaccgcugcggcugggacaucgccggcgaccccggcuccauccgcacccuccaguccaaccucggcugccucccccccuccuccgcccuccccuccggcacccgcucccucccccgccccaucgacggcgucuccgacuggucccagggcugcucccuccgcuccaccggcucccccgccucccucgccuccaaccucgagaucucccagucccccaccaugcccuuccucucccuccaccgcuccccccacggccccuccaagcucugcgacgacccccaggccucccucguccccgagcccguccccggcggcugccaggagcccgaggagauguccuggccccccuccggcgagaucgccuccccccccgagcuccccuccucccccccccccggccuccccgaggucgcccccgacgccaccuccaccggccuccccgacacccccgccgcccccgagaccuccaccaacuaccccgucgagugcaccgagggcuccgccggcccccagucccucccccuccccauccucgagcccgucaagaaccccugcuccgucaaggaccagaccccccuccagcucuccgucgaggacaccaccucccccaacaccaagcccugcccccccacccccaccacccccgagaccuccccccccccccccccccccccccccuccuccacccccugcuccgcccaccucacccccuccucccucuuccccuccucccucgaguccuccuccgagcagaaguucuacaacuucgucauccuccacgcccgcgccgacgagcacaucgcccuccgcguccgcgagaagcucgaggcccucggcguccccgacggcgccaccuucugcgaggacuuccagguccccggccgcggcgagcucuccugccuccaggacgccaucgaccacuccgccuucaucauccuccuccucaccuccaacuucgacugccgccucucccuccaccaggucaaccaggccaugauguccaaccucacccgccagggcucccccgacugcgucauccccuuccucccccucgaguccucccccgcccagcucuccuccgacaccgccucccuccucuccggccucguccgccucgacgagcacucccagaucuucgcccgcaaggucgccaacaccuucaagccccaccgccuccaggcccgcaaggccauguggcgcaaggagcaggacacccgcgcccuccgcgagcagucccagcaccucgacggcgagcgcaugcaggccgccgcccucaacgccgccuacuccgccuaccuccaguccuaccucuccuaccaggcccagauggagcagcuccaggucgccuucggcucccacauguccuucggcaccggcgcccccuacggcgcccgcaugcccuucggcggccaggucccccucggcgcccccccccccuuccccaccuggcccggcugcccccagccccccccccuccacgccuggcaggccggcaccccccccccccccuccccccagcccgccgccuucccccagucccuccccuucccccagucccccgccuuccccaccgccucccccgcccccccccagucccccggccuccagccccucaucauccaccacgcccagaugguccagcucggccucaacaaccacauguggaaccagcgcggcucccaggcccccgaggacaagacccaggaggccgaguga

SEQ ID NO: 50733 - RNA, 708 nt, Artificial Sequence
  derived and/or modified sequence opt2 from TICAM2__Homo_sapiens__NP_067681
augggcaucggcaaguccaagaucaacuccugcccccucucccucuccuggggcaagcgccacuccgucgacaccucccccggcuaccacgaguccgacuccaagaaguccgaggaccucucccucugcaacgucgccgagcacuccaacaccaccgagggccccaccggcaagcaggagggcgcccaguccgucgaggagauguucgaggaggaggccgaggaggaggucuuccucaaguucgucauccuccacgccgaggacgacaccgacgaggcccuccgcguccagaaccuccuccaggacgacuucggcaucaagcccggcaucaucuucgccgagaugcccugcggccgccagcaccuccagaaccucgacgacgccgucaacggcuccgccuggaccauccuccuccucaccgagaacuuccuccgcgacaccuggugcaacuuccaguucuacaccucccucaugaacuccgucaaccgccagcacaaguacaacuccgucauccccaugcgcccccucaacaacccccucccccgcgagcgcacccccuucgcccuccagaccaucaacgcccucgaggaggagucccgcggcuuccccacccaggucgagcgcaucuuccaggaguccgucuacaagacccagcagaccaucuggaaggagacccgcaacaugguccagcgccaguucaucgccuga

SEQ ID NO: 50734 - RNA, 5733 nt, Artificial Sequence
  derived and/or modified sequence opt2 from TICRR__Homo_sapiens__NP_689472
auggccugcugccacaaggucaugcuccuccucgacaccgccggcggcgccgcccgccacucccgcguccgccgcgccgcccuccgccuccucaccuaccucuccugccgcuucggccucgcccgcguccacugggccuucaaguucuucgacucccagggcgcccgcucccgccccucccgcgucuccgacuuccgcgagcucggcucccgcuccugggaggacuucgaggaggagcucgaggcccgccucgaggaccgcgcccaccuccccggccccgccccccgcgccacccacacccacggcgcccucauggagacccuccucgacuaccagugggaccgccccgagaucaccucccccaccaagcccauccuccgcuccuccggccgccgccuccucgacgucgaguccgaggccaaggaggccgaggccgcccucggcggccucgucaacgccgucuuccuccucgcccccugcccccacucccagcgcgagcuccuccaguucgucuccggcugcgaggcccaggcccagcgccucccccccacccccaagcaggucauggagaagcuccuccccaagcgcguccgcgaggucauggucgcccgcaagaucaccuucuacugggucgacaccaccgagugguccaagcucugggagucccccgaccaccucggcuacuggaccgucugcgagcuccuccaccacggcggcggcaccguccuccccuccgaguccuucuccugggacuucgcccaggccggcgagaugcuccuccgcuccggcaucaagcucuccuccgagccccaccucucccccuggaucuccaugcuccccaccgacgccacccucaaccgccuccucuacaacucccccgaguacgaggccuccuucccccgcauggagggcaugcucuuccuccccgucgaggccggcaaggagauccaggagaccuggaccgucacccucgagccccucgccaugcaccagcgccacuuccagaagcccguccgcaucuuccucaagggcuccgucgcccaguggucccuccccaccuccuccacccucggcaccgacuccuggaugcucggcucccccgaggaguccaccgccacccagcgccuccucuuccagcagcucgucucccgccucaccgccgaggagcuccaccucgucgccgacgucgaccccggcgagggccgcccccccaucaccggcgucaucuccccccucuccgccuccgccaugauccucaccgucugccgcaccaaggaggccgaguuccagcgccacguccuccagaccgccgucgccgacuccccccgcgacaccgccucccucuucuccgacgucgucgacuccauccucaaccagacccacgacucccucgccgacaccgccuccgccgccucccccguccccgagugggcccagcaggagcucggccacaccacccccuggucccccgccgucgucgagaagugguuccccuucugcaacaucuccggcgccuccuccgaccucauggaguccuucggccuccuccaggccgccuccgccaacaaggaggaguccuccaagaccgagggcgagcucauccacugccucgccgagcucuaccagcgcaagucccgcgaggaguccaccaucgcccaccaggaggacuccaagaagaagcgcggcgucccccgcacccccguccgccagaagaugaacaccaugugccgcucccucaagaugcucaacgucgcccgccucaacgucaaggcccagaagcuccaccccgacggcucccccgacgucgccggcgagaagggcauccagaagauccccuccggccgcaccgucgacaagcucgaggaccgcggccgcacccuccgcuccuccaagcccaaggacuucaagaccgaggaggagcuccucuccuacauccgcgagaacuaccagaagaccgucgccaccggcgagaucaugcucuacgccugcgcccgcaacaugaucuccaccgucaagauguuccucaaguccaagggcaccaaggagcucgaggucaacugccucaaccaggucaaguccucccuccucaagaccuccaagucccuccgccagaaccucggcaagaagcucgacaaggaggacaagguccgcgagugccagcuccaggucuuccuccgccucgagaugugccuccagugccccuccaucaacgaguccaccgacgacauggagcaggucgucgaggaggucaccgaccuccuccgcauggucugccucaccgaggacuccgccuaccucgccgaguuccucgaggagauccuccgccucuacaucgacuccauccccaagacccucggcaaccucuacaacucccucggcuucgucaucccccagaagcucgccggcguccuccccaccgacuucuucuccgacgacuccaugacccaggagaacaaguccccccuccucuccguccccuuccucuccuccgcccgccgcuccgucuccggcucccccgaguccgacgagcuccaggagcuccgcacccgcuccgccaagaagcgccgcaagaacgcccucauccgccacaaguccaucgccgaggucucccagaaccuccgccagaucgagauccccaaggucuccaagcgcgccaccaagaaggagaacucccaccccgccccccagcagcccucccagcccgucaaggacaccguccaggaggucaccaagguccgccgcaaccucuucaaccaggagcuccucucccccuccaagcgcucccucaagcgcggccucccccgcucccacuccgucuccgccgucgacggccucgaggacaagcucgacaacuucaagaagaacaagggcuaccacaagcuccucaccaaguccgucgccgagacccccguccacaagcagaucuccaagcgccuccuccaccgccagaucaagggccgcuccuccgaccccggccccgacaucggcgucgucgaggagucccccgagaagggcgacgagaucucccuccgccgcuccccccgcaucaagcagcucuccuucucccgcacccacuccgccuccuucuacuccgucucccagcccaagucccgcuccguccagcgcguccacuccuuccagcaggacaaguccgaccagcgcgagaacucccccguccaguccauccgcucccccaagucccuccucuucggcgccauguccgagaugaucucccccuccgagaagggcuccgcccgcaugaagaagcgcucccgcaacacccucgacuccgagguccccgccgccuaccagacccccaagaagucccaccagaagucccucuccuucuccaagaccaccccccgccgcaucucccacaccccccagaccccccucuacacccccgagcgccuccagaagucccccgccaagaugacccccaccaagcaggccgccuucaaggagucccucaaggacuccuccucccccggccacgacuccccccucgacuccaagaucaccccccagaagcgccacacccaggccggcgagggcaccucccucgagaccaagaccccccgcacccccaagcgccagggcacccagccccccggcuuccuccccaacugcaccuggccccacuccgucaacuccucccccgagucccccuccugccccgccccccccaccuccuccaccgcccagccccgccgcgagugccucacccccauccgcgacccccuccgcacccccccccgcgccgccgccuucaugggcaccccccagaaccagacccaccagcagccccacguccuccgcgccgcccgcgccgaggagcccgcccagaagcucaaggacaaggccaucaagacccccaagcgccccggcaacuccaccgucaccuccuccccccccgucacccccaagaagcucuucaccuccccccucugcgacgucuccaagaagucccccuuccgcaaguccaagaucgagugccccucccccggcgagcucgaccagaaggagccccagaugucccccuccgucgccgccucccucuccugccccguccccuccaccccccccgagcucucccagcgcgccacccucgacaccguccccccccccccccccuccaaggucggcaagcgcugccgcaagaccuccgacccccgccgcuccaucgucgagugccagcccgacgccuccgccacccccggcgucggcaccgccgacucccccgccgcccccaccgacucccgcgacgaccagaagggccucucccucuccccccaguccccccccgagcgccgcggcuaccccggccccggccuccgcuccgacuggcacgccuccuccccccuccucaucaccuccgacaccgagcacgucacccuccucuccgaggccgagcaccacggcaucggcgaccucaaguccaacguccucuccgucgaggagggcgagggccuccgcaccgccgacgccgagaaguccucccucucccaccccggcaucccccccuccccccccuccugcggccccggcuccccccucaugcccucccgcgacguccacugcaccaccgacggccgccagugccaggccuccgcccagcucgacaaccuccccgccuccgccuggcacuccaccgacuccgccuccccccagaccuacgaggucgagcucgagaugcaggccuccggccuccccaagcuccgcaucaagaagaucgaccccuccuccucccucgaggccgagccccucuccaaggaggaguccucccucggcgaggaguccuuccuccccgcccucuccaugccccgcgccucccgcucccucuccaagcccgagcccaccuacgucuccccccccugcccccgccucucccacuccacccccggcaagucccgcggccagaccuacaucugccaggccugcacccccacccacggccccuccuccacccccucccccuuccagaccgacggcguccccuggacccccucccccaagcacuccggcaagaccacccccgacaucaucaaggacuggccccgccgcaagcgcgccgucggcugcggcgccggcuccuccuccggccgcggcgaggucggcgccgaccuccccggcucccucucccuccucgaguccgagggcaaggaccacggccucgagcucuccauccaccgcacccccauccucgaggacuucgagcucgagggcgucugccagcuccccgaccagucccccccccgcaacuccaugcccaaggccgaggaggccuccuccuggggccaguucggccucuccucccgcaagcgcguccuccucgccaaggaggaggccgaccgcggcgccaagcgcaucugcgaccuccgcgaggacuccgaggucuccaaguccaaggagggcucccccuccugguccgccuggcagcuccccuccaccggcgacgaggaggucuucgucuccggcuccacccccccccccuccugcgccguccgcuccugccucuccgccuccgcccuccaggcccucacccaguccccccuccucuuccagggcaagacccccuccucccaguccaaggacccccgcgacgaggacgucgacguccuccccuccaccgucgaggacucccccuucucccgcgccuucucccgccgccgccccaucucccgcaccuacacccgcaagaagcucaugggcaccuggcucgaggaccucuga

SEQ ID NO: 50735 - RNA, 555 nt, Artificial Sequence
  derived and/or modified sequence opt2 from TIFA__Homo_sapiens__NP_443096
augaccuccuucgaggacgccgacaccgaggagaccgucaccugccuccagaugaccgucuaccaccccggccagcuccagugcggcaucuuccaguccaucuccuucaaccgcgagaagcuccccuccuccgaggucgucaaguucggccgcaacuccaacaucugccacuacaccuuccaggacaagcaggucucccgcguccaguucucccuccagcucuucaagaaguucaacuccuccguccucuccuucgagaucaagaacauguccaagaagaccaaccucaucgucgacucccgcgagcucggcuaccucaacaagauggaccuccccuaccgcugcaugguccgcuucggcgaguaccaguuccucauggagaaggaggacggcgagucccucgaguucuucgagacccaguucauccucuccccccgcucccuccuccaggagaacaacuggcccccccaccgccccauccccgaguacggcaccuacucccucugcuccucccaguccuccucccccaccgagauggacgagaacgaguccuga

SEQ ID NO: 50736 - RNA, 1578 nt, Artificial Sequence
  derived and/or modified sequence opt2 from TIGD2__Homo_sapiens__NP_663761
augcucggcaagcgcaagcgcgucguccucaccaucaaggacaagcucgacaucaucaagaagcucgaggagggcaucuccuucaagaagcucuccgucgucuacggcaucggcgaguccaccguccgcgacaucaagaagaacaaggagcgcaucaucaacuacgccaacuccuccgaccccaccuccggcgucuccaagcgcaaguccaugaaguccuccaccuacgaggagcucgaccgcgucaugaucgagugguucaaccagcagaagaccgacggcauccccgucuccggcaccaucugcgccaagcaggccaaguucuucuucgacgcccucggcauggagggcgacuucaacgccuccuccggcuggcucacccgcuucaagcagcgccacggcauccccaaggccgccggcaagggcaccaagcucaagggcgacgagaccgccgcccgcgaguucugcggcuccuuccaggaguucgucgagaaggagaaccuccagcccgagcagaucuacggcgccgaccagaccggccucuucuggaagugccuccccucccgcacccucacccucgagaccgaccaguccaccuccggcugccgcuccucccgcgagcgcaucaucaucaugugcugcgccaacgccaccggccuccacaagcucaaccucugcgucgucggcaaggccaagaagccccgcgccuucaagggcaccgaccucuccaaccuccccgucaccuacuacucccagaagggcgccuggaucgagcaguccgucuuccgccagugguucgagaaguacuucgucccccagguccagaagcaccucaaguccaagggccuccucgagaaggccguccuccuccucgacuucccccccgcccgccccaacgaggagaugcucuccuccgacgacggccgcaucaucgucaaguaccucccccccaacgucaccucccucauccagcccaugucccagggcguccucgccaccgucaagcgcuacuaccgcgccggccuccuccagaaguacauggacgagggcaacgaccccaagaucuucuggaagaaccucaccguccucgacgccaucuacgaggucucccgcgccuggaacauggucaaguccuccaccaucaccaaggccuggaagaagcucuuccccggcaacgaggagaacuccggcaugaacaucgacgagggcgccauccucgccgccaaccucgccaccguccuccagaacaccgaggagugcgagcacgucgacaucgagaacaucgaccagugguucgacucccgcuccuccgacuccuccugccagguccucaccgacuccgaguccgccgaggaccagaccaaggccgccgagcagaagcccuccuccaagucccgcaagaccgagcucaaccccgagaagcacaucucccacaaggccgcccucgaguggaccgagaaccuccucgacuaccucgagcagcaggacgacaugcuccucuccgacaagcucguccuccgccgccuccgcaccaucauccgcaagaagcagaagauccagaacaacaagaaccacuga

SEQ ID NO: 50737 - RNA, 735 nt, Artificial Sequence
  derived and/or modified sequence opt2 from TIGIT__Homo_sapiens__NP_776160
augcgcuggugccuccuccucaucugggcccagggccuccgccaggccccccucgccuccggcaugaugaccggcaccaucgagaccaccggcaacaucuccgccgagaagggcggcuccaucauccuccagugccaccucuccuccaccaccgcccaggucacccaggucaacugggagcagcaggaccagcuccucgccaucugcaacgccgaccucggcuggcacaucucccccuccuucaaggaccgcgucgcccccggccccggccucggccucacccuccagucccucaccgucaacgacaccggcgaguacuucugcaucuaccacaccuaccccgacggcaccuacaccggccgcaucuuccucgagguccucgaguccuccgucgccgagcacggcgcccgcuuccagaucccccuccucggcgccauggccgccacccucgucgucaucugcaccgccgucaucgucgucgucgcccucacccgcaagaagaaggcccuccgcauccacuccgucgagggcgaccuccgccgcaaguccgccggccaggaggaguggucccccuccgcccccuccccccccggcuccugcguccaggccgaggccgcccccgccggccucugcggcgagcagcgcggcgaggacugcgccgagcuccacgacuacuucaacguccucuccuaccgcucccucggcaacugcuccuucuucaccgagaccggcuga

SEQ ID NO: 50738 - RNA, 1053 nt, Artificial Sequence
  derived and/or modified sequence opt2 from TIMD4__Homo_sapiens__NP_001140198
auguccaaggagccccucauccucuggcucaugaucgaguucugguggcucuaccucacccccgucaccuccgagaccgucgucaccgagguccucggccaccgcgucacccuccccugccucuacuccuccuggucccacaacuccaacuccaugugcuggggcaaggaccagugccccuacuccggcugcaaggaggcccucauccgcaccgacggcaugcgcgucaccucccgcaaguccgccaaguaccgccuccagggcaccaucccccgcggcgacgucucccucaccauccucaaccccuccgaguccgacuccggcgucuacugcugccgcaucgagguccccggcugguucaacgacgucaagaucaacguccgccucaaccuccagcgcgccuccaccaccacccaccgcaccgccaccaccaccacccgccgcaccaccaccaccucccccaccaccacccgccagaugaccaccacccccgccgcccuccccaccaccgucgucaccacccccgaccucaccaccggcaccccccuccagaugaccaccaucgccgucuucaccaccgccaacaccugccucucccucacccccuccacccuccccgaggaggccaccggccuccucacccccgagcccuccaaggagggccccauccucaccgccgaguccgagaccguccuccccuccgacuccugguccuccgucgaguccaccuccgccgacaccguccuccucaccuccaaggccuccgacaccgccguccccgagcagaacaagaccaccaagaccggccagauggacggcauccccauguccaugaagaacgagaugcccaucucccagcuccucaugaucaucgcccccucccucggcuucguccucuucgcccucuucgucgccuuccuccuccgcggcaagcucauggagaccuacugcucccagaagcacacccgccucgacuacaucggcgacuccaagaacguccucaacgacguccagcacggccgcgaggacgaggacggccucuucacccucuga

SEQ ID NO: 50739 - RNA, 3627 nt, Artificial Sequence
  derived and/or modified sequence opt2 from TIMELESS__Homo_sapiens__NP_003911
auggaccuccacaugaugaacugcgagcuccucgccaccugcuccgcccucggcuaccucgagggcgacaccuaccacaaggagcccgacugccucgaguccgucaaggaccucauccgcuaccuccgccacgaggacgagacccgcgacguccgccagcagcucggcgccgcccagauccuccaguccgaccuccuccccauccucacccagcaccaccaggacaagccccucuucgacgccgucauccgccucauggucaaccucacccagcccgcccuccucugcuucggcaaccuccccaaggagcccuccuuccgccaccacuuccuccagguccucaccuaccuccaggccuacaaggaggccuucgccuccgagaaggccuucggcguccucuccgagacccucuacgagcuccuccagcucggcugggaggagcgccaggaggaggacaaccuccucaucgagcgcauccuccuccucguccgcaacauccuccacguccccgccgaccucgaccaggagaagaagaucgacgacgacgccuccgcccacgaccagcuccucugggccauccaccucuccggccucgacgaccuccuccucuuccucgccuccuccuccgccgaggagcaguggucccuccacguccucgagaucgucucccucauguuccgcgaccagaaccccgagcagcucgccggcgucggccagggccgccucgcccaggagcgcuccgccgacuucgccgagcucgagguccuccgccagcgcgagauggccgagaagaagacccgcgcccuccagcgcggcaaccgccacucccgcuucggcggcuccuacaucguccagggccucaaguccaucggcgagcgcgaccucaucuuccacaagggccuccacaaccuccgcaacuacuccuccgaccucggcaagcagcccaagaagguccccaagcgccgccaggccgcccgcgagcucuccauccagcgccgcuccgcccucaacguccgccucuuccuccgcgacuucugcuccgaguuccucgagaacugcuacaaccgccucaugggcuccgucaaggaccaccuccuccgcgagaaggcccagcagcacgacgagaccuacuacaugugggcccucgccuucuucauggccuucaaccgcgccgccuccuuccgccccggccucgucuccgagacccucuccguccgcaccuuccacuucaucgagcagaaccucaccaacuacuacgagaugaugcucaccgaccgcaaggaggccgccuccugggcccgccgcaugcaccucgcccucaaggccuaccaggagcuccucgccaccgucaacgagauggacaucucccccgacgaggccguccgcgaguccucccgcaucaucaagaacaacaucuucuacgucauggaguaccgcgagcucuuccucgcccucuuccgcaaguucgacgagcgcugccagccccgcuccuuccuccgcgaccucgucgagaccacccaccucuuccucaagaugcucgagcgcuucugccgcucccgcggcaaccucgucguccagaacaagcagaagaagcgccgcaagaagaagaagaagguccucgaccaggccaucgucuccggcaacguccccuccucccccgaggaggucgaggccgucuggcccgcccucgccgagcagcuccagugcugcgcccagaacuccgagcucuccauggacuccgucguccccuucgacgccgccuccgagguccccgucgaggagcagcgcgccgaggccaugguccgcauccaggacugccuccucgccggccaggccccccaggcccucacccuccuccgcuccgcccgcgaggucuggcccgagggcgacgucuucggcucccaggacaucucccccgaggaggagauccagcuccucaagcagauccucuccgccccccucccccgccagcagggccccgaggagcgcggcgccgaggaggaggaggaggaggaggaggaggaggaggaggagcuccaggucguccaggucuccgagaaggaguucaacuuccucgacuaccucaagcgcuucgccugcuccaccgucguccgcgccuacguccuccuccuccgcuccuaccagcagaacuccgcccacaccaaccacugcaucgucaagaugcuccaccgccucgcccacgaccucaagauggaggcccuccucuuccagcucuccgucuucugccucuucaaccgccuccucuccgaccccgccgccggcgccuacaaggagcucgucaccuucgccaaguacauccucggcaaguucuucgcccucgccgccgucaaccagaaggccuucgucgagcuccucuucuggaagaacaccgccgucguccgcgagaugaccgagggcuacggcucccucgacgaccgcuccuccucccgccgcgcccccaccuggucccccgaggaggaggcccaccuccgcgagcucuaccucgccaacaaggacgucgagggccaggacgucgucgaggccauccucgcccaccucaacaccgucccccgcacccgcaagcagaucauccaccaccucguccagaugggccucgccgacuccgucaaggacuuccagcgcaagggcacccacaucguccucuggaccggcgaccaggagcucgagcuccagcgccucuucgaggaguuccgcgacuccgacgacguccucggccacaucaugaagaacaucaccgccaagcgcucccgcgcccgcaucgucgacaagcuccucgcccucggccucgucgccgagcgccgcgagcucuacaagaagcgccagaagaagcucgccuccuccauccuccccaacggcgccgagucccucaaggacuucugccaggaggaccucgaggaggaggagaaccuccccgaggaggacuccgaggaggaggaggagggcggcuccgaggccgagcagguccagggcucccucguccucuccaacgagaaccucggccagucccuccaccaggagggcuucuccaucccccuccucuggcuccagaacugccucauccgcgccgccgacgaccgcgaggaggacggcugcucccaggccgucccccucgucccccucaccgaggagaacgaggaggccauggagaacgagcaguuccagcagcuccuccgcaagcucggcguccgcccccccgccuccggccaggagaccuucuggcgcauccccgccaagcucucccccacccagcuccgccgcgccgccgccucccucucccagcccgaggaggagcagaagcuccagcccgagcuccagcccaagguccccggcgagcagggcuccgacgaggagcacugcaaggagcaccgcgcccaggcccuccgcgcccuccuccucgcccacaagaagaaggccggccucgccucccccgaggaggaggacgccgucggcaaggagccccucaaggccgcccccaagaagcgccagcuccucgacuccgacgaggagcaggaggaggacgagggccgcaaccgcgcccccgagcucggcgcccccggcauccagaagaagaagcgcuaccagaucgaggacgacgaggacgacuga

SEQ ID NO: 50740 - RNA, 273 nt, Artificial Sequence
  derived and/or modified sequence opt2 from TIMM10__Homo_sapiens__NP_036588
auggacccccuccgcgcccagcagcucgccgccgagcucgaggucgagaugauggccgacauguacaaccgcaugaccuccgccugccaccgcaagugcguccccccccacuacaaggaggccgagcucuccaagggcgaguccgucugccucgaccgcugcgucuccaaguaccucgacauccacgagcgcaugggcaagaagcucaccgagcucuccaugcaggacgaggagcucaugaagcgcguccagcaguccuccggccccgccuga

SEQ ID NO: 50741 - RNA, 516 nt, Artificial Sequence
  derived and/or modified sequence opt2 from TIMM17A__Homo_sapiens__NP_006326
auggaggaguacgcccgcgagcccugccccuggcgcaucgucgacgacugcggcggcgccuucaccaugggcaccaucggcggcggcaucuuccaggccaucaagggcuuccgcaacucccccgucggcgucaaccaccgccuccgcggcucccucaccgccaucaagacccgcgccccccagcucggcggcuccuucgccgucuggggcggccucuucuccaugaucgacugcuccaugguccagguccgcggcaaggaggaccccuggaacuccaucaccuccggcgcccucaccggcgccauccucgccgcccgcaacggccccgucgccauggucggcuccgccgccaugggcggcauccuccucgcccucaucgagggcgccggcauccuccucacccgcuucgccuccgcccaguuccccaacggcccccaguucgccgaggaccccucccagcuccccuccacccagcuccccuccucccccuucggcgacuaccgccaguaccaguga

SEQ ID NO: 50742 - RNA, 747 nt, Artificial Sequence
  derived and/or modified sequence opt2 from TIMM21__Homo_sapiens__NP_054896
augaucugcaccuuccuccgcgccguccaguacaccgagaagcuccaccgcuccuccgccaagcgccuccuccuccccuacaucguccucaacaaggccugccucaagaccgagcccucccuccgcugcggccuccaguaccagaagaagacccuccgcccccgcugcauccucggcgucacccagaagaccaucuggacccagggccccuccccccgcaaggccaaggaggacggcuccaagcaggucuccguccaccgcucccagcgcggcggcaccgccguccccaccucccagaaggucaaggaggccggccgcgacuucaccuaccucaucgucguccucuucggcaucuccaucaccggcggccucuucuacaccaucuucaaggagcucuucuccuccuccucccccuccaagaucuacggccgcgcccucgagaagugccgcucccaccccgaggucaucggcgucuucggcgaguccgucaagggcuacggcgaggucacccgccgcggccgccgccagcacguccgcuucaccgaguacgucaaggacggccucaagcacaccugcgucaaguucuacaucgagggcuccgagcccggcaagcagggcaccgucuacgcccaggucaaggagaaccccggcuccggcgaguacgacuuccgcuacaucuucgucgagaucgaguccuacccccgccgcaccaucaucaucgaggacaaccgcucccaggacgacuga

SEQ ID NO: 50743 - RNA, 585 nt, Artificial Sequence
  derived and/or modified sequence opt2 from TIMM22__Homo_sapiens__NP_037469
auggccgccgccgcccccaacgccggcggcuccgcccccgagaccgccggcuccgccgaggccccccuccaguacucccuccuccuccaguaccucgucggcgacaagcgccagccccgccuccucgagcccggcucccucggcggcauccccucccccgccaaguccgaggagcagaagaugaucgagaaggccauggaguccugcgccuucaaggccgcccucgccugcgucggcggcuucguccucggcggcgccuucggcgucuucaccgccggcaucgacaccaacgucggcuucgaccccaaggaccccuaccgcacccccaccgccaaggagguccucaaggacaugggccagcgcggcauguccuacgccaagaacuucgccaucgucggcgccauguucuccugcaccgagugccucaucgaguccuaccgcggcaccuccgacuggaagaacuccgucaucuccggcugcaucaccggcggcgccaucggcuuccgcgccggccucaaggccggcgccaucggcugcggcggcuucgccgccuucuccgccgccaucgacuacuaccuccgcuga

SEQ ID NO: 50744 - RNA, 630 nt, Artificial Sequence
  derived and/or modified sequence opt2 from TIMM23__Homo_sapiens__NP_006318
auggagggcggcggcggcuccggcaacaagaccaccggcggccucgccggcuucuucggcgccggcggcgccggcuacucccacgccgaccucgccggcgucccccucaccggcaugaacccccucucccccuaccucaacgucgacccccgcuaccucguccaggacaccgacgaguucauccuccccaccggcgccaacaagacccgcggccgcuucgagcucgccuucuucaccaucggcggcugcugcaugaccggcgccgccuucggcgccaugaacggccuccgccucggccucaaggagacccagaacauggccugguccaagccccgcaacguccagauccucaacauggucacccgccagggcgcccucugggccaacacccucggcucccucgcccuccucuacuccgccuucggcgucaucaucgagaagacccgcggcgccgaggacgaccucaacaccgucgccgccggcaccaugaccggcaugcucuacaagugcaccggcggccuccgcggcaucgcccgcggcggccucaccggccucacccucaccucccucuacgcccucuacaacaacugggagcacaugaagggcucccuccuccagcagucccucuga

SEQ ID NO: 50745 - RNA, 1359 nt, Artificial Sequence
  derived and/or modified sequence opt2 from TIMM44__Homo_sapiens__NP_006342
auggccgccgccgcccuccgcuccggcuggugccgcugcccccgccgcugccucggcuccggcauccaguuccucuccucccacaaccucccccacggcuccaccuaccagaugcgccgccccggcggcgagcucccccucuccaaguccuacuccuccggcaaccgcaagggcuuccucuccggccuccucgacaacgucaagcaggagcucgccaagaacaaggagaugaaggaguccaucaagaaguuccgcgacgaggcccgccgccucgaggaguccgacguccuccaggaggcccgccgcaaguacaagaccaucgaguccgagaccguccgcaccuccgagguccuccgcaagaagcucggcgagcucaccggcaccgucaaggagucccuccacgaggucuccaaguccgaccucggccgcaagaucaaggagggcgucgaggaggccgccaagaccgccaagcaguccgccgaguccgucuccaagggcggcgagaagcucggccgcaccgccgccuuccgcgcccucucccagggcgucgaguccgucaagaaggagaucgacgacuccguccucggccagaccggccccuaccgccgcccccagcgccuccgcaagcgcaccgaguucgccggcgacaaguucaaggaggagaaggucuucgagcccaacgaggaggcccucggcgucguccuccacaaggacuccaagugguaccagcaguggaaggacuucaaggagaacaacgucgucuucaaccgcuucuucgagaugaagaugaaguacgacgaguccgacaacgccuucauccgcgccucccgcgcccucaccgacaaggucaccgaccuccucggcggccucuucuccaagaccgagauguccgagguccucaccgagauccuccgcgucgaccccgccuucgacaaggaccgcuuccucaagcagugcgagaacgacaucauccccaacguccucgaggccaugaucuccggcgagcucgacauccucaaggacuggugcuacgaggccaccuacucccagcucgcccaccccauccagcaggccaaggcccucggccuccaguuccacucccgcauccucgacaucgacaacgucgaccucgccaugggcaagaugauggagcagggccccguccucaucaucaccuuccaggcccagcucgucauggucguccgcaaccccaagggcgaggucgucgagggcgaccccgacaagguccuccgcaugcucuacgucugggcccucugccgcgaccaggacgagcucaaccccuacgccgccuggcgccuccucgacaucuccgccuccuccaccgagcagauccucuga

SEQ ID NO: 50746 - RNA, 1371 nt, Artificial Sequence
  derived and/or modified sequence opt2 from TIMM50__Homo_sapiens__NP_001001563
auggccuccgcccucucccucggcaacaagugcgaccccuuccuccgcugcguccucugccgcggcggcggcgcccuccagggcccccgcggccgcggccccgacgacuucgagucccagcucuccccccccggcuccgcccgccgccucguccgcuccaagcgcgccugcggcaacccccccgacgccuucggccucucccgcgccuccguccaccccccccucccccgcgucuccaucggcugcuccuccggccccggccgcgccaagcgcgagcgcgucggcggcgccgccuggcgccagcgcaagauggccgccuccgccgccgucuucucccgccuccgcuccggccuccgccucggcucccgcggccucugcacccgccucgccacccccccccgccgcgcccccgaccaggccgccgagaucggcucccgcggcuccaccaaggcccagggcccccagcagcagcccggcuccgagggccccuccuacgccaagaaggucgcccucuggcucgccggccuccucggcgccggcggcaccgucuccgucgucuacaucuucggcaacaaccccgucgacgagaacggcgccaagauccccgacgaguucgacaacgaccccauccucguccagcagcuccgccgcaccuacaaguacuucaaggacuaccgccagaugaucaucgagcccaccucccccugccuccuccccgacccccuccaggagcccuacuaccagccccccuacacccucguccucgagcucaccggcguccuccuccaccccgaguggucccucgccaccggcuggcgcuucaagaagcgccccggcaucgagacccucuuccagcagcucgccccccucuacgagaucgucaucuucaccuccgagaccggcaugaccgccuucccccucaucgacuccgucgacccccacggcuucaucuccuaccgccucuuccgcgacgccacccgcuacauggacggccaccacgucaaggacaucuccugccucaaccgcgaccccgcccgcgucgucgucgucgacugcaagaaggaggccuuccgccuccagcccuacaacggcgucgcccuccgccccugggacggcaacuccgacgaccgcguccuccucgaccucuccgccuuccucaagaccaucgcccucaacggcgucgaggacguccgcaccguccucgagcacuacgcccucgaggacgacccccucgccgccuucaagcagcgccagucccgccucgagcaggaggagcagcagcgccucgccgagcucuccaaguccaacaagcagaaccucuuccucggcucccucaccucccgccucuggccccgcuccaagcagcccuga

SEQ ID NO: 50747 - RNA, 294 nt, Artificial Sequence
  derived and/or modified sequence opt2 from TIMM8A__Homo_sapiens__NP_004076
auggacuccuccuccuccuccuccgccgccggccucggcgccgucgacccccagcuccagcacuucaucgaggucgagacccagaagcagcgcuuccagcagcucguccaccagaugaccgagcucugcugggagaagugcauggacaagcccggccccaagcucgacucccgcgccgaggccugcuucgucaacugcgucgagcgcuucaucgacaccucccaguucauccucaaccgccucgagcagacccagaaguccaagcccgucuucuccgagucccucuccgacuga

SEQ ID NO: 50748 - RNA, 297 nt, Artificial Sequence
  derived and/or modified sequence opt2 from TIMM8B__Homo_sapiens__NP_036591
augcgcaagcacuccugccgcaaggucgccucccuccgccgcaccauggccgagcucggcgaggccgacgaggccgagcuccagcgccucgucgccgccgagcagcagaaggcccaguucaccgcccagguccaccacuucauggagcucugcugggacaagugcgucgagaagcccggcaaccgccucgacucccgcaccgagaacugccucuccuccugcgucgaccgcuucaucgacaccacccucgccaucaccucccgcuucgcccagaucguccagaagggcggccaguga

SEQ ID NO: 50749 - RNA, 858 nt, Artificial Sequence
  derived and/or modified sequence opt2 from TIMMDC1__Homo_sapiens__NP_057673
auggagguccccccccccgccccccgcuccuuccucugccgcgcccucugccucuucccccgcgucuucgccgccgaggccgucaccgccgacuccgagguccucgaggagcgccagaagcgccuccccuacguccccgagcccuacuaccccgaguccggcugggaccgccuccgcgagcucuucggcaaggacgagcagcagcgcaucuccaaggaccucgccaacaucugcaagaccgccgccaccgccggcaucaucggcugggucuacggcggcauccccgccuucauccacgccaagcagcaguacaucgagcagucccaggccgagaucuaccacaaccgcuucgacgccguccaguccgcccaccgcgccgccacccgcggcuucauccgcuacggcuggcgcuggggcuggcgcaccgccgucuucgucaccaucuucaacaccgucaacaccucccucaacgucuaccgcaacaaggacgcccucucccacuucgucaucgccggcgccgucaccggcucccucuuccgcaucaacgucggccuccgcggccucgucgccggcggcaucaucggcgcccuccucggcacccccgucggcggccuccucauggccuuccagaaguacuccggcgagaccguccaggagcgcaagcagaaggaccgcaaggcccuccacgagcucaagcucgaggaguggaagggccgccuccaggucaccgagcaccuccccgagaagaucgaguccucccuccaggaggacgagcccgagaacgacgccaagaagaucgaggcccuccucaaccucccccgcaaccccuccgucaucgacaagcaggacaaggacuga

SEQ ID NO: 50750 - RNA, 624 nt, Artificial Sequence
  derived and/or modified sequence opt2 from TIMP1__Homo_sapiens__NP_003245
auggcccccuucgagccccucgccuccggcauccuccuccuccucuggcucaucgcccccucccgcgccugcaccugcguccccccccacccccagaccgccuucugcaacuccgaccucgucauccgcgccaaguucgucggcacccccgaggucaaccagaccacccucuaccagcgcuacgagaucaagaugaccaagauguacaagggcuuccaggcccucggcgacgccgccgacauccgcuucgucuacacccccgccauggaguccgucugcggcuacuuccaccgcucccacaaccgcuccgaggaguuccucaucgccggcaagcuccaggacggccuccuccacaucaccaccugcuccuucgucgcccccuggaacucccucucccucgcccagcgccgcggcuucaccaagaccuacaccgucggcugcgaggagugcaccgucuuccccugccucuccauccccugcaagcuccaguccggcacccacugccucuggaccgaccagcuccuccagggcuccgagaagggcuuccagucccgccaccucgccugccucccccgcgagcccggccucugcaccuggcagucccuccgcucccagaucgccuga

SEQ ID NO: 50751 - RNA, 663 nt, Artificial Sequence
  derived and/or modified sequence opt2 from TIMP2__Homo_sapiens__NP_003246
augggcgccgccgcccgcacccuccgccucgcccucggccuccuccuccucgccacccuccuccgccccgccgacgccugcuccugcucccccguccacccccagcaggccuucugcaacgccgacgucgucauccgcgccaaggccgucuccgagaaggaggucgacuccggcaacgacaucuacggcaaccccaucaagcgcauccaguacgagaucaagcagaucaagauguucaagggccccgagaaggacaucgaguucaucuacaccgcccccuccuccgccgucugcggcgucucccucgacgucggcggcaagaaggaguaccucaucgccggcaaggccgagggcgacggcaagaugcacaucacccucugcgacuucaucguccccugggacacccucuccaccacccagaagaagucccucaaccaccgcuaccagaugggcugcgagugcaagaucacccgcugccccaugauccccugcuacaucuccucccccgacgagugccucuggauggacugggucaccgagaagaacaucaacggccaccaggccaaguucuucgccugcaucaagcgcuccgacggcuccugcgccugguaccgcggcgccgccccccccaagcaggaguuccucgacaucgaggaccccuga

SEQ ID NO: 50752 - RNA, 636 nt, Artificial Sequence
  derived and/or modified sequence opt2 from TIMP3__Homo_sapiens__NP_000353
augacccccuggcucggccucaucguccuccucggcuccuggucccucggcgacuggggcgccgaggccugcaccugcucccccucccacccccaggacgccuucugcaacuccgacaucgucauccgcgccaaggucgucggcaagaagcucgucaaggagggccccuucggcacccucgucuacaccaucaagcagaugaagauguaccgcggcuucaccaagaugccccacguccaguacauccacaccgaggccuccgagucccucugcggccucaagcucgaggucaacaaguaccaguaccuccucaccggccgcgucuacgacggcaagauguacaccggccucugcaacuucgucgagcgcugggaccagcucacccucucccagcgcaagggccucaacuaccgcuaccaccucggcugcaacugcaagaucaaguccugcuacuaccuccccugcuucgucaccuccaagaacgagugccucuggaccgacaugcucuccaacuucggcuaccccggcuaccaguccaagcacuacgccugcauccgccagaagggcggcuacugcuccugguaccgcggcugggccccccccgacaaguccaucaucaacgccaccgaccccuga

SEQ ID NO: 50753 - RNA, 675 nt, Artificial Sequence
  derived and/or modified sequence opt2 from TIMP4__Homo_sapiens__NP_003247
augcccggcuccccccgccccgcccccuccuggguccuccuccuccgccuccucgcccuccuccgcccccccggccucggcgaggccugcuccugcgcccccgcccacccccagcagcacaucugccacuccgcccucgucauccgcgccaagaucuccuccgagaaggucguccccgccuccgccgaccccgccgacaccgagaagaugcuccgcuacgagaucaagcagaucaagauguucaagggcuucgagaaggucaaggacguccaguacaucuacacccccuucgacuccucccucugcggcgucaagcucgaggccaacucccagaagcaguaccuccucaccggccagguccucuccgacggcaaggucuucauccaccucugcaacuacaucgagcccugggaggaccucucccucguccagcgcgagucccucaaccaccacuaccaccucaacugcggcugccagaucaccaccugcuacaccguccccugcaccaucuccgcccccaacgagugccucuggaccgacuggcuccucgagcgcaagcucuacggcuaccaggcccagcacuacgucugcaugaagcacgucgacggcaccugcuccugguaccgcggccaccucccccuccgcaaggaguucgucgacaucguccagcccuga

SEQ ID NO: 50754 - RNA, 1431 nt, Artificial Sequence
  derived and/or modified sequence opt2 from TINAG__Homo_sapiens__NP_055279
auguggaccggcuacaagauccucaucuucuccuaccucaccaccgagaucuggauggagaagcaguaccucucccagcgcgaggucgaccucgaggccuacuucacccgcaaccacaccguccuccagggcacccgcuucaagcgcgccaucuuccagggccaguacugccgcaacuucggcugcugcgaggaccgcgacgacggcugcgucaccgaguucuacgccgccaacgcccucugcuacugcgacaaguucugcgaccgcgagaacuccgacugcugccccgacuacaaguccuucugccgcgaggagaaggaguggcccccccacacccagcccugguaccccgagggcugcuucaaggacggccagcacuacgaggagggcuccgucaucaaggagaacugcaacuccugcaccugcuccggccagcaguggaagugcucccagcacgucugccucguccgcuccgagcucaucgagcaggucaacaagggcgacuacggcuggaccgcccagaacuacucccaguucuggggcaugacccucgaggacggcuucaaguuccgccucggcacccucccccccucccccaugcuccucuccaugaacgagaugaccgccucccuccccgccaccaccgaccuccccgaguucuucgucgccuccuacaaguggcccggcuggacccacggcccccucgaccagaagaacugcgccgccuccugggccuucuccaccgccuccgucgccgccgaccgcaucgccauccaguccaagggccgcuacaccgccaaccucuccccccagaaccucaucuccugcugcgccaagaaccgccacggcugcaacuccggcuccaucgaccgcgccuggugguaccuccgcaagcgcggccucgucucccacgccugcuacccccucuucaaggaccagaacgccaccaacaacggcugcgccauggccucccgcuccgacggccgcggcaagcgccacgccaccaagcccugccccaacaacgucgagaaguccaaccgcaucuaccagugcuccccccccuaccgcgucuccuccaacgagaccgagaucaugaaggagaucaugcagaacggccccguccaggccaucaugcagguccgcgaggacuucuuccacuacaagaccggcaucuaccgccacgucaccuccaccaacaaggaguccgagaaguaccgcaagcuccagacccacgccgucaagcucaccggcuggggcacccuccgcggcgcccagggccagaaggagaaguucuggaucgccgccaacuccuggggcaaguccuggggcgagaacggcuacuuccgcauccuccgcggcgucaacgaguccgacaucgagaagcucaucaucgccgccuggggccagcucaccuccuccgacgagcccuga

SEQ ID NO: 50755 - RNA, 1356 nt, Artificial Sequence
  derived and/or modified sequence opt2 from TINF2__Homo_sapiens__NP_001092744
auggccaccccccucgucgccggccccgccgcccuccgcuucgccgccgccgccuccuggcaggucguccgcggccgcugcgucgagcacuucccccgcguccucgaguuccuccgcucccuccgcgccgucgcccccggccucguccgcuaccgccaccacgagcgccucugcaugggccucaaggccaaggucgucgucgagcucauccuccagggccgccccugggcccagguccucaaggcccucaaccaccacuuccccgaguccggccccaucguccgcgaccccaaggccaccaagcaggaccuccgcaagauccucgaggcccaggagaccuucuaccagcaggucaagcagcucuccgaggcccccgucgaccucgccuccaagcuccaggagcucgagcaggaguacggcgagcccuuccucgccgccauggagaagcuccucuucgaguaccucugccagcucgagaaggcccuccccaccccccaggcccagcagcuccaggacguccucuccuggaugcagcccggcgucuccaucaccuccucccucgccuggcgccaguacggcgucgacaugggcuggcuccuccccgagugcuccgucaccgacuccgucaaccucgccgagcccauggagcagaaccccccccagcagcagcgccucgcccuccacaacccccuccccaaggccaagcccggcacccaccucccccagggccccuccucccgcacccaccccgagccccucgccggccgccacuucaaccucgccccccucggccgccgccgcguccagucccagugggccuccacccgcggcggccacaaggagcgccccaccgucaugcucuuccccuuccgcaaccucggcucccccacccaggucaucuccaagcccgaguccaaggaggagcacgccaucuacaccgccgaccucgccaugggcacccgcgccgccuccaccggcaaguccaagucccccugccagacccucggcggccgcgcccucaaggagaaccccgucgaccuccccgccaccgagcagaaggagaacugccucgacugcuacauggacccccuccgccucucccuccuccccccccgcgcccgcaagcccgucugcccccccucccucugcuccuccgucaucaccaucggcgaccucguccucgacuccgacgaggaggagaacggccagggcgagggcaaggagucccucgagaacuaccagaagaccaaguucgacacccucauccccacccucugcgaguaccucccccccuccggccacggcgccauccccgucuccuccugcgacugccgcgacuccucccgcccccucuga

SEQ ID NO: 50756 - RNA, 1974 nt, Artificial Sequence
  derived and/or modified sequence opt2 from TIPARP__Homo_sapiens__NP_001171646
auggagauggagaccaccgagcccgagcccgacugcgucguccagccccccuccccccccgacgacuucuccugccagaugcgccucuccgagaagaucaccccccucaagaccugcuucaagaagaaggaccagaagcgccucggcaccggcacccuccgcucccuccgccccauccucaacacccuccucgaguccggcucccucgacggcgucuuccgcucccgcaaccaguccaccgacgagaacucccuccacgagcccaugaugaagaaggccauggagaucaacuccuccugcccccccgccgagaacaacauguccguccucauccccgaccgcaccaacgucggcgaccagauccccgaggcccaccccuccaccgaggcccccgagcgcgucguccccauccaggaccacuccuuccccuccgagacccucuccggcaccgucgccgacuccacccccgcccacuuccagaccgaccuccuccaccccgucuccuccgacguccccaccucccccgacugccucgacaaggucaucgacuacguccccggcaucuuccaggagaacuccuucaccauccaguacauccucgacaccuccgacaagcucuccaccgagcucuuccaggacaaguccgaggaggccucccucgaccucgucuucgagcucgucaaccagcuccaguaccacacccaccaggagaacggcaucgagaucugcauggacuuccuccagggcaccugcaucuacggccgcgacugccucaagcaccacaccguccuccccuaccacuggcagaucaagcgcaccaccacccagaaguggcaguccgucuucaacgacucccaggagcaccucgagcgcuucuacugcaaccccgagaacgaccgcaugcgcaugaaguacggcggccaggaguucugggccgaccucaacgccaugaacgucuacgagaccaccgaguucgaccagcuccgccgccucuccaccccccccuccuccaacgucaacuccaucuaccacaccgucuggaaguucuucugccgcgaccacuucggcuggcgcgaguaccccgaguccgucauccgccucaucgaggaggccaacucccgcggccucaaggagguccgcuucaugauguggaacaaccacuacauccuccacaacuccuucuuccgccgcgagaucaagcgccgcccccucuuccgcuccugcuucauccuccuccccuaccuccagacccucggcggcguccccacccaggccccccccccccucgaggccaccuccuccucccagaucaucugccccgacggcgucaccuccgccaacuucuaccccgagaccugggucuacaugcaccccucccaggacuucauccagguccccgucuccgccgaggacaaguccuaccgcaucaucuacaaccucuuccacaagaccguccccgaguucaaguaccgcauccuccagauccuccgcguccagaaccaguuccucugggagaaguacaagcgcaagaaggaguacaugaaccgcaagauguucggccgcgaccgcaucaucaacgagcgccaccucuuccacggcaccucccaggacgucgucgacggcaucugcaagcacaacuucgacccccgcgucugcggcaagcacgccaccauguucggccagggcuccuacuucgccaagaaggccuccuacucccacaacuucuccaagaaguccuccaagggcguccacuucauguuccucgccaagguccucaccggccgcuacaccaugggcucccacggcaugcgccgccccccccccgucaaccccggcuccgucaccuccgaccucuacgacuccugcgucgacaacuucuucgagccccagaucuucgucaucuucaacgacgaccaguccuaccccuacuucgucauccaguacgaggaggucuccaacaccgucuccaucuga

SEQ ID NO: 50757 - RNA, 603 nt, Artificial Sequence
  derived and/or modified sequence opt2 from TIPIN__Homo_sapiens__NP_001276915
augcucauccgccacauggagcacugggcccaccgccucuuccccaagcuccaguucgaggacuucaucgaccgcgucgaguaccucggcuccaagaaggagguccagaccugccucaagcgcauccgccucgaccuccccauccuccacgaggacuucgucuccaacaacgacgaggucgccgagaacaacgagcacgacgucaccuccaccgagcucgaccccuuccucaccaaccucuccgaguccgagauguucgccuccgagcucucccgcucccucaccgaggagcagcagcagcgcaucgagcgcaacaagcagcucgcccucgagcgccgccaggccaagcuccucuccaacucccagacccucggcaacgacaugcucaugaacaccccccgcgcccacaccgucgaggaggucaacaccgacgaggaccagaaggaggaguccaacggccucaacgaggacauccucgacaaccccugcaacgacgccaucgccaacacccucaacgaggaggagacccuccucgaccaguccuucaagaacguccagcagcagcucgacgccaccucccgcaacaucaccgaggcccgcuga

SEQ ID NO: 50758 - RNA, 537 nt, Artificial Sequence
  derived and/or modified sequence opt2 from TIPRL__Homo_sapiens__NP_001026970
augaugauccacggcuuccaguccucccaccgcgacuucugcuucggccccuggaagcucaccgccuccaagacccacaucaugaaguccgccgacgucgagaagcucgccgacgagcuccacaugcccucccuccccgagaugauguucggcgacaacguccuccgcauccagcacggcuccggcuucggcaucgaguucaacgccaccgacgcccuccgcugcgucaacaacuaccagggcaugcucaaggucgccugcgccgaggaguggcaggagucccgcaccgagggcgagcacuccaaggaggucaucaagcccuacgacuggaccuacaccaccgacuacaagggcacccuccucggcgagucccucaagcucaaggucguccccaccaccgaccacaucgacaccgagaagcucaaggcccgcgagcagaucaaguucuucgaggagguccuccucuucgaggacgagcuccacgaccacggcgucuccucccucuccgucaagauccccggcggcggccaccucuga

SEQ ID NO: 50759 - RNA, 1035 nt, Artificial Sequence
  derived and/or modified sequence opt2 from TIRAP__Homo_sapiens__XP_005271456
augcagaagcccggcuggcagggccucggcccccaguggacccagggccucccccgccccgccucccccgccgccggccucugcccccgcgucucccgcgucuggaccggccccggcggcgucggcggcgccguccgccgcgccgcccuccccgaguccggcgccugcgcccuccucuuccccgccgagcccgcccaguccgcccagcccuccucccagcucggcccccgcgccggcuggcuccuccacgaggucaagaccggcuccccccccuccucccccuucaccaacgccuggucccacggcgccuccuucgacccccacgccauggccuccuccaccucccuccccgcccccggcucccgccccaagaagccccucggcaagauggccgacugguuccgccagacccuccucaagaagcccaagaagcgccccaacucccccgaguccaccuccuccgacgccucccagcccaccucccaggacuccccccucccccccucccucuccuccgucaccucccccucccucccccccacccacgccuccgacuccggcuccucccgcugguccaaggacuacgacgucugcgucugccacuccgaggaggaccucgucgccgcccaggaccucgucuccuaccucgagggcuccaccgccucccuccgcugcuuccuccagcuccgcgacgccacccccggcggcgccaucgucuccgagcucugccaggcccucuccuccucccacugccgcguccuccucaucacccccggcuuccuccaggaccccuggugcaaguaccagaugcuccaggcccucaccgaggcccccggcgccgagggcugcaccaucccccuccucuccggccucucccgcgccgccuacccccccgagcuccgcuucauguacuacgucgacggccgcggccccgacggcggcuuccgccaggucaaggaggccgucaugcgcugcaagcuccuccaggagggcgagggcgagcgcgacuccgccaccgucuccgaccuccucuga

SEQ ID NO: 50760 - RNA, 5247 nt, Artificial Sequence
  derived and/or modified sequence opt2 from TJP1__Homo_sapiens__NP_003248
auguccgcccgcgccgccgccgccaaguccaccgccauggaggagaccgccaucugggagcagcacaccgucacccuccaccgcgcccccggcuucggcuucggcaucgccaucuccggcggccgcgacaacccccacuuccaguccggcgagaccuccaucgucaucuccgacguccucaagggcggccccgccgagggccagcuccaggagaacgaccgcgucgccauggucaacggcgucuccauggacaacgucgagcacgccuucgccguccagcagcuccgcaaguccggcaagaacgccaagaucaccauccgccgcaagaagaagguccagauccccgucucccgccccgaccccgagcccgucuccgacaacgaggaggacuccuacgacgaggagauccacgacccccgcuccggccgcuccggcgucgucaaccgccgcuccgagaagaucuggccccgcgaccgcuccgccucccgcgagcgcucccucuccccccgcuccgaccgccgcuccgucgccuccucccagcccgccaagcccaccaaggucacccucgucaagucccgcaagaacgaggaguacggccuccgccucgccucccacaucuucgucaaggagaucucccaggacucccucgccgcccgcgacggcaacauccaggagggcgacgucguccucaagaucaacggcaccgucaccgagaacaugucccucaccgacgccaagacccucaucgagcgcuccaagggcaagcucaagauggucguccagcgcgacgagcgcgccacccuccucaacguccccgaccucuccgacuccauccacuccgccaacgccuccgagcgcgacgacaucuccgagauccagucccucgccuccgaccacuccggccgcucccacgaccgccccccccgccgcucccgcucccgcucccccgaccagcgcuccgagcccuccgaccacucccgccacuccccccagcagcccuccaacggcucccuccgcucccgcgacgaggagcgcaucuccaagcccggcgccgucuccacccccgucaagcacgccgacgaccacacccccaagaccgucgaggaggucaccgucgagcgcaacgagaagcagacccccucccuccccgagcccaagcccgucuacgcccaggucggccagcccgacgucgaccuccccgucucccccuccgacggcguccuccccaacuccacccacgaggacggcauccuccgccccuccaugaagcucgucaaguuccgcaagggcgacuccgucggccuccgccucgccggcggcaacgacgucggcaucuucgucgccggcguccucgaggacucccccgccgccaaggagggccucgaggagggcgaccagauccuccgcgucaacaacgucgacuucaccaacaucauccgcgaggaggccguccucuuccuccucgaccuccccaagggcgaggaggucaccauccucgcccagaagaagaaggacgucuaccgccgcaucgucgaguccgacgucggcgacuccuucuacauccgcacccacuucgaguacgagaaggagucccccuacggccucuccuucaacaagggcgaggucuuccgcgucgucgacacccucuacaacggcaagcucggcuccuggcucgccauccgcaucggcaagaaccacaaggaggucgagcgcggcaucauccccaacaagaaccgcgccgagcagcucgccuccguccaguacacccuccccaagaccgccggcggcgaccgcgccgacuucuggcgcuuccgcggccuccgcuccuccaagcgcaaccuccgcaagucccgcgaggaccucuccgcccagcccguccagaccaaguuccccgccuacgagcgcgucguccuccgcgaggccggcuuccuccgccccgucaccaucuucggccccaucgccgacgucgcccgcgagaagcucgcccgcgaggagcccgacaucuaccagaucgccaaguccgagccccgcgacgccggcaccgaccagcgcuccuccggcaucauccgccuccacaccaucaagcagaucaucgaccaggacaagcacgcccuccucgacgucacccccaacgccgucgaccgccucaacuacgcccagugguaccccaucgucgucuuccucaaccccgacuccaagcagggcgucaagaccaugcgcaugcgccucugccccgagucccgcaaguccgcccgcaagcucuacgagcgcucccacaagcuccgcaagaacaaccaccaccucuucaccaccaccaucaaccucaacuccaugaacgacggcugguacggcgcccucaaggaggccauccagcagcagcagaaccagcucgucugggucuccgagggcaaggccgacggcgccaccuccgacgaccucgaccuccacgacgaccgccucuccuaccucuccgcccccggcuccgaguacuccauguacuccaccgacucccgccacaccuccgacuacgaggacaccgacaccgagggcggcgccuacaccgaccaggagcucgacgagacccucaacgacgaggucggcaccccccccgaguccgccaucacccgcuccuccgagcccguccgcgaggacuccuccggcaugcaccacgagaaccagaccuacccccccuacuccccccaggcccagccccagcccauccaccgcaucgacucccccggcuucaagcccgccucccagcagaaggccgaggccuccucccccguccccuaccucucccccgagaccaaccccgccuccuccaccuccgccgucaaccacaacgucaaccucaccaacguccgccucgaggagcccacccccgcccccuccaccuccuacuccccccaggccgacucccuccgcacccccuccaccgaggccgcccacaucaugcuccgcgaccaggagcccucccucuccucccacgucgaccccaccaaggucuaccgcaaggaccccuaccccgaggagaugaugcgccagaaccacguccucaagcagcccgccgucucccaccccggccaccgccccgacaaggagcccaaccucaccuacgagccccagcuccccuacgucgagaagcaggccucccgcgaccucgagcagcccaccuaccgcuacgaguccuccuccuacaccgaccaguucucccgcaacuacgagcaccgccuccgcuacgaggaccgcguccccauguacgaggagcagugguccuacuacgacgacaagcagcccuaccccucccgcccccccuucgacaaccagcacucccaggaccucgacucccgccagcaccccgaggaguccuccgagcgcggcuacuucccccgcuucgaggagcccgccccccucuccuacgacucccgcccccgcuacgagcaggccccccgcgccuccgcccuccgccacgaggagcagcccgcccccggcuacgacacccacggccgccuccgccccgaggcccagccccaccccuccgccggccccaagcccgccgaguccaagcaguacuucgagcaguacucccgcuccuacgagcagguccccccccagggcuucaccucccgcgccggccacuucgagccccuccacggcgccgccgccguccccccccucauccccuccucccagcacaagcccgaggcccuccccuccaacaccaagccccucccccccccccccacccagaccgaggaggaggaggaccccgccaugaagccccaguccguccucacccgcgucaagauguucgagaacaagcgcuccgccucccucgagaccaagaaggacgucaacgacaccggcuccuucaagccccccgaggucgccuccaagcccuccggcgcccccaucaucggccccaagcccaccucccagaaccaguucuccgagcacgacaagacccucuaccgcauccccgagccccagaagccccagcucaagccccccgaggacaucguccgcuccaaccacuacgaccccgaggaggacgaggaguacuaccgcaagcagcucuccuacuucgaccgccgcuccuucgagaacaagccccccgcccacaucgccgccucccaccucuccgagcccgccaagcccgcccacucccagaaccaguccaacuucuccuccuacuccuccaagggcaagccccccgaggccgacggcgucgaccgcuccuucggcgagaagcgcuacgagcccauccaggccaccccccccccccccccccuccccucccaguacgcccagcccucccagcccgucaccuccgccucccuccacauccacuccaagggcgcccacggcgagggcaacuccgucucccucgacuuccagaacucccucgucuccaagcccgaccccccccccucccagaacaagcccgccaccuuccgcccccccaaccgcgaggacaccgcccaggccgccuucuacccccagaaguccuuccccgacaaggcccccgucaacggcaccgagcagacccagaagaccgucacccccgccuacaaccgcuucacccccaagcccuacaccuccuccgcccgccccuucgagcgcaaguucgagucccccaaguucaaccacaaccuccuccccuccgagaccgcccacaagcccgaccucuccuccaagacccccaccucccccaagacccucgucaagucccacucccucgcccagccccccgaguucgacuccggcgucgagaccuucuccauccacgccgagaagcccaaguaccagaucaacaacaucuccaccguccccaaggccauccccgucucccccuccgccgucgaggaggacgaggacgaggacggccacaccgucgucgccaccgcccgcggcaucuucaacuccaacggcggcguccucuccuccaucgagaccggcgucuccaucaucaucccccagggcgccauccccgagggcgucgagcaggagaucuacuucaaggucugccgcgacaacuccauccuccccccccucgacaaggagaagggcgagacccuccucuccccccucgucaugugcggcccccacggccucaaguuccucaagcccgucgagcuccgccucccccacugcgaccccaagaccuggcagaacaagugccuccccggcgaccccaacuaccucgucggcgccaacugcgucuccguccucaucgaccacuucuga

SEQ ID NO: 50761 - RNA, 3063 nt, Artificial Sequence
  derived and/or modified sequence opt2 from TJP2__Homo_sapiens__NP_001163885
auggaggagcucaucugggagcaguacaccgucacccuccagaaggacuccaagcgcggcuucggcaucgccgucuccggcggccgcgacaacccccacuucgagaacggcgagaccuccaucgucaucuccgacguccuccccggcggccccgccgacggccuccuccaggagaacgaccgcgucgucauggucaacggcacccccauggaggacguccuccacuccuucgccguccagcagcuccgcaaguccggcaaggucgccgccaucgucgucaagcgcccccgcaagguccaggucgccgcccuccaggccucccccccccucgaccaggacgaccgcgccuucgaggucauggacgaguucgacggccgcuccuuccgcuccggcuacuccgagcgcucccgccucaacucccacggcggccgcucccgcuccugggaggacucccccgagcgcggccgcccccacgagcgcgcccgcucccgcgagcgcgaccucucccgcgaccgcucccgcggccgcucccucgagcgcggccucgaccaggaccacgcccgcacccgcgaccgcucccgcggccgcucccucgagcgcggccucgaccacgacuucggccccucccgcgaccgcgaccgcgaccgcucccgcggccgcuccaucgaccaggacuacgagcgcgccuaccaccgcgccuacgaccccgacuacgagcgcgccuacucccccgaguaccgccgcggcgcccgccacgacgcccgcucccgcggcccccgcucccgcucccgcgagcacccccacucccgcucccccucccccgagccccgcggccgccccggccccaucggcguccuccucaugaagucccgcgccaacgaggaguacggccuccgccucggcucccagaucuucgucaaggagaugacccgcaccggccucgccaccaaggacggcaaccuccacgagggcgacaucauccucaagaucaacggcaccgucaccgagaacaugucccucaccgacgcccgcaagcucaucgagaagucccgcggcaagcuccagcucgucguccuccgcgacucccagcagacccucaucaacauccccucccucaacgacuccgacuccgagaucgaggacaucuccgagaucgaguccaaccgcuccuucucccccgaggagcgccgccaccaguacuccgacuacgacuaccacuccuccuccgagaagcucaaggagcgccccuccucccgcgaggacacccccucccgccucucccgcaugggcgccacccccacccccuucaaguccaccggcgacaucgccggcaccgucguccccgagaccaacaaggagccccgcuaccaggaggacccccccgccccccagcccaaggccgccccccgcaccuuccuccgccccucccccgaggacgaggccaucuacggccccaacaccaagaugguccgcuucaagaagggcgacuccgucggccuccgccucgccggcggcaacgacgucggcaucuucgucgccggcauccaggagggcaccuccgccgagcaggagggccuccaggagggcgaccagauccucaaggucaacacccaggacuuccgcggccucguccgcgaggacgccguccucuaccuccucgagauccccaagggcgagauggucaccauccucgcccagucccgcgccgacgucuaccgcgacauccucgccugcggccgcggcgacuccuucuucauccgcucccacuucgagugcgagaaggagaccccccagucccucgccuucacccgcggcgaggucuuccgcgucgucgacacccucuacgacggcaagcucggcaacuggcucgccguccgcaucggcaacgagcucgagaagggccucauccccaacaagucccgcgccgagcagauggccuccguccagaacgcccagcgcgacaacgccggcgaccgcgccgacuucuggcgcaugcgcggccagcgcuccggcgucaagaagaaccuccgcaagucccgcgaggaccucaccgccgucgucuccgucuccaccaaguuccccgccuacgagcgcguccuccuccgcgaggccggcuucaagcgccccgucguccucuucggccccaucgccgacaucgccauggagaagcucgccaacgagcuccccgacugguuccagaccgccaagaccgagcccaaggacgccggcuccgagaaguccaccggcgucguccgccucaacaccguccgccagaucaucgagcaggacaagcacgcccuccucgacgucacccccaaggccgucgaccuccucaacuacacccagugguuccccaucgucaucuucuucaaccccgacucccgccagggcgucaagaccaugcgccagcgccucaaccccaccuccaacaaguccucccgcaagcucuucgaccaggccaacaagcucaagaagaccugcgcccaccucuucaccgccaccaucaaccucaacuccgccaacgacuccugguucggcucccucaaggacaccauccagcaccagcagggcgaggccgucugggucuccgagggcaagauggagggcauggacgacgaccccgaggaccgcauguccuaccucaccgccaugggcgccgacuaccucuccugcgacucccgccucaucuccgacuucgaggacaccgacggcgagggcggcgccuacaccgacaacgagcucgacgagcccgccgaggagccccucgucuccuccaucacccgcuccuccgagcccguccagcacgaggagaucgagaucgcccagaagcaccccgacaucuacgccguccccaucaagacccacaagcccgaccccggcaccccccagcacaccuccucccgcccccccgagccccagaaggcccccucccgccccuaccaggacacccgcggcuccuacggcuccgacgccgaggaggaggaguaccgccagcagcucuccgagcacuccaagcgcggcuacuacggccaguccgcccgcuaccgcgacaccgagcucuga

SEQ ID NO: 50762 - RNA, 2760 nt, Artificial Sequence
  derived and/or modified sequence opt2 from TJP3__Homo_sapiens__NP_001254489
auggaggagcucaccaucugggagcagcacaccgccacccucuccaaggacccccgccgcggcuucggcaucgccaucuccggcggccgcgaccgccccggcggcuccauggucgucuccgacgucguccccggcggccccgccgagggccgccuccagaccggcgaccacaucgucauggucaacggcgucuccauggagaacgccaccuccgccuucgccauccagauccucaagaccugcaccaagauggccaacaucaccgucaagcgcccccgccgcauccaccuccccgccaccaaggccucccccuccucccccggccgccaggacuccgacgaggacgacggcccccagcgcgucgaggaggucgaccagggccgcggcuacgacggcgacuccuccuccggcuccggccgcuccugggacgagcgcucccgccgcccccgccccggccgccgcggccgcgccggcucccacggccgccgcucccccggcggcggcuccgaggccaacggccucgcccucgucuccggcuucaagcgccucccccgccaggacguccagaugaagcccgucaaguccguccucgucaagcgccgcgacuccgaggaguucggcgucaagcucggcucccagaucuucaucaagcacaucaccgacuccggccucgccgcccgccaccgcggccuccaggagggcgaccucauccuccagaucaacggcgucuccucccagaaccucucccucaacgacacccgccgccucaucgagaaguccgagggcaagcucucccuccucguccuccgcgaccgcggccaguuccucgucaacaucccccccgccgucuccgacuccgacuccuccccccucgaggacaucuccgaccucgccuccgagcucucccaggccccccccucccacauccccccccccccccgccacgcccagcgcucccccgaggccucccagaccgacucccccgucgaguccccccgccuccgccgcgaguccuccgucgacucccgcaccaucuccgagcccgacgagcagcgcuccgagcucccccgcgaguccuccuacgacaucuaccgcguccccuccucccaguccauggaggaccgcggcuacucccccgacacccgcgucguccgcuuccucaagggcaaguccaucggccuccgccucgccggcggcaacgacgucggcaucuucgucuccggcguccaggccggcucccccgccgacggccagggcauccaggagggcgaccagauccuccaggucaacgacguccccuuccagaaccucacccgcgaggaggccguccaguuccuccucggccucccccccggcgaggagauggagcucgucacccagcgcaagcaggacaucuucuggaagaugguccagucccgcgucggcgacuccuucuacauccgcacccacuucgagcucgagcccuccccccccuccggccucggcuucacccgcggcgacgucuuccacguccucgacacccuccaccccggccccggccagucccacgcccgcggcggccacuggcucgccguccgcaugggccgcgaccuccgcgagcaggagcgcggcaucauccccaaccagucccgcgccgagcagcucgccucccucgaggccgcccagcgcgccgucggcgucggccccggcuccuccgccggcuccaacgcccgcgccgaguucuggcgccuccgcggccuccgccgcggcgccaagaagaccacccagcgcucccgcgaggaccucuccgcccucacccgccagggccgcuacccccccuacgagcgcgucguccuccgcgaggccuccuucaagcgccccgucgucauccucggccccgucgccgacaucgccaugcagaagcucaccgccgagaugcccgaccaguucgagaucgccgagaccgucucccgcaccgacucccccuccaagaucaucaagcucgacaccguccgcgucaucgccgagaaggacaagcacgcccuccucgacgucacccccuccgccaucgagcgccucaacuacguccaguacuaccccaucgucgucuucuucauccccgagucccgccccgcccucaaggcccuccgccaguggcucgcccccgccucccgccgcuccacccgccgccucuacgcccaggcccagaagcuccgcaagcacuccucccaccucuucaccgccaccaucccccucaacggcaccuccgacaccugguaccaggagcucaaggccaucauccgcgagcagcagacccgccccaucuggaccgccgaggaccagcucgacggcucccucgaggacaaccucgaccucccccaccacggccucgccgacuccuccgccgaccucuccugcgacucccgcgucaacuccgacuacgagaccgacggcgagggcggcgccuacaccgacggcgagggcuacaccgacggcgagggcggccccuacaccgacgucgacgacgagccccccgcccccgcccucgcccgcuccuccgagcccguccaggccgacgagucccaguccccccgcgaccgcggccgcaucuccgcccaccagggcgcccaggucgacucccgccacccccagggccaguggcgccaggacuccaugcgcaccuacgagcgcgaggcccucaagaagaaguucaugcgcguccacgacgccgaguccuccgacgaggacggcuacgacuggggccccgccaccgaccucuga

SEQ ID NO: 50763 - RNA, 705 nt, Artificial Sequence
  derived and/or modified sequence opt2 from TK1__Homo_sapiens__NP_003249
auguccugcaucaaccuccccaccguccuccccggcucccccuccaagacccgcggccagauccaggucauccucggccccauguucuccggcaaguccaccgagcucaugcgccgcguccgccgcuuccagaucgcccaguacaagugccucgucaucaaguacgccaaggacacccgcuacuccuccuccuucugcacccacgaccgcaacaccauggaggcccuccccgccugccuccuccgcgacgucgcccaggaggcccucggcgucgccgucaucggcaucgacgagggccaguucuuccccgacaucgucgaguucugcgaggccauggccaacgccggcaagaccgucaucgucgccgcccucgacggcaccuuccagcgcaagcccuucggcgccauccucaaccucgucccccucgccgaguccgucgucaagcucaccgccgucugcauggagugcuuccgcgaggccgccuacaccaagcgccucggcaccgagaaggaggucgaggucaucggcggcgccgacaaguaccacuccgucugccgccucugcuacuucaagaaggccuccggccagcccgccggccccgacaacaaggagaacugccccguccccggcaagcccggcgaggccgucgccgcccgcaagcucuucgccccccagcagauccuccagugcucccccgccaacuga

SEQ ID NO: 50764 - RNA, 705 nt, Artificial Sequence
  derived and/or modified sequence opt2 from TK2__Homo_sapiens__NP_001166114
augggcgccuucugccagcgccccuccuccgacaaggagcaggagaaggagaagaaguccgucaucugcgucgagggcaacaucgccuccggcaagaccaccugccucgaguucuucuccaacgccaccgacgucgagguccucaccgagcccgucuccaaguggcgcaacguccgcggccacaacccccucggccucauguaccacgacgccucccgcuggggccucacccuccagaccuacguccagcucaccaugcucgaccgccacacccgcccccaggucuccuccguccgccucauggagcgcuccauccacuccgcccgcuacaucuucgucgagaaccucuaccgcuccggcaagaugcccgaggucgacuacgucguccucuccgagugguucgacuggauccuccgcaacauggacgucuccgucgaccucaucgucuaccuccgcaccaaccccgagaccugcuaccagcgccucaagaagcgcugccgcgaggaggagaaggucaucccccucgaguaccucgaggccauccaccaccuccacgaggaguggcucaucaagggcucccucuuccccauggccgcccccguccucgucaucgaggccgaccaccacauggagcgcaugcucgagcucuucgagcagaaccgcgaccgcauccucacccccgagaaccgcaagcacugccccuga

SEQ ID NO: 50765 - RNA, 1872 nt, Artificial Sequence
  derived and/or modified sequence opt2 from TKT__Homo_sapiens__NP_001128527
auggaguccuaccacaagcccgaccagcagaagcuccaggcccucaaggacaccgccaaccgccuccgcaucuccuccauccaggccaccaccgccgccggcuccggccaccccaccuccugcugcuccgccgccgagaucauggccguccucuucuuccacaccaugcgcuacaagucccaggacccccgcaacccccacaacgaccgcuucguccucuccaagggccacgccgcccccauccucuacgccgucugggccgaggccggcuuccucgccgaggccgagcuccucaaccuccgcaagaucuccuccgaccucgacggccaccccguccccaagcaggccuucaccgacgucgccaccggcucccucggccagggccucggcgccgccugcggcauggccuacaccggcaaguacuucgacaaggccuccuaccgcgucuacugccuccucggcgacggcgagcucuccgagggcuccgucugggaggccauggccuucgccuccaucuacaagcucgacaaccucgucgccauccucgacaucaaccgccucggccaguccgaccccgccccccuccagcaccagauggacaucuaccagaagcgcugcgaggccuucggcuggcacgccaucaucgucgacggccacuccgucgaggagcucugcaaggccuucggccaggccaagcaccagcccaccgccaucaucgccaagaccuucaagggccgcggcaucaccggcgucgaggacaaggaguccuggcacggcaagccccuccccaagaacauggccgagcagaucauccaggagaucuacucccagauccaguccaagaagaagauccucgccacccccccccaggaggacgcccccuccgucgacaucgccaacauccgcaugcccucccuccccuccuacaaggucggcgacaagaucgccacccgcaaggccuacggccaggcccucgccaagcucggccacgccuccgaccgcaucaucgcccucgacggcgacaccaagaacuccaccuucuccgagaucuucaagaaggagcaccccgaccgcuucaucgagugcuacaucgccgagcagaacauggucuccaucgccgucggcugcgccacccgcaaccgcaccguccccuucugcuccaccuucgccgccuucuucacccgcgccuucgaccagauccgcauggccgccaucuccgaguccaacaucaaccucugcggcucccacugcggcgucuccaucggcgaggacggccccucccagauggcccucgaggaccucgccauguuccgcuccguccccaccuccaccgucuucuaccccuccgacggcgucgccaccgagaaggccgucgagcucgccgccaacaccaagggcaucugcuucauccgcaccucccgccccgagaacgccaucaucuacaacaacaacgaggacuuccaggucggccaggccaaggucguccucaaguccaaggacgaccaggucaccgucaucggcgccggcgucacccuccacgaggcccucgccgccgccgagcuccucaagaaggagaagaucaacauccgcguccucgaccccuucaccaucaagccccucgaccgcaagcucauccucgacuccgcccgcgccaccaagggccgcauccucaccgucgaggaccacuacuacgagggcggcaucggcgaggccgucuccuccgccgucgucggcgagcccggcaucaccgucacccaccucgccgucaaccgcgucccccgcuccggcaagcccgccgagcuccucaagauguucggcaucgaccgcgacgccaucgcccaggccguccgcggccucaucaccaaggccuga

SEQ ID NO: 50766 - RNA, 1773 nt, Artificial Sequence
  derived and/or modified sequence opt2 from TKTL1__Homo_sapiens__NP_001139405
auggccgacgccgaggcccgcgccgaguuccccgaggaggcccgccccgaccgcggcacccuccagguccuccaggacauggccucccgccuccgcauccacuccauccgcgccaccugcuccaccuccuccggcuccuccuccgagaucauguccguccucuucuucuacaucaugcgcuacaagcaguccgaccccgagaaccccgacaacgaccgcuucguccucgccaagcgccucuccuucgucgacgucgccaccggcuggcucggccagggccucggcgucgccugcggcauggccuacaccggcaaguacuucgaccgcgccuccuaccgcgucuucugccucauguccgacggcgaguccuccgagggcuccgucugggaggccauggccuucgccuccuacuacucccucgacaaccucgucgccaucuucgacgucaaccgccucggccacuccggcgcccuccccgccgagcacugcaucaacaucuaccagcgccgcugcgaggccuucggcuggaacaccuacgucgucgacggccgcgacgucgaggcccucugccaggucuucuggcaggccucccaggucaagcacaagcccaccgccgucgucgccaagaccuucaagggccgcggcacccccuccaucgaggacgccgaguccuggcacgccaagcccaugccccgcgagcgcgccgacgccaucaucaagcucaucgagucccagauccagaccucccgcaaccucgacccccagccccccaucgaggacucccccgaggucaacaucaccgacguccgcaugaccuccccccccgacuaccgcgucggcgacaagaucgccacccgcaaggccugcggccucgcccucgccaagcucggcuacgccaacaaccgcgucgucguccucgacggcgacacccgcuacuccaccuucuccgagaucuucaacaaggaguaccccgagcgcuucaucgagugcuucauggccgagcagaacauggucuccgucgcccucggcugcgccucccgcggccgcaccaucgccuucgccuccaccuucgccgccuuccucacccgcgccuucgaccacauccgcaucggcggccucgccgaguccaacaucaacaucaucggcucccacugcggcgucuccgucggcgacgacggcgccucccagauggcccucgaggacaucgccauguuccgcaccauccccaagugcaccaucuucuaccccaccgacgccgucuccaccgagcacgccgucgcccucgccgccaacgccaagggcaugugcuucauccgcaccacccgccccgagaccauggucaucuacaccccccaggagcgcuucgagaucggccaggccaagguccuccgccacugcgucuccgacaaggucaccgucaucggcgccggcaucaccgucuacgaggcccucgccgccgccgacgagcucuccaagcaggacaucuucauccgcgucaucgaccucuucaccaucaagccccucgacgucgccaccaucgucuccuccgccaaggccaccgagggccgcaucaucaccgucgaggaccacuacccccagggcggcaucggcgaggccgucugcgccgccgucuccauggaccccgacauccagguccacucccucgccgucuccggcgucccccaguccggcaaguccgaggagcuccucgacauguacggcaucuccgcccgccacaucaucgucgccgucaagugcaugcuccucaacuga

SEQ ID NO: 50767 - RNA, 1881 nt, Artificial Sequence
  derived and/or modified sequence opt2 from TKTL2__Homo_sapiens__NP_115512
augauggccaacgacgccaagcccgacgucaagaccguccagguccuccgcgacaccgccaaccgccuccgcauccacuccauccgcgccaccugcgccuccggcuccggccagcucaccuccugcugcuccgccgccgaggucgucuccguccucuucuuccacaccaugaaguacaagcagaccgaccccgagcaccccgacaacgaccgcuucauccucucccgcggccacgccgcccccauccucuacgccgccugggucgaggucggcgacaucuccgaguccgaccuccucaaccuccgcaagcuccacuccgaccucgagcgccaccccaccccccgccuccccuucgucgacgucgccaccggcucccucggccagggccucggcaccgccugcggcauggccuacaccggcaaguaccucgacaaggccuccuaccgcgucuucugccucaugggcgacggcgaguccuccgagggcuccgucugggaggccuucgccuucgccucccacuacaaccucgacaaccucgucgccgucuucgacgucaaccgccucggccaguccggccccgccccccucgagcacggcgccgacaucuaccagaacugcugcgaggccuucggcuggaacaccuaccucgucgacggccacgacgucgaggcccucugccaggccuucuggcaggccucccaggucaagaacaagcccaccgccaucgucgccaagaccuucaagggccgcggcauccccaacaucgaggacgccgagaacuggcacggcaagcccguccccaaggagcgcgccgacgccaucgucaagcucaucgagucccagauccagaccaacgagaaccucauccccaagucccccgucgaggacuccccccagaucuccaucaccgacaucaagaugaccuccccccccgccuacaaggucggcgacaagaucgccacccagaagaccuacggccucgcccucgccaagcucggccgcgccaacgagcgcgucaucguccucuccggcgacaccaugaacuccaccuucuccgagaucuuccgcaaggagcaccccgagcgcuucaucgagugcaucaucgccgagcagaacauggucuccgucgcccucggcugcgccacccgcggccgcaccaucgccuucgccggcgccuucgccgccuucuucacccgcgccuucgaccagcuccgcaugggcgccaucucccaggccaacaucaaccucaucggcucccacugcggcgucuccaccggcgaggacggcgucucccagauggcccucgaggaccucgccauguuccgcuccauccccaacugcaccgucuucuaccccuccgacgccaucuccaccgagcacgccaucuaccucgccgccaacaccaagggcaugugcuucauccgcaccucccagcccgagaccgccgucaucuacaccccccaggagaacuucgagaucggccaggccaaggucguccgccacggcgucaacgacaaggucaccgucaucggcgccggcgucacccuccacgaggcccucgaggccgccgaccaccucucccagcagggcaucuccguccgcgucaucgaccccuucaccaucaagccccucgacgccgccaccaucaucuccuccgccaaggccaccggcggccgcgucaucaccgucgaggaccacuaccgcgagggcggcaucggcgaggccgucugcgccgccgucucccgcgagcccgacauccucguccaccagcucgccgucuccggcgucccccagcgcggcaagaccuccgagcuccucgacauguucggcaucuccacccgccacaucaucgccgccgucacccucacccucaugaaguga

SEQ ID NO: 50768 - RNA, 1485 nt, Artificial Sequence
  derived and/or modified sequence opt2 from TLDC1__Homo_sapiens__XP_005256131
augcuccccggcaaccgcgagggcgccgcccucgagcgcucccccugggccgccggccccgaccgcaccgcccccggcucccccgccggcgaguucugccagaucuccggccagaugggcaacucccgcucccgcgucggccgcuccuucugcucccaguuccuccccgaggagcaggccgagaucgaccagcucuucgacgcccucuccuccgacaagaacucccccaacgucuccuccaaguccuucucccucaaggcccuccagaaccacgucggcgaggcccucccccccgagauggucacccgccucuacgacggcaugcgccgcgucgaccucaccggcaaggccaagggccccuccgagaacgucucccaggagcaguucaccgccuccaugucccaccuccucaagggcaacuccgaggagaagucccucaugaucaugaagaugaucuccgccaccgagggccccgucaaggcccgcgagguccagaaguucaccgaggaccucgucggcuccgucguccacguccucucccaccgccaggagcuccgcggcuggaccggcaaggaggcccccggccccaacccccgcguccagguccucgccgcccagcuccucuccgacaugaagcuccaggacggcaagcgccuccucggcccccaguggcucgacuacgacugcgaccgcgccgucaucgaggacugggucuuccgcgucccccacgucgccaucuuccucuccgucgucaucugcaagggcuuccucauccucugcuccucccucgaccucaccacccucguccccgagcgccaggucgaccagggccgcggcuucgaguccauccucgacguccucuccgucauguacaucaacgcccagcucccccgcgagcagcgccaccgcuggugccuccucuucuccuccgagcuccacggccacuccuucucccagcucugcggccacaucacccaccgcggccccugcgucgccguccucgaggaccacgacaagcacgucuucggcggcuucgccuccugcuccugggaggucaagccccaguuccagggcgacaaccgcugcuuccucuucuccaucugccccuccauggccgucuacacccacaccggcuacaacgaccacuacauguaccucaaccacggccagcagaccauccccaacggccucggcaugggcggccagcacaacuacuucggccucugggucgacgucgacuucggcaagggccacucccgcgccaagcccaccugcaccaccuacaacuccccccagcucuccgcccaggagaacuuccaguucgacaagauggaggucugggccgucggcgaccccuccgaggagcagcucgccaagggcaacaaguccauccucgacgccgaccccgaggcccaggcccuccucgagaucuccggccacucccgccacuccgagggccuccgcgagguccccgacgacgaguga

SEQ ID NO: 50769 - RNA, 2343 nt, Artificial Sequence
  derived and/or modified sequence opt2 from TLE1__Homo_sapiens__NP_001290032
auguucccccagucccgccaccccaccccccaccaggccgccggccagcccuucaaguucaccauccccgagucccucgaccgcaucaaggaggaguuccaguuccuccaggcccaguaccacucccucaagcucgagugcgagaagcucgccuccgagaagaccgagaugcagcgccacuacgucauguacuacgagauguccuacggccucaacaucgagaugcacaagcagaccgagaucgccaagcgccucaacaccaucugcgcccaggucauccccuuccucucccaggagcaccagcagcaggucgcccaggccgucgagcgcgccaagcaggucaccauggccgagcucaacgccaucaucggcguccgcggccuccccggccucccccccacccagcagcagcuccaggcccagcaccucucccacggccacggcccccccgucccccucaccccccaccccuccggccuccagccccccggcauccccccccucggcggcuccgccggccuccucgcccucuccuccgcccucuccggccagucccaccucgccaucaaggacgacaagaagcaccacgacgccgagcaccaccgcgaccgcgagcccggcaccuccaacucccuccucguccccgacucccuccgcggcaccgacaagcgccgcaacggccccgaguucuccaacgacaucaagaagcgcaaggucgacgacaaggacuccucccacuacgacuccgacggcgacaaguccgacgacaaccucgucgucgacgucuccaacgaggaccccuccuccccccgcgccucccccgcccacuccccccgcgagaacggcaucgacaagaaccgccuccucaagaaggacgccuccuccucccccgccuccaccgccuccuccgccuccuccaccucccucaaguccaaggagaugucccuccacgagaaggccuccacccccguccucaaguccuccacccccaccccccgcuccgacaugcccacccccggcaccuccgccacccccggccuccgccccggccucggcaagccccccgccaucgacccccucgucaaccaggccgccgccggccuccgcaccccccucgccguccccggccccuaccccgcccccuucggcauggucccccacgccggcaugaacggcgagcucaccucccccggcgccgccuacgccucccuccacaacauguccccccagauguccgccgccgccgccgccgccgccgucgucgccuacggccgcucccccauggucggcuucgacccccccccccacaugcgcguccccaccaucccccccaaccucgccggcauccccggcggcaagcccgccuacuccuuccacgucaccgccgacggccagaugcagcccguccccuucccccccgacgcccucaucggccccggcaucccccgccacgcccgccagaucaacacccucaaccacggcgaggucgucugcgccgucaccaucuccaaccccacccgccacgucuacaccggcggcaagggcugcgucaaggucugggacaucucccaccccggcaacaagucccccgucucccagcucgacugccucaaccgcgacaacuacauccgcuccugcaagcuccuccccgacggcugcacccucaucgucggcggcgaggccuccacccucuccaucugggaccucgccgcccccaccccccgcaucaaggccgagcucaccuccuccgcccccgccugcuacgcccucgccaucucccccgacuccaaggucugcuucuccugcugcuccgacggcaacaucgccgucugggaccuccacaaccagacccucguccgccaguuccagggccacaccgacggcgccuccugcaucgacaucuccaacgacggcaccaagcucuggaccggcggccucgacaacaccguccgcuccugggaccuccgcgagggccgccagcuccagcagcacgacuucaccucccagaucuucucccucggcuacugccccaccggcgaguggcucgccgucggcauggaguccuccaacgucgagguccuccacgucaacaagcccgacaaguaccagcuccaccuccacgaguccugcguccucucccucaaguucgccuacugcggcaagugguucgucuccaccggcaaggacaaccuccucaacgccuggcgcacccccuacggcgccuccaucuuccaguccaaggaguccuccuccguccucuccugcgacaucuccgucgacgacaaguacaucgucaccggcuccggcgacaagaaggccaccgucuacgaggucaucuacuga

SEQ ID NO: 50770 - RNA, 2121 nt, Artificial Sequence
  derived and/or modified sequence opt2 from TLE2__Homo_sapiens__NP_001138233
augguccagucccgccucaccgccaccuccgccucccaggacucccccgccuccggccuccagaccccccuccaguccggccagcccuucaaguucuccauccucgagaucugcgaccgcaucaaggaggaguuccaguuccuccaggcccaguaccacucccucaagcucgagugcgagaagcucgccuccgagaagaccgagaugcagcgccacuacgucauguacuacgagauguccuacggccucaacaucgagaugcacaagcaggccgagaucgucaagcgccucuccggcaucugcgcccagaucauccccuuccucacccaggagcaccagcagcagguccuccaggccgucgagcgcgccaagcaggucaccgucggcgagcucaacucccucaucggccagcagcagcuccagccccucucccaccacgccccccccgucccccucaccccccgccccgccggccucgucggcggcuccgccaccggccuccucgcccucuccggcgcccucgccgcccaggcccagcucgccgccgccgucaaggaggaccgcgccggcgucgaggccgagggcucccgcgucgagcgcgcccccucccgcuccgccucccccuccccccccgagucccucgucgaggaggagcgccccuccggccccggcggcggcggcaagcagcgcgccgacgagaaggagcccuccggccccuacgaguccgacgaggacaaguccgacuacaaccucgucgucgacgaggaccagcccuccgagccccccucccccgccaccacccccugcggcaagguccccaucugcauccccgcccgccgcgaccucgucgacucccccgccucccucgccuccucccucggcuccccccucccccgcgccaaggagcucauccucaacgaccuccccgccuccacccccgccuccaaguccugcgacuccucccccccccaggacgccuccacccccggccccuccuccgccucccaccucugccagcucgccgccaagcccgcccccuccaccgacuccgucgcccuccgcuccccccucacccucuccucccccuucaccaccuccuucucccucggcucccacuccacccucaacggcgaccucuccguccccuccuccuacgucucccuccaccucuccccccaggucuccuccuccgucgucuacggccgcucccccgucauggccuucgagucccacccccaccuccgcggcuccuccgucuccuccucccuccccuccauccccggcggcaagcccgccuacuccuuccacgucuccgccgacggccagaugcagcccguccccuuccccuccgacgcccucgucggcgccggcaucccccgccacgcccgccagcuccacacccucgcccacggcgaggucgucugcgccgucaccaucuccggcuccacccagcacgucuacaccggcggcaagggcugcgucaaggucugggacgucggccagcccggcgccaagacccccgucgcccagcucgacugccucaaccgcgacaacuacauccgcuccugcaagcuccuccccgacggccgcucccucaucgucggcggcgaggccuccacccucuccaucugggaccucgccgcccccaccccccgcaucaaggccgagcucaccuccuccgcccccgccugcuacgcccucgccgucucccccgacgccaaggucugcuucuccugcugcuccgacggcaacaucgucgucugggaccuccagaaccagaccaugguccgccaguuccagggccacaccgacggcgccuccugcaucgacaucuccgacuacggcacccgccucuggaccggcggccucgacaacaccguccgcugcugggaccuccgcgagggccgccagcuccagcagcacgacuucuccucccagaucuucucccucggccacugccccaaccaggacuggcucgccgucggcauggaguccuccaacgucgagauccuccacguccgcaagcccgagaaguaccagcuccaccuccacgaguccugcguccucucccucaaguucgccuccugcguccagggcgucguccucucccccgagcucuga

SEQ ID NO: 50771 - RNA, 2310 nt, Artificial Sequence
  derived and/or modified sequence opt2 from TLE3__Homo_sapiens__NP_001098662
auguacccccagggccgccaccccgccccccaccagcccggccagcccggcuucaaguucaccgucgccgaguccugcgaccgcaucaaggacgaguuccaguuccuccaggcccaguaccacucccucaaggucgaguacgacaagcucgccaacgagaagaccgagaugcagcgccacuacgucauguacuacgagauguccuacggccucaacaucgagaugcacaagcagaccgagaucgccaagcgccucaacaccauccucgcccagaucaugcccuuccucucccaggagcaccagcagcaggucgcccaggccgucgagcgcgccaagcaggucaccaugaccgagcucaacgccaucaucggccagcagcagcuccaggcccagcaccucucccacgccacccacggcccccccguccagcuccccccccaccccuccggccuccagccccccggcaucccccccgucaccggcuccuccuccggccuccucgcccucggcgcccucggcucccaggcccaccucaccgucaaggacgagaagaaccaccacgagcucgaccaccgcgagcgcgaguccuccgccaacaacuccgucucccccuccgagucccuccgcgccuccgagaagcaccgcggcuccgccgacuacuccauggaggccaagaagcgcaaggccgaggagaaggacucccucucccgcuacgacuccgacggcgacaaguccgacgaccucgucgucgacgucuccaacgaggaccccgccaccccccgcgucucccccgcccacuccccccccgagaacggccucgacaaggcccgcucccucaagaaggacgcccccaccucccccgccuccgucgccuccuccuccuccacccccuccuccaagaccaaggaccucggccacaacgacaaguccuccacccccggccucaaguccaacacccccaccccccgcaacgacgcccccacccccggcaccuccaccacccccggccuccgcuccaugcccggcaagccccccggcauggaccccaucgccuccgcccuccgcacccccaucuccaucaccuccuccuacgccgcccccuucgccaugaugucccaccacgagaugaacggcucccucaccucccccggcgccuacgccggccuccacaacauccccccccagauguccgccgccgccgccgccgccgccgccgccuacggccgcucccccauggucuccuucggcgccgucggcuucgacccccacccccccaugcgcgccaccggccuccccuccucccucgccuccauccccggcggcaagcccgccuacuccuuccacgucuccgccgacggccagaugcagcccguccccuucccccacgacgcccucgccggccccggcaucccccgccacgcccgccagaucaacacccucucccacggcgaggucgucugcgccgucaccaucuccaaccccacccgccacgucuacaccggcggcaagggcugcgucaagaucugggacaucucccagcccggcuccaagucccccaucucccagcucgacugccucaaccgcgacaacuacauccgcuccugcaagcuccuccccgacggccgcacccucaucgucggcggcgaggccuccacccucaccaucugggaccucgccucccccaccccccgcaucaaggccgagcucaccuccuccgcccccgccugcuacgcccucgccaucucccccgacgccaaggucugcuucuccugcugcuccgacggcaacaucgccgucugggaccuccacaaccagacccucguccgccaguuccagggccacaccgacggcgccuccugcaucgacaucucccacgacggcaccaagcucuggaccggcggccucgacaacaccguccgcuccugggaccuccgcgagggccgccagcuccagcagcacgacuucaccucccagaucuucucccucggcuacugccccaccggcgaguggcucgccgucggcauggaguccuccaacgucgagguccuccaccacaccaagcccgacaaguaccagcuccaccuccacgaguccugcguccucucccucaaguucgccuacugcggcaagugguucgucuccaccggcaaggacaaccuccucaacgccuggcgcacccccuacggcgccuccaucuuccaguccaaggaguccuccuccguccucuccugcgacaucuccgccgacgacaaguacaucgucaccggcuccggcgacaagaaggccaccgucuacgaggucaucuacuga

SEQ ID NO: 50772 - RNA, 2418 nt, Artificial Sequence
  derived and/or modified sequence opt2 from TLE4__Homo_sapiens__NP_001269677
augauccgcgaccucuccaagauguacccccagacccgccaccccgccccccaccagcccgcccagcccuucaaguucaccaucuccgaguccugcgaccgcaucaaggaggaguuccaguuccuccaggcccaguaccacucccucaagcucgagugcgagaagcucgccuccgagaagaccgagaugcagcgccacuacgucauguacuacgagauguccuacggccucaacaucgagaugcacaagcaggccgagaucgucaagcgccucaacgccaucugcgcccaggucauccccuuccucucccaggagcaccagcagcaggucguccaggccgucgagcgcgccaagcaggucaccauggccgagcucaacgccaucaucggccagcagcuccaggcccagcaccucucccacggccacggccuccccgucccccucaccccccaccccuccggccuccagccccccgccaucccccccaucggcuccuccgccggccuccucgcccucuccuccgcccucggcggccagucccaccuccccaucaaggacgagaagaagcaccacgacaacgaccaccagcgcgaccgcgacuccaucaaguccuccuccgucucccccuccgccuccuuccgcggcgccgagaagcaccgcaacuccgccgacuacuccuccgaguccaagaagcagaagaccgaggagaaggagaucgccgcccgcuacgacuccgacggcgagaaguccgacgacaaccucgucgucgacgucuccaacgaggaccccuccuccccccgcggcucccccgcccacuccccccgcgagaacggccucgacaagacccgccuccucaagaaggacgcccccaucucccccgccuccaucgccuccuccuccuccacccccuccuccaaguccaaggagcucucccucaagcgcgacaugggcaagcucuccgagacccgccucuccgaggacgagcagugcacccucggccuccagcgcugguucugccgccucugguucaugaacgagaaguccaccacccccgucuccaaguccaacacccccaccccccgcaccgacgcccccacccccggcuccaacuccacccccggccuccgccccguccccggcaagccccccggcgucgacccccucgccuccucccuccgcacccccauggccguccccugccccuaccccacccccuucggcaucgucccccacgccggcaugaacggcgagcucaccucccccggcgccgccuacgccggccuccacaacaucuccccccagauguccgccgccgccgccgccgccgccgccgccgccgccuacggccgcucccccgucgucggcuucgacccccaccaccacaugcgcguccccgccaucccccccaaccucaccggcauccccggcggcaagcccgccuacuccuuccacgucuccgccgacggccagaugcagcccguccccuucccccccgacgcccucaucggccccggcaucccccgccacgcccgccagaucaacacccucaaccacggcgaggucgucugcgccgucaccaucuccaaccccacccgccacgucuacaccggcggcaagggcugcgucaaggucugggacaucucccaccccggcaacaagucccccgucucccagcucgacugccucaaccgcgacaacuacauccgcuccugccgccuccuccccgacggccgcacccucaucgucggcggcgaggccuccacccucuccaucugggaccucgccgcccccaccccccgcaucaaggccgagcucaccuccuccgcccccgccugcuacgcccucgccaucucccccgacuccaaggucugcuucuccugcugcuccgacggcaacaucgccgucugggaccuccacaaccagacccucguccgccaguuccagggccacaccgacggcgccuccugcaucgacaucuccaacgacggcaccaagcucuggaccggcggccucgacaacaccguccgcuccugggaccuccgcgagggccgccagcuccagcagcacgacuucaccucccagaucuucucccucggcuacugccccaccggcgaguggcucgccgucggcauggagaacuccaacgucgagguccuccacgucaccaagcccgacaaguaccagcuccaccuccacgaguccugcguccucucccucaaguucgcccacugcggcaagugguucgucuccaccggcaaggacaaccuccucaacgccuggcgcacccccuacggcgccuccaucuuccaguccaaggaguccuccuccguccucuccugcgacaucuccgucgacgacaaguacaucgucaccggcuccggcgacaagaaggccaccgucuacgaggucaucuacuga

SEQ ID NO: 50773 - RNA, 1719 nt, Artificial Sequence
  derived and/or modified sequence opt2 from TLE6__Homo_sapiens__NP_001137458
augaccucccgcgaccagccccgccccaagggcccccccaaguccaccucccccugccccggcaucuccaacuccgaguccucccccacccucaacuaccagggcauccucaaccgccucaagcaguucccccgcuucuccccccacuucgccgccgagcucgaguccaucuacuacucccuccacaagauccagcaggacgucgccgagcaccacaagcagaucggcaacguccuccagaucgucgaguccugcucccagcuccagggcuuccaguccgaggaggucucccccgccgagcccgccucccccggcaccccccagcaggucaaggacaagacccuccaggaguccuccuucgaggacaucauggccacccgcuccuccgacuggcuccgccgcccccucggcgaggacaaccagcccgagacccagcucuucugggacaaggagcccugguucuggcacgacacccucaccgagcagcucuggcgcaucuucgccggcguccacgacgagaaggccaagccccgcgaccgccagcaggcccccggccucggccaggaguccaaggcccccggcuccugcgaccccggcaccgaccccugccccgaggacgccuccaccccccgcccccccgaggccuccuccuccccccccgagggcucccaggaccgcaacaccuccuggggcgucguccaggagccccccggccgcgccucccgcuuccuccaguccaucuccugggaccccgaggacuucgaggacgccuggaagcgccccgacgcccuccccggccaguccaagcgccucgccguccccugcaagcucgagaagaugcgcauccucgcccacggcgagcucguccucgccaccgccaucuccuccuucacccgccacgucuucaccugcggccgccgcggcaucaaggucuggucccucaccggccaggucgccgaggaccgcuuccccgagucccaccuccccauccagacccccggcgccuuccuccgcaccugccuccucuccuccaacucccgcucccuccucaccggcggcuacaaccucgccuccgucuccgucugggaccucgccgcccccucccuccacgucaaggagcagcuccccugcgccggccucaacugccaggcccucgacgccaaccucgacgccaaccucgccuucgccuccuucaccuccggcgucguccgcaucugggaccuccgcgaccaguccgucguccgcgaccucaagggcuaccccgacggcgucaaguccaucgucgucaagggcuacaacaucuggaccggcggccccgacgccugccuccgcugcugggaccagcgcaccaucaugaagccccucgaguaccaguucaagucccagaucaugucccucucccacuccccccaggaggacuggguccuccucggcauggccaacggccagcaguggcuccaguccaccuccggcucccagcgccacauggucggccagaaggacuccgucauccucuccgucaaguucucccccuucggccaguggugggccuccgucggcauggacgacuuccucggcgucuacuccaugcccgccggcaccaaggucuucgagguccccgagaugucccccgucaccugcugcgacgucuccuccaacaaccgccucgucgucaccggcuccggcgagcacgccuccgucuaccagaucaccuacuga

SEQ ID NO: 50774 - RNA, 2157 nt, Artificial Sequence
  derived and/or modified sequence opt2 from TLK1__Homo_sapiens__NP_001130026
auggacgagcuccacucccucgacccccgccgccaggagcuccucgaggcccgcuucaccggcgucgccuccggcuccaccggcuccaccggcuccugcuccgucggcgccaaggccuccaccaacaacgaguccuccaaccacuccuucggcucccucggcucccucuccgacaaggaguccgagacccccgagaagaagcaguccgaguccucccgcggccgcaagcgcaaggccgagaaccagaacgaguccucccagggcaaguccaucggcggccgcggccacaagaucuccgacuacuucgaguaccagggcggcaacggcuccucccccguccgcggcaucccccccgccauccgcuccccccagaacucccacucccacuccacccccuccuccuccguccgccccaacucccccucccccaccgcccucgccuucggcgaccaccccaucguccagcccaagcagcucuccuucaagaucauccagaccgaccucaccaugcucaagcucgccgcccucgaguccaacaagauccaggaccucgagaagaaggagggccgcaucgacgaccuccuccgcgccaacugcgaccuccgccgccagaucgacgagcagcagaagcuccucgagaaguacaaggagcgccucaacaagugcaucuccauguccaagaagcuccucaucgagaaguccacccaggagaagcucuccucccgcgagaaguccaugcaggaccgccuccgccucggccacuucaccaccguccgccacggcgccuccuucaccgagcaguggaccgacggcuucgccuuccagaaccucgucaagcagcaggagugggucaaccagcagcgcgaggacaucgagcgccagcgcaagcuccucgccaagcgcaagccccccaccgccaacaacucccaggcccccuccaccaacuccgagcccaagcagcgcaagaacaaggccgucaacggcgccgagaacgaccccuucguccgccccaaccucccccagcuccucacccucgccgaguaccacgagcaggaggagaucuucaagcuccgccucggccaccucaagaaggaggaggccgagauccaggccgagcucgagcgccucgagcgcguccgcaaccuccacauccgcgagcucaagcgcaucaacaacgaggacaacucccaguucaaggaccaccccacccucaacgagcgcuaccuccuccuccaccuccucggccgcggcggcuucuccgaggucuacaaggccuucgaccucuacgagcagcgcuacgccgccgucaagauccaccagcucaacaaguccuggcgcgacgagaagaaggagaacuaccacaagcacgccugccgcgaguaccgcauccacaaggagcucgaccacccccgcaucgucaagcucuacgacuacuucucccucgacaccgacaccuucugcaccguccucgaguacugcgagggcaacgaccucgacuucuaccucaagcagcacaagcucauguccgagaaggaggcccgcuccaucgucaugcagaucgucaacgcccuccgcuaccucaacgagaucaagccccccaucauccacuacgaccucaagcccggcaacauccuccucgucgacggcaccgccugcggcgagaucaagaucaccgacuucggccucuccaagaucauggacgacgacuccuacggcgucgacggcauggaccucaccucccagggcgccggcaccuacugguaccucccccccgagugcuucgucgucggcaaggagccccccaagaucuccaacaaggucgacgucugguccgucggcgucaucuucuuccagugccucuacggccgcaagcccuucggccacaaccagucccagcaggacauccuccaggagaacaccauccucaaggccaccgagguccaguuccccgucaagcccgucgucuccuccgaggccaaggccuucauccgccgcugccucgccuaccgcaaggaggaccgcuucgacguccaccagcucgccaacgaccccuaccuccucccccacaugcgccgcuccaacuccuccggcaaccuccacauggccggccucaccgccucccccaccccccccuccuccuccaucaucaccuacuga

SEQ ID NO: 50775 - RNA, 2319 nt, Artificial Sequence
  derived and/or modified sequence opt2 from TLK2__Homo_sapiens__NP_001271262
augauggaggagcuccacucccucgacccccgccgccaggagcuccucgaggcccgcuucaccggcgucggcgucuccaagggcccccucaacuccgaguccuccaaccagucccucugcuccgucggcucccucuccgacaaggaggucgagacccccgagaagaagcagaacgaccagcgcaaccgcaagcgcaaggccgagcccuacgagaccucccagggcaagggcaccccccgcggccacaagaucuccgacuacuucgaguucgccggcggcuccgcccccggcaccucccccggccgcuccgucccccccgucgcccgcuccuccccccagcacucccucuccaacccccucccccgccgcgucgagcagccccucuacggccucgacggcuccgccgccaaggaggccaccgaggagcaguccgcccuccccacccucauguccgucaugcucgccaagccccgccucgacaccgagcagcucgcccagcgcggcgccggccucugcuucaccuucgucuccgcccagcagaacucccccuccuccaccggcuccggcaacaccgagcacuccugcuccucccagaagcagaucuccauccagcaccgccagacccaguccgaccucaccaucgagaagaucuccgcccucgagaacuccaagaacuccgaccucgagaagaaggagggccgcaucgacgaccuccuccgcgccaacugcgaccuccgccgccagaucgacgagcagcagaagaugcucgagaaguacaaggagcgccucaaccgcugcgucaccauguccaagaagcuccucaucgagaaguccaagcaggagaagauggccugccgcgacaaguccaugcaggaccgccuccgccucggccacuucaccaccguccgccacggcgccuccuucaccgagcaguggaccgacggcuacgccuuccagaaccucaucaagcagcaggagcgcaucaacucccagcgcgaggagaucgagcgccagcgcaagaugcucgccaagcgcaagccccccgccaugggccaggccccccccgccaccaacgagcagaagcagcgcaaguccaagaccaacggcgccgagaacgagacccccuccuccggcaacaccgagcucaaggacaccgcccccgcccucggcgcccacucccuccuccgccucacccucgccgaguaccacgagcaggaggagaucuucaagcuccgccucggccaccucaagaaggaggaggccgagauccaggccgagcucgagcgccucgagcgcguccgcaaccuccacauccgcgagcucaagcgcauccacaacgaggacaacucccaguucaaggaccaccccacccucaacgaccgcuaccuccuccuccaccuccucggccgcggcggcuucuccgaggucuacaaggccuucgaccucaccgagcagcgcuacgucgccgucaagauccaccagcucaacaagaacuggcgcgacgagaagaaggagaacuaccacaagcacgccugccgcgaguaccgcauccacaaggagcucgaccacccccgcaucgucaagcucuacgacuacuucucccucgacaccgacuccuucugcaccguccucgaguacugcgagggcaacgaccucgacuucuaccucaagcagcacaagcucauguccgagaaggaggcccgcuccaucaucaugcagaucgucaacgcccucaaguaccucaacgagaucaagccccccaucauccacuacgaccucaagcccggcaacauccuccucgucaacggcaccgccugcggcgagaucaagaucaccgacuucggccucuccaagaucauggacgacgacuccuacaacuccgucgacggcauggagcucaccucccagggcgccggcaccuacugguaccucccccccgagugcuucgucgucggcaaggagccccccaagaucuccaacaaggucgacgucugguccgucggcgucaucuucuaccagugccucuacggccgcaagcccuucggccacaaccagucccagcaggacauccuccaggagaacaccauccucaaggccaccgagguccaguucccccccaagcccgucgucacccccgaggccaaggccuucauccgccgcugccucgccuaccgcaaggaggaccgcaucgacguccagcagcucgccugcgaccccuaccuccucccccacauccgcaaguccgucuccaccuccucccccgccggcgccgccaucgccuccaccuccggcgccuccaacaacuccuccuccaacuga

SEQ ID NO: 50776 - RNA, 1179 nt, Artificial Sequence
  derived and/or modified sequence opt2 from TLL1__Homo_sapiens__NP_001191689
augggccucggcacccucuccccccgcaugcucgucuggcucgucgccuccggcaucgucuucuacggcgagcucugggucugcgccggccucgacuacgacuacaccuucgacggcaacgaggaggacaagaccgagaccaucgacuacaaggaccccugcaaggccgccgucuucuggggcgacaucgcccucgacgacgaggaccucaacaucuuccagaucgaccgcaccaucgaccucacccagaaccccuucggcaaccucggccacaccaccggcggccucggcgaccacgccauguccaagaagcgcggcgcccucuaccagcucaucgaccgcauccgccgcaucggcuucggccucgagcagaacaacaccgucaagggcaaggucccccuccaguucuccggccagaacgagaagaaccgcgucccccgcgccgccaccucccgcaccgagcgcaucuggcccggcggcgucauccccuacgucaucggcggcaacuucaccggcucccagcgcgccauguucaagcaggccaugcgccacugggagaagcacaccugcgucaccuucaucgagcgcuccgacgaggaguccuacaucgucuucaccuaccgccccugcggcugcugcuccuacgucggccgccgcggcaacggcccccaggccaucuccaucggcaagaacugcgacaaguucggcaucgucguccacgagcucggccacgucaucggcuucuggcacgagcacacccgccccgaccgcgacaaccacgucaccaucauccgcgagaacauccagcccggccaggaguacaacuuccucaagauggagcccggcgaggucaacucccucggcgagcgcuacgacuucgacuccaucaugcacuacgcccgcaacaccuucucccgcggcauguuccucgacaccauccuccccucccgcgacgacaacggcauccgccccgccaucggccagcgcacccgccucuccaagggcgacaucgcccaggcccgcaagcucuaccgcugccccgccugcggcgagacccuccaggaguccaacggcaaccucuccucccccggcuuccccaacggcuaccccuccuacacccacugcaucuggcgcgucuccgucacccccggcgagaaggucgucuucucccucugcuga

SEQ ID NO: 50777 - RNA, 3048 nt, Artificial Sequence
  derived and/or modified sequence opt2 from TLL2__Homo_sapiens__NP_036597
augccccgcgccaccgcccucggcgcccucgucucccuccuccuccuccucccccucccccgcggcgccggcggccucggcgagcgccccgacgccaccgccgacuacuccgagcucgacggcgaggagggcaccgagcagcagcucgagcacuaccacgaccccugcaaggccgccgucuucuggggcgacaucgcccucgacgaggacgaccucaagcucuuccacaucgacaaggcccgcgacuggaccaagcagaccgucggcgccaccggccacuccaccggcggccucgaggagcaggccuccgaguccucccccgacaccaccgccauggacaccggcaccaaggaggccggcaaggacggccgcgagaacaccacccuccuccacucccccggcacccuccacgccgccgccaagaccuucuccccccgcguccgccgcgccaccaccucccgcaccgagcgcaucuggcccggcggcgucauccccuacgucaucggcggcaacuucaccggcucccagcgcgccaucuucaagcaggccaugcgccacugggagaagcacaccugcgucaccuucaucgagcgcaccgacgaggaguccuucaucgucuucuccuaccgcaccugcggcugcugcuccuacgucggccgccgcggcggcggcccccaggccaucuccaucggcaagaacugcgacaaguucggcaucgucgcccacgagcucggccacgucgucggcuucuggcacgagcacacccgccccgaccgcgaccagcacgucaccaucauccgcgagaacauccagcccggccaggaguacaacuuccucaagauggaggccggcgaggucuccucccucggcgagaccuacgacuucgacuccaucaugcacuacgcccgcaacaccuucucccgcggcgucuuccucgacaccauccucccccgccaggacgacaacggcguccgccccaccaucggccagcgcguccgccucucccagggcgacaucgcccaggcccgcaagcucuacaagugccccgccugcggcgagacccuccaggacaccaccggcaacuucuccgcccccggcuuccccaacggcuaccccuccuacucccacugcgucuggcgcaucuccgucacccccggcgagaagaucguccucaacuucaccuccauggaccucuucaagucccgccucugcugguacgacuacgucgagguccgcgacggcuacuggcgcaaggccccccuccucggccgcuucugcggcgacaagauccccgagccccucgucuccaccgacucccgccucugggucgaguuccgcuccuccuccaacauccucggcaagggcuucuucgccgccuacgaggccaccugcggcggcgacaugaacaaggacgccggccagauccagucccccaacuaccccgacgacuaccgccccuccaaggagugcgucuggcgcaucaccgucuccgagggcuuccacgucggccucaccuuccaggccuucgagaucgagcgccacgacuccugcgccuacgacuaccucgagguccgcgacggccccaccgaggaguccgcccucaucggccacuucugcggcuacgagaagcccgaggacgucaaguccuccuccaaccgccucuggaugaaguucgucuccgacggcuccaucaacaaggccggcuucgccgccaacuucuucaaggaggucgacgagugcuccuggcccgaccacggcggcugcgagcaccgcugcgucaacacccucggcuccuacaagugcgccugcgaccccggcuacgagcucgccgccgacaagaagaugugcgaggucgccugcggcggcuucaucaccaagcucaacggcaccaucaccucccccggcuggcccaaggaguaccccaccaacaagaacugcgucuggcaggucgucgcccccgcccaguaccgcaucucccuccaguucgaggucuucgagcucgagggcaacgacgucugcaaguacgacuucgucgagguccgcuccggccucucccccgacgccaagcuccacggccgcuucugcggcuccgagacccccgaggucaucaccucccaguccaacaacaugcgcgucgaguucaaguccgacaacaccgucuccaagcgcggcuuccgcgcccacuucuucuccgacaaggacgagugcgccaaggacaacggcggcugccagcacgagugcgucaacaccuucggcuccuaccucugccgcugccgcaacggcuacuggcuccacgagaacggccacgacugcaaggaggccggcugcgcccacaagaucuccuccgucgagggcacccucgccucccccaacuggcccgacaaguaccccucccgccgcgagugcaccuggaacaucuccuccaccgccggccaccgcgucaagcucaccuucaacgaguucgagaucgagcagcaccaggagugcgccuacgaccaccucgagauguacgacggccccgacucccucgcccccauccucggccgcuucugcggcuccaagaagcccgaccccaccgucgccuccggcuccuccauguuccuccgcuucuacuccgacgccuccguccagcgcaagggcuuccaggccguccacuccaccgagugcggcggccgccucaaggccgagguccagaccaaggagcucuacucccacgcccaguucggcgacaacaacuaccccuccgaggcccgcugcgacugggucaucgucgccgaggacggcuacggcgucgagcucaccuuccgcaccuucgaggucgaggaggaggccgacugcggcuacgacuacauggaggccuacgacggcuacgacuccuccgccccccgccucggccgcuucugcggcuccggcccccucgaggagaucuacuccgccggcgacucccucaugauccgcuuccgcaccgacgacaccaucaacaagaagggcuuccacgcccgcuacaccuccaccaaguuccaggacgcccuccacaugaagaaguga

SEQ ID NO: 50778 - RNA, 7626 nt, Artificial Sequence
  derived and/or modified sequence opt2 from TLN1__Homo_sapiens__NP_006280
auggucgcccucucccucaagaucuccaucggcaacgucgucaagaccaugcaguucgagcccuccaccauggucuacgacgccugccgcaucauccgcgagcgcauccccgaggcccccgccggcccccccuccgacuucggccucuuccucuccgacgacgaccccaagaagggcaucuggcucgaggccggcaaggcccucgacuacuacaugcuccgcaacggcgacaccauggaguaccgcaagaagcagcgcccccucaagauccgcaugcucgacggcaccgucaagaccaucauggucgacgacuccaagaccgucaccgacaugcucaugaccaucugcgcccgcaucggcaucaccaaccacgacgaguacucccucguccgcgagcucauggaggagaagaaggaggagaucaccggcacccuccgcaaggacaagacccuccuccgcgacgagaagaagauggagaagcucaagcagaagcuccacaccgacgacgagcucaacuggcucgaccacggccgcacccuccgcgagcagggcgucgaggagcacgagacccuccuccuccgccgcaaguucuucuacuccgaccagaacgucgacucccgcgaccccguccagcucaaccuccucuacguccaggcccgcgacgacauccucaacggcucccaccccgucuccuucgacaaggccugcgaguucgccggcuuccagugccagauccaguucggcccccacaacgagcagaagcacaaggccggcuuccucgaccucaaggacuuccuccccaaggaguacgucaagcagaagggcgagcgcaagaucuuccaggcccacaagaacugcggccagauguccgagaucgaggccaagguccgcuacgucaagcucgcccgcucccucaagaccuacggcgucuccuucuuccucgucaaggagaagaugaagggcaagaacaagcucgucccccgccuccucggcaucaccaaggagugcgucaugcgcgucgacgagaagaccaaggaggucauccaggaguggaaccucaccaacaucaagcgcugggccgccucccccaaguccuucacccucgacuucggcgacuaccaggacggcuacuacuccguccagaccaccgagggcgagcagaucgcccagcucaucgccggcuacaucgacaucauccucaagaagaagaaguccaaggaccacuucggccucgagggcgacgaggaguccaccaugcucgaggacuccgucucccccaagaaguccaccguccuccagcagcaguacaaccgcgucggcaaggucgagcacggcuccgucgcccuccccgccaucaugcgcuccggcgccuccggccccgagaacuuccaggucggcuccaugccccccgcccagcagcagaucaccuccggccagaugcaccgcggccacaugcccccccucaccuccgcccagcaggcccucaccggcaccaucaacuccuccaugcaggccguccaggccgcccaggccacccucgacgacuucgacacccuccccccccucggccaggacgccgccuccaaggccuggcgcaagaacaagauggacgaguccaagcacgagauccacucccaggucgacgccaucaccgccggcaccgccuccgucgucaaccucaccgccggcgaccccgccgagaccgacuacaccgccgucggcugcgccgucaccaccaucuccuccaaccucaccgagaugucccgcggcgucaagcuccucgccgcccuccucgaggacgagggcggcuccggccgcccccuccuccaggccgccaagggccucgccggcgccgucuccgagcuccuccgcuccgcccagcccgccuccgccgagccccgccagaaccuccuccaggccgccggcaacgucggccaggccuccggcgagcuccuccagcagaucggcgaguccgacaccgacccccacuuccaggacgcccucaugcagcucgccaaggccgucgccuccgccgccgccgcccucguccucaaggccaaguccgucgcccagcgcaccgaggacuccggccuccagacccaggucaucgccgccgccacccagugcgcccucuccaccucccagcucgucgccugcaccaaggucgucgcccccaccaucuccucccccgucugccaggagcagcucgucgaggccggccgccucgucgccaaggccgucgagggcugcgucuccgccucccaggccgccaccgaggacggccagcuccuccgcggcgucggcgccgccgccaccgccgucacccaggcccucaacgagcuccuccagcacgucaaggcccacgccaccggcgccggccccgccggccgcuacgaccaggccaccgacaccauccucaccgucaccgagaacaucuucuccuccaugggcgacgccggcgagaugguccgccaggcccgcauccucgcccaggccaccuccgaccucgucaacgccaucaaggccgacgccgagggcgaguccgaccucgagaacucccgcaagcuccucuccgccgccaagauccucgccgacgccaccgccaagauggucgaggccgccaagggcgccgccgcccaccccgacuccgaggagcagcagcagcgccuccgcgaggccgccgagggccuccgcauggccaccaacgccgccgcccagaacgccaucaagaagaagcucguccagcgccucgagcacgccgccaagcaggccgccgccuccgccacccagaccaucgccgccgcccagcacgccgccuccacccccaaggccuccgccggcccccagccccuccucguccaguccugcaaggccgucgccgagcagaucccccuccucguccagggcguccgcggcucccaggcccagcccgacucccccuccgcccagcucgcccucaucgccgccucccaguccuuccuccagcccggcggcaagauggucgccgccgccaaggccuccguccccaccauccaggaccaggccuccgccaugcagcucucccagugcgccaagaaccucggcaccgcccucgccgagcuccgcaccgccgcccagaaggcccaggaggccugcggcccccucgagauggacuccgcccucuccgucguccagaaccucgagaaggaccuccaggaggucaaggccgccgcccgcgacggcaagcucaagccccuccccggcgagaccauggagaagugcacccaggaccucggcaacuccaccaaggccgucuccuccgccaucgcccagcuccucggcgaggucgcccagggcaacgagaacuacgccggcaucgccgcccgcgacgucgccggcggccuccgcucccucgcccaggccgcccgcggcgucgccgcccucaccuccgaccccgccguccaggccaucguccucgacaccgccuccgacguccucgacaaggccuccucccucaucgaggaggccaagaaggccgccggccaccccggcgaccccgagucccagcagcgccucgcccaggucgccaaggccgucacccaggcccucaaccgcugcgucuccugccuccccggccagcgcgacgucgacaacgcccuccgcgccgucggcgacgccuccaagcgccuccucuccgacucccucccccccuccaccggcaccuuccaggaggcccagucccgccucaacgaggccgccgccggccucaaccaggccgccaccgagcucguccaggccucccgcggcaccccccaggaccucgcccgcgccuccggccgcuucggccaggacuucuccaccuuccucgaggccggcgucgagauggccggccaggcccccucccaggaggaccgcgcccaggucgucuccaaccucaagggcaucuccauguccuccuccaagcuccuccucgccgccaaggcccucuccaccgaccccgccgcccccaaccucaagucccagcucgccgccgccgcccgcgccgucaccgacuccaucaaccagcucaucaccaugugcacccagcaggcccccggccagaaggagugcgacaacgcccuccgcgagcucgagaccguccgcgagcuccucgagaaccccguccagcccaucaacgacauguccuacuucggcugccucgacuccgucauggagaacuccaagguccucggcgaggccaugaccggcaucucccagaacgccaagaacggcaaccuccccgaguucggcgacgccaucuccaccgccuccaaggcccucugcggcuucaccgaggccgccgcccaggccgccuaccucgucggcgucuccgaccccaacucccaggccggccagcagggccucgucgagcccacccaguucgcccgcgccaaccaggccauccagauggccugccagucccucggcgagcccggcugcacccaggcccagguccucuccgccgccaccaucgucgccaagcacaccuccgcccucugcaacuccugccgccucgccuccgcccgcaccaccaaccccaccgccaagcgccaguucguccaguccgccaaggaggucgccaacuccaccgccaaccucgucaagaccaucaaggcccucgacggcgccuucaccgaggagaaccgcgcccagugccgcgccgccaccgccccccuccucgaggccgucgacaaccucuccgccuucgccuccaaccccgaguucuccuccauccccgcccagaucucccccgagggccgcgccgccauggagcccaucgucaucuccgccaagaccaugcucgaguccgccggcggccucauccagaccgcccgcgcccucgccgucaacccccgcgacccccccuccugguccguccucgccggccacucccgcaccgucuccgacuccaucaagaagcucaucaccuccaugcgcgacaaggcccccggccagcucgagugcgagaccgccaucgccgcccucaacuccugccuccgcgaccucgaccaggccucccucgccgccgucucccagcagcucgccccccgcgagggcaucucccaggaggcccuccacacccagaugcucaccgccguccaggagaucucccaccucaucgagccccucgccaacgccgcccgcgccgaggccucccagcucggccacaaggucucccagauggcccaguacuucgagccccucacccucgccgccgucggcgccgccuccaagacccucucccacccccagcagauggcccuccucgaccagaccaagacccucgccgaguccgcccuccagcuccucuacaccgccaaggaggccggcggcaaccccaagcaggccgcccacacccaggaggcccucgaggaggccguccagaugaugaccgaggccgucgaggaccucaccaccacccucaacgaggccgccuccgccgccggcgucgucggcggcauggucgacuccaucacccaggccaucaaccagcucgacgagggccccaugggcgagcccgagggcuccuucgucgacuaccagaccaccaugguccgcaccgccaaggccaucgccgucaccguccaggagauggucaccaaguccaacaccucccccgaggagcucggcccccucgccaaccagcucaccuccgacuacggccgccucgccuccgaggccaagcccgccgccgucgccgccgagaacgaggagaucggcucccacaucaagcaccgcguccaggagcucggccacggcugcgccgcccucgucaccaaggccggcgcccuccagugcucccccuccgacgccuacaccaagaaggagcucaucgagugcgcccgccgcgucuccgagaaggucucccacguccucgccgcccuccaggccggcaaccgcggcacccaggccugcaucaccgccgccuccgccgucuccggcaucaucgccgaccucgacaccaccaucauguucgccaccgccggcacccucaaccgcgagggcaccgagaccuucgccgaccaccgcgagggcauccucaagaccgccaagguccucgucgaggacaccaagguccucguccagaacgccgccggcucccaggagaagcucgcccaggccgcccaguccuccgucgccaccaucacccgccucgccgacgucgucaagcucggcgccgccucccucggcgccgaggaccccgagacccaggucguccucaucaacgccgucaaggacgucgccaaggcccucggcgaccucaucuccgccaccaaggccgccgccggcaaggucggcgacgaccccgccgucuggcagcucaagaacuccgccaaggucauggucaccaacgucaccucccuccucaagaccgucaaggccgucgaggacgaggccaccaagggcacccgcgcccucgaggccaccaccgagcacauccgccaggagcucgccgucuucugcucccccgagccccccgccaagaccuccacccccgaggacuucauccgcaugaccaagggcaucaccauggccaccgccaaggccgucgccgccggcaacuccugccgccaggaggacgucaucgccaccgccaaccucucccgccgcgccaucgccgacaugcuccgcgccugcaaggaggccgccuaccaccccgaggucgcccccgacguccgccuccgcgcccuccacuacggccgcgagugcgccaacggcuaccucgagcuccucgaccacguccuccucacccuccagaagcccucccccgagcucaagcagcagcucaccggccacuccaagcgcgucgccggcuccgucaccgagcucauccaggccgccgaggccaugaagggcaccgagugggucgaccccgaggaccccaccgucaucgccgagaacgagcuccucggcgccgccgccgccaucgaggccgccgccaagaagcucgagcagcucaagccccgcgccaagcccaaggaggccgacgagucccucaacuucgaggagcagauccucgaggccgccaaguccaucgccgccgccaccuccgcccucgucaaggccgccuccgccgcccagcgcgagcucgucgcccagggcaaggucggcgccauccccgccaacgcccucgacgacggccaguggucccagggccucaucuccgccgcccgcauggucgccgccgccaccaacaaccucugcgaggccgccaacgccgccguccagggccacgccucccaggagaagcucaucuccuccgccaagcaggucgccgccuccaccgcccagcuccucgucgccugcaaggucaaggccgaccaggacuccgaggccaugaagcgccuccaggccgccggcaacgccgucaagcgcgccuccgacaaccucgucaaggccgcccagaaggccgccgccuucgaggagcaggagaacgagaccgucgucgucaaggagaagauggucggcggcaucgcccagaucaucgccgcccaggaggagaugcuccgcaaggagcgcgagcucgaggaggcccgcaagaagcucgcccagauccgccagcagcaguacaaguuccuccccuccgagcuccgcgacgagcacuga

SEQ ID NO: 50779 - RNA, 7629 nt, Artificial Sequence
  derived and/or modified sequence opt2 from TLN2__Homo_sapiens__XP_011520408
auggucgcccucucccucaagaucugcguccgccacugcaacgucgucaagaccaugcaguucgagcccuccaccgccgucuacgacgccugccgcgucauccgcgagcgcguccccgaggcccagaccggccaggccuccgacuacggccucuuccucuccgacgaggacccccgcaagggcaucuggcucgaggccggccgcacccucgacuacuacaugcuccgcaacggcgacauccucgaguacaagaagaagcagcgcccccagaagauccgcaugcucgacggcuccgucaagaccgucauggucgacgacuccaagaccgucggcgagcuccucgucaccaucugcucccgcaucggcaucaccaacuacgaggaguacucccucauccaggagaccaucgaggagaagaaggaggagggcaccggcacccucaagaaggaccgcacccuccuccgcgacgagcgcaagauggagaagcucaaggccaagcuccacaccgacgacgaccucaacuggcucgaccacucccgcaccuuccgcgagcagggcgucgacgagaacgagacccuccuccuccgccgcaaguucuucuacuccgaccagaacgucgacucccgcgaccccguccagcucaaccuccucuacguccaggcccgcgacgacauccucaacggcucccaccccgucuccuucgagaaggccugcgaguucggcggcuuccaggcccagauccaguucggcccccacgucgagcacaagcacaagcccggcuuccucgaccucaaggaguuccuccccaaggaguacaucaagcagcgcggcgccgagaagcgcaucuuccaggagcacaagaacugcggcgagauguccgagaucgaggccaaggucaaguacgucaagcucgcccgcucccuccgcaccuacggcgucuccuucuuccucgucaaggagaagaugaagggcaagaacaagcucgucccccgccuccucggcaucaccaaggacuccgucaugcgcgucgacgagaagaccaaggagguccuccaggaguggccccucaccaccgucaagcgcugggccgccucccccaaguccuucacccucgacuucggcgaguaccaggaguccuacuacuccguccagaccaccgagggcgagcagaucucccagcucaucgccggcuacaucgacaucauccucaagaagaagcaguccaaggaccgcuucggccucgagggcgacgaggaguccaccaugcucgaggaguccgucucccccaagaaguccaccauccuccagcagcaguucaaccgcaccggcaaggccgagcacggcuccgucgcccuccccgccgucaugcgcuccggcuccuccggccccgagaccuucaacgucggcuccaugcccuccccccagcagcaggucauggucggccagaugcaccgcggccacaugcccccccucaccuccgcccagcaggcccucaugggcaccaucaacaccuccaugcacgccguccagcaggcccaggacgaccucuccgagcucgacucccuccccccccucggccaggacauggccucccgcgucuggguccagaacaaggucgacgaguccaagcacgagauccacucccaggucgacgccaucaccgccggcaccgccuccgucgucaaccucaccgccggcgaccccgccgacaccgacuacaccgccgucggcugcgccaucaccaccaucuccuccaaccucaccgagauguccaagggcgucaagcuccucgccgcccucauggacgacgaggucggcuccggcgaggaccuccuccgcgccgcccgcacccucgccggcgccgucuccgaccuccucaaggccguccagcccaccuccggcgagccccgccagaccguccucaccgccgccggcuccaucggccaggccuccggcgaccuccuccgccagaucggcgagaacgagaccgacgagcgcuuccaggacguccucaugucccucgccaaggccgucgccaacgccgccgccaugcucguccucaaggccaagaacgucgcccaggucgccgaggacaccguccuccagaaccgcgucaucgccgccgccacccagugcgcccucuccaccucccagcucgucgccugcgccaaggucgucucccccaccaucuccucccccgucugccaggagcagcucaucgaggccggcaagcucgucgaccgcuccgucgagaacugcguccgcgccugccaggccgccaccaccgacuccgagcuccucaagcaggucuccgccgccgccuccgucgucucccaggcccuccacgaccuccuccagcacguccgccaguucgccucccgcggcgagcccaucggccgcuacgaccaggccaccgacaccaucaugugcgucaccgaguccaucuucuccuccaugggcgacgccggcgagaugguccgccaggcccgcguccucgcccaggccaccuccgaccucgucaacgccaugcgcuccgacgccgaggccgagaucgacauggagaacuccaagaagcuccucgccgccgccaagcuccucgccgacuccaccgcccgcauggucgaggccgccaagggcgccgccgccaaccccgagaacgaggaccagcagcagcgccuccgcgaggccgccgagggccuccgcgucgccaccaacgccgccgcccagaacgccaucaagaagaagaucgucaaccgccucgaggucgccgccaagcaggccgccgccgccgccacccagaccaucgccgccucccagaacgccgccgucuccaacaagaaccccgccgcccagcagcagcucguccaguccugcaaggccgucgccgaccacaucccccagcucguccagggcguccgcggcucccaggcccaggccgaggaccucuccgcccagcucgcccucaucaucuccucccagaacuuccuccagcccggcuccaagauggucuccuccgccaaggccgccguccccaccgucuccgaccaggccgccgccaugcagcucucccagugcgccaagaaccucgccaccucccucgccgagcuccgcaccgccucccagaaggcccacgaggccugcggccccauggagaucgacuccgcccucaacaccguccagacccucaagaacgagcuccaggacgccaagauggccgccgucgagucccagcucaagccccuccccggcgagacccucgagaagugcgcccaggaccucggcuccaccuccaaggccgucggcuccuccauggcccagcuccucaccugcgccgcccagggcaacgagcacuacaccggcgucgccgcccgcgagaccgcccaggcccucaagacccucgcccaggccgcccgcggcgucgccgccuccaccaccgaccccgccgccgcccacgccaugcucgacuccgcccgcgacgucauggagggcuccgccaugcucauccaggaggccaagcaggcccucaucgcccccggcgacgccgagcgccagcagcgccucgcccaggucgccaaggccgucucccacucccucaacaacugcgucaacugccuccccggccagaaggacgucgacgucgcccucaaguccaucggcgaguccuccaagaagcuccucgucgacucccucccccccuccaccaagcccuuccaggaggcccaguccgagcucaaccaggccgccgccgaccucaaccaguccgccggcgaggucguccacgccacccgcggccaguccggcgagcucgccgccgccuccggcaaguucuccgacgacuucgacgaguuccucgacgccggcaucgagauggccggccaggcccagaccaaggaggaccagauccaggucaucggcaaccucaagaacaucuccauggccuccuccaagcuccuccucgccgccaagucccucuccgucgaccccggcgcccccaacgccaagaaccuccucgccgccgccgcccgcgccgucaccgaguccaucaaccagcucaucacccucugcacccagcaggcccccggccagaaggagugcgacaacgcccuccgcgagcucgagaccgucaagggcaugcucgacaaccccaacgagcccgucuccgaccucuccuacuucgacugcaucgaguccgucauggagaacuccaagguccucggcgaguccauggccggcaucucccagaacgccaagaccggcgaccuccccgccuucggcgagugcgucggcaucgccuccaaggcccucugcggccucaccgaggccgccgcccaggccgccuaccucgucggcaucuccgaccccaacucccaggccggccaccagggccucgucgaccccauccaguucgcccgcgccaaccaggccauccagauggccugccagaaccucgucgaccccggcuccucccccucccagguccucuccgccgccaccaucgucgccaagcacaccuccgcccucugcaacgccugccgcaucgccuccuccaagaccgccaaccccgucgccaagcgccacuucguccaguccgccaaggaggucgccaacuccaccgccaaccucgucaagaccaucaaggcccucgacggcgacuucuccgaggacaaccgcaacaagugccgcaucgccaccgccccccucaucgaggccgucgagaaccucaccgccuucgccuccaaccccgaguucgucuccauccccgcccagaucuccuccgagggcucccaggcccaggagcccauccucgucuccgccaagaccaugcucgaguccuccuccuaccucauccgcaccgcccgcucccucgccaucaaccccaaggacccccccaccugguccguccucgccggccacucccacaccgucuccgacuccaucaagucccucaucaccuccauccgcgacaaggcccccggccagcgcgagugcgacuacuccaucgacggcaucaaccgcugcauccgcgacaucgagcaggccucccucgccgccgucucccagucccucgccacccgcgacgacaucuccgucgaggcccuccaggagcagcucaccuccgucguccaggagaucggccaccucaucgaccccaucgccaccgccgcccgcggcgaggccgcccagcucggccacaaggucacccagcucgccuccuacuucgagccccucauccucgccgccgucggcgucgccuccaagauccucgaccaccagcagcagaugaccguccucgaccagaccaagacccucgccgaguccgcccuccagaugcucuacgccgccaaggagggcggcggcaaccccaaggcccagcacacccacgacgccaucaccgaggccgcccagcucaugaaggaggccgucgacgacaucauggucacccucaacgaggccgccuccgaggucggccucgucggcggcauggucgacgccaucgccgaggccauguccaagcucgacgagggcaccccccccgagcccaagggcaccuucgucgacuaccagaccaccgucgucaaguacuccaaggccaucgccgucaccgcccaggagaugaugaccaaguccgucaccaaccccgaggagcucggcggccucgccucccagaugaccuccgacuacggccaccucgccuuccagggccagauggccgccgccaccgccgagcccgaggagaucggcuuccagauccgcacccgcguccaggaccucggccacggcugcaucuuccucguccagaaggccggcgcccuccaggucugccccaccgacuccuacaccaagcgcgagcucaucgagugcgcccgcgccgucaccgagaaggucucccucguccucuccgcccuccaggccggcaacaagggcacccaggccugcaucaccgccgccaccgccgucuccggcaucaucgccgaccucgacaccaccaucauguucgccaccgccggcacccucaacgccgagaacuccgagaccuucgccgaccaccgcgagaacauccucaagaccgccaaggcccucgucgaggacaccaagcuccucgucuccggcgccgccuccacccccgacaagcucgcccaggccgcccaguccuccgccgccaccaucacccagcucgccgaggucgucaagcucggcgccgccucccucggcuccgacgaccccgagacccaggucguccucaucaacgccaucaaggacgucgccaaggcccucuccgaccucaucuccgccaccaagggcgccgccuccaagcccgucgacgaccccuccauguaccagcucaagggcgccgccaaggucauggucaccaacgucaccucccuccucaagaccgucaaggccgucgaggacgaggccacccgcggcacccgcgcccucgaggccaccaucgagugcaucaagcaggagcucaccgucuuccaguccaaggacguccccgagaagaccuccucccccgaggaguccauccgcaugaccaagggcaucaccauggccaccgccaaggccgucgccgccggcaacuccugccgccaggaggacgucaucgccaccgccaaccucucccgcaaggccgucuccgacaugcucaccgccugcaagcaggccuccuuccaccccgacgucuccgacgagguccgcacccgcgcccuccgcuucggcaccgagugcacccucggcuaccucgaccuccucgagcacguccucgucauccuccagaagcccacccccgaguucaagcagcagcucgccgccuucuccaagcgcgucgccggcgccgucaccgagcucauccaggccgccgaggccaugaagggcaccgagugggucgaccccgaggaccccaccgucaucgccgagaccgagcuccucggcgccgccgccuccaucgaggccgccgccaagaagcucgagcagcucaagccccgcgccaagcccaagcaggccgacgagacccucgacuucgaggagcagauccucgaggccgccaaguccaucgccgccgccaccuccgcccucgucaaguccgccuccgccgcccagcgcgagcucgucgcccagggcaaggucggcuccauccccgccaacgccgccgacgacggccaguggucccagggccucaucuccgccgcccgcauggucgccgccgccaccuccucccucugcgaggccgccaacgccuccguccagggccacgccuccgaggagaagcucaucuccuccgccaagcaggucgccgccuccaccgcccagcuccucgucgccugcaaggucaaggccgaccaggacuccgaggccaugcgccgccuccaggccgccggcaacgccgucaagcgcgccuccgacaaccucguccgcgccgcccagaaggccgccuucggcaaggccgacgacgacgacgucgucgucaagaccaaguucgucggcggcaucgcccagaucaucgccgcccaggaggagaugcucaagaaggagcgcgagcucgaggaggcccgcaagaagcucgcccagauccgccagcagcaguacaaguuccuccccaccgagcuccgcgaggacgagggcuga

SEQ ID NO: 50780 - RNA, 2436 nt, Artificial Sequence
  derived and/or modified sequence opt2 from TLR10__Homo_sapiens__XP_011512064
augcgccucauccgcaacaucuacaucuucugcuccaucgucaugaccgccgagggcgacgcccccgagcuccccgaggagcgcgagcucaugaccaacugcuccaacaugucccuccgcaagguccccgccgaccucacccccgccaccaccacccucgaccucuccuacaaccuccucuuccagcuccaguccuccgacuuccacuccgucuccaagcuccgcguccucauccucugccacaaccgcauccagcagcucgaccucaagaccuucgaguucaacaaggagcuccgcuaccucgaccucuccaacaaccgccucaaguccgucaccugguaccuccucgccggccuccgcuaccucgaccucuccuucaacgacuucgacaccaugcccaucugcgaggaggccggcaacaugucccaccucgagauccucggccucuccggcgccaagauccagaaguccgacuuccagaagaucgcccaccuccaccucaacaccgucuuccucggcuuccgcacccucccccacuacgaggagggcucccuccccauccucaacaccaccaagcuccacaucguccuccccauggacaccaacuucuggguccuccuccgcgacggcaucaagaccuccaagauccucgagaugaccaacaucgacggcaagucccaguucgucuccuacgagaugcagcgcaaccucucccucgagaacgccaagaccuccguccuccuccucaacaaggucgaccuccucugggacgaccucuuccucauccuccaguucgucuggcacaccuccgucgagcacuuccagauccgcaacgucaccuucggcggcaaggccuaccucgaccacaacuccuucgacuacuccaacaccgucaugcgcaccaucaagcucgagcacguccacuuccgcgucuucuacauccagcaggacaagaucuaccuccuccucaccaagauggacaucgagaaccucaccaucuccaacgcccagaugccccacaugcucuuccccaacuaccccaccaaguuccaguaccucaacuucgccaacaacauccucaccgacgagcucuucaagcgcaccauccagcucccccaccucaagacccucauccucaacggcaacaagcucgagacccucucccucgucuccugcuucgccaacaacaccccccucgagcaccucgaccucucccagaaccuccuccagcacaagaacgacgagaacugcuccuggcccgagaccgucgucaacaugaaccucuccuacaacaagcucuccgacuccgucuuccgcugccuccccaaguccauccagauccucgaccucaacaacaaccagauccagaccguccccaaggagaccauccaccucauggcccuccgcgagcucaacaucgccuucaacuuccucaccgaccuccccggcugcucccacuucucccgccucuccguccucaacaucgagaugaacuucauccucucccccucccucgacuucguccaguccugccaggaggucaagacccucaacgccggccgcaaccccuuccgcugcaccugcgagcucaagaacuucauccagcucgagaccuacuccgaggucaugauggucggcugguccgacuccuacaccugcgaguacccccucaaccuccgcggcacccgccucaaggacguccaccuccacgagcucuccugcaacaccgcccuccucaucgucaccaucgucgucaucaugcucguccucggccucgccgucgccuucugcugccuccacuucgaccuccccugguaccuccgcaugcucggccagugcacccagaccuggcaccgcguccgcaagaccacccaggagcagcucaagcgcaacguccgcuuccacgccuucaucuccuacuccgagcacgacucccucugggucaagaacgagcucauccccaaccucgagaaggaggacggcuccauccucaucugccucuacgaguccuacuucgaccccggcaaguccaucuccgagaacaucgucuccuucaucgagaaguccuacaaguccaucuucguccucucccccaacuucguccagaacgaguggugccacuacgaguucuacuucgcccaccacaaccucuuccacgagaacuccgaccacaucauccucauccuccucgagcccauccccuucuacugcauccccacccgcuaccacaagcucaaggcccuccucgagaagaaggccuaccucgaguggcccaaggaccgccgcaagugcggccucuucugggccaaccuccgcgccgccaucaacgucaacguccucgccacccgcgagauguacgagcuccagaccuucaccgagcucaacgaggagucccgcggcuccaccaucucccucaugcgcaccgacugccucuga

SEQ ID NO: 50781 - RNA, 2361 nt, Artificial Sequence
  derived and/or modified sequence opt2 from TLR1__Homo_sapiens__NP_003254
augaccuccaucuuccacuucgccaucaucuucaugcucauccuccagauccgcauccagcucuccgaggaguccgaguuccucgucgaccgcuccaagaacggccucauccacguccccaaggaccucucccagaagaccaccauccucaacaucucccagaacuacaucuccgagcucuggaccuccgacauccucucccucuccaagcuccgcauccucaucaucucccacaaccgcauccaguaccucgacaucuccgucuucaaguucaaccaggagcucgaguaccucgaccucucccacaacaagcucgucaagaucuccugccaccccaccgucaaccucaagcaccucgaccucuccuucaacgccuucgacgcccuccccaucugcaaggaguucggcaacaugucccagcucaaguuccucggccucuccaccacccaccucgagaaguccuccguccuccccaucgcccaccucaacaucuccaagguccuccucguccucggcgagaccuacggcgagaaggaggaccccgagggccuccaggacuucaacaccgagucccuccacaucgucuuccccaccaacaaggaguuccacuucauccucgacgucuccgucaagaccgucgccaaccucgagcucuccaacaucaagugcguccucgaggacaacaagugcuccuacuuccucuccauccucgccaagcuccagaccaaccccaagcucuccaaccucacccucaacaacaucgagaccaccuggaacuccuucauccgcauccuccagcucgucuggcacaccaccgucugguacuucuccaucuccaacgucaagcuccagggccagcucgacuuccgcgacuucgacuacuccggcaccucccucaaggcccucuccauccaccaggucgucuccgacgucuucggcuucccccaguccuacaucuacgagaucuucuccaacaugaacaucaagaacuucaccgucuccggcacccgcaugguccacaugcucugccccuccaagaucucccccuuccuccaccucgacuucuccaacaaccuccucaccgacaccgucuucgagaacugcggccaccucaccgagcucgagacccucauccuccagaugaaccagcucaaggagcucuccaagaucgccgagaugaccacccagaugaagucccuccagcagcucgacaucucccagaacuccgucuccuacgacgagaagaagggcgacugcuccuggaccaagucccuccucucccucaacauguccuccaacauccucaccgacaccaucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcucggcgaguucgucaagaacaucgaccaggucuccuccgagguccucgagggcuggcccgacuccuacaagugcgacuaccccgaguccuaccgcggcacccuccucaaggacuuccacauguccgagcucuccugcaacaucacccuccucaucgucaccaucgucgccaccaugcucguccucgccgucaccgucaccucccucugcuccuaccucgaccuccccugguaccuccgcauggucugccaguggacccagacccgccgccgcgcccgcaacaucccccucgaggagcuccagcgcaaccuccaguuccacgccuucaucuccuacuccggccacgacuccuucugggucaagaacgagcuccuccccaaccucgagaaggagggcaugcagaucugccuccacgagcgcaacuucguccccggcaaguccaucgucgagaacaucaucaccugcaucgagaaguccuacaaguccaucuucguccucucccccaacuucguccaguccgaguggugccacuacgagcucuacuucgcccaccacaaccucuuccacgagggcuccaacucccucauccucauccuccucgagcccaucccccaguacuccauccccuccuccuaccacaagcucaagucccucauggcccgccgcaccuaccucgaguggcccaaggagaaguccaagcgcggccucuucugggccaaccuccgcgccgccaucaacaucaagcucaccgagcaggccaagaaguga

SEQ ID NO: 50782 - RNA, 2355 nt, Artificial Sequence
  derived and/or modified sequence opt2 from TLR2__Homo_sapiens__XP_011530518
augccccacacccucuggauggucuggguccucggcgucaucaucucccucuccaaggaggaguccuccaaccaggccucccucuccugcgaccgcaacggcaucugcaagggcuccuccggcucccucaacuccauccccuccggccucaccgaggccgucaagucccucgaccucuccaacaaccgcaucaccuacaucuccaacuccgaccuccagcgcugcgucaaccuccaggcccucguccucaccuccaacggcaucaacaccaucgaggaggacuccuucuccucccucggcucccucgagcaccucgaccucuccuacaacuaccucuccaaccucuccuccuccugguucaagccccucuccucccucaccuuccucaaccuccucggcaaccccuacaagacccucggcgagaccucccucuucucccaccucaccaagcuccagauccuccgcgucggcaacauggacaccuucaccaagauccagcgcaaggacuucgccggccucaccuuccucgaggagcucgagaucgacgccuccgaccuccaguccuacgagcccaagucccucaaguccauccagaacgucucccaccucauccuccacaugaagcagcacauccuccuccucgagaucuucgucgacgucaccuccuccgucgagugccucgagcuccgcgacaccgaccucgacaccuuccacuucuccgagcucuccaccggcgagaccaacucccucaucaagaaguucaccuuccgcaacgucaagaucaccgacgagucccucuuccaggucaugaagcuccucaaccagaucuccggccuccucgagcucgaguucgacgacugcacccucaacggcgucggcaacuuccgcgccuccgacaacgaccgcgucaucgaccccggcaaggucgagacccucaccauccgccgccuccacaucccccgcuucuaccucuucuacgaccucuccacccucuacucccucaccgagcgcgucaagcgcaucaccgucgagaacuccaaggucuuccucguccccugccuccucucccagcaccucaagucccucgaguaccucgaccucuccgagaaccucauggucgaggaguaccucaagaacuccgccugcgaggacgccuggcccucccuccagacccucauccuccgccagaaccaccucgccucccucgagaagaccggcgagacccuccucacccucaagaaccucaccaacaucgacaucuccaagaacuccuuccacuccaugcccgagaccugccaguggcccgagaagaugaaguaccucaaccucuccuccacccgcauccacuccgucaccggcugcauccccaagacccucgagauccucgacgucuccaacaacaaccucaaccucuucucccucaaccucccccagcucaaggagcucuacaucucccgcaacaagcucaugacccuccccgacgccucccuccuccccaugcuccucguccucaagaucucccgcaacgccaucaccaccuucuccaaggagcagcucgacuccuuccacacccucaagacccucgaggccggcggcaacaacuucaucugcuccugcgaguuccucuccuucacccaggagcagcaggcccucgccaagguccucaucgacuggcccgccaacuaccucugcgacucccccucccacguccgcggccagcagguccaggacguccgccucuccgucuccgagugccaccgcaccgcccucgucuccggcaugugcugcgcccucuuccuccucauccuccucaccggcguccucugccaccgcuuccacggccucugguacaugaagaugaugugggccuggcuccaggccaagcgcaagccccgcaaggcccccucccgcaacaucugcuacgacgccuucgucuccuacuccgagcgcgacgccuacugggucgagaaccucaugguccaggagcucgagaacuucaacccccccuucaagcucugccuccacaagcgcgacuucauccccggcaaguggaucaucgacaacaucaucgacuccaucgagaagucccacaagaccgucuucguccucuccgagaacuucgucaaguccgaguggugcaaguacgagcucgacuucucccacuuccgccucuucgacgagaacaacgacgccgccauccucauccuccucgagcccaucgagaagaaggccaucccccagcgcuucugcaagcuccgcaagaucaugaacaccaagaccuaccucgaguggcccauggacgaggcccagcgcgagggcuucugggucaaccuccgcgccgccaucaaguccuga

SEQ ID NO: 50783 - RNA, 2715 nt, Artificial Sequence
  derived and/or modified sequence opt2 from TLR3__Homo_sapiens__NP_003256
augcgccagacccuccccugcaucuacuucuggggcggccuccuccccuucggcaugcucugcgccuccuccaccaccaagugcaccgucucccacgaggucgccgacugcucccaccucaagcucacccagguccccgacgaccuccccaccaacaucaccguccucaaccucacccacaaccagcuccgccgccuccccgccgccaacuucacccgcuacucccagcucaccucccucgacgucggcuucaacaccaucuccaagcucgagcccgagcucugccagaagcuccccaugcucaagguccucaaccuccagcacaacgagcucucccagcucuccgacaagaccuucgccuucugcaccaaccucaccgagcuccaccucauguccaacuccauccagaagaucaagaacaaccccuucgucaagcagaagaaccucaucacccucgaccucucccacaacggccucuccuccaccaagcucggcacccagguccagcucgagaaccuccaggagcuccuccucuccaacaacaagauccaggcccucaaguccgaggagcucgacaucuucgccaacuccucccucaagaagcucgagcucuccuccaaccagaucaaggaguucucccccggcugcuuccacgccaucggccgccucuucggccucuuccucaacaacguccagcucggccccucccucaccgagaagcucugccucgagcucgccaacaccuccauccgcaaccucucccucuccaacucccagcucuccaccaccuccaacaccaccuuccucggccucaaguggaccaaccucaccaugcucgaccucuccuacaacaaccucaacgucgucggcaacgacuccuucgccuggcucccccagcucgaguacuucuuccucgaguacaacaacauccagcaccucuucucccacucccuccacggccucuucaacguccgcuaccucaaccucaagcgcuccuucaccaagcaguccaucucccucgccucccuccccaagaucgacgacuucuccuuccaguggcucaagugccucgagcaccucaacauggaggacaacgacauccccggcaucaaguccaacauguucaccggccucaucaaccucaaguaccucucccucuccaacuccuucaccucccuccgcacccucaccaacgagaccuucgucucccucgcccacuccccccuccacauccucaaccucaccaagaacaagaucuccaagaucgaguccgacgccuucuccuggcucggccaccucgagguccucgaccucggccucaacgagaucggccaggagcucaccggccaggaguggcgcggccucgagaacaucuucgagaucuaccucuccuacaacaaguaccuccagcucacccgcaacuccuucgcccucguccccucccuccagcgccucaugcuccgccgcgucgcccucaagaacgucgacuccucccccucccccuuccagccccuccgcaaccucaccauccucgaccucuccaacaacaacaucgccaacaucaacgacgacaugcucgagggccucgagaagcucgagauccucgaccuccagcacaacaaccucgcccgccucuggaagcacgccaaccccggcggccccaucuacuuccucaagggccucucccaccuccacauccucaaccucgaguccaacggcuucgacgagauccccgucgaggucuucaaggaccucuucgagcucaagaucaucgaccucggccucaacaaccucaacacccuccccgccuccgucuucaacaaccaggucucccucaagucccucaaccuccagaagaaccucaucaccuccgucgagaagaaggucuucggccccgccuuccgcaaccucaccgagcucgacaugcgcuucaaccccuucgacugcaccugcgaguccaucgccugguucgucaacuggaucaacgagacccacaccaacauccccgagcucuccucccacuaccucugcaacacccccccccacuaccacggcuuccccguccgccucuucgacaccuccuccugcaaggacuccgcccccuucgagcucuucuucaugaucaacaccuccauccuccucaucuucaucuucaucguccuccucauccacuucgagggcuggcgcaucuccuucuacuggaacgucuccguccaccgcguccucggcuucaaggagaucgaccgccagaccgagcaguucgaguacgccgccuacaucauccacgccuacaaggacaaggacugggucugggagcacuucuccuccauggagaaggaggaccagucccucaaguucugccucgaggagcgcgacuucgaggccggcgucuucgagcucgaggccaucgucaacuccaucaagcgcucccgcaagaucaucuucgucaucacccaccaccuccucaaggacccccucugcaagcgcuucaagguccaccacgccguccagcaggccaucgagcagaaccucgacuccaucauccucgucuuccucgaggagauccccgacuacaagcucaaccacgcccucugccuccgccgcggcauguucaagucccacugcauccucaacuggcccguccagaaggagcgcaucggcgccuuccgccacaagcuccaggucgcccucggcuccaagaacuccguccacuga

SEQ ID NO: 50784 - RNA, 2400 nt, Artificial Sequence
  derived and/or modified sequence opt2 from TLR4__Homo_sapiens__NP_003257
auggagcucaacuucuacaagauccccgacaaccuccccuucuccaccaagaaccucgaccucuccuucaacccccuccgccaccucggcuccuacuccuucuucuccuuccccgagcuccagguccucgaccucucccgcugcgagauccagaccaucgaggacggcgccuaccagucccucucccaccucuccacccucauccucaccggcaaccccauccagucccucgcccucggcgccuucuccggccucuccucccuccagaagcucgucgccgucgagaccaaccucgccucccucgagaacuuccccaucggccaccucaagacccucaaggagcucaacgucgcccacaaccucauccaguccuucaagcuccccgaguacuucuccaaccucaccaaccucgagcaccucgaccucuccuccaacaagauccaguccaucuacugcaccgaccuccgcguccuccaccagaugccccuccucaaccucucccucgaccucucccucaaccccaugaacuucauccagcccggcgccuucaaggagauccgccuccacaagcucacccuccgcaacaacuucgacucccucaacgucaugaagaccugcauccagggccucgccggccucgagguccaccgccucguccucggcgaguuccgcaacgagggcaaccucgagaaguucgacaaguccgcccucgagggccucugcaaccucaccaucgaggaguuccgccucgccuaccucgacuacuaccucgacgacaucaucgaccucuucaacugccucaccaacgucuccuccuucucccucgucuccgucaccaucgagcgcgucaaggacuucuccuacaacuucggcuggcagcaccucgagcucgucaacugcaaguucggccaguuccccacccucaagcucaagucccucaagcgccucaccuucaccuccaacaagggcggcaacgccuucuccgaggucgaccuccccucccucgaguuccucgaccucucccgcaacggccucuccuucaagggcugcugcucccaguccgacuucggcaccaccucccucaaguaccucgaccucuccuucaacggcgucaucaccauguccuccaacuuccucggccucgagcagcucgagcaccucgacuuccagcacuccaaccucaagcagauguccgaguucuccgucuuccucucccuccgcaaccucaucuaccucgacaucucccacacccacacccgcgucgccuucaacggcaucuucaacggccucuccucccucgagguccucaagauggccggcaacuccuuccaggagaacuuccuccccgacaucuucaccgagcuccgcaaccucaccuuccucgaccucucccagugccagcucgagcagcucucccccaccgccuucaacucccucuccucccuccagguccucaacaugucccacaacaacuucuucucccucgacaccuuccccuacaagugccucaacucccuccagguccucgacuacucccucaaccacaucaugaccuccaagaagcaggagcuccagcacuuccccuccucccucgccuuccucaaccucacccagaacgacuucgccugcaccugcgagcaccaguccuuccuccaguggaucaaggaccagcgccagcuccucgucgaggucgagcgcauggagugcgccacccccuccgacaagcagggcaugcccguccucucccucaacaucaccugccagaugaacaagaccaucaucggcgucuccguccucuccguccucgucgucuccgucgucgccguccucgucuacaaguucuacuuccaccucaugcuccucgccggcugcaucaaguacggccgcggcgagaacaucuacgacgccuucgucaucuacuccucccaggacgaggacuggguccgcaacgagcucgucaagaaccucgaggagggcgucccccccuuccagcucugccuccacuaccgcgacuucauccccggcgucgccaucgccgccaacaucauccacgagggcuuccacaagucccgcaaggucaucgucgucgucucccagcacuucauccagucccgcuggugcaucuucgaguacgagaucgcccagaccuggcaguuccucuccucccgcgccggcaucaucuucaucguccuccagaaggucgagaagacccuccuccgccagcaggucgagcucuaccgccuccucucccgcaacaccuaccucgagugggaggacuccguccucggccgccacaucuucuggcgccgccuccgcaaggcccuccucgacggcaaguccuggaaccccgagggcaccgucggcaccggcugcaacuggcaggaggccaccuccaucuga

SEQ ID NO: 50785 - RNA, 2577 nt, Artificial Sequence
  derived and/or modified sequence opt2 from TLR5__Homo_sapiens__XP_006711569
augggcgaccaccucgaccuccuccucggcgucguccucauggccggccccgucuucggcauccccuccugcuccuucgacggccgcaucgccuucuaccgcuucugcaaccucacccaggucccccagguccucaacaccaccgagcgccuccuccucuccuucaacuacauccgcaccgucaccgccuccuccuuccccuuccucgagcagcuccagcuccucgagcucggcucccaguacaccccccucaccaucgacaaggaggccuuccgcaaccuccccaaccuccgcauccucgaccucggcuccuccaagaucuacuuccuccaccccgacgccuuccagggccucuuccaccucuucgagcuccgccucuacuucugcggccucuccgacgccguccucaaggacggcuacuuccgcaaccucaaggcccucacccgccucgaccucuccaagaaccagauccgcucccucuaccuccaccccuccuucggcaagcucaacucccucaaguccaucgacuucuccuccaaccagaucuuccucgucugcgagcacgagcucgagccccuccagggcaagacccucuccuucuucucccucgccgccaacucccucuacucccgcgucuccgucgacuggggcaagugcaugaaccccuuccgcaacaugguccucgagauccucgacgucuccggcaacggcuggaccgucgacaucaccggcaacuucuccaacgccaucuccaagucccaggccuucucccucauccucgcccaccacaucaugggcgccggcuucggcuuccacaacaucaaggaccccgaccagaacaccuucgccggccucgcccgcuccuccguccgccaccucgaccucucccacggcuucgucuucucccucaacucccgcgucuucgagacccucaaggaccucaagguccucaaccucgccuacaacaagaucaacaagaucgccgacgaggccuucuacggccucgacaaccuccagguccucaaccucuccuacaaccuccucggcgagcucuacuccuccaacuucuacggccuccccaaggucgccuacaucgaccuccagaagaaccacaucgccaucauccaggaccagaccuucaaguuccucgagaagcuccagacccucgaccuccgcgacaacgcccucaccaccauccacuucauccccuccauccccgacaucuuccucuccggcaacaagcucgucacccuccccaagaucaaccucaccgccaaccucauccaccucuccgagaaccgccucgagaaccucgacauccucuacuuccuccuccgcgucccccaccuccagauccucauccucaaccagaaccgcuucuccuccugcuccggcgaccagacccccuccgagaaccccucccucgagcagcucuuccucggcgagaacaugcuccagcucgccugggagaccgagcucugcugggacgucuucgagggccucucccaccuccagguccucuaccucaaccacaacuaccucaacucccucccccccggcgucuucucccaccucaccgcccuccgcggccucucccucaacuccaaccgccucaccguccucucccacaacgaccuccccgccaaccucgagauccucgacaucucccgcaaccagcuccucgcccccaaccccgacgucuucgucucccucuccguccucgacaucacccacaacaaguucaucugcgagugcgagcucuccaccuucaucaacuggcucaaccacaccaacgucaccaucgccggcccccccgccgacaucuacugcgucuaccccgacuccuucuccggcgucucccucuucucccucuccaccgagggcugcgacgaggaggagguccucaagucccucaaguucucccucuucaucgucugcaccgucacccucacccucuuccucaugaccauccucaccgucaccaaguuccgcggcuucugcuucaucugcuacaagaccgcccagcgccucgucuucaaggaccacccccagggcaccgagcccgacauguacaaguacgacgccuaccucugcuucuccuccaaggacuucaccuggguccagaacgcccuccucaagcaccucgacacccaguacuccgaccagaaccgcuucaaccucugcuucgaggagcgcgacuucguccccggcgagaaccgcaucgccaacauccaggacgccaucuggaacucccgcaagaucgucugccucgucucccgccacuuccuccgcgacggcuggugccucgaggccuucuccuacgcccagggccgcugccucuccgaccucaacuccgcccucaucauggucgucgucggcucccucucccaguaccagcucaugaagcaccaguccauccgcggcuucguccagaagcagcaguaccuccgcuggcccgaggaccuccaggacgucggcugguuccuccacaagcucucccagcagauccucaagaaggagaaggagaagaagaaggacaacaacaucccccuccagaccgucgccaccaucuccuga

SEQ ID NO: 50786 - RNA, 2391 nt, Artificial Sequence
  derived and/or modified sequence opt2 from TLR6__Homo_sapiens__NP_006059
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaucgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggcuccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccguccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugacccagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 50787 - RNA, 3150 nt, Artificial Sequence
  derived and/or modified sequence opt2 from TLR7__Homo_sapiens__NP_057646
auggucuuccccauguggacccucaagcgccagauccucauccucuucaacaucauccucaucuccaagcuccucggcgcccgcugguuccccaagacccuccccugcgacgucacccucgacguccccaagaaccacgucaucgucgacugcaccgacaagcaccucaccgagauccccggcggcauccccaccaacaccaccaaccucacccucaccaucaaccacauccccgacaucucccccgccuccuuccaccgccucgaccaccucgucgagaucgacuuccgcugcaacugcguccccaucccccucggcuccaagaacaacaugugcaucaagcgccuccagaucaagccccgcuccuucuccggccucaccuaccucaagucccucuaccucgacggcaaccagcuccucgagaucccccagggccucccccccucccuccagcuccucucccucgaggccaacaacaucuucuccauccgcaaggagaaccucaccgagcucgccaacaucgagauccucuaccucggccagaacugcuacuaccgcaaccccugcuacgucuccuacuccaucgagaaggacgccuuccucaaccucaccaagcucaagguccucucccucaaggacaacaacgucaccgccguccccaccguccuccccuccacccucaccgagcucuaccucuacaacaacaugaucgccaagauccaggaggacgacuucaacaaccucaaccagcuccagauccucgaccucuccggcaacugcccccgcugcuacaacgcccccuuccccugcgcccccugcaagaacaacuccccccuccagauccccgucaacgccuucgacgcccucaccgagcucaagguccuccgccuccacuccaacucccuccagcacguccccccccgcugguucaagaacaucaacaagcuccaggagcucgaccucucccagaacuuccucgccaaggagaucggcgacgccaaguuccuccacuuccuccccucccucauccagcucgaccucuccuucaacuucgagcuccaggucuaccgcgccuccaugaaccucucccaggccuucuccucccucaagucccucaagauccuccgcauccgcggcuacgucuucaaggagcucaaguccuucaaccucuccccccuccacaaccuccagaaccucgagguccucgaccucggcaccaacuucaucaagaucgccaaccucuccauguucaagcaguucaagcgccucaaggucaucgaccucuccgucaacaagaucucccccuccggcgacuccuccgaggucggcuucugcuccaacgcccgcaccuccgucgaguccuacgagccccagguccucgagcagcuccacuacuuccgcuacgacaaguacgcccgcuccugccgcuucaagaacaaggaggccuccuucauguccgucaacgaguccugcuacaaguacggccagacccucgaccucuccaagaacuccaucuucuucgucaaguccuccgacuuccagcaccucuccuuccucaagugccucaaccucuccggcaaccucaucucccagacccucaacggcuccgaguuccagccccucgccgagcuccgcuaccucgacuucuccaacaaccgccucgaccuccuccacuccaccgccuucgaggagcuccacaagcucgagguccucgacaucuccuccaacucccacuacuuccaguccgagggcaucacccacaugcucaacuucaccaagaaccucaagguccuccagaagcucaugaugaacgacaacgacaucuccuccuccaccucccgcaccauggaguccgagucccuccgcacccucgaguuccgcggcaaccaccucgacguccucuggcgcgagggcgacaaccgcuaccuccagcucuucaagaaccuccucaagcucgaggagcucgacaucuccaagaacucccucuccuuccuccccuccggcgucuucgacggcaugccccccaaccucaagaaccucucccucgccaagaacggccucaaguccuucuccuggaagaagcuccagugccucaagaaccucgagacccucgaccucucccacaaccagcucaccaccguccccgagcgccucuccaacugcucccgcucccucaagaaccucauccucaagaacaaccagauccgcucccucaccaaguacuuccuccaggacgccuuccagcuccgcuaccucgaccucuccuccaacaagauccagaugauccagaagaccuccuuccccgagaacguccucaacaaccucaagaugcuccuccuccaccacaaccgcuuccucugcaccugcgacgccgucugguucgucuggugggucaaccacaccgaggucaccauccccuaccucgccaccgacgucaccugcgucggccccggcgcccacaagggccaguccgucaucucccucgaccucuacaccugcgagcucgaccucaccaaccucauccucuucucccucuccaucuccgucucccucuuccucauggucaugaugaccgccucccaccucuacuucugggacgucugguacaucuaccacuucugcaaggccaagaucaagggcuaccagcgccucaucucccccgacugcugcuacgacgccuucaucgucuacgacaccaaggaccccgccgucaccgaguggguccucgccgagcucgucgccaagcucgaggacccccgcgagaagcacuucaaccucugccucgaggagcgcgacuggcuccccggccagcccguccucgagaaccucucccaguccauccagcucuccaagaagaccgucuucgucaugaccgacaaguacgccaagaccgagaacuucaagaucgccuucuaccucucccaccagcgccucauggacgagaaggucgacgucaucauccucaucuuccucgagaagcccuuccagaaguccaaguuccuccagcuccgcaagcgccucugcggcuccuccguccucgaguggcccaccaacccccaggcccaccccuacuucuggcagugccucaagaacgcccucgccaccgacaaccacgucgccuacucccaggucuucaaggagaccgucuga

SEQ ID NO: 50788 - RNA, 3126 nt, Artificial Sequence
  derived and/or modified sequence opt2 from TLR8__Homo_sapiens__NP_619542
auggagaacauguuccuccaguccuccaugcucaccugcaucuuccuccucaucuccggcuccugcgagcucugcgccgaggagaacuucucccgcuccuaccccugcgacgagaagaagcagaacgacuccgucaucgccgagugcuccaaccgccgccuccaggaggucccccagaccgucggcaaguacgucaccgagcucgaccucuccgacaacuucaucacccacaucaccaacgaguccuuccagggccuccagaaccucaccaagaucaaccucaaccacaaccccaacguccagcaccagaacggcaaccccggcauccaguccaacggccucaacaucaccgacggcgccuuccucaaccucaagaaccuccgcgagcuccuccucgaggacaaccagcucccccagauccccuccggccuccccgagucccucaccgagcucucccucauccagaacaacaucuacaacaucaccaaggagggcaucucccgccucaucaaccucaagaaccucuaccucgccuggaacugcuacuucaacaaggucugcgagaagaccaacaucgaggacggcgucuucgagacccucaccaaccucgagcuccucucccucuccuucaacucccucucccacgucccccccaagcuccccuccucccuccgcaagcucuuccucuccaacacccagaucaaguacaucuccgaggaggacuucaagggccucaucaaccucacccuccucgaccucuccggcaacugcccccgcugcuucaacgcccccuuccccugcguccccugcgacggcggcgccuccaucaacaucgaccgcuucgccuuccagaaccucacccagcuccgcuaccucaaccucuccuccaccucccuccgcaagaucaacgccgccugguucaagaacaugccccaccucaagguccucgaccucgaguucaacuaccucgucggcgagaucgccuccggcgccuuccucaccaugcucccccgccucgagauccucgaccucuccuucaacuacaucaagggcuccuacccccagcacaucaacaucucccgcaacuucuccaagcuccucucccuccgcgcccuccaccuccgcggcuacgucuuccaggagcuccgcgaggacgacuuccagccccucaugcagcuccccaaccucuccaccaucaaccucggcaucaacuucaucaagcagaucgacuucaagcucuuccagaacuucuccaaccucgagaucaucuaccucuccgagaaccgcaucuccccccucgucaaggacacccgccaguccuacgccaacuccuccuccuuccagcgccacauccgcaagcgccgcuccaccgacuucgaguucgacccccacuccaacuucuaccacuucacccgcccccucaucaagccccagugcgccgccuacggcaaggcccucgaccucucccucaacuccaucuucuucaucggccccaaccaguucgagaaccuccccgacaucgccugccucaaccucuccgccaacuccaacgcccagguccucuccggcaccgaguucuccgccaucccccacgucaaguaccucgaccucaccaacaaccgccucgacuucgacaacgccuccgcccucaccgagcucuccgaccucgagguccucgaccucuccuacaacucccacuacuuccgcaucgccggcgucacccaccaccucgaguucauccagaacuucaccaaccucaagguccucaaccucucccacaacaacaucuacacccucaccgacaaguacaaccucgaguccaagucccucgucgagcucgucuucuccggcaaccgccucgacauccucuggaacgacgacgacaaccgcuacaucuccaucuucaagggccucaagaaccucacccgccucgaccucucccucaaccgccucaagcacauccccaacgaggccuuccucaaccuccccgccucccucaccgagcuccacaucaacgacaacaugcucaaguucuucaacuggacccuccuccagcaguucccccgccucgagcuccucgaccuccgcggcaacaagcuccucuuccucaccgacucccucuccgacuucaccuccucccuccgcacccuccuccucucccacaaccgcaucucccaccuccccuccggcuuccucuccgaggucuccucccucaagcaccucgaccucuccuccaaccuccucaagaccaucaacaaguccgcccucgagaccaagaccaccaccaagcucuccaugcucgagcuccacggcaaccccuucgagugcaccugcgacaucggcgacuuccgccgcuggauggacgagcaccucaacgucaagaucccccgccucgucgacgucaucugcgccucccccggcgaccagcgcggcaaguccaucgucucccucgagcucaccaccugcgucuccgacgucaccgccgucauccucuucuucuucaccuucuucaucaccaccauggucaugcucgccgcccucgcccaccaccucuucuacugggacgucugguucaucuacaacgucugccucgccaaggucaagggcuaccgcucccucuccaccucccagaccuucuacgacgccuacaucuccuacgacaccaaggacgccuccgucaccgacugggucaucaacgagcuccgcuaccaccucgaggagucccgcgacaagaacguccuccucugccucgaggagcgcgacugggaccccggccucgccaucaucgacaaccucaugcaguccaucaaccaguccaagaagaccgucuucguccucaccaagaaguacgccaaguccuggaacuucaagaccgccuucuaccucgcccuccagcgccucauggacgagaacauggacgucaucaucuucauccuccucgagcccguccuccagcacucccaguaccuccgccuccgccagcgcaucugcaaguccuccauccuccaguggcccgacaaccccaaggccgagggccucuucuggcagacccuccgcaacgucguccucaccgagaacgacucccgcuacaacaacauguacgucgacuccaucaagcaguacuga

SEQ ID NO: 50789 - RNA, 3099 nt, Artificial Sequence
  derived and/or modified sequence opt2 from TLR9__Homo_sapiens__NP_059138
augggcuucugccgcuccgcccuccacccccucucccuccucguccaggccaucaugcucgccaugacccucgcccucggcacccuccccgccuuccuccccugcgagcuccagccccacggccucgucaacugcaacuggcucuuccucaaguccgucccccacuucuccauggccgccccccgcggcaacgucaccucccucucccucuccuccaaccgcauccaccaccuccacgacuccgacuucgcccaccuccccucccuccgccaccucaaccucaaguggaacugcccccccgucggccucucccccaugcacuuccccugccacaugaccaucgagcccuccaccuuccucgccguccccacccucgaggagcucaaccucuccuacaacaacaucaugaccguccccgcccuccccaagucccucaucucccucucccucucccacaccaacauccucaugcucgacuccgccucccucgccggccuccacgcccuccgcuuccucuucauggacggcaacugcuacuacaagaaccccugccgccaggcccucgaggucgcccccggcgcccuccucggccucggcaaccucacccaccucucccucaaguacaacaaccucaccgucgucccccgcaaccuccccuccucccucgaguaccuccuccucuccuacaaccgcaucgucaagcucgcccccgaggaccucgccaaccucaccgcccuccgcguccucgacgucggcggcaacugccgccgcugcgaccacgcccccaaccccugcauggagugcccccgccacuucccccagcuccaccccgacaccuucucccaccucucccgccucgagggccucguccucaaggacuccucccucuccuggcucaacgccuccugguuccgcggccucggcaaccuccgcguccucgaccucuccgagaacuuccucuacaagugcaucaccaagaccaaggccuuccagggccucacccagcuccgcaagcucaaccucuccuucaacuaccagaagcgcgucuccuucgcccaccucucccucgcccccuccuucggcucccucgucgcccucaaggagcucgacaugcacggcaucuucuuccgcucccucgacgagaccacccuccgcccccucgcccgccuccccaugcuccagacccuccgccuccagaugaacuucaucaaccaggcccagcucggcaucuuccgcgccuuccccggccuccgcuacgucgaccucuccgacaaccgcaucuccggcgccuccgagcucaccgccaccaugggcgaggccgacggcggcgagaaggucuggcuccagcccggcgaccucgcccccgcccccgucgacacccccuccuccgaggacuuccgccccaacugcuccacccucaacuucacccucgaccucucccgcaacaaccucgucaccguccagcccgagauguucgcccagcucucccaccuccagugccuccgccucucccacaacugcaucucccaggccgucaacggcucccaguuccucccccucaccggccuccagguccucgaccucucccacaacaagcucgaccucuaccacgagcacuccuucaccgagcucccccgccucgaggcccucgaccucuccuacaacucccagcccuucggcaugcagggcgucggccacaacuucuccuucgucgcccaccuccgcacccuccgccaccucucccucgcccacaacaacauccacucccaggucucccagcagcucugcuccaccucccuccgcgcccucgacuucuccggcaacgcccucggccacaugugggccgagggcgaccucuaccuccacuucuuccagggccucuccggccucaucuggcucgaccucucccagaaccgccuccacacccuccucccccagacccuccgcaaccuccccaagucccuccagguccuccgccuccgcgacaacuaccucgccuucuucaagugguggucccuccacuuccuccccaagcucgagguccucgaccucgccggcaaccagcucaaggcccucaccaacggcucccuccccgccggcacccgccuccgccgccucgacgucuccugcaacuccaucuccuucgucgcccccggcuucuucuccaaggccaaggagcuccgcgagcucaaccucuccgccaacgcccucaagaccgucgaccacuccugguucggcccccucgccuccgcccuccagauccucgacgucuccgccaacccccuccacugcgccugcggcgccgccuucauggacuuccuccucgagguccaggccgccguccccggccuccccucccgcgucaagugcggcucccccggccagcuccagggccucuccaucuucgcccaggaccuccgccucugccucgacgaggcccucuccugggacugcuucgcccucucccuccucgccgucgcccucggccucggcguccccaugcuccaccaccucugcggcugggaccucugguacugcuuccaccucugccucgccuggcuccccuggcgcggccgccaguccggccgcgacgaggacgcccuccccuacgacgccuucgucgucuucgacaagacccaguccgccgucgccgacugggucuacaacgagcuccgcggccagcucgaggagugccgcggccgcugggcccuccgccucugccucgaggagcgcgacuggcuccccggcaagacccucuucgagaaccucugggccuccgucuacggcucccgcaagacccucuucguccucgcccacaccgaccgcgucuccggccuccuccgcgccuccuuccuccucgcccagcagcgccuccucgaggaccgcaaggacgucgucguccucgucauccucucccccgacggccgccgcucccgcuacguccgccuccgccagcgccucugccgccaguccguccuccucuggccccaccagcccuccggccagcgcuccuucugggcccagcucggcauggcccucacccgcgacaaccaccacuucuacaaccgcaacuucugccagggccccaccgccgaguga

SEQ ID NO: 50790 - RNA, 774 nt, Artificial Sequence
  derived and/or modified sequence opt2 from TLX1__Homo_sapiens__NP_001182446
auggagcaccucggcccccaccaccuccaccccggccacgccgagcccaucuccuucggcaucgaccagauccucaacucccccgaccagggcggcugcaugggccccgccucccgccuccaggacggcgaguacggccucggcugccucgucggcggcgccuacaccuacggcggcggcggcuccgccgccgccaccggcgccggcggcgccggcgccuacggcaccggcggccccggcggccccggcggccccgccggcggcggcggcgccugcuccaugggcccccucaccggcuccuacaacgucaacauggcccucgccggcggccccggccccggcggcggcggcggcuccuccggcggcgccggcgcccucuccgccgccggcgucauccgcguccccgcccaccgcccccucgccggcgccgucgcccacccccagccccucgccaccggccuccccaccguccccuccguccccgccaugcccggcgucaacaaccucaccggccucaccuuccccuggauggaguccaaccgccgcuacaccaaggaccgcuucaccggccaccccuaccagaaccgcaccccccccaagaagaagaagccccgcaccuccuucacccgccuccagaucugcgagcucgagaagcgcuuccaccgccagaaguaccucgccuccgccgagcgcgccgcccucgccaaggcccucaagaugaccgacgcccaggucaagaccugguuccagaaccgccgcaccaaguggcgcuga

SEQ ID NO: 50791 - RNA, 855 nt, Artificial Sequence
  derived and/or modified sequence opt2 from TLX2__Homo_sapiens__NP_057254
auggagcccggcaugcucggcccccacaaccucccccaccacgagcccaucuccuucggcaucgaccagauccucuccggccccgagacccccggcggcggccucggccucggccgcggcggccagggccacggcgagaacggcgccuucuccggcggcuaccacggcgccuccggcuacggccccgccggcucccucgccccccuccccggcuccuccggcgucggccccggcggcgucauccgcguccccgcccaccgcccccuccccguccccccccccgccggcggcgcccccgccguccccggccccuccggccucggcggcgccggcggccucgccggccucaccuuccccuggauggacuccggccgccgcuucgccaaggaccgccucaccgccgcccucucccccuucuccggcacccgccgcaucggccaccccuaccagaaccgcaccccccccaagcgcaagaagccccgcaccuccuucucccgcucccagguccucgagcucgagcgccgcuuccuccgccagaaguaccucgccuccgccgagcgcgccgcccucgccaaggcccuccgcaugaccgacgcccaggucaagaccugguuccagaaccgccgcaccaaguggcgccgccagaccgccgaggagcgcgaggccgagcgccaccgcgccggccgccuccuccuccaccuccagcaggacgcccucccccgcccccuccgccccccccucccccccgacccccucugccuccacaacuccucccucuucgcccuccagaaccuccagcccugggccgaggacaacaaggucgccuccgucuccggccucgccuccgucgucuga

SEQ ID NO: 50792 - RNA, 876 nt, Artificial Sequence
  derived and/or modified sequence opt2 from TLX3__Homo_sapiens__NP_066305
auggaggcccccgccuccgcccagaccccccacccccacgagcccaucuccuucggcaucgaccagauccucaacucccccgaccaggacuccgcccccgccccccgcggccccgacggcgccuccuaccucggcggcccccccggcggccgccccggcgccaccuaccccucccuccccgccuccuucgccggccucggcgcccccuucgaggacgccggcuccuacuccgucaaccucucccucgcccccgccggcgucauccgcguccccgcccaccgcccccuccccggcgccgucccccccccccuccccuccgcccuccccgccaugcccuccguccccaccgucuccucccucggcggccucaacuuccccuggauggaguccucccgccgcuucgucaaggaccgcuucaccgccgccgccgcccucacccccuucaccgucacccgccgcaucggccaccccuaccagaaccgcaccccccccaagcgcaagaagccccgcaccuccuucucccgcguccagaucugcgagcucgagaagcgcuuccaccgccagaaguaccucgccuccgccgagcgcgccgcccucgccaagucccucaagaugaccgacgcccaggucaagaccugguuccagaaccgccgcaccaaguggcgccgccagaccgccgaggagcgcgaggccgagcgccagcaggccucccgccucaugcuccagcuccagcacgacgccuuccagaagucccucaacgacuccauccagcccgacccccucugccuccacaacuccucccucuucgcccuccagaaccuccagcccugggaggaggacuccuccaagguccccgccgucaccucccucgucuga

SEQ ID NO: 50793 - RNA, 609 nt, Artificial Sequence
  derived and/or modified sequence opt2 from TM4SF1__Homo_sapiens__NP_055035
augugcuacggcaagugcgcccgcugcaucggccacucccucgucggccucgcccuccucugcaucgccgccaacauccuccucuacuuccccaacggcgagaccaaguacgccuccgagaaccaccucucccgcuucgucugguucuucuccggcaucgucggcggcggccuccucaugcuccuccccgccuucgucuucaucggccucgagcaggacgacugcugcggcugcugcggccacgagaacugcggcaagcgcugcgccaugcucuccuccguccucgccgcccucaucggcaucgccggcuccggcuacugcgucaucgucgccgcccucggccucgccgagggcccccucugccucgacucccucggccaguggaacuacaccuucgccuccaccgagggccaguaccuccucgacaccuccaccugguccgagugcaccgagcccaagcacaucgucgaguggaacgucucccucuucuccauccuccucgcccucggcggcaucgaguucauccucugccucauccaggucaucaacggcguccucggcggcaucugcggcuucugcugcucccaccagcagcaguacgacugcuga

SEQ ID NO: 50794 - RNA, 690 nt, Artificial Sequence
  derived and/or modified sequence opt2 from TM4SF20__Homo_sapiens__NP_079071
augaccugcugcgagggcuggaccuccugcaacggcuucucccuccucguccuccuccuccucggcgucguccucaacgccaucccccucaucgucucccucgucgaggaggaccaguucucccagaaccccaucuccugcuucgaguggugguuccccggcaucaucggcgccggccucauggccauccccgccaccaccaugucccucaccgcccgcaagcgcgccugcugcaacaaccgcaccggcauguuccucuccucccucuucuccgucaucaccgucaucggcgcccucuacugcaugcucaucuccauccaggcccuccucaagggcccccucaugugcaacucccccuccaacuccaacgccaacugcgaguucucccucaagaacaucuccgacauccaccccgaguccuucaaccuccagugguucuucaacgacuccugcgccccccccaccggcuucaacaagcccaccuccaacgacaccauggccuccggcuggcgcgccuccuccuuccacuucgacuccgaggagaacaagcaccgccucauccacuucuccgucuuccucggccuccuccucgucggcauccucgagguccucuucggccucucccagaucgucaucggcuuccucggcugccucugcggcgucuccaagcgccgcucccagaucgucuga

SEQ ID NO: 50795 - RNA, 609 nt, Artificial Sequence
  derived and/or modified sequence opt2 from TM4SF4__Homo_sapiens__NP_004608
augugcaccggcggcugcgcccgcugccucggcggcacccucaucccccucgccuucuucggcuuccucgccaacauccuccucuucuuccccggcggcaaggucaucgacgacaacgaccaccucucccaggagaucugguucuucggcggcauccucggcuccggcguccucaugaucuuccccgcccucgucuuccucggccucaagaacaacgacugcugcggcugcugcggcaacgagggcugcggcaagcgcuucgccauguucaccuccaccaucuucgccgucgucggcuuccucggcgccggcuacuccuucaucaucuccgccaucuccaucaacaagggccccaagugccucauggccaacuccaccuggggcuaccccuuccacgacggcgacuaccucaacgacgaggcccucuggaacaagugccgcgagccccucaacgucguccccuggaaccucacccucuucuccauccuccucgucgucggcggcauccagaugguccucugcgccauccaggucgucaacggccuccucggcacccucugcggcgacugccagugcugcggcugcugcggcggcgacggccccgucuga

SEQ ID NO: 50796 - RNA, 594 nt, Artificial Sequence
  derived and/or modified sequence opt2 from TM4SF5__Homo_sapiens__NP_003954
augugcaccggcaagugcgcccgcugcgucggccucucccucaucacccucugccucgucugcaucgucgccaacgcccuccuccucguccccaacggcgagaccuccuggaccaacaccaaccaccucucccuccaggucuggcucaugggcggcuucaucggcggcggccucaugguccucugccccggcaucgccgccguccgcgccggcggcaagggcugcugcggcgccggcugcugcggcaaccgcugccgcaugcuccgcuccgucuucuccuccgccuucggcguccucggcgccaucuacugccucuccgucuccggcgccggccuccgcaacggcccccgcugccucaugaacggcgaguggggcuaccacuucgaggacaccgccggcgccuaccuccucaaccgcacccucugggaccgcugcgaggcccccccccgcgucguccccuggaacgucacccucuucucccuccucgucgccgccuccugccucgagaucguccucugcggcauccagcucgucaacgccaccaucggcgucuucugcggcgacugccgcaagaagcaggacaccccccacuga

SEQ ID NO: 50797 - RNA, 1134 nt, Artificial Sequence
  derived and/or modified sequence opt2 from TM6SF2__Homo_sapiens__NP_001001524
auggacauccccccccucgccggcaagaucgccgcccucucccucuccgcccuccccgucuccuacgcccucaaccacgucuccgcccucucccacccccucugggucgcccucauguccgcccucauccucggccuccucuucgucgccgucuacucccucucccacggcgaggucuccuacgacccccucuacgccgucuucgccgucuucgccuucaccuccgucgucgaccucaucaucgcccuccaggaggacuccuacgucgucggcuucauggaguucuacaccaaggagggcgagcccuaccuccgcaccgcccacggcgucuucaucugcuacugggacggcaccguccacuaccuccucuaccucgccauggccggcgccaucugccgccgcaagcgcuaccgcaacuucggccucuacuggcucggcuccuucgccauguccauccucgucuuccucaccggcaacauccucggcaaguacuccuccgagauccgccccgccuucuuccucaccauccccuaccuccucguccccugcugggccggcaugaaggucuucucccagccccgcgcccucacccgcugcaccgccaacaugguccaggaggagcagcgcaagggccuccuccagcgccccgccgaccucgcccucgucaucuaccucauccucgccggcuucuucacccucuuccgcggccucgucguccucgacugccccaccgacgccugcuucgucuacaucuaccaguacgagcccuaccuccgcgaccccgucgccuaccccaagguccagaugcucauguacauguucuacguccuccccuucugcggccucgccgccuacgcccucaccuuccccggcugcuccuggcuccccgacugggcccucgucuucgccggcggcaucggccaggcccaguucucccacaugggcgccuccaugcaccuccgcacccccuucaccuaccgcguccccgaggacaccuggggcugcuucuucgucugcaaccuccucuacgcccucggcccccaccuccucgccuaccgcugccuccaguggcccgccuucuuccaccagcccccccccuccgacccccucgcccuccacaagaagcagcacuga

SEQ ID NO: 50798 - RNA, 1176 nt, Artificial Sequence
  derived and/or modified sequence opt2 from TM7SF2__Homo_sapiens__NP_001264162
auggcccccacccagggcccccgcgccccccucgaguucggcggcccccucggcgccgccgcccuccuccuccuccuccccgccaccauguuccaccuccuccucgccgcccgcuccggccccgcccgccuccucggcccccccgccucccuccccggccucgagguccucugguccccccgcgcccuccuccucuggcucgccuggcucggccuccaggccgcccucuaccuccuccccgcccgcaaggucgccgagggccaggagcucaaggacaagucccgccuccgcuaccccaucaacggcuuccaggcccucguccucaccgcccuccucgucggccucggcauguccgccggccucccccucggcgcccuccccgagaugcuccucccccucgccuucgucgccacccucaccgccuucaucuucucccucuuccucuacaugaaggcccaggucgcccccgucuccgcccucgcccccggcggcaacuccggcaaccccaucuacgacuucuuccucggccgcgagcucaacccccgcaucugcuucuucgacuucaaguacuucugcgagcuccgccccggccucaucggcuggguccucaucaaccucgcccuccucaugaaggaggccgagcuccgcggcucccccucccucgccauguggcucgucaacggcuuccagcuccucuacgucggcgacgcccucuggcacgaggaggccguccucaccaccauggacaucacccacgacggcuucggcuucaugcucgccuucggcgacauggccuggguccccuucaccuacucccuccaggcccaguuccuccuccaccacccccagccccucggccuccccauggccuccgucaucugccucaucaacggccucgagaccaucuccaccgccaccggccgcaagcuccucgucuccggcugguggggcaugguccgccaccccaacuaccucggcgaccucaucauggcccucgccuggucccuccccugcggcgucucccaccuccuccccuacuucuaccuccucuacuucaccgcccuccucguccaccgcgaggcccgcgacgagcgccagugccuccagaaguacggccucgccuggcaggaguacugccgccgcguccccuaccgcaucaugcccuacaucuacuga

SEQ ID NO: 50799 - RNA, 1992 nt, Artificial Sequence
  derived and/or modified sequence opt2 from TM9SF2__Homo_sapiens__NP_004791
auguccgcccgccuccccguccucucccccccccgcuggccccgccuccuccuccucucccuccuccuccucggcgccguccccggcccccgccgcuccggcgccuucuaccuccccggccucgcccccgucaacuucugcgacgaggagaagaaguccgacgagugcaaggccgagaucgagcucuucgucaaccgccucgacuccgucgaguccguccuccccuacgaguacaccgccuucgacuucugccaggccuccgagggcaagcgccccuccgagaaccucggccagguccucuucggcgagcgcaucgagcccucccccuacaaguucaccuucaacaagaaggagaccugcaagcucgucugcaccaagaccuaccacaccgagaaggccgaggacaagcagaagcucgaguuccucaagaaguccaugcuccucaacuaccagcaccacuggaucgucgacaacaugcccgucaccuggugcuacgacgucgaggacggccagcgcuucugcaaccccggcuuccccaucggcugcuacaucaccgacaagggccacgccaaggacgccugcgucaucuccuccgacuuccacgagcgcgacaccuucuacaucuucaaccacgucgacaucaagaucuacuaccacgucgucgagaccggcuccaugggcgcccgccucgucgccgccaagcucgagcccaaguccuucaagcacacccacaucgacaagcccgacugcuccggcccccccauggacaucuccaacaaggccuccggcgagaucaagaucgccuacaccuacuccgucuccuucgaggaggacgacaagauccgcugggccucccgcugggacuacauccucgaguccaugccccacacccacauccagugguucuccaucaugaacucccucgucaucguccucuuccucuccggcauggucgccaugaucaugcuccgcacccuccacaaggacaucgcccgcuacaaccagauggacuccaccgaggacgcccaggaggaguucggcuggaagcucguccacggcgacaucuuccgccccccccgcaagggcaugcuccucuccgucuuccucggcuccggcacccagauccucaucaugaccuucgucacccucuucuucgccugccucggcuuccucucccccgccaaccgcggcgcccucaugaccugcgccgucguccucuggguccuccucggcacccccgccggcuacgucgccgcccgcuucuacaaguccuucggcggcgagaaguggaagaccaacguccuccucaccuccuuccucugccccggcaucgucuucgccgacuucuucaucaugaaccucauccucuggggcgagggcuccuccgccgccauccccuucggcacccucgucgccauccucgcccucugguucugcaucuccgucccccucaccuucaucggcgccuacuucggcuucaagaagaacgccaucgagcaccccguccgcaccaaccagaucccccgccagauccccgagcaguccuucuacaccaagccccuccccggcaucaucaugggcggcauccuccccuucggcugcaucuucauccagcucuucuucauccucaacuccaucuggucccaccagauguacuacauguucggcuuccucuuccucgucuucaucauccucgucaucaccugcuccgaggccaccauccuccucugcuacuuccaccucugcgccgaggacuaccacuggcaguggcgcuccuuccucaccuccggcuucaccgccgucuacuuccucaucuacgccguccacuacuucuucuccaagcuccagaucaccggcaccgccuccaccauccucuacuucggcuacaccaugaucaugguccucaucuucuuccucuucaccggcaccaucggcuucuucgccugcuucugguucgucaccaagaucuacuccgucgucaaggucgacuga

SEQ ID NO: 50800 - RNA, 1929 nt, Artificial Sequence
  derived and/or modified sequence opt2 from TM9SF4__Homo_sapiens__NP_055557
auggccaccgccauggacuggcuccccuggucccuccuccucuucucccucaugugcgagaccuccgccuucuacguccccggcgucgcccccaucaacuuccaccagaacgaccccgucgagaucaaggccgucaagcucaccuccucccgcacccagcuccccuacgaguacuacucccuccccuucugccagcccuccaagaucaccuacaaggccgagaaccucggcgagguccuccgcggcgaccgcaucgucaacacccccuuccagguccucaugaacuccgagaagaagugcgagguccucugcucccaguccaacaagcccgucacccucaccgucgagcagucccgccucgucgccgagcgcaucaccgaggacuacuacguccaccucaucgccgacaaccuccccgucgccacccgccucgagcucuacuccaaccgcgacuccgacgacaagaagaaggagaaggacguccaguucgagcacggcuaccgccucggcuucaccgacgucaacaagaucuaccuccacaaccaccucuccuucauccucuacuaccaccgcgaggacauggaggaggaccaggagcacaccuaccgcgucguccgcuucgaggucaucccccaguccauccgccucgaggaccucaaggccgacgagaaguccuccugcacccuccccgagggcaccaacuccuccccccaggagaucgaccccaccaaggagaaccagcucuacuucaccuacuccguccacugggaggaguccgacaucaagugggccucccgcugggacaccuaccucaccauguccgacguccagauccacugguucuccaucaucaacuccgucgucgucgucuucuuccucuccggcauccucuccaugaucaucauccgcacccuccgcaaggacaucgccaacuacaacaaggaggacgacaucgaggacaccauggaggaguccggcuggaagcucguccacggcgacgucuuccgccccccccaguaccccaugauccucuccucccuccucggcuccggcauccagcucuucugcaugauccucaucgucaucuucgucgccaugcucggcaugcucucccccuccucccgcggcgcccucaugaccaccgccugcuuccucuucauguucaugggcgucuucggcggcuucuccgccggccgccucuaccgcacccucaagggccaccgcuggaagaagggcgccuucugcaccgccacccucuaccccggcgucgucuucggcaucugcuucguccucaacugcuucaucuggggcaagcacuccuccggcgccguccccuuccccaccauggucgcccuccucugcaugugguucggcaucucccucccccucgucuaccucggcuacuacuucggcuuccgcaagcagcccuacgacaaccccguccgcaccaaccagaucccccgccagauccccgagcagcgcugguacaugaaccgcuucgucggcauccucauggccggcauccuccccuucggcgccauguucaucgagcucuucuucaucuucuccgccaucugggagaaccaguucuacuaccucuucggcuuccucuuccucgucuucaucauccucgucgucuccugcucccagaucuccaucgucauggucuacuuccagcucugcgccgaggacuaccgcuggugguggcgcaacuuccucgucuccggcggcuccgccuucuacguccucgucuacgccaucuucuacuucgucaacaagcucgacaucgucgaguucauccccucccuccucuacuucggcuacaccgcccucaugguccucuccuucuggcuccucaccggcaccaucggcuucuacgccgccuacauguucguccgcaagaucuacgccgccgucaagaucgacuga

SEQ ID NO: 50801 - RNA, 858 nt, Artificial Sequence
  derived and/or modified sequence opt2 from TMBIM4__Homo_sapiens__NP_001269535
auggccgaccccgacccccgcuacccccgcuccuccaucgaggacgacuucaacuacggcuccuccgucgccuccgccaccguccacauccgcaugguccuccagcgcgacugcaccuucuccaagcaguacaugcgcauccccuccgcccccuccgccacccucaacaucauccgcuucuuccaccuccgccaguccggccgcuccggcauggucaacaucuucuacaagggccccaccuuccuccgcaaggucuacuccauccucucccuccagguccuccucaccaccgucaccuccaccgucuuccucuacuucgaguccguccgcaccuucguccacgagucccccgcccucauccuccucuucgcccucggcucccucggccucaucuucgcccucauccucaaccgccacaaguacccccucaaccucuaccuccucuucggcuucacccuccucgaggcccucaccgucgccgucgucgucaccuucuacgacgucuacaucauccuccaggccuucauccucaccaccaccgucuucuucggccucaccgucuacacccuccaguccaagaaggacuucuccaaguucggcgccggccucuucgcccuccucuggauccucugccucuccggcuuccucaaguucuucuucuacuccgagaucauggagcucguccucgccgccgccggcgcccuccucuucugcggcuucaucaucuacgacacccacucccucaugcacaagcucucccccgaggaguacguccucgccgccaucucccucuaccucgacaucaucaaccucuuccuccaccuccuccgcuuccucgaggccgucaacaagaaguga

SEQ ID NO: 50802 - RNA, 714 nt, Artificial Sequence
  derived and/or modified sequence opt2 from TMBIM6__Homo_sapiens__NP_003208
augaacaucuucgaccgcaagaucaacuucgacgcccuccucaaguucucccacaucacccccuccacccagcagcaccucaagaaggucuacgccuccuucgcccucugcauguucgucgccgccgccggcgccuacguccacauggucacccacuucauccaggccggccuccucuccgcccucggcucccucauccucaugaucuggcucauggccaccccccacucccacgagaccgagcagaagcgccucggccuccucgccggcuucgccuuccucaccggcgucggccucggccccgcccucgaguucugcaucgccgucaaccccuccauccuccccaccgccuucaugggcaccgccaugaucuucaccugcuucacccucuccgcccucuacgcccgccgccgcuccuaccucuuccucggcggcauccucauguccgcccucucccuccuccuccucuccucccucggcaacgucuucuucggcuccaucuggcucuuccaggccaaccucuacgucggccucgucgucaugugcggcuucguccucuucgacacccagcucaucaucgagaaggccgagcacggcgaccaggacuacaucuggcacugcaucgaccucuuccucgacuucaucaccgucuuccgcaagcucaugaugauccucgccaugaacgagaaggacaagaagaaggagaagaaguga

SEQ ID NO: 50803 - RNA, 2283 nt, Artificial Sequence
  derived and/or modified sequence opt2 from TMC1__Homo_sapiens__NP_619636
augucccccaagaagguccagaucaaggucgaggagaaggaggacgagaccgaggaguccuccuccgaggaggaggaggaggucgaggacaagcucccccgccgcgagucccuccgccccaagcgcaagcgcacccgcgacgucaucaacgaggacgaccccgagcccgagcccgaggacgaggagacccgcaaggcccgcgagaaggagcgccgccgccgccucaagcgcggcgccgaggaggaggagaucgacgaggaggagcucgagcgccucaaggccgagcucgacgagaagcgccagaucaucgccaccgucaagugcaagcccuggaagauggagaagaagaucgagguccucaaggaggccaagaaguucgucuccgagaacgagggcgcccucggcaagggcaagggcaagcgcugguucgccuucaagaugaugauggccaagaagugggccaaguuccuccgcgacuucgagaacuucaaggccgccugcguccccugggagaacaagaucaaggccaucgagucccaguucggcuccuccgucgccuccuacuuccucuuccuccgcuggauguacggcgucaacaugguccucuucauccucaccuucucccucaucaugcuccccgaguaccucuggggccuccccuacggcucccucccccgcaagaccgucccccgcgccgaggaggccuccgccgccaacuucggcguccucuacgacuucaacggccucgcccaguacuccguccucuucuacggcuacuacgacaacaagcgcaccaucggcuggaugaacuuccgccucccccucuccuacuuccucgucggcaucaugugcaucggcuacuccuuccucgucguccucaaggccaugaccaagaacaucggcgacgacggcggcggcgacgacaacaccuucaacuucuccuggaaggucuucaccuccugggacuaccucaucggcaaccccgagaccgccgacaacaaguucaacuccaucaccaugaacuucaaggaggccaucaccgaggagaaggccgcccaggucgaggagaacguccaccucauccgcuuccuccgcuuccucgccaacuucuucgucuuccucacccucggcggcuccggcuaccucaucuucugggccgucaagcgcucccaggaguucgcccagcaggaccccgacacccucggcuggugggagaagaacgagaugaacauggucaugucccuccucggcauguucugccccacccucuucgaccucuucgccgagcucgaggacuaccacccccucaucgcccucaaguggcuccucggccgcaucuucgcccuccuccucggcaaccucuacgucuucauccucgcccucauggacgagaucaacaacaagaucgaggaggagaagcucgucaaggccaacaucacccucugggaggccaacaugaucaaggccuacaacgccuccuucuccgagaacuccaccggcccccccuucuucguccaccccgccgacgucccccgcggccccugcugggagaccauggucggccaggaguucguccgccucaccgucuccgacguccucaccaccuacgucaccauccucaucggcgacuuccuccgcgccugcuucguccgcuucugcaacuacugcuggugcugggaccucgaguacggcuaccccuccuacaccgaguucgacaucuccggcaacguccucgcccucaucuucaaccagggcaugaucuggaugggcuccuucuucgcccccucccuccccggcaucaacauccuccgccuccacaccuccauguacuuccagugcugggccgucaugugcugcaacguccccgaggcccgcgucuucaaggccucccgcuccaacaacuucuaccucggcaugcuccuccucauccucuuccucuccaccaugcccguccucuacaugaucgucucccucccccccuccuucgacugcggccccuucuccggcaagaaccgcauguucgaggucaucggcgagacccucgagcacgacuuccccuccuggauggccaagauccuccgccagcucuccaaccccggccucgucaucgccgucauccucgucaugguccucgccaucuacuaccucaacgccaccgccaagggccagaaggccgccaaccucgaccucaagaagaagaugaagaugcaggcccucgagaacaagaugcgcaacaagaagauggccgccgcccgcgccgccgccgccgccggccgccaguga

SEQ ID NO: 50804 - RNA, 2721 nt, Artificial Sequence
  derived and/or modified sequence opt2 from TMC2__Homo_sapiens__NP_542789
augucccaccaggucaagggccucaaggaggaggcccgcggcggcgucaagggccgcgucaaguccggcuccccccacaccggcgaccgccucggccgccgcuccuccuccaagcgcgcccucaaggccgagggcacccccggccgccgcggcgcccagcgcucccagaaggagcgcgccggcggcucccccucccccggcuccccccgccgcaagcagaccggccgccgccgccaccgcgaggagcucggcgagcaggagcgcggcgaggccgagcgcaccugcgagggccgccgcaagcgcgacgagcgcgccuccuuccaggagcgcaccgccgcccccaagcgcgagaaggagaucccccgccgcgaggagaaguccaagcgccagaagaagccccgcuccuccucccucgccuccuccgccuccggcggcgagucccucuccgaggaggagcucgcccagauccucgagcaggucgaggagaagaagaagcucaucgccaccaugcgcuccaagcccuggcccauggccaagaagcucaccgagcuccgcgaggcccaggaguucgucgagaaguacgagggcgcccucggcaagggcaagggcaagcagcucuacgccuacaagaugcucauggccaagaagugggucaaguucaagcgcgacuucgacaacuucaagacccagugcauccccugggagaugaagaucaaggacaucgagucccacuucggcuccuccgucgccuccuacuucaucuuccuccgcuggauguacggcgucaaccucguccucuucggccucaucuucggccucgucaucauccccgagguccucaugggcaugcccuacggcuccaucccccgcaagaccgucccccgcgccgaggaggagaaggccauggacuucuccguccucugggacuucgagggcuacaucaaguacuccgcccucuucuacggcuacuacaacaaccagcgcaccaucggcuggcuccgcuaccgccuccccauggccuacuucauggucggcgucuccgucuucggcuacucccucaucaucgucauccgcuccauggccuccaacacccagggcuccaccggcgagggcgaguccgacaacuucaccuucuccuucaagauguucaccuccugggacuaccucaucggcaacuccgagaccgccgacaacaaguacgccuccaucaccaccuccuucaaggaguccaucgucgacgagcaggaguccaacaaggaggagaacauccaccucacccgcuuccuccgcguccucgccaacuuccucaucaucugcugccucugcggcuccggcuaccucaucuacuucgucgucaagcgcucccagcaguucuccaagaugcagaacgucuccugguacgagcgcaacgaggucgagaucgucaugucccuccucggcauguucugccccccccucuucgagaccaucgccgcccucgagaacuaccacccccgcaccggccucaaguggcagcucggccgcaucuucgcccucuuccucggcaaccucuacaccuuccuccucgcccucauggacgacguccaccucaagcucgccaacgaggagaccaucaagaacaucacccacuggacccucuucaacuacuacaacuccuccggcuggaacgaguccgucccccgccccccccuccaccccgccgacgucccccgcggcuccugcugggagaccgccgucggcaucgaguucaugcgccucaccgucuccgacaugcucgucaccuacaucaccauccuccucggcgacuuccuccgcgccugcuucguccgcuucaugaacuacugcuggugcugggaccucgaggccggcuuccccuccuacgccgaguucgacaucuccggcaacguccucggccucaucuucaaccagggcaugaucuggaugggcuccuucuacgcccccggccucgucggcaucaacguccuccgccuccucaccuccauguacuuccagugcugggccgucauguccuccaacgucccccacgagcgcgucuucaaggccucccgcuccaacaacuucuacaugggccuccuccuccucguccucuuccucucccuccuccccgucgccuacaccaucaugucccucccccccuccuucgacugcggccccuucuccggcaagaaccgcauguacgacguccuccaggagaccaucgagaacgacuuccccaccuuccucggcaagaucuucgccuuccucgccaaccccggccucaucauccccgccauccuccucauguuccucgccaucuacuaccucaacuccgucuccaagucccucucccgcgccaacgcccagcuccgcaagaagauccagguccuccgcgaggucgagaagucccacaaguccgucaagggcaaggccaccgcccgcgacuccgaggacacccccaaguccuccuccaagaacgccacccagcuccagcucaccaaggaggagaccaccccccccuccgccucccagucccaggccauggacaagaaggcccagggccccggcaccuccaacuccgccucccgcaccacccuccccgccuccggccaccuccccaucucccgcccccccggcaucggccccgacuccggccacgcccccucccagacccaccccuggcgcuccgccuccggcaaguccgcccagcgccccccccacuga

SEQ ID NO: 50805 - RNA, 3303 nt, Artificial Sequence
  derived and/or modified sequence opt2 from TMC3__Homo_sapiens__NP_001074001
augaagaccuccaaggccucccagcgcuaccgcggcauccgccgcaacgccucccagugcuaccucuaccaggagucccuccuccucuccaaccucgacgacuccuucuccgccgacgagaccggcgacuccaacgaccccgagcagaucuuccagaacauccaguuccagaaggaccucauggccaacauccgcugccgccccuggaccaugggccagaagcuccgcgcccuccgccaggccaagaacaucguccucaaguucgagggccgccucacccgcacccgcggcuaccaggccgccggcgccgagcucuggcgcaaguucgcccgccucgccugcaacuucgucgucaucuucauccccugggagaugcgcaucaagaagaucgagucccacuucggcuccggcgucgccuccuacuucaucuuccuccgcuggcucuucggcaucaacaucguccucaccaucaugaccggcgccuucaucgucauccccgagcucaucgccggccagcccuucggcuccaccgcccgcaagaccauccccaaggagcaggucuccuccgcccaggaccucgacaccgucuggucccucggcggcuaccuccaguacuccguccucuucuacggcuacuacggccgcgagcgcaagaucggccgcgccggcuaccgccucccccucgccuacuuccucgucggcauggccgucuucgccuacuccuucaucauccuccucaagaagauggccaagaacucccgcaccucccucgccuccgccuccaacgagaacuacaccuucugcuggcgcgucuucugcgccugggacuaccucaucggcaaccccgaggccgccgaguccaagaccgccgccaucgucaacuccauccgcgaggccauccucgaggagcaggagaagaagaaguccaagaaccucgccgucaccaucugccuccgcaucaucgccaacauccucguccuccucucccucgccggcuccaucuaccucaucuacuucgucgucgaccgcucccagaagcucgagcaguccaagaaggagcucacccucugggagaagaacgaggucuccgucgucgucucccucgucaccaugaucgcccccuccgccuucgaccucaucgccgcccucgagauguaccacccccgcaccacccuccgcuuccagcucgcccgcguccucguccucuaccucggcaaccucuacucccucaucaucgcccuccucgacaaggucaacuccauguccaucgaggagauggccaccaagaacaacaccucccacuggaucgacuccaccaccuucuucgccacccgcaccgcccccgaggaggagaagugguccaccucccgccccggcaugggccuccgccgcaacaacaccugggcccucgaggagaccuccaucuccgccuacaccaugccccucaucaaggccaacaagaccucccuccacacccaguccccccaggaccagugcugggagaccuacgucggccaggagaugcucaagcucuccaucaucgacaugcucuucaccgucgccuccauccuccucaucgacuucuuccgcggccucuucguccgcuaccucuccgacuacuggugcugggaccucgaguccaaguuccccgaguacggcgaguucaagaucgccgagaacguccuccaccucgucuacaaccagggcaugaucuggaugggcgccuucuucucccccugccuccccgccuucaacguccucaagcucaucggccucauguaccuccgcuccugggccguccucaccugcaacgucccccaccagcaggucuuccgcgccucccgcuccaacaacuucuaccucgccaugcuccucuucaugcucuuccucugcaugcuccccaccaucuucgccaucguccgcuacaagcccucccucaacugcggccccuucuccggccaggagaagaucuacgacaucgucuccgagaccaucgagaaggacuuccccgucugguucggcuccgucgucggccacaucuccucccccgucgucauccuccccgccguccuccuccucuucaugcucaucuacuaccuccaguccaucgcccgcucccucaagcucuccaaccaccagcucaagaugcagauccagaacgcccgcuccgaggacaagaagaaggucgcccagauggucgaggcccgcauccagacccaggaggaguccaccaagaagcuccccaacgacuccgaccucaccucccagcucuccuccgcccacuccggcaccccccagaacaacggcaacgucgcccacuucgacuccggcuccuccaaguccggccgcaucgagaccgucgcccaguccaugccccaguccccccgccccggcgaccgcgcccccuccuccccccuccccggcguccccaagucccgccucgagcacgagaccaaccgcuaccuccacggccucugcgccuccaccuccgaccuccaccgcaaccgcucccgcacccccaugaccuucaccacccacaucgaggacguccacuccgagccccucuuccgcaaggacuuccagcagaucaaccccccccaccgcggcccccaggccuccacccuccucgcccagggcccccgcccccacgccccccgcuacuacgucaucaacgagugcgacuccuacaagaagaagcaccucaacgucuggcccgagcgccacuucaagaucgacgccuccggcgacaucgucgagcucuacccccgcaacguccgccaguacgccucccgcgucccccgccagccccccuccccccagcucuccgaggaggaggaggagacccccucccgcgacuggaucaagcgcucccuccccccccgcucccucaucgaccuccgccgcgccccccacuucuacaucggcgagcgcuccgagucccagacccgcgaccccgagcaccagggccgcguccacuacaaguccuggaacgaggacuucgagggccaccucgagcgccccgccuacgucccccgcaagccccgcucccgcaacuuccaguacccccagcccccccucaagccccgcggcaagccccgcuucgagcccucccucaccgaguccgacuccgucuccgccgccuccuccuccgaccagcagaacuccuccgccgaccaguaccuccaggucacccacucccagggccgcuucccccgcuccgucggccagcccucccgccgcaaggccaaguccggccaggagcucaccgucgaccucgacgaccucaucugcuccgacgucuga

SEQ ID NO: 50806 - RNA, 3021 nt, Artificial Sequence
  derived and/or modified sequence opt2 from TMC5__Homo_sapiens__NP_001098718
auguccgccuacuaccgcaacaacugguccgaggaggaccccgacuaccccgacuacuccggcucccagaaccgcacccagggcuaccucaagacccagggcuaccccgacguccccggcccccucaacaaccccgacuaccccggcacccgcuccaaccccuacuccgucgccucccgcacccgccccgacuaccccggcucccucgccgagcccaacuacccccgcucccucuccaaccccgacuacuccggcacccgcuccaacgccuacuccgccgccucccgcaccucccccgaccaccccaccucccuccccgagcccgacuacuccgaguuccagucccaccccuaccaccgcgccuccucccgccagcccgacuaccccggcucccagcgcaaccccgacuucgccggcuccuccuccuccggcaacuacgccggcucccgcacccaccccgaccacuucggcucccucgagcccgacuaccccggcgcccaguccaacuccgaccaccccggcccccgcgccaaccucaaccaccccggcucccgcaagaaccucgagcacaccuccuuccgcaucaaccccuacgccgacucccucggcaagcccgacuaccccggcgccgacauccagcccaacuccccccccuucuucggcgagcccgacuaccccuccgccgaggacaaccagaaccuccccuccaccuggcgcgagcccgacuacuccgacgccgagaacggccacgacuacggcuccuccgagacccccaagaugacccgcggcguccucucccgcaccuccuccauccagcccuccuuccgccaccgcuccgacgaccccgucggcucccucuggggcgagaacgacuaccccgagggcaucgagauggccuccauggagauggccaacuccuacggccacucccuccccggcgcccccggcuccggcuacgucaaccccgccuacgucggcgaguccggccccguccacgccuacggcaaccccccccucuccgagugcgacuggcacaaguccccccagggccagaagcucaucgccucccucauccccaugaccucccgcgaccgcaucaaggccauccgcaaccagccccgcaccauggaggagaagcgcaaccuccgcaagaucgucgacaaggagaaguccaagcagacccaccgcauccuccagcucaacugcugcauccagugccucaacuccaucucccgcgccuaccgccgcuccaagaacucccucuccgagauccucaacuccaucucccucuggcagaagacccucaagaucaucggcggcaaguucggcaccuccguccucuccuacuucaacuuccuccgcuggcuccucaaguucaacaucuucuccuucauccucaacuucuccuucaucaucaucccccaguucaccgucgccaagaagaacacccuccaguucaccggccucgaguucuucaccggcgucggcuacuuccgcgacaccgucauguacuacggcuucuacaccaacuccaccauccagcacggcaacuccggcgccuccuacaacaugcagcucgccuacaucuucaccaucggcgccugccucaccaccugcuucuucucccuccucuucuccauggccaaguacuuccgcaacaacuucaucaacccccacaucuacuccggcggcaucaccaagcucaucuucugcugggacuucaccgucacccacgagaaggccgucaagcucaagcagaagaaccucuccaccgagauccgcgagaaccucuccgagcuccgccaggagaacuccaagcucaccuucaaccagcuccucacccgcuucuccgccuacauggucgccugggucgucuccaccggcgucgccaucgccugcugcgccgccgucuacuaccucgccgaguacaaccucgaguuccucaagacccacuccaaccccggcgccguccuccuccuccccuucgucgucuccugcaucaaccucgccguccccugcaucuacuccauguuccgccucgucgagcgcuacgagaugccccgccacgaggucuacguccuccucauccgcaacaucuuccucaagaucuccaucaucggcauccucugcuacuacuggcucaacaccgucgcccucuccggcgaggagugcugggagacccucaucggccaggacaucuaccgccuccuccucauggacuucgucuucucccucgucaacuccuuccucggcgaguuccuccgccgcaucaucggcaugcagcucaucaccucccucggccuccaggaguucgacaucgcccgcaacguccucgagcucaucuacgcccagacccucgucuggaucggcaucuucuucugcccccuccuccccuucauccagaugaucaugcucuucaucauguucuacuccaagaacaucucccucaugaugaacuuccagccccccuccaaggccuggcgcgccucccagaugaugaccuucuucaucuuccuccucuucuuccccuccuucaccggcguccucugcacccucgccaucaccaucuggcgccucaagcccuccgccgacugcggccccuuccgcggccucccccucuucauccacuccaucuacuccuggaucgacacccucuccacccgccccggcuaccucugggucgucuggaucuaccgcaaccucaucggcuccguccacuucuucuucauccucacccucaucguccucaucaucaccuaccucuacuggcagaucaccgagggccgcaagaucaugauccgccuccuccacgagcagaucaucaacgagggcaaggacaagauguuccucaucgagaagcucaucaagcuccaggacauggagaagaaggccaaccccuccucccucguccucgagcgccgcgaggucgagcagcagggcuuccuccaccucggcgagcacgacggcucccucgaccuccgcucccgccgcuccguccaggagggcaacccccgcgccuga

SEQ ID NO: 50807 - RNA, 2418 nt, Artificial Sequence
  derived and/or modified sequence opt2 from TMC6__Homo_sapiens__NP_009198
auggcccagccccucgccuucauccucgacguccccgagacccccggcgaccagggccagggccccucccccuacgacgaguccgagguccacgacuccuuccagcagcucauccaggagcagucccagugcaccgcccaggagggccucgagcuccagcagcgcgagcgcgaggucaccggcuccucccagcagacccucuggcgccccgagggcacccaguccaccgccacccuccgcauccucgccuccaugcccucccgcaccaucggccgcucccgcggcgccaucaucucccaguacuacaaccgcaccguccagcuccgcugccgcuccucccgcccccuccucggcaacuucguccgcuccgccuggcccucccuccgccucuacgaccucgagcucgaccccaccgcccucgaggaggaggagaagcagucccuccucgucaaggagcuccagucccucgccgucgcccagcgcgaccacaugcuccgcggcaugccccucucccucgccgagaagcgcucccuccgcgagaagucccgcaccccccgcggcaaguggcgcggccagcccggcuccggcggcgucugcuccugcugcggccgccuccgcuacgccugcguccucgcccuccacucccucggccucgcccuccucuccgcccuccaggcccucaugcccuggcgcuacgcccucaagcgcaucggcggccaguucggcuccuccguccucuccuacuuccucuuccucaagacccuccucgccuucaacgcccuccuccuccuccuccucgucgccuucaucaugggcccccaggucgccuucccccccgcccuccccggccccgcccccgucugcaccggccucgagcuccucaccggcgccggcugcuucacccacaccgucauguacuacggccacuacuccaacgccacccucaaccagcccugcggcuccccccucgacggcucccagugcaccccccgcgucggcggccuccccuacaacaugccccucgccuaccucuccaccgucggcgucuccuucuucaucaccugcaucacccucgucuacuccauggcccacuccuucggcgaguccuaccgcgucggcuccaccuccggcauccacgccaucaccgucuucugcuccugggacuacaaggucacccagaagcgcgccucccgccuccagcaggacaacauccgcacccgccucaaggagcuccucgccgaguggcagcuccgccacuccccccgcuccgucugcggccgccuccgccaggccgccguccucggccucgucuggcuccucugccucggcaccgcccucggcugcgccgucgccguccacgucuucuccgaguucaugauccagucccccgaggccgccggccaggaggccguccuccucguccucccccucgucgucggccuccucaaccucggcgcccccuaccucugccgcguccucgccgcccucgagccccacgacucccccguccucgaggucuacgucgccaucugccgcaaccucauccucaagcucgccauccucggcacccucugcuaccacuggcucggccgccgcgucggcguccuccagggccagugcugggaggacuucgucggccaggagcucuaccgcuuccucgucauggacuucguccucaugcuccucgacacccucuucggcgagcucgucuggcgcaucaucuccgagaagaagcucaagcgccgccgcaagcccgaguucgacaucgcccgcaacguccucgagcucaucuacggccagacccucaccuggcucggcguccucuucuccccccuccuccccgccguccagaucaucaagcuccuccucgucuucuacgucaagaagaccucccuccucgccaacugccaggccccccgccgccccuggcucgccucccacauguccaccgucuuccucacccuccucugcuuccccgccuuccucggcgccgccgucuuccucugcuacgccgucuggcaggucaagcccuccuccaccugcggccccuuccgcacccucgacaccauguacgaggccggccgcgucuggguccgccaccucgaggccgccggcccccgcgucuccuggcuccccuggguccaccgcuaccucauggagaacaccuucuucgucuuccucgucuccgcccuccuccucgccgucaucuaccucaacauccaggucguccgcggccagcgcaaggucaucugccuccucaaggagcagaucuccaacgagggcgaggacaagaucuuccucaucaacaagcuccacuccaucuacgagcgcaaggagcgcgaggagcgcucccgcgucggcaccaccgaggaggccgccgccccccccgcccuccucaccgacgagcaggacgccuga

SEQ ID NO: 50808 - RNA, 2181 nt, Artificial Sequence
  derived and/or modified sequence opt2 from TMC8__Homo_sapiens__NP_689681
augcuccucccccgcuccgucuccuccgagcgcgcccccggcguccccgagcccgaggagcucugggaggccgagauggagcgccuccgcggcuccggcacccccguccgcggccuccccuacgccaugauggacaagcgccucaucuggcagcuccgcgagcccgccggcguccagacccuccgcuggcagcgcuggcagcgccgccgccagaccgucgagcgccgccuccgcgaggccgcccagcgccucgcccgcggccucggccucugggagggcgcccucuacgagaucggcggccucuucggcaccggcauccgcuccuacuucaccuuccuccgcuuccuccuccuccucaaccuccucucccuccuccucaccgccuccuucguccuccucccccucgucuggcuccgcccccccgaccccggccccacccucaaccucacccuccagugccccggcucccgccaguccccccccggcguccuccgcuuccacaaccagcucuggcacguccucaccggccgcgccuucaccaacaccuaccucuucuacggcgccuaccgcgucggccccgaguccuccuccgucuacuccauccgccucgccuaccuccucuccccccucgccugccuccuccucugcuucugcggcacccuccgccgcauggucaagggccucccccagaagacccuccucggccagggcuaccaggccccccucuccgccaaggucuucuccuccugggacuucugcauccgcguccaggaggccgccaccaucaagaagcacgagaucuccaacgaguucaaggucgagcucgaggagggccgccgcuuccagcucaugcagcagcagacccgcgcccagaccgccugccgccuccucuccuaccuccgcgucaacguccucaacggccuccucgucgucggcgccaucuccgccaucuucugggccaccaaguacucccaggacaacaaggaggagucccucuuccuccuccuccaguaccucccccccggcgucaucgcccucgucaacuuccucggcccccuccucuucaccuuccucguccagcucgagaacuacccccccaacaccgaggucaaccucacccucaucuggugcgucguccucaagcucgccucccucggcauguucuccgucucccucggccagaccauccucugcaucggccgcgacaaguccuccugcgaguccuacggcuacaacgucugcgacuaccagugcugggagaacuccgucggcgaggagcucuacaagcucuccaucuucaacuuccuccucaccgucgccuucgccuuccucgucacccucccccgccgccuccucgucgaccgcuucuccggccgcuucugggccuggcucgagcgcgaggaguuccucguccccaagaacguccucgacaucgucgccggccagaccgucaccuggaugggccucuucuacugcccccuccucccccuccucaacuccgucuuccucuuccucaccuucuacaucaagaaguacacccuccucaagaacucccgcgccuccucccgccccuuccgcgccuccuccuccaccuucuucuuccagcucguccuccuccucggccuccuccucgccgccgucccccucggcuacgucgucuccuccauccacuccuccugggacugcggccucuucaccaacuacuccgcccccuggcaggucguccccgagcucgucgcccucggccucccccccaucggccagcgcgcccuccacuaccucggcucccacgccuucuccuucccccuccucaucaugcucucccucguccucaccgucugcgucucccagacccaggccaacgcccgcgccauccaccgccuccgcaagcagcucgucuggcagguccaggagaaguggcaccucgucgaggaccucucccgccuccuccccgagcccggccccuccgacucccccggccccaaguaccccgccucccaggccucccgcccccaguccuucugccccggcugccccugccccggcucccccggccaccaggccccccgccccggccccuccgucgucgacgccgccggccuccgcucccccugccccggccagcacggcgcccccgccuccgcccgccgcuuccgcuuccccuccggcgccgagcucuga

SEQ ID NO: 50809 - RNA, 1443 nt, Artificial Sequence
  derived and/or modified sequence opt2 from TMCC1__Homo_sapiens__XP_006713615
auguggugcggcugcaccugccucuucugcgagucccacuucuccgagaccgucaagaucgagcgccucgaggucuccucccucgcccagaccuccuccgccgucgccuccuccaccgacggcuccauccacaccgacuccgucgacggcacccccgacccccagcgcaccaaggccgccaucgcccaccuccagcagaagauccucaagcucaccgagcagaucaagaucgcccagaccgcccgcgacgacaacgucgccgaguaccucaagcucgccaacuccgccgacaagcagcaggccgcccgcaucaagcaggucuucgagaagaagaaccagaaguccgcccagaccauccuccagcuccagaagaagcucgagcacuaccaccgcaagcuccgcgaggucgagcagaacggcaucccccgccagcccaaggacgucuuccgcgacaugcaccagggccucaaggacgucggcgccaaggucaccggcuucuccgagggcgucgucgacuccgucaagggcggcuucuccuccuucucccaggccacccacuccgccgccggcgccgucgucuccaagccccgcgagaucgccucccucauccgcaacaaguucggcuccgccgacaacauccccaaccucaaggacucccucgaggagggccaggucgacgacgccggcaaggcccucggcgucaucuccaacuuccaguccucccccaaguacggcuccgaggaggacugcuccuccgccaccuccggcuccgucggcgccaacuccaccaccggcggcaucgccgucggcgccuccuccuccaagaccaacacccucgacaugcaguccuccggcuucgacgcccuccuccacgagauccaggagauccgcgagacccaggcccgccucgaggaguccuucgagacccucaaggagcacuaccagcgcgacuacucccucaucaugcagacccuccaggaggagcgcuaccgcugcgagcgccucgaggagcagcucaacgaccucaccgagcuccaccagaacgagauccucaaccucaagcaggagcucgccuccauggaggagaagaucgccuaccaguccuacgagcgcgcccgcgacauccaggaggcccucgaggccugccagacccgcaucuccaagauggagcuccagcagcagcagcagcaggucguccagcucgagggccucgagaacgccaccgcccgcaaccuccucggcaagcucaucaacauccuccucgccgucauggccguccuccucgucuucgucuccaccgucgccaacugcgucgucccccucaugaagacccgcaaccgcaccuucuccacccucuuccucgucgucuucaucgccuuccucuggaagcacugggacgcccucuucuccuacgucgagcgcuucuucuccuccccccgcuga

SEQ ID NO: 50810 - RNA, 1896 nt, Artificial Sequence
  derived and/or modified sequence opt2 from TMCC2__Homo_sapiens__NP_001229854
auguucggccacggccucaagcaccucuuccacucccgccgccgcucccgcgagcgcgagcaccagaccucccaggacucccagcagcaccagcagcagcagggcauguccgaccacgacucccccgacgagaaggagcgcucccccgagaugcaccgcgucuccuacgccaugucccuccacgaccuccccgcccgccccaccgccuucaaccgcguccuccagcagauccgcucccgccccuccaucaagcgcggcgccucccuccacuccuccuccggcggcggcuccuccggcuccuccucccgccgcaccaaguccuccucccucgagccccagcgcggcuccccccaccuccuccgcaaggccccccaggacuccucccucgccgccauccuccaccagcaccagugccgcccccgcuccuccuccaccaccgacaccgcccuccuccucgccgacggcuccaacgucuaccuccucgccgaggaggccgagggcaucggcgacaaggucgacaagggcgaccucgucgcccucucccuccccgccggccacggcgacaccgacggccccaucucccucgacguccccgacggcgcccccgacccccagcgcaccaaggccgccaucgaccaccuccaccagaagauccucaagaucaccgagcagaucaagaucgagcaggaggcccgcgacgacaacgucgccgaguaccucaagcucgccaacaacgccgacaagcagcaggucucccgcaucaagcaggucuucgagaagaagaaccagaaguccgcccagaccaucgcccagcuccacaagaagcucgagcacuaccgccgccgccucaaggagaucgagcagaacggccccucccgccagcccaaggacguccuccgcgacaugcagcagggccucaaggacgucggcgccaacguccgcgccggcaucuccggcuucggcggcggcgucgucgagggcgucaagggcucccucuccggccucucccaggccacccacaccgccgucgucuccaagccccgcgaguucgccucccucauccgcaacaaguucggcuccgccgacaacaucgcccaccucaaggacccccucgaggacggcccccccgaggaggccgcccgcgcccucuccggcuccgccacccucgucuccucccccaaguacggcuccgacgacgagugcuccuccgccuccgccuccuccgccggcgccggcuccaacuccggcgccggccccggcggcgcccucggcucccccaaguccaacgcccucuacggcgcccccggcaaccucgacgcccuccucgaggagcuccgcgagaucaaggagggccagucccaccucgaggacuccauggaggaccucaagacccagcuccagcgcgacuacaccuacaugacccagugccuccaggaggagcgcuaccgcuacgagcgccucgaggagcagcucaacgaccucaccgagcuccaccagaacgagaugaccaaccucaagcaggagcucgccuccauggaggagaaggucgccuaccaguccuacgagcgcgcccgcgacauccaggaggccgucgaguccugccucacccgcgucaccaagcucgagcuccagcagcagcagcagcaggucguccagcucgagggcgucgagaacgccaacgcccgcgcccuccucggcaaguucaucaacgucauccucgcccucauggccguccuccucgucuucgucuccaccaucgccaacuucaucaccccccucaugaagacccgccuccgcaucaccuccaccacccuccucguccucguccucuuccuccucuggaagcacugggacucccucaccuaccuccucgagcacguccuccuccccuccuga

SEQ ID NO: 50811 - RNA, 1434 nt, Artificial Sequence
  derived and/or modified sequence opt2 from TMCC3__Homo_sapiens__NP_065749
augcccggcuccgacaccgcccucaccgucgaccgcaccuacuccgaccccggccgccaccaccgcugcaagucccgcgucgagcgccacgacaugaacacccucucccucccccucaacauccgccgcggcggcuccgacaccaaccucaacuucgacguccccgacggcauccucgacuuccacaaggucaagcucaccgccgacucccucaagcagaagauccucaaggucaccgagcagaucaagaucgagcagaccucccgcgacggcaacgucgccgaguaccucaagcucgucaacaacgccgacaagcagcaggccggccgcaucaagcaggucuucgagaagaagaaccagaaguccgcccacuccaucgcccagcuccagaagaagcucgagcaguaccaccgcaagcuccgcgagaucgagcagaacggcgccucccgcuccuccaaggacaucuccaaggaccaccucaaggacauccaccgcucccucaaggacgcccacgucaagucccgcaccgccccccacugcauggaguccuccaaguccggcaugcccggcgucucccucaccccccccgucuucgucuucaacaagucccgcgaguucgccaaccucauccgcaacaaguucggcuccgccgacaacaucgcccaccucaagaacucccucgaggaguuccgccccgaggccuccgcccgcgccuacggcggcuccgccaccaucgucaacaagcccaaguacggcuccgacgacgagugcuccuccggcaccuccggcuccgccgacuccaacggcaaccaguccuucggcgccggcggcgccuccacccucgacucccagggcaagcucgccgucauccucgaggagcuccgcgagaucaaggacacccaggcccagcucgccgaggacaucgaggcccucaagguccaguucaagcgcgaguacggcuucaucucccagacccuccaggaggagcgcuaccgcuacgagcgccucgaggaccagcuccacgaccucaccgaccuccaccagcacgagaccgccaaccucaagcaggagcucgccuccaucgaggagaaggucgccuaccaggccuacgagcgcucccgcgacauccaggaggcccucgaguccugccagacccgcaucuccaagcucgagcuccaccagcaggagcagcaggcccuccagaccgacaccgucaacgccaagguccuccucggccgcugcaucaacgucauccucgccuucaugaccgucauccucgucugcgucuccaccaucgccaaguucgucucccccaugaugaagucccgcugccacauccucggcaccuucuucgccgucacccuccucgccaucuucugcaagaacugggaccacauccucugcgccaucgagcgcaugaucaucccccgcuga

SEQ ID NO: 50812 - RNA, 720 nt, Artificial Sequence
  derived and/or modified sequence opt2 from TMCO1__Homo_sapiens__NP_061899
augccccgcaagcgcaagugcgaccuccgcgccguccgcgucggccuccuccucggcggcggcggcgucuacggcucccgcuuccgcuucaccuuccccggcugccgcgcccucucccccuggcgcguccgcguccagcgccgccgcugcgagauguccaccauguucgccgacacccuccucaucgucuucaucuccgucugcaccgcccuccucgccgagggcaucaccuggguccucgucuaccgcaccgacaaguacaagcgccucaaggccgaggucgagaagcaguccaagaagcucgagaagaagaaggagaccaucaccgaguccgccggccgccagcagaagaagaagaucgagcgccaggaggagaagcucaagaacaacaaccgcgaccucuccaugguccgcaugaaguccauguucgccaucggcuucugcuucaccgcccucaugggcauguucaacuccaucuucgacggccgcgucgucgccaagcuccccuucaccccccucuccuacauccagggccucucccaccgcaaccuccucggcgacgacaccaccgacugcuccuucaucuuccucuacauccucugcaccauguccauccgccagaacauccagaagauccucggccucgcccccucccgcgccgccaccaagcaggccggcggcuuccucggcccccccccccccuccggcaaguucuccuga

SEQ ID NO: 50813 - RNA, 1905 nt, Artificial Sequence
  derived and/or modified sequence opt2 from TMCO4__Homo_sapiens__XP_011539488
auggccauguggaaccgccccugccagcgccucccccagcagccccucgucgccgagcccaccgccgagggcgagccccaccuccccaccggccgcgagcucaccgaggccaaccgcuucgccuacgccgcccucugcggcaucucccucucccagcucuuccccgagcccgagcacuccuccuucugcaccgaguucauggccggccucguccaguggcucgagcucuccgaggccguccuccccaccaugaccgccuucgccuccggccucggcggcgagggcgccgacgucuucguccagauccuccucaaggaccccauccucaaggacgaccccaccgucaucacccaggaccuccucuccuucucccucaaggacggccacuacgacgcccgcgcccgcguccucgucugccacaugaccucccuccuccaggucccccucgaggagcucgacguccucgaggagauguuccucgagucccucaaggagaucaaggaggaggaguccgagauggccgaggccucccgcaagaagaaggagaaccgccgcaaguggaagcgcuaccuccucaucggccucgccaccgucggcggcggcaccgucaucggcgucaccggcggccucgccgccccccucgucgccgccggcgccgccaccaucaucggcuccgccggcgccgccgcccucggcuccgccgccggcaucgccaucaugaccucccucuucggcgccgccggcgccggccucaccggcuacaagaugaagaagcgcgucggcgccaucgaggaguucaccuuccucccccucaccgagggccgccagcuccacaucaccaucgccgucaccggcuggcucgccuccggcaaguaccgcaccuucuccgcccccugggccgcccucgcccacucccgcgagcaguacugccucgccugggaggccaaguaccucauggagcucggcaacgcccucgagaccauccucuccggccucgccaacauggucgcccaggaggcccucaaguacaccguccucuccggcaucgucgccgcccucaccuggcccgccucccuccucuccgucgccaacgucaucgacaaccccuggggcgucugccuccaccgcuccgccgaggucggcaagcaccucgcccacauccuccucucccgccagcagggccgccgccccgucacccucaucggcuucucccucggcgcccgcgucaucuacuucugccuccaggagauggcccaggagaaggacugccagggcaucaucgaggacgucauccuccucggcgcccccgucgagggcgaggccaagcacugggagcccuuccgcaaggucgucuccggccgcaucaucaacggcuacugccgcggcgacuggcuccucuccuucgucuaccgcaccuccuccguccagcuccgcgucgccggccuccagcccguccuccuccaggaccgccgcgucgagaacgucgaccucaccuccgucgucuccggccaccucgacuacgccaagcagauggacgccauccucaaggccgucggcauccgcaccaagcccggcugggacgagaagggccuccuccucgcccccggcugccuccccuccgaggagccccgccaggccgccgccgccgccuccuccggcgagaccccccaccaggucggccagacccagggccccaucuccggcgacaccuccaagcucgccauguccaccgaccccucccaggcccagguccccgucggccucgaccaguccgagggcgccucccuccccgccgccgccucccccgagcgcccccccaucugcucccacggcauggaccccaacccccucggcugccccgacugcgccugcaagacccagggccccuccaccggccucgacuga

SEQ ID NO: 50814 - RNA, 867 nt, Artificial Sequence
  derived and/or modified sequence opt2 from TMCO5A__Homo_sapiens__XP_005254225
auggagaucucccgccucgcccaguccaagcgcaacaucaucucccucaacauggaccucgagcgcgacacccagcgcaucgacgaggccaaccagaagcuccuccucaagauccaggagcgcgaggacaagauccagcgccucgaguccgagaucauccagacccgcggccucgucgaggacgaggagugggagaaggagaaccgcaccaccauggagcgcgagcgcgcccuccaggagcucgaggaggagaccgcccgccucgagcgcaagaacaagacccucguccacuccaucaccgagcuccagcagaagcucacccgcaagucccagaagaucaccaacugcgagcaguccucccccgacggcgcccucgaggagaccaaggucaagcuccagcagcucgaggccuccuacgccugccaggagaaggagcuccucaaggucaugaaggaguacgccuucgucacccagcucugcgaggaccaggcccucuacaucaagaaguaccaggagacccucaagaagaucgaggaggagcucgaggcccucuuccucgagcgcgaggucuccaagcucgucuccaugaaccccgucgagaaggagcacaccucccagaacaacgagggcacccccacccagaagaccgcccgccucuucuccaagaagaucuucugcugccucuucuucaucacccucuucuucauccgccuccucuccuacauguucuuccacguccgcuucaucaaccccgaccuccucgucaacguccuccccaagguccucggccgcuccacccucuggaagcuccgcugcuucuucuuccccucccucacccucgagaccgaggacaugcucccccacuga

SEQ ID NO: 50815 - RNA, 660 nt, Artificial Sequence
  derived and/or modified sequence opt2 from TMED10__Homo_sapiens__NP_006818
auguccggccucuccggcccccccgcccgccgcggccccuucccccucgcccuccuccuccucuuccuccucggcccccgccucguccucgccaucuccuuccaccuccccaucaacucccgcaagugccuccgcgaggagauccacaaggaccuccucgucaccggcgccuacgagaucuccgaccaguccggcggcgccggcggccuccgcucccaccucaagaucaccgacuccgccggccacauccucuacuccaaggaggacgccaccaagggcaaguucgccuucaccaccgaggacuacgacauguucgaggucugcuucgaguccaagggcaccggccgcauccccgaccagcucgucauccucgacaugaagcacggcgucgaggccaagaacuacgaggagaucgccaaggucgagaagcucaagccccucgaggucgagcuccgccgccucgaggaccucuccgaguccaucgucaacgacuucgccuacaugaagaagcgcgaggaggagaugcgcgacaccaacgaguccaccaacacccgcguccucuacuucuccaucuucuccauguucugccucaucggccucgccaccuggcaggucuucuaccuccgccgcuucuucaaggccaagaagcucaucgaguga

SEQ ID NO: 50816 - RNA, 684 nt, Artificial Sequence
  derived and/or modified sequence opt2 from TMED1__Homo_sapiens__NP_006849
augauggccgccggcgccgcccucgcccucgcccucuggcuccucaugccccccgucgaggucggcggcgccggccccccccccauccaggacggcgaguucaccuuccuccuccccgccggccgcaagcagugcuucuaccaguccgcccccgccaacgccucccucgagaccgaguaccaggucaucggcggcgccggccucgacgucgacuucacccucgaguccccccagggcguccuccucgucuccgagucccgcaaggccgacggcguccacaccgucgagcccaccgaggccggcgacuacaagcucugcuucgacaacuccuucuccaccaucuccgagaagcucgucuucuucgagcucaucuucgacucccuccaggacgacgaggaggucgagggcugggccgaggccgucgagcccgaggagaugcucgacgucaagauggaggacaucaaggaguccaucgagaccaugcgcacccgccucgagcgcuccauccagaugcucacccuccuccgcgccuucgaggcccgcgaccgcaaccuccaggagggcaaccucgagcgcgucaacuucugguccgccgucaacgucgccguccuccuccucgucgccguccuccaggucugcacccucaagcgcuucuuccaggacaagcgccccguccccaccuga

SEQ ID NO: 50817 - RNA, 606 nt, Artificial Sequence
  derived and/or modified sequence opt2 from TMED2__Homo_sapiens__NP_006806
auggucacccucgccgagcuccucguccuccucgccgcccuccucgccaccgucuccggcuacuucgucuccaucgacgcccacgccgaggagugcuucuucgagcgcgucaccuccggcaccaagaugggccucaucuucgaggucgccgagggcggcuuccucgacaucgacgucgagaucaccggccccgacaacaagggcaucuacaagggcgaccgcgaguccuccggcaaguacaccuucgccgcccacauggacggcaccuacaaguucugcuucuccaaccgcauguccaccaugacccccaagaucgucauguucaccaucgacaucggcgaggcccccaagggccaggacauggagaccgaggcccaccagaacaagcucgaggagaugaucaacgagcucgccgucgccaugaccgccgucaagcacgagcaggaguacauggagguccgcgagcgcauccaccgcgccaucaacgacaacaccaacucccgcgucguccucugguccuucuucgaggcccucguccucgucgccaugacccucggccagaucuacuaccucaagcgcuucuucgagguccgccgcgucgucuga

SEQ ID NO: 50818 - RNA, 468 nt, Artificial Sequence
  derived and/or modified sequence opt2 from TMED3__Homo_sapiens__NP_001288132
augggcuccaccgucccccgcuccgccuccguccuccuccuccuccuccuccuccgccgcgccgagcagcccugcggcgccgagcucaccuucgagcuccccgacaacgccaagcagugcuuccacgaggaggucgagcagggcgucaaguucucccucgacuaccaggucaucaccggcggccacuacgacgucgacugcuacgucgaggacccccagggcaacaccaucuaccgcgagaccaagaagcaguacgacuccuucaccuaccgcgccgaggucaagggcgucuaccaguucugcuucuccaacgaguucuccaccuucucccacaagaccgucuacuucgacuuccaggucggcgacgagccccccauccuccccgacaugggcaaccgcgucaccgcccucacccagggccccuccgccucccccacccccacccccccccuccgcguccccgucuga

SEQ ID NO: 50819 - RNA, 684 nt, Artificial Sequence
  derived and/or modified sequence opt2 from TMED4__Homo_sapiens__NP_872353
auggccggcgucggcgccggcccccuccgcgccaugggccgccaggcccuccuccuccucgcccucugcgccaccggcgcccagggccucuacuuccacaucggcgagaccgagaagcgcugcuucaucgaggagauccccgacgagaccauggucaucggcaacuaccgcacccagaugugggacaagcagaaggaggucuuccuccccuccacccccggccucggcaugcacgucgaggucaaggaccccgacggcaaggucguccucucccgccaguacggcuccgagggccgcuucaccuucaccucccacacccccggcgaccaccagaucugccuccacuccaacuccacccgcauggcccucuucgccggcggcaagcuccgcguccaccucgacauccaggucggcgagcacgccaacaacuaccccgagaucgccgccaaggacaagcucaccgagcuccagcuccgcgcccgccagcuccucgaccaggucgagcagauccagaaggagcaggacuaccagcgcuaccgcgaggagcgcuuccgccucaccuccgaguccaccaaccagcgcguccucuggugguccaucgcccagaccgucauccucauccucaccggcaucuggcagaugcgccaccucaaguccuucuucgaggccaagaagcucgucuga

SEQ ID NO: 50820 - RNA, 675 nt, Artificial Sequence
  derived and/or modified sequence opt2 from TMED7__Homo_sapiens__NP_861974
augccccgccccggcuccgcccagcgcugggccgccgucgccggccgcuggggcugccgccuccucgcccuccuccuccucguccccggccccggcggcgccuccgagaucaccuucgagcuccccgacaacgccaagcagugcuucuacgaggacaucgcccagggcaccaagugcacccucgaguuccaggucaucaccggcggccacuacgacgucgacugccgccucgaggaccccgacggcaagguccucuacaaggagaugaagaagcaguacgacuccuucaccuucaccgccuccaagaacggcaccuacaaguucugcuucuccaacgaguucuccaccuucacccacaagaccgucuacuucgacuuccaggucggcgaggaccccccccucuuccccuccgagaaccgcgucuccgcccucacccagauggaguccgccugcgucuccauccacgaggcccucaaguccgucaucgacuaccagacccacuuccgccuccgcgaggcccagggccgcucccgcgccgaggaccucaacacccgcgucgccuacugguccgucggcgaggcccucauccuccucgucgucuccaucggccaggucuuccuccucaaguccuucuucuccgacaagcgcaccaccaccacccgcgucggcuccuga

SEQ ID NO: 50821 - RNA, 1215 nt, Artificial Sequence
  derived and/or modified sequence opt2 from TMED7-TICAM2__Homo_sapiens__NP_001157940
augccccgccccggcuccgcccagcgcugggccgccgucgccggccgcuggggcugccgccuccucgcccuccuccuccucguccccggccccggcggcgccuccgagaucaccuucgagcuccccgacaacgccaagcagugcuucuacgaggacaucgcccagggcaccaagugcacccucgaguuccaggucaucaccggcggccacuacgacgucgacugccgccucgaggaccccgacggcaagguccucuacaaggagaugaagaagcaguacgacuccuucaccuucaccgccuccaagaacggcaccuacaaguucugcuucuccaacgaguucuccaccuucacccacaagaccgucuacuucgacuuccaggucggcgaggaccccccccucuuccccuccgagaaccgcgucuccgcccucacccagauggaguccgccugcgucuccauccacgaggcccucaaguccgucaucgacuaccagacccacuuccgccuccgcgaggcccagggccgcucccgcgccgaggaccucaacacccgcgucgccuacuggcacuccgucgacaccucccccggcuaccacgaguccgacuccaagaaguccgaggaccucucccucugcaacgucgccgagcacuccaacaccaccgagggccccaccggcaagcaggagggcgcccaguccgucgaggagauguucgaggaggaggccgaggaggaggucuuccucaaguucgucauccuccacgccgaggacgacaccgacgaggcccuccgcguccagaaccuccuccaggacgacuucggcaucaagcccggcaucaucuucgccgagaugcccugcggccgccagcaccuccagaaccucgacgacgccgucaacggcuccgccuggaccauccuccuccucaccgagaacuuccuccgcgacaccuggugcaacuuccaguucuacaccucccucaugaacuccgucaaccgccagcacaaguacaacuccgucauccccaugcgcccccucaacaacccccucccccgcgagcgcacccccuucgcccuccagaccaucaacgcccucgaggaggagucccgcggcuuccccacccaggucgagcgcaucuuccaggaguccgucuacaagacccagcagaccaucuggaaggagacccgcaacaugguccagcgccaguucaucgccuga

SEQ ID NO: 50822 - RNA, 708 nt, Artificial Sequence
  derived and/or modified sequence opt2 from TMED9__Homo_sapiens__NP_059980
auggccgucgagcucggcguccuccucguccgcccccgccccggcaccggccucggccgcgucaugcgcacccuccuccucguccucuggcucgccacccgcggcuccgcccucuacuuccacaucggcgagaccgagaagaagugcuucaucgaggagauccccgacgagaccauggucaucggcaacuaccgcacccagcucuacgacaagcagcgcgaggaguaccagcccgccacccccggccucggcauguucgucgaggucaaggaccccgaggacaaggucauccucgcccgccaguacggcuccgagggccgcuucaccuucaccucccacacccccggcgagcaccagaucugccuccacuccaacuccaccaaguucucccucuucgccggcggcaugcuccgcguccaccucgacauccaggucggcgagcacgccaacgacuacgccgagaucgccgccaaggacaagcucuccgagcuccagcuccgcguccgccagcucgucgagcaggucgagcagauccagaaggagcagaacuaccagcgcuggcgcgaggagcgcuuccgccagaccuccgaguccaccaaccagcgcguccucuggugguccauccuccagacccucauccucgucgccaucggcgucuggcagaugcgccaccucaaguccuucuucgaggccaagaagcucgucuga

SEQ ID NO: 50823 - RNA, 1143 nt, Artificial Sequence
  derived and/or modified sequence opt2 from TMEFF1__Homo_sapiens__NP_003683
augggcgccgccgccgccgaggccccccuccgccuccccgccgcccccccccucgccuucugcugcuacaccuccguccuccuccucuucgccuucucccuccccggcucccgcgccuccaaccagccccccggcggcggcggcggcuccggcggcgacugccccggcggcaagggcaaguccaucaacugcuccgagcucaacguccgcgaguccgacguccgcgucugcgacgaguccuccugcaaguacggcggcgucugcaaggaggacggcgacggccucaagugcgccugccaguuccagugccacaccaacuacauccccgucugcggcuccaacggcgacaccuaccagaacgagugcuuccuccgccgcgccgccugcaagcaccagaaggagaucaccgucaucgcccgcggccccugcuacuccgacaacggcuccggcuccggcgagggcgaggaggagggcuccggcgccgagguccaccgcaagcacuccaagugcggccccugcaaguacaaggccgagugcgacgaggacgccgagaacgucggcugcgucugcaacaucgacugcuccggcuacuccuucaaccccgucugcgccuccgacggcuccuccuacaacaaccccugcuucguccgcgaggccuccugcaucaagcaggagcagaucgacauccgccaccucggccacugcaccgacaccgacgacaccucccuccucggcaagaaggacgacggccuccaguaccgccccgacgucaaggacgccuccgaccagcgcgaggacgucuacaucggcaaccacaugcccugccccgagaaccucaacggcuacugcauccacggcaagugcgaguucaucuacuccacccagaaggccuccugccgcugcgaguccggcuacaccggccagcacugcgagaagaccgacuucuccauccucuacgucguccccucccgccagaagcucacccacguccucaucgccgccaucaucggcgccguccagaucgccaucaucgucgccaucgucaugugcaucacccgcaagugccccaagaacaaccgcggccgccgccagaagcagaaccucggccacuucaccuccgacaccuccucccgcauggucuga

SEQ ID NO: 50824 - RNA, 1125 nt, Artificial Sequence
  derived and/or modified sequence opt2 from TMEFF2__Homo_sapiens__NP_057276
augguccucugggaguccccccgccagugcuccuccuggacccucugcgagggcuucugcuggcuccuccuccuccccgucaugcuccucaucgucgcccgccccgucaagcucgccgccuuccccaccucccucuccgacugccagacccccaccggcuggaacugcuccggcuacgacgaccgcgagaacgaccucuuccucugcgacaccaacaccugcaaguucgacggcgagugccuccgcaucggcgacaccgucaccugcgucugccaguucaagugcaacaacgacuacguccccgucugcggcuccaacggcgaguccuaccagaacgagugcuaccuccgccaggccgccugcaagcagcaguccgagauccucgucgucuccgagggcuccugcgccaccgacgccggcuccggcuccggcgacggcguccacgagggcuccggcgagaccucccagaaggagaccuccaccugcgacaucugccaguucggcgccgagugcgacgaggacgccgaggacgucuggugcgucugcaacaucgacugcucccagaccaacuucaacccccucugcgccuccgacggcaaguccuacgacaacgccugccagaucaaggaggccuccugccagaagcaggagaagaucgaggucaugucccucggccgcugccaggacaacaccaccaccaccaccaaguccgaggacggccacuacgcccgcaccgacuacgccgagaacgccaacaagcucgaggaguccgcccgcgagcaccacauccccugccccgagcacuacaacggcuucugcaugcacggcaagugcgagcacuccaucaacaugcaggagcccuccugccgcugcgacgccggcuacaccggccagcacugcgagaagaaggacuacuccguccucuacgucguccccggccccguccgcuuccaguacguccucaucgccgccgucaucggcaccauccagaucgccgucaucugcgucgucguccucugcaucacccgcaagugcccccgcuccaaccgcauccaccgccagaagcagaacaccggccacuacuccuccgacaacaccacccgcgccuccacccgccucaucuga

SEQ ID NO: 50825 - RNA, 405 nt, Artificial Sequence
  derived and/or modified sequence opt2 from TMEM100__Homo_sapiens__NP_060756
augaccgaggagcccaucaaggagauccucggcgcccccaaggcccacauggccgccaccauggagaagucccccaaguccgaggucgucaucaccaccgucccccucgucuccgagauccagcucauggccgccaccggcggcaccgagcucuccugcuaccgcugcaucauccccuucgccgucgucgucuucaucgccggcaucgucgucaccgccgucgccuacuccuucaacucccacggcuccaucaucuccaucuucggccucgucguccucuccuccggccucuuccuccucgccuccuccgcccucugcuggaagguccgccagcgcuccaagaaggccaagcgccgcgagucccagaccgcccucgucgccaaccagcgcucccucuucgccuga

SEQ ID NO: 50826 - RNA, 774 nt, Artificial Sequence
  derived and/or modified sequence opt2 from TMEM101__Homo_sapiens__XP_011523653
auggccuccaagaucggcucccgccgcuggaugcuccagcucaucaugcagcucggcuccguccuccucacccgcugccccuucuggggcugcuucucccagcucaugcucuacgccgagcgcgccgaggcccgccgcaagcccgacauccccguccccuaccucuacuucgacaugggcgccgccguccucugcgccuccuucauguccuucggcgucaagcgccgcugguucgcccucggcgccgcccuccagcucgccaucuccaccuacgccgccuacaucggcggcuacguccacuacggcgacuggcucaagguccgcauguacucccgcaccgucgccaucaucggcggcuuccucguccucgccuccggcgccggcgagcucuaccgccgcaagccccgcucccgcucccuccaguccaccggccaggucuuccucggcaucuaccucaucugcgucgccuacucccuccagcacuccaaggaggaccgccucgccuaccucaaccaccuccccggcggcgagcucaugauccagcucuucuucguccucuacggcauccucgcccucgccuuccucuccggcuacuacgucacccucgccgcccagauccucgccguccuccucccccccgucaugcuccucaucgacggcaacgucgccuacuggcacaacacccgccgcgucgaguucuggaaccagaugaagcuccucggcgaguccgucggcaucuucggcaccgccgucauccucgccaccgacggcuga

SEQ ID NO: 50827 - RNA, 390 nt, Artificial Sequence
  derived and/or modified sequence opt2 from TMEM105__Homo_sapiens__NP_848615
augcuccucaagguccgccgcgccucccucaagccccccgccaccccccaccagggcgccuuccgcgccggcaacgucaucggccagcucaucuaccuccucaccuggucccucuucaccgccuggcuccgcccccccacccuccuccagggcccccgcaccuccccccagggcucccccccccgcucccccuggggcgacugcgccgagcccuccugccucugcgagaugaagauccgccgccgccgccacgagggccccgccuggggccaguccggcuuccucgccggcggccuccaccucguccccuccucccucucccucgccgccugcggcgucguccgcaugaagggccucuggggccgcggcgccggcauccgcggccgcuga

SEQ ID NO: 50828 - RNA, 825 nt, Artificial Sequence
  derived and/or modified sequence opt2 from TMEM106B__Homo_sapiens__XP_005249846
augggcaagucccucucccaccucccccuccacuccuccaaggaggacgccuacgacggcgucaccuccgagaacaugcgcaacggccucgucaacuccgagguccacaacgaggacggccgcaacggcgacgucucccaguuccccuacgucgaguucaccggccgcgacuccgucaccugccccaccugccagggcaccggccgcaucccccgcggccaggagaaccagcucgucgcccucauccccuacuccgaccagcgccuccgcccccgccgcaccaagcucuacgucauggccuccgucuucgucugccuccuccucuccggccucgccgucuucuuccucuucccccgcuccaucgacgucaaguacaucggcgucaaguccgccuacgucuccuacgacguccagaagcgcaccaucuaccucaacaucaccaacacccucaacaucaccaacaacaacuacuacuccgucgaggucgagaacaucaccgcccagguccaguucuccaagaccgucaucggcaaggcccgccucaacaacaucaccaucaucggcccccucgacaugaagcagaucgacuacaccguccccaccgucaucgccgaggagauguccuacauguacgacuucugcacccucaucuccaucaagguccacaacaucguccucaugaugcaggucaccgucaccaccaccuacuucggccacuccgagcagaucucccaggagcgcuaccaguacgucgacugcggccgcaacaccaccuaccagcucggccaguccgaguaccucaacguccuccagccccagcaguga

SEQ ID NO: 50829 - RNA, 318 nt, Artificial Sequence
  derived and/or modified sequence opt2 from TMEM108__Homo_sapiens__NP_001269794
augaagcgcucccuccaggcccucuacugccagcuccucaccguccuccucaccgucugcugcaugaagcgcaagaagaagaccgccaaccccgagaacaaccucuccuacuggaacaacaccaucaccauggacuacuucaaccgccacgccgucgagcucccccgcgagauccagucccucgagaccuccgaggaccagcucuccgagccccgcucccccgccaacggcgacuaccgcgacaccggcaugguccucgucaaccccuucugccaggagacccucuucgucggcaacgaccaggucuccgagaucuga

SEQ ID NO: 50830 - RNA, 429 nt, Artificial Sequence
  derived and/or modified sequence opt2 from TMEM114__Homo_sapiens__NP_001277026
augaaccccuuccgccucgagaacgucaccgucuccgaguccucccgccagcuccucaccaugcacggcaccuucgucauccuccucccccucucccucauccucauggucuucggcggcaugaccggcuuccucuccuuccuccuccaggccuaccuccuccuccuccucaccggcauccucuuccucuucggcgccauggucacccucgccggcaucuccgucuacaucgccuacuccgccgccgccuuccgcgaggcccucugccuccucgaggagaaggcccuccucgaccaggucgacaucuccuucggcuggucccucgcccucggcuggaucuccuucaucgccgagcuccucaccggcgccgccuuccucgccgccgcccgcgagcucucccuccgccgccgccaggaccaggccaucuga

SEQ ID NO: 50831 - RNA, 1056 nt, Artificial Sequence
  derived and/or modified sequence opt2 from TMEM115__Homo_sapiens__NP_008955
augcagcgcgcccuccccggcgcccgccagcaccucggcgccauccucgccuccgccuccgucgucgucaaggcccucugcgccgccguccucuuccucuaccuccucuccuucgccgucgacaccggcugccucgccgucacccccggcuaccucuucccccccaacuucuggaucuggacccucgccacccacggccucauggagcagcacgucugggacgucgccaucucccucaccaccgucgucgucgccggccgccuccucgagccccucuggggcgcccucgagcuccucaucuucuucuccgucgucaacgucuccgucggccuccucggcgccuucgccuaccuccucaccuacauggccuccuucaaccucgucuaccucuucaccguccgcauccacggcgcccucggcuuccucggcggcguccucgucgcccucaagcagaccaugggcgacugcgucguccuccgcgucccccagguccgcgucuccgucaugcccaugcuccuccucgcccuccuccuccuccuccgccucgccacccuccuccagucccccgcccucgccuccuacggcuucggccuccucuccuccugggucuaccuccgcuucuaccagcgccacucccgcggccgcggcgacauggccgaccacuucgccuucgccaccuucuuccccgagauccuccagcccgucgucggccuccucgccaaccucguccacucccuccucgucaaggucaagaucugccagaagaccgucaagcgcuacgacgucggcgcccccuccuccaucaccaucucccuccccggcaccgacccccaggacgccgagcgccgccgccagcucgcccucaaggcccucaacgagcgccucaagcgcgucgaggaccaguccaucuggcccuccauggacgacgacgaggaggaguccggcgccaaggucgacuccccccuccccuccgacaaggcccccaccccccccggcaagggcgccgcccccgaguccucccucaucaccuucgaggccgccccccccacccucuga

SEQ ID NO: 50832 - RNA, 1233 nt, Artificial Sequence
  derived and/or modified sequence opt2 from TMEM117__Homo_sapiens__NP_001273141
auggccaccugccacucccaccgcaccaacuccuggcagaucuccguccccuccgccuucgucugguccgucgcccccaucaagaacgucucccgccgcuccugggucgucgacgacaacguccuccagcacaacucccucucccuccacaucuucucccacauccagcacgacuccuccaacggcugggagcacggcgucaccgacaugaugcuccaggacaagcccuaccccgacuggggcaaguccgcccgcgccuucuggaagaagggcaacguccgcaucacccucuucuggaccguccucuucacccucaccuccgucgucguccucgucaucaccaccgacuggaucuccugggacaagcucaaccgcggcuuccuccccuccgacgaggucucccgcgccuuccucgccuccuucauccucgucuucgaccuccucaucgucaugcaggacugggaguucccccacuucaugggcgacgucgacgucaaccuccccggccuccacaccccccacaugcaguucaagauccccuucuuccagaagaucuucaaggaggaguaccgcauccacaucaccggcaagugguucaacuacggcaucaucuuccucguccucauccucgaccucaacauguggaagaaccagaucuucuacaagccccacgaguacggccaguacaucggccccggccagaagaucuacaccgucaaggacuccgagucccucaaggaccucaaccgcaccaagcucuccugggaguggcgcuccaaccacaccaacccccgcaccaacaagaccuacgucgagggcgacauguuccuccacucccgcuucaucggcgccucccucgacgucaagugccucgccuucguccccucccucaucgccuucgucugguucggcuucuucaucugguucuucggccgcuuccucaagaacgagccccgcauggagaaccaggacaagaccuacacccgcaugaagcgcaagucccccuccgagcacuccaaggacaugggcaucacccgcgagaacacccaggccuccgucgaggacccccucaacgaccccucccucgucugcauccgcuccgacuucaacgagaucgucuacaaguccucccaccucaccuccgagaaccucuccucccagcucaacgaguccaccuccgccaccgaggccgaccaggaccccaccaccuccaaguccacccccaccaacuga

SEQ ID NO: 50833 - RNA, 579 nt, Artificial Sequence
  derived and/or modified sequence opt2 from TMEM11__Homo_sapiens__NP_003867
auggccgccuggggccgccgccgccucggccccggcuccuccggcggcuccgcccgcgagcgcgucucccucuccgccaccgacugcuacaucguccacgagaucuacaacggcgagaacgcccaggaccaguucgaguacgagcucgagcaggcccucgaggcccaguacaaguacaucgucaucgagcccacccgcaucggcgacgagaccgcccgcuggaucaccgucggcaacugccuccacaagaccgccguccucgccggcaccgccugccucuucaccccccucgcccucccccucgacuacucccacuacaucucccuccccgccggcguccucucccucgccugcugcacccucuacggcaucuccuggcaguucgaccccugcugcaaguaccaggucgaguacgacgccuacaagcucucccgccucccccuccacacccucaccuccuccacccccgucguccucguccgcaaggacgaccuccaccgcaagcgccuccacaacaccaucgcccucgccgcccucgucuacugcgucaagaagaucuacgagcucuacgccgucuga

SEQ ID NO: 50834 - RNA, 378 nt, Artificial Sequence
  derived and/or modified sequence opt2 from TMEM126A__Homo_sapiens__NP_001231664
auggccggcauccccuuccucaccaccgaccucaccuaccgcugcuucgucuccuucccccucaacaccggcgaccucgacugcgagaccugcaccaucacccgcuccggccucaccggccucgucaucggcggccucuaccccgucuuccucgccauccccgucaacggcggccucgccgcccgcuaccaguccgcccuccucccccacaagggcaacauccucuccuacuggauccgcaccuccaagcccgucuuccgcaagaugcucuuccccauccuccuccagaccauguucuccgccuaccucggcuccgagcaguacaagcuccucaucaaggcccuccagcucuccgagcccggcaaggagauccacuga

SEQ ID NO: 50835 - RNA, 717 nt, Artificial Sequence
  derived and/or modified sequence opt2 from TMEM127__Homo_sapiens__NP_001180233
auguacgcccccggcggcgccggccuccccggcggccgccgccgccgcucccccggcggcuccgcccuccccaagcagcccgagcgcucccucgccuccgcccuccccggcgcccucuccaucaccgcccucugcaccgcccucgccgagcccgccuggcuccacauccacggcggcaccugcucccgccaggagcucggcgucuccgacguccucggcuacguccaccccgaccuccucaaggacuucugcaugaacccccagaccguccuccuccuccgcgucaucgccgccuucugcuuccucggcauccucugcucccucuccgccuuccuccucgacgucuucggccccaagcaccccgcccucaagaucacccgccgcuacgccuucgcccacauccucaccguccuccagugcgccaccgucaucggcuucuccuacugggccuccgagcucauccucgcccagcagcagcagcacaagaaguaccacggcucccaggucuacgucaccuucgccgucuccuucuaccucgucgccggcgccggcggcgccuccauccucgccaccgccgccaaccuccuccgccacuaccccaccgaggaggaggagcaggcccucgagcuccucuccgagauggaggagaacgagcccuaccccgccgaguacgaggucaucaaccaguuccagcccccccccgccuacacccccuga

SEQ ID NO: 50836 - RNA, 498 nt, Artificial Sequence
  derived and/or modified sequence opt2 from TMEM128__Homo_sapiens__NP_001284480
auggacuccucccgcgcccgccagcagcuccgccgccgcuuccuccuccuccccgacgccgaggcccagcucgaccgcgagggcgacgccggccccgagaccuccaccgccgucgagaagaaggagaagccccucccccgccucaacauccacuccggcuucuggauccucgccuccaucgucgucaccuacuacgucgacuucuucaagacccucaaggagaacuuccacaccuccuccugguuccucugcggcuccgcccuccuccucgucucccucuccaucgccuucuacugcaucgucuaccucgagugguacugcggcaucggcgaguacgacgucaaguaccccgcccucauccccaucaccaccgccuccuucaucgccgccggcaucugcuucaacaucgcccucuggcacgucugguccuucuucaccccccuccuccucuucacccaguucaugggcgucgucauguucaucacccuccucggcuga

SEQ ID NO: 50837 - RNA, 3075 nt, Artificial Sequence
  derived and/or modified sequence opt2 from TMEM132A__Homo_sapiens__NP_060340
augugcgcccgcauggccggccgcaccaccgccgccccccgcggccccuacggccccuggcucugccuccucgucgcccucgcccucgacgucguccgcgucgacugcggccaggccccccucgaccccgucuaccuccccgccgcccucgagcuccucgacgcccccgagcacuuccgcguccagcaggucggccacuacccccccgccaacuccucccucuccucccgcuccgagaccuuccuccuccuccagcccuggccccgcgcccagccccuccuccgcgccuccuacccccccuucgccacccagcaggucguccccccccgcgucaccgagccccaccagcgccccguccccugggacguccgcgccgucuccgucgaggccgccgucacccccgccgagcccuacgcccgcguccucuuccaccucaagggccaggacuggccccccggcuccggcucccuccccugcgcccgccuccacgccacccaccccgccggcaccgcccaccaggccugccgcuuccagcccucccucggcgccugcgucgucgagcucgagcuccccucccacugguucucccaggccuccaccacccgcgccgagcucgccuacacccucgagcccgccgccgagggccccggcggcugcggcuccggcgaggagaacgaccccggcgagcaggcccuccccgucggcggcgucgagcuccgccccgccgaccccccccaguaccaggaggucccccucgacgaggccgucacccuccgcguccccgacaugcccguccgccccggccagcucuucuccgccacccuccuccuccgccacaacuucaccgccucccuccucacccuccgcaucaaggucaagaagggccuccacgucaccgccgcccgccccgcccagcccacccucuggaccgccaagcucgaccgcuucaagggcucccgccaccacaccacccucaucaccugccaccgcgccggccucaccgagcccgacuccuccuccccccucgagcucuccgaguuccucugggucgacuucgucgucgagaacuccaccggcggcggcgucgccgucacccgccccgucaccuggcagcucgaguaccccggccaggcccccgaggccgagaaggacaagauggucugggagauccucgucuccgagcgcgacauccgcgcccucaucccccucgccaaggccgaggagcucgucaacaccgccccccucaccggcgucccccagcacguccccguccgccucgucaccgucgacggcggcggcgcccucgucgaggucaccgagcacgucggcugcgaguccgccaacacccagguccuccaggucuccgaggccugcgacgccgucuucgucgccggcaaggagucccgcggcgcccgcggcguccgcgucgacuucugguggcgccgccuccgcgccucccuccgccucaccgucugggccccccuccucccccuccgcaucgagcucaccgacaccacccucgagcagguccgcggcuggcgcguccccggccccgccgagggccccgccgagcccgccgccgaggccuccgacgaggccgagcgccgcgcccgcggcugccaccuccaguaccagcgcgccggcguccgcuuccucgcccccuucgccgcccacccccucgacggcggccgccgccucacccaccuccucggccccgacuggcuccucgacgucucccaccucgucgccccccacgcccgcguccucgacucccgcgucgccucccucgagggcggccgcgucgucgucggccgcgagcccggcgucaccuccaucgagguccgcuccccccucuccgacuccauccucggcgagcaggcccucgccgucaccgacgacaaggucuccguccucgagcuccgcguccagcccgucaugggcaucucccucacccucucccgcggcaccgcccaccccggcgaggucaccgccaccugcugggcccaguccgcccuccccgcccccaagcaggaggucgcccucucccucuggcucuccuucuccgaccacaccgucgcccccgccgagcucuacgaccgccgcgaccucggccucuccgucuccgccgaggagcccggcgccauccuccccgccgaggagcagggcgcccagcucggcgucgucgucuccggcgccggcgccgagggccucccccuccacgucgcccuccacccccccgagcccugccgccgcggccgccaccgcgucccccucgccuccggcaccgccuggcucggccucccccccgccuccacccccgcccccgcccuccccuccucccccgccugguccccccccgccaccgaggccaccaugggcggcaagcgccaggucgccggcuccgucggcggcaacaccggcguccgcggcaaguucgagcgcgccgaggaggaggcccgcaaggaggagaccgaggcccgcgaggaggaggaggaggaggaggaggagaugguccccgccccccagcacgucaccgagcucgagcucggcauguacgcccuccucggcgucuucugcgucgccaucuucaucuuccucgucaacggcgucgucuucguccuccgcuaccagcgcaaggagccccccgacuccgccaccgaccccaccuccccccagccccacaacugggucuggcucggcaccgaccaggaggagcucucccgccagcucgaccgccagucccccggcccccccaagggcgagggcuccugccccugcgaguccggcggcggcggcgaggcccccacccucgcccccggcccccccggcggcaccaccuccuccuccuccacccucgcccgcaaggaggccggcggccgccgcaagcgcgucgaguucgucaccuucgcccccgccccccccgcccagucccccgaggagcccgucggcgcccccgccguccaguccauccucgucgccggcgaggaggacauccgcugggucugcgaggacaugggccucaaggaccccgaggagcuccgcaacuacauggagcgcauccgcggcuccuccuga

SEQ ID NO: 50838 - RNA, 3237 nt, Artificial Sequence
  derived and/or modified sequence opt2 from TMEM132B__Homo_sapiens__NP_443139
auguucggcgccgccucccgcauggacaccaccgccgucugcaccggcggcgucaccgagucccgcggcaucgucgacucccuccagaaguucuccucccuccccgccuaccuccccaccaaccuccacaucuccaacgccgaggaguccuucuuccucaaggaggccaaccaggaccucacccgcaacuccucccuccaggcccgcgucgagcccuucuucaucuaccgcgcccgcaccccccccaucaucaacgccuccuacggccccuucuccgucgagaagaucaucccccaggagcuccuccucaccuccaccgccuucggcaacauggacaaguuccccuucaacuggaagcucaagucccacauccucgacuccuccaucuacuccaaccgccccaagguccagacccucuucuacgucaccggcaugggcugggacgacuccgaccucaccgaggaccuccccugcgucaagauguucgccuuccccgaggcccgcgaggucgccgccuccugccgccuccagggcgcccccggccucugcgucgccgagcucgagcuccuccccgagugguucuccuccggccucgaccucgagcccgaggaggagauccccgcccuccucggcggcaccaccauggagcucuucuucacccucuaccccgccgacaaggccggccagugcccccucgaggaggagggcaagugggagaacaacauccacuccggccucgaguccccccagcaggccuuccccgcccgcgagcgcaucggcuccgucgucgucuaccccacccaggacgaccucaaguggucccucgucucccucgacgagaacgucgucaucuccgucccccucaaccucguccgcgagggcgacaccgccaccuuccucgucucccucaccuccuccuccgucgccgaccaguucacccuccgcaucaaggccgccgccggcgucaagaucaccgccguccgcgucuccuccgaggaccagugggccguccaggaggagaucgacaacggcuccacccagaccuccgccacccucaccugcaugggccaccgccccgacacccagucccgcgucaacggcuccuucuacgagauccuccaggucgacuucggcaucgacaacuccuccgaccucgccggcgcccagcagaucaccuggcaggucgaguaccccaucgaggacuccauguccgagcucgucgucuccgagaucuucgucucccagaccaccuucgucggcaucgucccccucgccauggacaccgagguccucaacaccgccauccucaccggcaagcccgucuccguccccgucaaggucgucggcguccaggaggacggcuccgucgucgacgucuccgaguccgucgagugcaaguccgccgacgaggacgucaucaaggucuccaacaacugcgacuccaucuucgucaacggcaaggagaugaaguccaaggucgacaccaucgucaacuucacccaccagcacuucaccucccaguucgaggucaccgucugggccccccgccucccccuccagaucgagaucuccgacaccgagcucucccagaucaagggcuggcgcauccccgucgccgccaaccgccgccccacccgcgaguccgacgacgaggacgacgaggagaagaagggccgcggcugcucccuccaguaccagcacgccaccguccgcguccucacccaguucgucgccgagucccccgaccucggccagcucaccuacaugcucggccccgacuggcaguucgacaucaccgaccucgucaccgaguucaugaaggucgaggagcccaagaucgcccagcuccaggacggccgcacccucgccggccgcgagcccggcaucaccaccguccagguccucuccccccucuccgacuccauccucgccgagaagaccgucaucguccucgacgaccgcgucaccaucgccgagcucggcguccagcucgucgccggcaugucccucucccuccagccccaccgcgccgacaagcgcgccaucgucuccaccgccgccgcccucgacguccuccaguccccccagcaggaggccaucgucuccuccuggauccucuucuccgacggcuccgucaccccccucgacaucuacgaccccaaggacuacuccgucaccgucuccucccucgacgagauggucgucuccguccaggccaaccucgaguccaaguggcccaucgucgucgccgagggcgagggccagggcccccucaucaagcucgagaugaugaucuccgagcccugccagaagaccaagcgcaaguccguccucgccgucggcaagggcaacgucaaggucaaguucgagcccuccuccgacgagcaccagggcggcuccaacgacaucgagggcaucaaccgcgaguacaaggaccaccucuccaacuccaucgagcgcgagggcaaccaggagcgcgccguccaggagugguuccaccgcggcacccccgucggccaggaggaguccaccaacaaguccaccaccccccagucccccauggagggcaagaacaagcuccucaaguccggcggccccgacgccuucaccuccuuccccacccagggcaagucccccgaccccaacaaccccuccgaccucaccgucaccucccgcggccucaccgaccucgagaucggcauguacgcccuccucugcgucuucugccucgccauccucgucuuccucaucaacugcgucgccuucgccuggaaguaccgccacaagcgcuucgccgucuccgagcagggcaacaucccccacucccacgacugggucuggcucggcaacgaggucgagcuccucgagaaccccgucgacaucacccuccccuccgaggagugcaccaccaugaucgaccgcggccuccaguucgaggagcgcaacuuccuccucaacggcuccucccagaagaccuuccacucccagcuccuccgccccuccgacuacgucuacgagaaggagaucaagaacgagcccaugaacuccuccggccccaagcgcaagcgcgucaaguucaccuccuacaccaccauccuccccgaggacggcggccccuacaccaacuccauccucuucgacuccgacgacaacaucaagugggucugccaggacaugggccucggcgacucccaggacuuccgcgacuacauggagucccuccaggaccagauguga

SEQ ID NO: 50839 - RNA, 3327 nt, Artificial Sequence
  derived and/or modified sequence opt2 from TMEM132C__Homo_sapiens__NP_001129575
augcgcuccgagggcgccgcccccggccccgccgccccccucugcggcgcccucucccuccuccucggcgcccuccucggcaaggucaucgagggccacggcgucaccgacaacauccagcgcuucuccucccucccccccuaccuccccgucuccuaccacauccuccgcgccgagaccuccuucuuccucaaggaggccaaccaggaccuccuccgcaacuccucccuccaggcccgcgucgaguccuucuucaccuacaagacccgccagccccccguccucaacgccuccuacggccccuucuccgucgagaaggucgucccccucgaccucaugcucaccuccaacuuccucggccccaccaacaaguucuccuucgacuggaagcucaaggcccacauccuccgcgacaaggucuaccucucccgccccaagguccagguccucuuccacaucaugggccgcgacugggacgaccacggcgccggcgagaagcuccccugccuccgcgucuucgccuuccgcgagacccgcgagguccgcggcuccugccgccucaagggcgaccucggccucugcgucgccgagcucgagcuccucuccuccugguucuccgcccccaccgucggcgccggccgcaagaaguccauggaccagcccgagggcacccccgucgagcucuacuacaccguccaccccggcaacgagcgcggcgacugcgccggcggcgacuuccgcaagggcaacgccauccgccccggcaaggacggccucgaggagaccaccucccaccuccagcgcaucggcaccgucggccucuaccgcgcccaggacuccgcccagcucuccgagcuccgccucgacggcaacgucgucaucuggcuccccucccgccccgucaagcagggcgaggucgucaccgccuacgucaccaucuccuccaacuccuccgucgaccucuucauccuccgcgccaaggucaagaagggcgucaacauccucuccgcccagacccgcgagccccgccaguggggcgucaagcaggaggucggcuccggcggcaagcacgucaccgccaccgucgccugccagcgccucggccccuccccccgcaaccgcuccuccucccucuucaacgaggucguccagaugaacuucgagaucgccuccuucuccucccucuccggcacccagcccaucaccuggcaggucgaguacccccgcaagggcaccaccgacaucgccgucuccgagaucuucgucucccagaaggaccucgucggcaucgucccccucgccauggacaccgagauccucaacaccgccguccucaccggcaagaccgucgccaugcccaucaaggucgucuccgucgaggagaacuccgccgucauggacaucuccgaguccgucgagugcaaguccaccgacgaggacgucaucaaggucuccgagcgcugcgacuacaucuucgucaacggcaaggagaucaagggcaagauggacgccgucgucaacuucaccuaccaguaccucuccgccccccucugcgucaccgucugggucccccgccucccccuccagaucgaggucuccgacaccgagcucucccagaucaagggcuggcgcguccccaucgucaccaacaagcgccccacccgcgaguccgaggacgaggacgaggaggagcgccgcggccgcggcugcgcccuccaguaccagcacgccaccguccgcguccucacccaguucgucuccgagggcgccggccccuggggccagcccaacuaccuccucucccccaacuggcaguucgacaucacccaccucgucgccgacuucaugaagcucgaggagccccacgucgccacccuccaggacucccgcguccucgucggccgcgaggucggcaugaccaccauccagguccucuccccccucuccgacuccauccucgccgagaagaccaucaccguccucgacgacaaggucuccgucaccgaccucgccauccagcucgucgccggccucuccgucgcccucuaccccaacgccgagaacuccaaggccgucaccgccgucgucaccgccgaggagguccuccgcacccccaagcaggaggccgucuucuccaccuggcuccaguucuccgacggcuccgucaccccccucgacaucuacgacaccaaggacuucucccucgccgccaccucccaggacgaggccgucgucuccgucccccagccccgcuccccccgcuggcccgucgucgucgccgagggcgagggccagggcccccucauccgcgucgacaugaccaucgccgaggccugccagaaguccaagcgcaaguccauccucgccgucggcgucggcaacguccgcgucaaguucggccagaacgacgccgacuccucccccggcggcgacuacgaggaggacgagaucaagaaccacgccuccgaccgccgccagaagggccagcaccacgagcgcaccggccaggacggccaccucuacggcuccucccccgucgagcgcgaggagggcgcccuccgccgcgccaccaccaccgcccgcucccuccucgacaacaaggucgucaagaacucccgcgccgacggcggccgccucgccggcgagggccagcuccagaacauccccaucgacuucaccaacuuccccgcccacgucgaccuccccaaggccggcuccggccucgaggagaacgaccucguccagaccccccgcggccucuccgaccucgagaucggcauguacgcccuccucggcgucuucugccucgccauccucgucuuccucaucaacugcgccaccuucgcccucaaguaccgccacaagcaggucccccucgagggccaggccuccaugacccacucccacgacugggucuggcucggcaacgaggccgagcuccucgaguccaugggcgacgccccccccccccaggacgagcacaccaccaucaucgaccgcggccccggcgccugcgaggaguccaaccaccuccuccucaacggcggcucccacaagcacguccagucccagauccaccgcuccgccgacuccggcggccgccagggccgcgagcagaagcaggacccccuccacucccccaccuccaagcgcaagaaggucaaguucaccaccuucaccaccaucccccccgacgacuccugccccaccgucaacuccaucgucuccuccaacgacgaggacaucaagugggucugccaggacgucgccgucggcgcccccaaggagcuccgcaacuaccucgagaagcucaaggacaaggccuga

SEQ ID NO: 50840 - RNA, 3300 nt, Artificial Sequence
  derived and/or modified sequence opt2 from TMEM132D__Homo_sapiens__NP_597705
augugccccuccgagaugggcacccucuggcaccacuggucccccguccucaucucccucgccgcccucuucuccaaggucaccgagggccgcggcauccucgaguccauccagcgcuucucccuccuccccaccuaccuccccgucaccuaccacaucaacaacgccgacgucuccuucuuccucaaggaggccaaccaggacaucaugcgcaacuccucccuccagucccgcgucgaguccuuccucaucuacaagucccgccgccuccccguccucaacgccuccuacggccccuucuccaucgagcaggucgucccccaggaccucaugcuccccuccaaccccuucggcuucaccaacaaguucucccucaacuggaagcucaaggcccacauccuccgcgacaaggucuaccucucccgccccaagguccagguccucuuccacaucaugggccgcgacugggacgaccgcuccgccggcgagaagcuccccugccuccgcgucuucgccuuccgcgagacccgcgagguccgcggcuccugccgccuccagggcgaccucggccucugcgucgccgagcucgagcuccucuccuccugguucuccccccccaccgucgucgccggccgccgcaaguccgucgaccagcccgagggcacccccgucgagcucuacuacaccguccaccccggcggcgagcgcggcgacugcguccgcgaggacgcccgccgcuccaacggcauccgcaccggccacuccgacaucgacgaguccggccccccccuccagcgcaucggcuccaucuuccucuaccagacccaccgcaagcccucccuccgcgagcuccgccucgacaacuccgucgccauccacuacauccccaagaccguccgcaagggcgacguccucaccuuccccgucuccaucucccgcaacuccaccgaggaccgcuucacccuccgcgccaaggucaagaagggcgucaacaucaucggcguccgcgccuccucccccuccaucugggacgucaaggagcgcaccgacuacaccggcaaguacgcccccgccgucaucgucugccagaagaaggccgccggcuccgagaacuccgccgacggcgccuccuacgaggucaugcagaucgacgucgaggucgaggagcccggcgaccuccccgccacccagcucgucaccuggcaggucgaguaccccggcgagaucaccuccgaccucggcgucuccaagaucuacgucucccccaaggaccucaucggcgucgucccccucgccauggaggccgagauccucaacaccgccauccucaccggcaagaccgucgccguccccgucaaggucgucuccgucgaggacgacggcaccgucaccgagcuccucgaguccgucgagugccgcuccuccgacgaggacgucaucaaggucuccgaccgcugcgacuacgucuucgucaacggcaaggagaugaagggcaaggucaacgucgucgucaacuucaccuaccagcaccucuccuccccccucgagaugaccgucugggucccccgccucccccuccagaucgaggucuccgacaccgagcucaaccagaucaagggcuggcgcguccccaucgucuccucccgccgccccgccggcgacuccgaggaggaggaggacgacgagcgccgcggccgcggcugcacccuccaguaccagcacgccaugguccgcguccucacccaguucgucgccgaggccgccggccccggcggccaccucgcccaccuccucggcuccgacuggcaggucgacaucaccgagcucaucaacgacuucaugcaggucgaggagccccgcaucgccaagcuccagggcggccagauccucaugggccaggagcucggcaugaccaccauccagauccucuccccccucuccgacaccauccucgccgagaagaccaucaccguccucgacgagaaggucaccaucaccgaccucggcguccagcucgucaccggccucucccucucccuccagcucucccccggcuccaaccgcgccaucuucgccaccgccgucgcccaggagcuccuccagcgccccaagcaggaggccgccaucuccugcuggguccaguucuccgacggcuccgucaccccccucgacaucuacgacggcaaggacuucucccucauggccaccucccucgacgagaaggucgucuccauccaccaggaccccaaguucaaguggcccaucaucgccgccgagaccgagggccagggcacccucgucaaggucgagauggucaucuccgaguccugccagaaguccaagcgcaaguccguccucgccgucggcaccgccaacaucaaggucaaguucggccagaacgacgccaaccccaacaccuccgacucccgccacaccggcgccggcguccacauggagaacaacgucuccgaccgccgccccaagaagcccucccaggaguggggcucccaggagggccaguacuacggcuccuccuccaugggccucauggagggccgcggcaccaccaccgaccgcuccauccuccagaagaagaagggccaggagucccuccucgacgacaacucccaccuccagaccauccccuccgaccucaccuccuuccccgcccaggucgaccucccccgcuccaacggcgagauggacggcaacgaccucaugcaggccuccaagggccucuccgaccucgagaucggcauguacgcccuccucggcgucuucugccucgccauccucgucuuccucaucaacugcgucaccuucgcccucaaguaccgccacaagcagguccccuucgaggagcaggagggcaugucccacucccacgacugggucggccucuccaaccgcaccgagcuccucgagaaccacaucaacuucgccuccucccaggacgagcagaucaccgccaucgaccgcggcauggacuucgaggaguccaaguaccuccucuccaccaacucccagaaguccaucaacggccagcucuucaagccccucggccccaucaucaucgacggcaaggaccagaaguccgagccccccaccucccccaccuccaagcgcaagcgcgucaaguucaccaccuucaccgccgucuccuccgacgacgaguaccccacccgcaacuccaucgucauguccuccgaggacgacaucaagugggucugccaggaccucgaccccggcgacugcaaggagcuccacaacuacauggagcgccuccacgagaacgucuga

SEQ ID NO: 50841 - RNA, 3225 nt, Artificial Sequence
  derived and/or modified sequence opt2 from TMEM132E__Homo_sapiens__NP_001291367
auggcccccggcauguccggccgcggcggcgccgcccuccucugccucuccgcccuccucgcccacgccuccggccgcucccaccccgccucccccuccccccccggcccccaggccucccccguccuccccgucuccuaccgccucucccacacccgccucgccuucuuccuccgcgaggcccgcccccccucccccgccgucgccaacuccucccuccagcgcuccgagcccuucgucgucuuccagaccaaggagcuccccguccucaacgucucccucggccccuucuccaccucccaggucgucgcccgcgagcuccuccagcccuccuccacccucgacauccccgagcgccucaccgucaacuggaagguccgcgccuucaucguccgcucccacguccccgccucccagcccgucguccagguccucuucuacgucgccggccgcgacugggacgacuucggcgucaccgagcgccuccccugcguccgccuccacgccuuccgcgacgcccgcgaggucaaguccuccugccgccucuccggcggccucgccaccugccucguccgcgccgagcucccccucgccugguucggcccccccgcccccgccgccccccccaccgcccgccgcaagucccccgacggccucgagcccgaggccaccggcgagucccagcaggccgagcucuacuacacccuccacgcccccgacgccuccggcggcugcggcggcucccgccgcggcgccggccccggcgucggcgcccgcgccgagucccccacccagcacccccuccuccgcaucggcuccaucucccucuuccgcccccccccccgccgcacccuccaggagcaccgccucgacuccaaccucaugauccgccuccccgaccgcccccucaagcccggcgagguccucuccauccuccucuaccucgcccccaacuccuccucccccuccucccccuccgucgagcacuucacccuccgcgucaaggccaagaagggcgucacccuccucggcaccaagucccgcuccggccaguggcacgucaccuccgagcuccucaccggcgccaagcacuccaccgccaccgucgacgucgccugggcccaguccaccccccuccccccccgcgagggccagggcccccucgagauccuccagcucgacuucgagauggagaacuucaccucccaguccgucaagcgccgcaucauguggcacaucgacuaccgcggccacggcgcccuccccgaccucgagcgcgccgucaccgagcucaccgucauccagcgcgacguccaggccauccucccccucgccauggacaccgagaucaucaacaccgccauccucaccggccgcaccgucgccauccccgucaaggucaucgccaucgaggucaacggccucguccucgacaucuccgcccucgucgagugcgaguccgacaacgaggacaucaucaaggucuccuccuccugcgacuacgucuucgucuccggcaaggagucccgcggcuccaugaacgcccgcgucaccuuccgcuacgacguccucaacgccccccucgagaugaccgucuggguccccaagcucccccuccacaucgagcucuccgacgcccgccucucccaggucaagggcuggcgcguccccauccuccccgaccgccgcuccguccgcgaguccgaggacgaggacgaggaggaggaggagcgccgccaguccgccucccgcggcugcacccuccaguaccagcacgccacccuccaggucuucacccaguuccacaccaccuccuccgagggcaccgaccaggucgucaccaugcucggccccgacuggcucgucgaggucaccgaccucgucuccgacuucaugcgcgucggcgacccccgcgucgcccacauggucgacuccuccacccucgccggccucgagcccggcaccacccccuucaaggucgucuccccccucaccgaggccguccucggcgagacccuccucaccgucaccgaggagaaggucuccaucacccagcuccaggcccaggucgucgccucccucgcccucucccuccgccccucccccggcuccucccacaccauccucgccaccaccgccgcccagcagacccucuccuuccucaagcaggaggcccuccucucccucuggcucuccuacuccgacggcaccaccgccccccucucccucuacuccccccgcgacuacggccuccucgucuccucccucgacgagcacgucgccaccgucacccaggaccgcgccuucccccucgucgucgccgaggccgagggcuccggcgagcuccuccgcgccgagcucaccaucgccgaguccugccagaagaccaagcgcaaguccguccucgccaccacccccgucggccuccgcguccacuucggccgcgacgaggaggaccccaccuacgacuaccccggccccucccagcccggccccggcggcggcgaggacgaggcccgcggcgccggcccccccggcuccgcccuccccgcccccgaggcccccggccccggcaccgccucccccgucgucccccccaccgaggacuuccucccccuccccaccggcuuccuccaggucccccgcggccucaccgaccucgagaucggcauguacgcccuccucggcgucuucugccucgccauccucgucuuccucaucaacugcaucgucuucguccuccgcuaccgccacaagcgcaucccccccgagggccagaccuccauggaccacucccaccacugggucuuccucggcaacggccagccccuccgcguccagggcgagcucuccccccccgccggcaacccccucgagaccguccccgccuucugccacggcgaccaccacuccuccggcuccucccagaccuccguccagucccagguccacggccgcggcgacggcuccuccggcggcuccgcccgcgaccaggccgaggaccccgccuccucccccaccuccaagcgcaagcgcgucaaguucaccaccuucaccacccuccccuccgaggagcucgccuacgacuccguccccgccggcgaggaggacgaggaggaggaggaggaccucggcuggggcugccccgacgucgccggccccacccgccccaccgccccccccgaccuccacaacuacaugcgccgcaucaaggagaucgccuga

SEQ ID NO: 50842 - RNA, 543 nt, Artificial Sequence
  derived and/or modified sequence opt2 from TMEM134__Homo_sapiens__NP_001072118
auguccgccgcccgcccccaguucuccaucgacgacgccuucgagcucucccucgaggacggcggccccggccccgaguccuccggcgucgcccgcuucggcccccuccacuucgagcgccgcgcccgcuucgaggucgccgacgaggacaagcagucccgccuccgcuaccagaaccucgagaacgacgaggacggcgcccaggccucccccgagcccgacggcggcgucggcacccgcgacuccucccgcaccuccauccgcuccucccagugguccuucuccaccaucuccuccuccacccagcgcuccuacaacaccugcugcuccuggacccagcacccccucauccagaagaaccgccgcgucguccucgccuccuuccuccuccuccuccucggccucggcgucuccuccgccaucuucuucguccccggcuuccuccuccucguccccggcgucuaccacgucaucuucaucuacugcgccgucaagggccaccgcggcuuccaguucuucuaccuccccuacuucgagaaguga

SEQ ID NO: 50843 - RNA, 1311 nt, Artificial Sequence
  derived and/or modified sequence opt2 from TMEM135__Homo_sapiens__NP_001162195
auggccgcccucuccaaguccaucccccacaacugcuacgagaucggccacaccuggcaccccuccugccgcgucuccuuccuccagaucaccggcggcgcccucgaggagucccucaagaucuacgccccccucuaccucaucgccgccauccuccgcaagcgcaagcucgacuacuaccuccacaagcuccuccccgagauccuccaguccgccuccuuccucaccgccaacggcgcccucuacauggccuucuucugcauccuccgcaagauccucggcaaguucuacuccuggacccccggcuucggcgccgcccuccccgccuccuacgucgccauccucaucgagcgcaagucccgccgcggccuccucaccaucuacauggccaaccucguccuccucuucugcaucaccgccgccauguacauguucuucuuccgcugcaaggacggccucaagggcuucaccuucuccgcccuccgcuucaucgucggcaaggaggagauccccacccacuccuucucccccgaggccgccuacgccaaggucgagcagaagcgcgagcagcacgaggagaagcccggccgcaugaacaugaucggccucguccgcaaguucgucgacuccaucugcaagcacggcccccgccaccgcugcugcaagcacuacgaggacaacugcaucuccuacugcaucaagggcuucauccgcauguucuccgucggcuaccucauccagugcugccuccgcauccccuccgccuuccgccaccucuucacccagcccucccgccuccucucccucuucuacaacaaggagaacuuccagcucggcgccuuccucggcuccuucgucuccaucuacaagggcaccuccugcuuccuccgcuggauccgcaaccucgacgacgagcuccacgccaucaucgccggcuuccucgccggcaucuccaugauguucuacaaguccaccaccaucuccauguaccucgccuccaagcucgucgagaccauguacuucaagggcaucgaggccggcaagguccccuacuucccccacgccgacaccaucaucuacuccaucuccaccgccaucugcuuccaggccgccgucauggagguccagacccuccgccccuccuacuggaaguuccuccuccgccucaccaagggcaaguucgccgucaugaaccgcaagguccucgacgucuucggcaccggcgccuccaagcacuuccaggacuucaucccccgccucgacccccgcuacaccaccgucacccccgagcuccccaccgaguucuccuga

SEQ ID NO: 50844 - RNA, 489 nt, Artificial Sequence
  derived and/or modified sequence opt2 from TMEM138__Homo_sapiens__NP_057548
augcuccagaccuccaacuacucccucguccucucccuccaguuccuccuccucuccuacgaccucuucgucaacuccuucuccgagcuccuccagaagacccccgucauccagcucguccucuucaucauccaggacaucgccguccucuucaacaucaucaucaucuuccucauguucuucaacaccuucgucuuccaggccggccucgucaaccuccucuuccacaaguucaagggcaccaucauccucaccgccgucuacuucgcccucuccaucucccuccacgucugggucaugaaccuccgcuggaagaacuccaacuccuucaucuggaccgacggccuccagaugcucuucgucuuccagcgccucgccgccguccucuacugcuacuucuacaagcgcaccgccguccgccucggcgacccccacuucuaccaggacucccucuggcuccgcaaggaguucaugcagguccgccgcuga

SEQ ID NO: 50845 - RNA, 702 nt, Artificial Sequence
  derived and/or modified sequence opt2 from TMEM150B__Homo_sapiens__XP_011525158
auguggggcuaccucucccucaugcccgucuuccucgccgucugggccaucuccggcgucuggaucgucuucgccaucgccgucaccaaccgcaccgucgaccucuccaagggcuuccccuacaucuccaucugcggcuccuuccccccccaguccugcaucuucucccagguccucaacaugggcgccgcccucgccgccuggaucugcaucguccgcuaccaccagcuccgcgacuggggcguccgccgcuggcccaaccagcucauccucuggaccggccuccucugcgcccucggcaccuccgucgucggcaacuuccaggagaagaaccagcgccccacccaccucgccggcgccuuccucgccuucauccucggcaacgucuacuucuggcuccagcuccuccucuggcgccucaagcgccucccccagcccggcgccgccuggaucggcccccuccgccucggccucugcuccgucugcaccauccucaucgucgccaugaucguccuccacgccugcucccuccgcuccgucuccgccgccugcgagugggucgucgccaugcuccucuucgcccucuucggccuccucgccgucgacuucuccgcccucgaguccugcacccucugcguccagcccuggcccucccucucccccccccccgccucccccaucucccuccccguccagcucuga

SEQ ID NO: 50846 - RNA, 1407 nt, Artificial Sequence
  derived and/or modified sequence opt2 from TMEM151A__Homo_sapiens__NP_694998
augcccgaggacggcgccggcgacggcggcgagguccccgcccucauccccgacggcgagccccuccgcgaggagcagcgcccccucaagcagucccucggcuccucccucugccgcgagucccacuggaagugccuccuccucacccuccucauccacgccugcggcgccgucgucgccuggugccgccucgccaccgucccccgccucguccucggccccgaggccgcccucgcccgcggcgccggcggccccccccccaccuaccccgccucccccugcuccgacggcuaccucuacaucccccucgccuucgucucccuccucuaccuccucuaccucgccgagugcuggcacugccacguccgcuccugccaggccccccgcaccgacgcccacaccguccucgcccucauccgccgccuccagcaggccccccccugcgucugguggaaggccaccuccuaccacuacguccgccgcacccgccagaucacccgcuaccgcaacggcgacgccuacaccaccacccaggucuaccacgagcgcgccgacucccgcaccgcccgcggcgaguucgacuacuccgcccacggcguccgcgacgucuccaaggagcucgucggccucgccgagcacgccgccacccgccuccgcuucaccaagugcuucuccuucggcuccgccgaggccgaggccuccuaccucacccagcgcgcccgcuucuucuccgccaacgagggccucgacgacuaccucgaggcccgcgagggcaugcaccucaaggacgucgacuuccgcgagucccucauggucuucgccgacccccgcuccccccccugguacgcccgcgccugggucuucuggcucgucuccgccgccacccucuccuggccccuccgcgucgucgccgccuacggcaccgcccacguccacuaccaggucgagaagcucuucggcgccuccucccccccccccggcgccguccccuccggccccccccucucccgcgucgccaccgucgacuucaccgagcucgaguggcacaucugcuccaaccgccagcucguccccuccuacuccgaggccgucgucaugggcgccggcuccggcgccuaccuccgcggcugccagcgcugccgccgcuccgucuccuccaacucccucccccccgcccgccccuccggcccccgccuccccuucucccgcucccgccucucccucggcgccggcggccgcgccacccccggcgucuuccgcucccucuccggcggcccccucggccgccgcggcgaggacaccgagccccucgaguccccccccugcuacgaggacgcccucuacuuccccguccucaucguccacggcgacuccggcugccagggcgacggccagggcgcccucuga

SEQ ID NO: 50847 - RNA, 1701 nt, Artificial Sequence
  derived and/or modified sequence opt2 from TMEM151B__Homo_sapiens__NP_001131032
auguccccccccggcuccgccgccggcgaguccgccgccggcggcggcggcggcggcggcggccccggcgucuccgaggagcucaccgccgccgccgccgccgccgccgccgacgagggccccgcccgcgaggagcagcgccccauccagcccuccuucaccaagucccucugccgcgagucccacuggaagugccuccuccucucccuccucauguacggcugccucggcgccgucgccuggugccacgucaccaccgucacccgccucaccuucuccuccgccuaccagggcaacucccucauguaccacgacucccccugcuccaacggcuacgucuacaucccccucgccuuccuccucaugcucuacgccgucuaccucgucgagugcuggcacugccaggcccgccacgagcuccagcaccgcgucgacgucuccuccguccgcgagcgcgucggccgcaugcagcaggccacccccugcaucugguggaaggccaucuccuaccacuacguccgccgcacccgccaggucacccgcuaccgcaacggcgacgccuacaccaccacccaggucuaccacgagcgcgucaacacccacgucgccgaggccgaguucgacuacgcccgcugcggcguccgcgacgucuccaagacccucgucggccucgagggcgcccccgccacccgccuccgcuucaccaagugcuucuccuucgccuccgucgaggccgagaacgccuaccucugccagcgcgcccgcuucuucgccgagaacgagggccucgacgacuacauggaggcccgcgagggcaugcaccucaagaacgucgacuuccgcgaguucauggucgccuuccccgaccccgcccgcccccccugguacgccugcuccuccgccuucugggccgccgcccuccucacccucuccuggccccuccgcguccucgccgaguaccgcaccgccuacgcccacuaccacgucgagaagcucuucggccucgagggccccggcuccgccuccuccgccggcggcggccucucccccuccgacgagcuccuccccccccucacccaccgccucccccgcgucaacaccgucgacuccaccgagcucgaguggcacauccgcuccaaccagcagcucguccccuccuacuccgaggccguccucauggaccucgccggccucggcacccgcugcggcggcgccggcggcggcuacgcccccuccugccgcuacggcggcgucggcggccccggcgccgccggcgucgcccccuaccgccgcuccugcgagcacugccagcgcgccgucuccuccuccuccaucuucucccgcuccgcccucuccaucugcgccuccccccgcgccggccccggccccggcggcggcgccggcugcggcggcucccgcuucucccucggccgccucuacggcucccgccgcuccugccucuggcgcucccgcuccggcuccgucaacgaggccuccugccccaccgagcagacccgccucuccucccaggccuccaugggcgacgacgaggacgacgacgaggaggaggccggcccccccccccccuaccacgacgcccucuacuuccccguccucaucguccaccgccaggagggcugccucggccacucccaccgcccccuccaccgccacggcuccugcgucgagaccucccucuga

SEQ ID NO: 50848 - RNA, 552 nt, Artificial Sequence
  derived and/or modified sequence opt2 from TMEM154__Homo_sapiens__NP_689893
augcaggccccccgcgccgcccucgucuucgcccucgucaucgcccucguccccgucggccgcggcaacuacgaggagcucgagaacuccggcgacaccaccgucgaguccgagcgccccaacaaggucaccauccccuccaccuucgccgccgucaccaucaaggagacccucaacgccaacaucaacuccaccaacuucgcccccgacgagaaccagcucgaguucauccucaugguccucaucccccucauccuccucguccuccuccuccucuccgucgucuuccucgccaccuacuacaagcgcaagcgcaccaagcaggagcccuccucccagggcucccaguccgcccuccagaccuacgagcucggcuccgagaacgucaagguccccaucuucgaggaggacacccccuccgucauggagaucgagauggaggagcucgacaaguggaugaacuccaugaaccgcaacgccgacuucgagugccuccccacccucaaggaggagaaggaguccaaccacaaccccuccgacuccgaguccuga

SEQ ID NO: 50849 - RNA, 903 nt, Artificial Sequence
  derived and/or modified sequence opt2 from TMEM158__Homo_sapiens__NP_056259
augcucccccuccucgccgcccuccucgccgccgccugcccccucccccccguccgcggcggcgccgccgacgcccccggccuccucggcguccccuccaacgccuccgucaacgccuccuccgccgacgagcccaucgccccccgccuccucgccuccgccgcccccggcccccccgagcgccccggccccgaggaggccgccgccgccgccgcccccugcaacaucuccguccagcgccagaugcucuccucccuccucguccgcuggggccgcccccgcggcuuccagugcgaccuccuccucuucuccaccaacgcccacggccgcgccuucuucgccgccgccuuccaccgcgucggccccccccuccucaucgagcaccucggccucgccgccggcggcgcccagcaggaccuccgccucugcgucggcugcggcuggguccgcggccgccgcaccggccgccuccgccccgccgccgcccccuccgccgccgccgccaccgccggcgcccccaccgcccuccccgccuaccccgccgccgagccccccggcccccucuggcuccagggcgagccccuccacuucugcugccucgacuucucccucgaggagcuccagggcgagcccggcuggcgccucaaccgcaagcccaucgaguccacccucgucgccugcuucaugacccucgucaucgucgucugguccgucgccgcccucaucuggcccguccccaucaucgccggcuuccuccccaacggcauggagcagcgccgcaccaccgccuccaccaccgccgccacccccgccgccguccccgccggcaccaccgccgccgccgccgccgccgccgccgccgccgccgccgccgccgucaccuccggcgucgccaccaaguga

SEQ ID NO: 50850 - RNA, 567 nt, Artificial Sequence
  derived and/or modified sequence opt2 from TMEM160__Homo_sapiens__NP_060324
augggcggcggcugguggugggcccgcgccgcccgccucgcccgccuccgcuuccgccgcucccuccuccccccccagcgcccccgcuccggcggcgcccgcggcuccuucgcccccggccacggcccccgcgccggcgccucccccccccccgucuccgagcucgaccgcgccgacgccuggcuccuccgcaaggcccacgagaccgccuuccucuccugguuccgcaacggccuccucgccuccggcaucggcgucaucuccuucaugcaguccgacaugggccgcgaggccgccuacggcuucuuccuccucggcggccucugcgucgucuggggcuccgccuccuacgccgucggccucgccgcccuccgcggccccaugcagcucacccucggcggcgccgccgucggcgccggcgccguccucgccgccucccuccucugggccugcgccgucggccucuacaugggccagcucgagcucgacgucgagcucguccccgaggacgacggcaccgccuccgccgagggccccgacgaggccggccgccccccccccgaguga

SEQ ID NO: 50851 - RNA, 1464 nt, Artificial Sequence
  derived and/or modified sequence opt2 from TMEM161B__Homo_sapiens__NP_699185
augggcgucaucggcauccagcucgucgucaccauggucauggccuccgucaugcagaagaucaucccccacuacucccucgcccgcuggcuccucugcaacggcucccuccgcugguaccagcaccccaccgaggaggagcuccgcauccucgccggcaagcagcagaagggcaagaccaagaaggaccgcaaguacaacggccacaucgaguccaagccccucaccauccccaaggacaucgaccuccaccucgagaccaaguccgucaccgaggucgacacccucgcccuccacuacuuccccgaguaccaguggcucgucgacuucaccgucgccgccaccgucgucuaccucgucaccgaggucuacuacaacuucaugaagcccacccaggagaugaacaucucccucgucuggugccuccucguccucuccuucgccaucaagguccucuucucccucaccacccacuacuucaaggucgaggacggcggcgagcgcuccgucugcgucaccuucggcuucuucuucuucgucaaggccauggccguccucaucgucaccgagaacuaccucgaguucggccucgagaccggcuucaccaacuucuccgacuccgccaugcaguuccucgagaagcagggccucgagucccagucccccgucuccaagcucaccuucaaguucuuccucgccaucuucugcuccuucaucggcgccuuccucaccuuccccggccuccgccucgcccagaugcaccucgacgcccucaaccucgccaccgagaagaucacccagacccuccuccacaucaacuuccucgccccccucuucaugguccuccucugggucaagcccaucaccaaggacuacaucaugaaccccccccucggcaaggaguccaucccccucaugaccgaggccaccuucgacacccuccgccucuggcucaucauccuccucugcgcccuccgccucgccaugaugcgcucccaccuccaggccuaccucaaccucgcccagaagugcgucgaccagaugaagaaggaggccggccgcaucuccaccgucgagcuccagaagauggucgcccgcgucuucuacuaccucugcgucaucgcccuccaguacgucgccccccucgucaugcuccuccacaccacccuccuccucaagacccucggcaaccacuccuggggcaucuaccccgaguccaucuccacccuccccgucgacaacucccuccucuccaacuccgucuacuccgagcuccccuccgccgagggcaagaugaaggucaccgucacccagaucaccgucgcccucuccucccucaagaacaucuucaccccccuccucuuccgcggccuccucuccuuccucaccugguggaucgccgccugccucuucuccaccucccucuucggccucuucuaccaccaguaccucaccgucgccuga

SEQ ID NO: 50852 - RNA, 870 nt, Artificial Sequence
  derived and/or modified sequence opt2 from TMEM163__Homo_sapiens__NP_112185
auggagcccgccgccggcauccagcgccgcuccucccagggccccaccguccccccccccccccgcggccacgccccccccgccgccgcccccggccccgccccccucuccucccccguccgcgagcccccccagcucgaggaggagcgccagguccgcaucuccgaguccggccaguucuccgacggccucgaggaccgcggccuccucgaguccuccacccgccucaagccccacgaggcccagaacuaccgcaagaaggcccucugggucuccugguucuccaucaucgucacccucgcccucgccgucgccgccuucaccgucuccgucaugcgcuacuccgccuccgccuucggcuucgccuucgacgccauccucgacguccucuccuccgccaucguccucuggcgcuacuccaacgccgccgccguccacuccgcccaccgcgaguacaucgccugcgucauccucggcgucaucuuccuccucuccuccaucugcaucgucgucaaggccauccacgaccucuccacccgccuccuccccgaggucgacgacuuccucuucuccgucuccauccucuccggcauccucugcuccauccucgccguccucaaguucaugcucggcaagguccucaccucccgcgcccucaucaccgacggcuucaacucccucgucggcggcgucaugggcuucuccauccuccucuccgccgaggucuucaagcacgacuccgccgucugguaccucgacggcuccaucggcguccucaucggccucaccaucuucgccuacggcgucaagcuccucaucgacauggucccccgcguccgccagacccgccacuacgagauguucgaguga

SEQ ID NO: 50853 - RNA, 975 nt, Artificial Sequence
  derived and/or modified sequence opt2 from TMEM165__Homo_sapiens__NP_060945
auggccgccgccgcccccggcaacggccgcgccuccgccccccgccuccuccuccucuuccucgucccccuccucugggcccccgccgccguccgcgccggccccgacgaggaccucucccaccgcaacaaggagccccccgcccccgcccagcagcuccagccccagcccgucgccguccagggccccgagcccgcccgcgucgagaagaucuucacccccgccgcccccguccacaccaacaaggaggaccccgccacccagaccaaccucggcuucauccacgccuucgucgccgccaucuccgucaucaucgucuccgagcucggcgacaagaccuucuucaucgccgccaucauggccaugcgcuacaaccgccucaccguccucgccggcgccaugcucgcccucggccucaugaccugccucuccguccucuucggcuacgccaccaccgucaucccccgcgucuacaccuacuacgucuccaccguccucuucgccaucuucggcauccgcaugcuccgcgagggccucaagaugucccccgacgagggccaggaggagcucgaggagguccaggccgagcucaagaagaaggacgaggaguuccagcgcaccaagcuccucaacggccccggcgacgucgagaccggcaccuccaucaccgucccccagaagaaguggcuccacuucaucucccccaucuucguccaggcccucacccucaccuuccucgccgaguggggcgaccgcucccagcucaccaccaucguccucgccgcccgcgaggaccccuacggcgucgccgucggcggcaccgucggccacugccucugcaccggccucgccgucaucggcggccgcaugaucgcccagaagaucuccguccgcaccgucaccaucaucggcggcaucgucuuccucgccuucgccuucuccgcccucuucaucucccccgacuccggcuucuga

SEQ ID NO: 50854 - RNA, 894 nt, Artificial Sequence
  derived and/or modified sequence opt2 from TMEM169__Homo_sapiens__NP_001135784
auggaggagcccaccgccgucgagggccagguccagcuccccuccccccaccagggcucccuccgcaaggccgucgccgccgcccucgcccucgacggcgaguccaccaugggccaccgcaagaagaagcgcaaggagucccgccccgaguccaucaucaucuaccgcuccgacaacgagaagaccgacgaggagcccggcgaguccgagggcggcgaccagcccaaggaggaggagggcgacgacuuccucgacuaccccgucgacgacgacauguggaaccucccccucgacucccgcuacgucacccucaccggcaccaucacccgcggcaagaagaagggccagauggucgacauccacgucacccucaccgagaaggagcuccaggagcucaccaagcccaaggaguccucccgcgagaccacccccgagggccgcauggccugccagaugggcgccgaccgcggcccccacgucguccucuggacccucaucugccuccccgucgucuucauccucuccuucgucgucuccuucuacuacggcaccaucaccugguacaacaucuuccucgucuacaacgaggagcgcaccuucuggcacaagaucuccuacugccccugccucguccucuucuaccccguccucaucauggccauggccuccucccucggccucuacgccgccgucguccagcucuccugguccugggaggccugguggcaggccgcccgcgacauggagaagggcuucugcggcuggcucugcuccaagcucggccucgaggacugcucccccuacuccaucgucgagcuccucgaguccgacaacaucuccuccacccucuccaacaaggaccccauccaggaggucgagaccuccaccgucuga

SEQ ID NO: 50855 - RNA, 435 nt, Artificial Sequence
  derived and/or modified sequence opt2 from TMEM170A__Homo_sapiens__NP_660297
auggagcgcgagggcuccggcggcuccggcggcuccgccggccuccuccagcagauccucucccucaaggucgucccccgcgucggcaacggcacccucugccccaacuccaccucccucugcuccuuccccgagaugugguacggcgucuuccucugggcccucgucuccucccucuucuuccacguccccgccggccuccucgcccucuucacccuccgccaccacaaguacggccgcuucauguccgucuccauccuccucaugggcaucgucggccccaucaccgccggcauccucaccuccgccgccaucgccggcgucuaccgcgccgccggcaaggagaugauccccuucgaggcccucacccucggcaccggccagaccuucugcguccucgucgucuccuuccuccgcauccucgccacccucuga

SEQ ID NO: 50856 - RNA, 972 nt, Artificial Sequence
  derived and/or modified sequence opt2 from TMEM171__Homo_sapiens__NP_001154814
augucccccgccgccgccgccgagcccgacggcgaccagcaggaccgccacgucuccaagcucaucuucugcuucuucgucuucggcgccguccuccucugcgucggcguccuccucuccaucuucggcuuccaggccugccaguacaagccccuccccgacugccccaugguccucaaggucgccggccccgccugcgccgucgucggccucggcgccgucauccucgcccgcucccgcgcccagcuccagcuccgcgccggccuccagcgcggccagcagauggaccccgaccgcgccuucaucugcggcgagucccgccaguucgcccagugccucaucuucggcuuccucuuccucaccuccggcaugcucaucuccguccucggcaucuggguccccggcugcggcuccaacugggcccaggagccccucaacgagaccgacaccggcgacuccgagccccgcaugugcggcuuccucucccuccagaucaugggcccccucaucguccucgucggccucugcuucuucgucgucgcccacgucaagaagcgcaacacccucaacgccggccaggacgccuccgagcgcgaggagggccagauccagaucauggagcccguccaggucaccgucggcgacuccgucaucaucuucccccccccccccccccccuacuuccccgaguccuccgccuccgccgucgccgagucccccggcaccaacucccuccuccccaacgagaacccccccuccuacuacuccaucuucaacuacggcacccccaccuccgagggcgccgccuccgagcgcgacugcgaguccaucuacaccaucuccggcaccaacuccuccuccgaggccucccacaccccccaccuccccuccgagcuccccccccgcuacgaggagaaggagaacgccgccgccaccuuccucccccucuccuccgagcccuccccccccuga

SEQ ID NO: 50857 - RNA, 1140 nt, Artificial Sequence
  derived and/or modified sequence opt2 from TMEM173__Homo_sapiens__NP_938023
augccccacuccucccuccaccccuccauccccugcccccgcggccacggcgcccagaaggccgcccucguccuccucuccgccugccucgucacccucuggggccucggcgagccccccgagcacacccuccgcuaccucguccuccaccucgccucccuccagcucggccuccuccucaacggcgucugcucccucgccgaggagcuccgccacauccacucccgcuaccgcggcuccuacuggcgcaccguccgcgccugccucggcugcccccuccgccgcggcgcccuccuccuccucuccaucuacuucuacuacucccuccccaacgccgucggcccccccuucaccuggaugcucgcccuccucggccucucccaggcccucaacauccuccucggccucaagggccucgcccccgccgagaucuccgccgucugcgagaagggcaacuucaacgucgcccacggccucgccugguccuacuacaucggcuaccuccgccucauccuccccgagcuccaggcccgcauccgcaccuacaaccagcacuacaacaaccuccuccgcggcgccgucucccagcgccucuacauccuccucccccucgacugcggcguccccgacaaccucuccauggccgaccccaacauccgcuuccucgacaagcucccccagcagaccggcgaccacgccggcaucaaggaccgcgucuacuccaacuccaucuacgagcuccucgagaacggccagcgcgccggcaccugcguccucgaguacgccaccccccuccagacccucuucgccaugucccaguacucccaggccggcuucucccgcgaggaccgccucgagcaggccaagcucuucugccgcacccucgaggacauccucgccgacgcccccgagucccagaacaacugccgccucaucgccuaccaggagcccgccgacgacuccuccuucucccucucccaggagguccuccgccaccuccgccaggaggagaaggaggaggucaccgucggcucccucaagaccuccgccguccccuccaccuccaccaugucccaggagcccgagcuccucaucuccggcauggagaagccccucccccuccgcaccgacuucuccuga

SEQ ID NO: 50858 - RNA, 1269 nt, Artificial Sequence
  derived and/or modified sequence opt2 from TMEM175__Homo_sapiens__NP_001284354
augaccuuccucaucgucaccgucgccugggccgcccacacccgccucuuccaggucgucggcaagaccgacgacacccucgcccuccucaaccucgccugcaugaugaccaucaccuuccuccccuacaccuucucccucauggucaccuuccccgacgucccccucggcaucuuccucuucugcgucugcgucaucgccaucggcgucguccaggcccucaucgucggcuacgccuuccacuucccccaccuccucuccccccagauccagcgcuccgcccaccgcgcccucuaccgccgccacguccucggcaucguccuccagggccccgcccucugcuucgccgccgccaucuucucccucuucuucgucccccucuccuaccuccucauggucaccgucauccuccuccccuacgucuccaaggucaccggcuggugccgcgaccgccuccucggccaccgcgagcccuccgcccaccccgucgaggucuucuccuucgaccuccacgagccccucuccaaggagcgcgucgaggccuucuccgacggcgucuacgccaucgucgccacccuccucauccucgacaucugcgaggacaacguccccgaccccaaggacgucaaggagcgcuucuccggcucccucgucgccgcccucuccgccaccggcccccgcuuccucgccuacuucggcuccuucgccaccgucggccuccucugguucgcccaccacucccucuuccuccacguccgcaaggccacccgcgccaugggccuccucaacacccucucccucgccuucgucggcggccucccccucgccuaccagcagaccuccgccuucgcccgccagccccgcgacgagcucgagcgcguccgcgucuccugcaccaucaucuuccucgccuccaucuuccagcucgccauguggaccaccgcccuccuccaccaggccgagacccuccagcccuccgucugguucggcggccgcgagcacguccucauguucgccaagcucgcccucuaccccugcgccucccuccucgccuucgccuccaccugccuccucucccgcuucuccgucggcaucuuccaccucaugcagaucgccguccccugcgccuuccuccuccuccgccuccucgucggccucgcccucgccacccuccgcguccuccgcggccucgcccgccccgagcaccccccccccgcccccaccggccaggacgacccccagucccagcuccuccccgcccccugcuga

SEQ ID NO: 50859 - RNA, 702 nt, Artificial Sequence
  derived and/or modified sequence opt2 from TMEM176B__Homo_sapiens__NP_001094784
augacccagaacaccgucaucgucaacggcgucgccauggccucccgccccucccagcccacccacgucaacguccacauccaccaggaguccgcccucacccagcuccucaaggccggcggcucccucaagaaguuccucuuccaccccggcgacaccguccccuccaccgcccgcaucggcuacgagcagcucgcccucggcgucaucgccgccggcgccggcgccaucguccacgagaagcaccccggcaagcucgccggcuacaucuccucccuccucacccucgccggcuucgccaccgccauggccgccgucguccucugcgucaacuccuucaucuggcagaccgagcccuuccucuacaucgacaccgucugcgaccgcuccgaccccgucuuccccaccaccggcuaccgcuggaugcgccgcucccaggagaaccaguggcagaaggaggagugccgcgccuacaugcagaugcuccgcaagcucuucaccgccauccgcgcccucuuccucgccgucugcguccucaaggucaucgucucccucgucucccucggcgucggccuccgcaaccucugcggccaguccucccagccccucaacgaggagggcuccgagaagcgccuccucggcgagaacuccgucccccccucccccucccgcgagcagaccuccaccgccaucguccucuga

SEQ ID NO: 50860 - RNA, 894 nt, Artificial Sequence
  derived and/or modified sequence opt2 from TMEM178A__Homo_sapiens__NP_689603
auggagccccgcgcccucgucaccgcccucucccucggccucucccucugcucccucggccuccucgucaccgccaucuucaccgaccacugguacgagaccgacccccgccgccacaaggaguccugcgagcgcucccgcgccggcgccgacccccccgaccagaagaaccgccucaugccccucucccaccucccccuccgcgacucccccccccucggccgccgccuccuccccggcggccccggccgcgccgaccccgaguccuggcgcucccuccucggccucggcggccucgacgccgagugcggccgcccccucuucgccaccuacuccggccucuggcgcaagugcuacuuccucggcaucgaccgcgacaucgacacccucauccucaagggcaucgcccagcgcugcaccgccaucaaguaccacuucucccagcccauccgccuccgcaacauccccuucaaccucaccaagaccauccagcaggacgaguggcaccuccuccaccuccgccgcaucaccgccggcuuccucggcauggccgucgccguccuccucugcggcugcaucgucgccaccgucuccuucuucugggaggagucccucacccagcacgucgccggccuccucuuccucaugaccggcaucuucugcaccaucucccucugcaccuacgccgccuccaucuccuacgaccucaaccgccuccccaagcucaucuacucccuccccgccgacgucgagcacggcuacuccugguccaucuucugcgccuggugcucccucggcuucaucgucgccgccggcggccucugcaucgccuaccccuucaucucccgcaccaagaucgcccagcucaaguccggccgcgacuccaccgucuga

SEQ ID NO: 50861 - RNA, 690 nt, Artificial Sequence
  derived and/or modified sequence opt2 from TMEM182__Homo_sapiens__NP_653233
augcgccucaacaucgccaucuucuucggcgcccucuucggcgcccucggcguccuccucuuccucgucgccuucggcuccgacuacuggcuccucgccaccgaggucggccgcugcuccggcgagaagaacaucgagaacgucaccuuccaccacgagggcuucuucuggcgcugcugguucaacggcaucgucgaggagaacgacuccaacaucuggaaguucugguacaccaaccagccccccuccaagaacugcacccacgccuaccucucccccuaccccuucaugcgcggcgagcacaacuccaccuccuacgacuccgccgucaucuaccgcggcuucugggccguccucaugcuccucggcgucgucgccgucgucaucgccuccuuccucaucaucugcgccgcccccuucgccucccacuuccucuacaaggccggcggcggcuccuacaucgccgccggcauccucuucucccucgucgucaugcucuacgucaucuggguccaggccgucgccgacauggaguccuaccgcaacaugaagaugaaggacugccucgacuucacccccuccguccucuacggcugguccuucuuccucgcccccgccggcaucuucuucucccuccucgccggccuccucuuccucgucgucggccgccacauccagauccaccacuga

SEQ ID NO: 50862 - RNA, 1131 nt, Artificial Sequence
  derived and/or modified sequence opt2 from TMEM183A__Homo_sapiens__NP_612400
auggcccgcggccccggcccccucggccgcccccgccccgacaccgucgccaugcccaagcgcggcaagcgccucaaguuccgcgcccacgacgccugcuccggccgcgucaccgucgccgacuacgccaacuccgaccccgccgucguccgcuccggccgcgucaagaaggccgucgccaacgccguccagcaggaggucaagucccucugcggccucgaggccucccagguccccgccgaggaggcccucuccggcgccggcgagcccugcgacaucaucgacuccuccgacgagauggacgcccaggaggaguccauccacgagcgcaccgucucccgcaagaagaaguccaagcgccacaaggaggagcucgacggcgccggcggcgaggaguaccccauggacaucuggcuccuccucgccuccuacauccgccccgaggacaucgucaacuucucccucaucugcaagaacgccuggaccgucaccugcaccgccgccuucuggacccgccucuaccgccgccacuacacccucgacgccucccucccccuccgccuccgccccgaguccauggagaagcuccgcugccuccgcgccugcgucauccgcucccucuaccacauguacgagcccuucgccgcccgcaucuccaagaaccccgccauccccgaguccacccccuccacccucaagaacuccaagugccuccucuucuggugccgcaagaucgucggcaaccgccaggagcccaugugggaguucaacuucaaguucaagaagcaguccccccgccucaaguccaagugcaccggcggccuccagccccccguccaguacgaggacguccacaccaaccccgaccaggacugcugccuccuccaggucaccacccucaacuucaucuucauccccaucgucaugggcaugaucuucacccucuucaccaucaacgucuccaccgacaugcgccaccaccgcguccgccucgucuuccaggacucccccguccacggcggccgcaagcuccgcuccgagcagggcguccaggucauccucgaccccguccacuccguccgccucuucgacugguggcacccccaguaccccuucucccuccgcgccuga

SEQ ID NO: 50863 - RNA, 1317 nt, Artificial Sequence
  derived and/or modified sequence opt2 from TMEM184C__Homo_sapiens__NP_060711
augcccugcaccugcaccuggcgcaacuggcgccaguggauccgcccccucgucgccgucaucuaccucgucuccaucgucgucgccgucccccucugcgucugggagcuccagaagcucgaggucggcauccacaccaaggccugguucaucgccggcaucuuccuccuccucaccauccccaucucccucugggucauccuccagcaccucguccacuacacccagcccgagcuccagaagcccaucauccgcauccucuggaugguccccaucuacucccucgacuccuggaucgcccucaaguaccccggcaucgccaucuacgucgacaccugccgcgagugcuacgaggccuacgucaucuacaacuucaugggcuuccucaccaacuaccucaccaaccgcuaccccaaccucguccucauccucgaggccaaggaccagcagaagcacuuccccccccucugcugcugcccccccugggccaugggcgagguccuccucuuccgcugcaagcucggcguccuccaguacaccgucguccgccccuucaccaccaucgucgcccucaucugcgagcuccucggcaucuacgacgagggcaacuucuccuucuccaacgccuggaccuaccucgucaucaucaacaacaugucccagcucuucgccauguacugccuccuccucuucuacaagguccucaaggaggagcucucccccauccagcccgucggcaaguuccucugcgucaagcucgucgucuucgucuccuucuggcaggccgucgucaucgcccuccucgucaaggucggcgucaucuccgagaagcacaccugggaguggcagaccgucgaggccgucgccaccggccuccaggacuucaucaucugcaucgagauguuccucgccgccaucgcccaccacuacaccuucuccuacaagcccuacguccaggaggccgaggagggcuccugcuucgacuccuuccucgccaugugggacgucuccgacauccgcgacgacaucuccgagcagguccgccacgucggccgcaccguccgcggccacccccgcaagaagcucuuccccgaggaccaggaccagaacgagcacaccucccuccucuccuccuccucccaggacgccaucuccaucgccuccuccaugccccccucccccaugggccacuaccagggcuucggccacaccgucaccccccagaccacccccaccaccgccaagaucuccgacgagauccucuccgacaccaucggcgagaagaaggagcccuccgacaaguccgucgacuccuga

SEQ ID NO: 50864 - RNA, 876 nt, Artificial Sequence
  derived and/or modified sequence opt2 from TMEM185A__Homo_sapiens__NP_001167563
augaaccuccgcggccucuuccaggacuucaacccccgcgccgagggcgagaccugcgucgaguucaaggccaugcucaucgccgucggcauccaccuccuccuccucauguucgagguccucgucugcgaccgcaucgagcgcggcucccacuucuggcuccucgucuucaugccccucuucuucgucucccccgucuccgucgccgccugcgucuggggcuuccgccacgaccgcucccucgagcucgagauccucugcuccgucaacauccuccaguucaucuucaucgcccuccgccucgacaagaucauccacuggcccuggcucgucgucugcgucccccucuggauccucauguccuuccucugccucgucguccucuacuacaucgucugguccguccucuuccuccgcuccauggacgucaucgccgagcagcgccgcacccacaucaccauggcccucuccuggaugaccaucgucgucccccuccucaccuucgagauccuccucguccacaagcucgacggccacaacgccuucuccugcauccccaucuucgucccccucuggcucucccucaucacccucauggccaccaccuucggccagaagggcggcaaccacuggugguucggcauccgcaaggacuucugccaguuccuccucgagaucuuccccuuccuccgcgaguacggcaacaucuccuacgaccuccaccacgaggacaacgaggagaccgaggagacccccguccccgagccccccaagaucgcccccauguuccgcaagaaggcccgcgucgucaucacccagucccccggcaaguacguccuccccccccccaagcucaacaucgagaugcccgacuga

SEQ ID NO: 50865 - RNA, 786 nt, Artificial Sequence
  derived and/or modified sequence opt2 from TMEM187__Homo_sapiens__XP_011529501
augaaccccgaguggggccaggccuucguccacgucgccgucgccggcggccucugcgccgucgccgucuucaccggcaucuucgacuccgucuccguccaggucggcuacgagcacuacgccgaggcccccgucgccggccuccccgccuuccucgccaugcccuucaacucccucgucaacauggccuacacccuccucggccucuccuggcuccaccgcggcggcgccaugggccucggcccccgcuaccucaaggacgucuucgccgccauggcccuccucuacggccccguccaguggcuccgccucuggacccaguggcgccgcgccgccguccucgaccaguggcucacccuccccaucuucgccuggcccgucgccuggugccucuaccucgaccgcggcuggcgccccuggcucuuccucucccucgagugcgucucccucgccuccuacggccucgcccuccuccacccccagggcuucgaggucgcccucggcgcccacgucgucgccgccgucggccaggcccuccgcacccaccgccacuacggcuccaccaccuccgccaccuaccucgcccucggcguccucuccugccucggcuucgucguccucaagcucugcgaccaccagcucgcccgcuggcgccucuuccagugccucaccggccacuucugguccaaggucugcgacguccuccaguuccacuucgccuuccucuuccucacccacuucaacacccacccccgcuuccaccccuccggcggcaagacccgcuga

SEQ ID NO: 50866 - RNA, 804 nt, Artificial Sequence
  derived and/or modified sequence opt2 from TMEM189__Homo_sapiens__NP_001155977
auggccggcgccgaggacuggcccggccagcagcucgagcucgacgaggacgaggccuccugcugccgcuggggcgcccagcacgccggcgcccgcgagcucgccgcccucuacucccccggcaagcgccuccaggaguggugcuccgucauccucugcuucucccucaucgcccacaaccucguccaccuccuccuccucgcccgcugggaggacaccccccucgucauccucggcgucgucgccggcgcccucaucgccgacuuccucuccggccucguccacuggggcgccgacaccuggggcuccgucgagcuccccaucgccuucauccgccccuuccgcgagcaccacaucgaccccaccgccaucacccgccacgacuucaucgagaccaacggcgacaacugccucgucacccuccucccccuccucaacauggccuacaaguuccgcacccacucccccgaggcccucgagcagcucuaccccugggagugcuucgucuucugccucaucaucuucggcaccuucaccaaccagauccacaaguggucccacaccuacuucggccucccccgcugggucacccuccuccaggacuggcacgucauccucccccgcaagcaccaccgcauccaccacgucuccccccacgagaccuacuucugcaucaccaccggcuggcucaacuacccccucgagaagaucggcuucuggcgccgccucgaggaccucauccagggccucaccggcgagaagccccgcgccgacgacaugaagugggcccagaagaucaaguga

SEQ ID NO: 50867 - RNA, 1113 nt, Artificial Sequence
  derived and/or modified sequence opt2 from TMEM189-UBE2V1__Homo_sapiens__NP_954673
auggccggcgccgaggacuggcccggccagcagcucgagcucgacgaggacgaggccuccugcugccgcuggggcgcccagcacgccggcgcccgcgagcucgccgcccucuacucccccggcaagcgccuccaggaguggugcuccgucauccucugcuucucccucaucgcccacaaccucguccaccuccuccuccucgcccgcugggaggacaccccccucgucauccucggcgucgucgccggcgcccucaucgccgacuuccucuccggccucguccacuggggcgccgacaccuggggcuccgucgagcuccccaucgucggcaaggccuucauccgccccuuccgcgagcaccacaucgaccccaccgccaucacccgccacgacuucaucgagaccaacggcgacaacugccucgucacccuccucccccuccucaacauggccuacaaguuccgcacccacucccccgaggcccucgagcagcucuaccccugggagugcuucgucuucugccucaucaucuucggcaccuucaccaaccagauccacaaguggucccacaccuacuucggccucccccgcugggucacccuccuccaggacuggcacgucauccucccccgcaagcaccaccgcauccaccacgucuccccccacgagaccuacuucugcaucaccaccggcgucaaggucccccgcaacuuccgccuccucgaggagcucgaggagggccagaagggcgucggcgacggcaccgucuccuggggccucgaggacgacgaggacaugacccucacccgcuggaccggcaugaucaucggccccccccgcaccaucuacgagaaccgcaucuacucccucaagaucgagugcggccccaaguaccccgaggccccccccuucguccgcuucgucaccaagaucaacaugaacggcgucaacuccuccaacggcgucgucgacccccgcgccaucuccguccucgccaaguggcagaacuccuacuccaucaaggucguccuccaggagcuccgccgccucaugauguccaaggagaacaugaagcucccccagccccccgagggccagugcuacuccaacuga

SEQ ID NO: 50868 - RNA, 423 nt, Artificial Sequence
  derived and/or modified sequence opt2 from TMEM18__Homo_sapiens__NP_690047
augcccuccgccuucuccgucuccuccuuccccgucuccauccccgccguccucacccagaccgacuggaccgagcccuggcucaugggccucgccaccuuccacgcccucugcguccuccucaccugccucuccucccgcuccuaccgccuccagaucggccacuuccucugccucgucauccucgucuacugcgccgaguacaucaacgaggccgccgccaugaacuggcgccucuucuccaaguaccaguacuucgacucccgcggcauguucaucuccaucgucuucuccgccccccuccucgucaacgccaugaucaucgucgucaugugggucuggaagacccucaacgucaugaccgaccucaagaacgcccaggagcgccgcaaggagaagaagcgccgccgcaaggaggacuga

SEQ ID NO: 50869 - RNA, 627 nt, Artificial Sequence
  derived and/or modified sequence opt2 from TMEM199__Homo_sapiens__NP_689677
auggccuccucccuccucgccggcgagcgccucguccgcgcccucggccccggcggcgagcucgagcccgagcgccucccccgcaagcuccgcgccgagcucgaggccgcccucggcaagaagcacaagggcggcgacuccuccuccggcccccagcgccucgucuccuuccgccucauccgcgaccuccaccagcaccuccgcgagcgcgacuccaagcucuaccuccacgagcuccucgagggcuccgagaucuaccuccccgaggucgucaagcccccccgcaaccccgagcucgucgcccgccucgagaagaucaagauccagcucgccaacgaggaguacaagcgcaucacccgcaacgucaccugccaggacacccgccacggcggcacccucuccgaccucggcaagcagguccgcucccucaaggcccucgucaucaccaucuucaacuucaucgucaccgucgucgccgccuucgucugcaccuaccucggcucccaguacaucuucaccgagauggccucccgcguccucgccgcccucaucgucgccuccgucgucggccucgccgagcucuacgucaugguccgcgccauggagggcgagcucggcgagcucuga

SEQ ID NO: 50870 - RNA, 1476 nt, Artificial Sequence
  derived and/or modified sequence opt2 from TMEM200A__Homo_sapiens__NP_001245206
augaucgccaccggcggcgucaucaccggccucgccgcccucaagcgccaggacuccgcccgcucccagcagcacgucaaccucucccccucccccgccacccaggagaagaagcccauccgccgccgcccccgcgccgacgucgucgucguccgcggcaagauccgccucuacucccccuccggcuucuuccucauccucggcguccucaucuccaucaucggcaucgccauggccguccucggcuacuggccccagaaggagcacuucaucgacgccgagaccacccucuccaccaacgagacccaggucauccgcaacgagggcggcgucgucguccgcuucuucgagcagcaccuccacuccgacaagaugaagaugcucggccccuucaccaugggcaucggcaucuucaucuucaucugcgccaacgccauccuccacgagaaccgcgacaaggagaccaagaucauccacaugcgcgacaucuacuccaccgucaucgacauccacacccuccgcaucaaggagcagcgccagaugaacggcauguacaccggccucaugggcgagaccgaggucaagcagaacggcuccuccugcgccucccgccucgccgccaacaccaucgccuccuucuccggcuuccgcuccuccuuccgcauggacuccuccgucgaggaggacgagcucaugcucaacgagggcaaguccuccggccaccucaugcccccccuccucuccgacuccuccgucuccgucuucggccucuaccccccccccuccaagaccaccgacgacaagaccuccggcuccaagaagugcgagaccaaguccaucgucuccuccuccaucuccgccuucacccuccccgucaucaagcucaacaacugcgucaucgacgagcccuccaucgacaacaucaccgaggacgccgacaaccucaagucccgcucccgcaaccucuccauggacucccucgucgucccccuccccaacaccuccgaguccuuccagcccgucuccaccguccucccccgcaacaacuccaucggcgagucccucuccucccaguacaaguccuccauggcccucggccccggcgccggccagcuccucucccccggcgccgcccgccgccaguucggcuccaacaccucccuccaccuccucuccucccacuccaagucccucgaccucgaccgcggccccuccacccucaccguccaggccgagcagcgcaagcaccccuccuggccccgccucgaccgcaacaacuccaagggcuacaugaagcucgagaacaaggaggaccccauggaccgccuccucgucccccaggucgccaucaagaaggacuucaccaacaaggagaagcuccucaugaucucccgcucccacaacaaccucuccuucgagcacgacgaguuccucuccaacaaccucaagcgcggcaccuccgagacccgcuucuga

SEQ ID NO: 50871 - RNA, 570 nt, Artificial Sequence
  derived and/or modified sequence opt2 from TMEM205__Homo_sapiens__NP_001138888
auggaggagggcggcaaccucggcggccucaucaagaugguccaccuccucguccucuccggcgccuggggcaugcagaugugggucaccuucgucuccggcuuccuccucuuccgcucccucccccgccacaccuucggccucguccaguccaagcucuuccccuucuacuuccacaucuccaugggcugcgccuucaucaaccucugcauccucgccucccagcacgccugggcccagcucaccuucugggaggccucccagcucuaccuccucuuccucucccucacccucgccaccgucaacgcccgcuggcucgagccccgcaccaccgccgccaugugggcccuccagaccgucgagaaggagcgcggccucggcggcgagguccccggcucccaccagggccccgaccccuaccgccagcuccgcgagaaggaccccaaguacuccgcccuccgccagaacuucuuccgcuaccacggccucuccucccucugcaaccucggcugcguccucuccaacggccucugccucgccggccucgcccucgagauccgcucccucuga

SEQ ID NO: 50872 - RNA, 441 nt, Artificial Sequence
  derived and/or modified sequence opt2 from TMEM207__Homo_sapiens__NP_997199
augucccgcucccgccucuucuccgucaccuccgccaucuccaccaucggcauccucugccucccccucuuccagcucguccucuccgaccuccccugcgaggaggacgagaugugcgucaacuacaacgaccagcaccccaacggcugguacaucuggauccuccuccuccucguccucgucgccgcccuccucugcggcgccgucguccucugccuccagugcuggcuccgccgcccccgcaucgacucccaccgccgcaccauggccgucuucgccgucggcgaccucgacuccaucuacggcaccgaggccgccgucucccccaccgucggcauccaccuccagacccagacccccgaccucuaccccguccccgcccccugcuucggcccccucggcucccccccccccuacgaggagaucgucaagaccaccuga

SEQ ID NO: 50873 - RNA, 1560 nt, Artificial Sequence
  derived and/or modified sequence opt2 from TMEM209__Homo_sapiens__NP_001288092
augaugcagggcgaggcccaccccuccgccucccucaucgaccgcaccaucaagaugcgcaaggagaccgaggcccgcaaggucguccucgccuggggccuccucaacgucuccauggccggcaugaucuacaccgagaugaccggcaagcucaucuccuccuacuacaacgucaccuacuggccccucugguacaucgagcucgcccucgccucccucuucucccucaacgcccucuucgacuucuggcgcuacuucaaguacaccgucgcccccaccucccucgucgucucccccggccagcagacccuccucggccucaagaccgccgucguccagaccacccccccccacgaccucgccgccacccagaucccccccgccccccccucccccuccauccagggccaguccguccucuccuacucccccucccgcucccccuccaccucccccaaguucaccaccuccugcaugaccggcuacuccccccagcuccagggccucuccuccggcggcuccggcuccuacucccccggcgucaccuacucccccgucuccggcuacaacaagcucgccuccuucucccccuccccccccucccccuaccccaccaccgucggccccgucgaguccuccggccuccgcucccgcuaccgcuccucccccaccgucuacaacucccccaccgacaaggaggacuacaugaccgaccuccgcacccucgacaccuuccuccgcuccgaggaggagaagcagcaccgcgucaagcucggcucccccgacuccaccucccccuccuccucccccaccuucuggaacuacucccgcuccaugggcgacuacgcccagacccucaagaaguuccaguaccagcucgccugccgcucccaggcccccugcgccaacaaggacgaggccgaccucuccuccaagcaggccgccgaggaggucugggcccgcgucgccaugaaccgccagcuccucgaccacauggacuccuggaccgccaaguuccgcaacuggaucaacgagaccauccucgucccccucguccaggagaucgaguccgucuccacccagaugcgccgcaugggcugccccgagcuccagaucggcgagcucucccagggcggcugcauguccuccuuccgcuggaaccgcggcggcgacuucaagggccgcaagugggacaccgaccuccccaccgacuccgccaucaucaugcacgucuucugcaccuaccucgacucccgccuccccccccaccccaaguaccccgacggcaagaccuucaccucccagcacuucguccagacccccaacaagcccgacgucaccaacgagaacgucuucugcaucuaccaguccgccaucaaccccccccacuacgagcucaucuaccagcgccacgucuacaaccuccccaagggccgcaacaacauguuccacacccuccucauguuccucuacaucaucaagaccaaggaguccggcaugcucggccgcgucaaccucggccucuccggcgucaacauccucuggaucuucggcgaguga

SEQ ID NO: 50874 - RNA, 324 nt, Artificial Sequence
  derived and/or modified sequence opt2 from TMEM213__Homo_sapiens__NP_001078898
augcagcgccuccccgccgccacccgcgccacccucauccucucccucgccuucgccucccuccacuccgccugcuccgccgaggccuccuccuccaacuccuccucccucaccgcccaccaccccgaccccggcacccucgagcagugccucaacgucgacuucugcccccaggccgcccgcugcugccgcaccggcgucgacgaguacggcuggaucgccgccgccgucggcuggucccucugguuccucacccucauccuccucugcgucgacaagcucaugaagcucacccccgacgagcccaaggaccuccaggccuga

SEQ ID NO: 50875 - RNA, 708 nt, Artificial Sequence
  derived and/or modified sequence opt2 from TMEM215__Homo_sapiens__NP_997723
augcgccccgacgacaucaacccccgcaccggccucgucgucgcccucgucuccgucuuccucgucuucggcuucauguucaccgucuccggcaugaagggcgagacccucggcaacaucccccuccucgccaucggccccgccaucugccuccccggcaucgccgccaucgcccucgcccgcaagaccgagggcugcaccaaguggcccgagaacgagcuccucuggguccgcaagcuccccugcuuccgcaagcccaaggacaaggaggucgucgagcuccuccgcacccccuccgaccucgaguccggcaagggcuccuccgacgagcucgccaagaaggccggccuccgcggcaagccccccccccagucccagggcgaggucuccgucgccuccuccaucaacucccccacccccaccgaggagggcgagugccagucccucguccagaacggccaccaggaggagaccucccgcuaccucgacggcuacugccccuccggcuccucccucaccuacuccgcccucgacgucaagugcuccgcccgcgaccgcuccgagugccccgagcccgaggacuccaucuucuucgucccccaggacuccaucaucgucugcuccuacaagcagaacucccccuacgaccgcuacugcugcuacaucaaccagauccagggccgcugggaccacgagaccaucgucuga

SEQ ID NO: 50876 - RNA, 438 nt, Artificial Sequence
  derived and/or modified sequence opt2 from TMEM216__Homo_sapiens__NP_001167461
augcucccccgcggccucaagauggccccccgcggcaagcgccucuccuccaccccccucgagauccucuucuuccucaacggcugguacaacgccaccuacuuccuccucgagcucuucaucuuccucuacaagggcguccuccuccccuaccccaccgccaaccucguccucgacgucgucaugcuccuccucuaccucggcaucgaggucauccgccucuucuucggcaccaagggcaaccucugccagcgcaagaugccccucuccaucuccgucgcccucaccuuccccuccgccaugauggccuccuacuaccuccuccuccagaccuacguccuccgccucgaggccaucaugaacggcauccuccucuucuucugcggcuccgagcuccuccucgagguccucacccucgccgccuucucccgcaucuga

SEQ ID NO: 50877 - RNA, 636 nt, Artificial Sequence
  derived and/or modified sequence opt2 from TMEM217__Homo_sapiens__NP_001273330
augaagcagcagcaguggugcggcaugaccgccaagaugggcaccguccucuccggcgucuucaccaucauggccgucgacauguaccucaucuucgagcagaagcaccucggcaacggcuccugcaccgagaucacccccaaguaccgcggcgccuccaacaucaucaacaacuucaucaucugcugguccuucaagaucguccucuuccucuccuucaucaccauccucaucuccugcuuccuccucuacuccgucuacgcccagaucuuccgcggccucgucaucuacaucgucuggaucuucuucuacgagaccgccaacgucgucauccagauccucaccaacaacgacuucgacaucaaggagguccgcaucaugcgcugguucggccucgucucccgcaccgucaugcacugcuucuggauguucuucgucaucaacuacgcccacaucaccuacaagaaccgcucccagggcaacaucaucuccuacaagcgccgcaucuccaccgccgagauccuccacucccgcaacaagcgccucuccaucuccuccggcuucuccggcucccaccucgagucccaguacuucgagcgccagcgccgcugcuccggcaagaccuccaucaaguga

SEQ ID NO: 50878 - RNA, 723 nt, Artificial Sequence
  derived and/or modified sequence opt2 from TMEM219__Homo_sapiens__NP_001077082
augggcaacugccaggccggccacaaccuccaccucugccucgcccaccaccccccccucgucugcgccacccucauccuccuccuccucggccucuccggccucggccucggcuccuuccuccucacccaccgcaccggccuccgcucccccgacaucccccaggacugggucuccuuccuccgcuccuucggccagcucacccucugcccccgcaacggcaccgucaccggcaaguggcgcggcucccacgucgucggccuccucaccacccucaacuucggcgacggccccgaccgcaacaagacccgcaccuuccaggccaccguccucggcucccagaugggccucaagggcuccuccgccggccagcucguccucaucaccgcccgcgucaccaccgagcgcaccgccggcaccugccucuacuucuccgccguccccggcauccuccccuccucccagccccccaucuccugcuccgaggagggcgccggcaacgccacccucuccccccgcaugggcgaggagugcgucuccgucuggucccacgagggccucguccucaccaagcuccucaccuccgaggagcucgcccucugcggcucccgccuccucguccucggcuccuuccuccuccucuucugcggccuccucugcugcgucaccgccaugugcuuccacccccgccgcgagucccacuggucccgcacccgccucuga

SEQ ID NO: 50879 - RNA, 483 nt, Artificial Sequence
  derived and/or modified sequence opt2 from TMEM220__Homo_sapiens__NP_001004313
auggcccccgcccucuggcgcgccugcaacggccucauggccgccuucuucgcccucgccgcccucguccaggucaacgaccccgacgccgaggucugggucgucgucuacaccauccccgccguccucacccuccucgucggccucaaccccgaggucaccggcaacgucaucuggaaguccaucuccgccauccacauccucuucugcaccgucugggccgucggccucgccuccuaccuccuccaccgcacccagcagaacauccuccacgaggaggagggccgcgagcucuccggccucgucaucaucaccgccuggaucauccucugccacuccuccuccaagaaccccgucggcggccgcauccagcucgccaucgccaucgucaucacccucuuccccuucaucuccugggucuacaucuacaucaacaaggagaugcgcuccuccuggcccacccacugcaagaccgucaucuga

SEQ ID NO: 50880 - RNA, 1143 nt, Artificial Sequence
  derived and/or modified sequence opt2 from TMEM229A__Homo_sapiens__NP_001129474
auggccggcuccgacgucgacuccgagggccccgcccgccgcggcggcgccgcccgccgccccggcgcccccggcggccccggcuccgaggccgccgccggcugccccgagccccucuccaccgccgaggcccccgccgaguccgccacccuccccgccuggaugcgccucuacuucuacggcaugcacggcaucacccucgacguccucgucuccuccgcccgccgcuucgcccgcucccccgaccuccgcaugcucggcuucuccucccccuaccgcugccuccuccacucccucacccacuucgcccucgagaaggucuaccuccagcagcgccgcugccccaacgccuucgucuucaacuuccuccucuaccccuccgcccacgucggccuccagacccucgccggccaggcccuccuccucucccucggcggcggcgccggcgucgccgucgcccccggcgcccucgaccucgcccuccaguacguccucgcccucuaccacugccaggucuuccucaagcgcuuccuccgccuccgcuacggccgccagcgccgccgccagcagcagcagcagcagcagcagcagcagcagcagcgccgcggcgcccuccccgucccccccggcgcccgcguccccaccgccgccggcgcccgccgccgccgcccccgcggcccccgcggcgccggcggcgcccccucccagggccuccccgaccucccccgcuuccucuucuucggcaugcacggcuuccucgacgagaucuucuucaccuucuucuucaacguccucggccagggcgacggcaccaccuccggccacaccucccucugguccuucuucauguacggcuccugcuccuucgucgucgagaagcucuacuuccaccuccacuacucccgcggcuggggcaccuggaagcgcguccccaucuacgucaucuucaucuacgucugggagcucuccuggggccucggccuccgcaccugcggcgccugcuccugggacuacucccacuacccccucaacuucaugggccucaucacccucauguaccuccccggcuggaucuuccucuccgucuaccaggaccucaucuccaacguccucuggcgcguccaguacguccccgccaacuga

SEQ ID NO: 50881 - RNA, 1110 nt, Artificial Sequence
  derived and/or modified sequence opt2 from TMEM231__Homo_sapiens__NP_001070884
auggccacccgccgcucccagaccuggucccccggcucccgcuccgccugcgagcgcugcuccuggcgcuccauguccuccucccucacccgcuccuccgccgucaccgcccgcggcuccgcccccaagccccgcugcuccugcugcuggccccuccgcucccgcaccucccgccgcugcugguggcccuccggcgccaccgucucccucccccgcccccucugccacgaggccccccgcgcccgcuccgcccgcgccggccuccccaaccgccuccccaccgcccucuucaacuccggcuucuggcucaagcgcuccuccuacgaggagcagcccaccguccgcuuccagcaccagguccuccucgucgcccuccucggccccgaguccgacggcuuccucgccugguccaccuuccccgccuucaaccgccuccagggcgaccgccuccgcgucccccucgucuccacccgcgaggaggaccgcaaccaggacggcaagaccgacaugcuccacuucaagcucgagcucccccuccaguccaccgagcacguccucggcguccagcucauccucaccuucuccuaccgccuccaccgcauggccacccucgucaugcaguccauggccuuccuccaguccuccuuccccguccccggcucccagcucuacgucaacggcgaccuccgccuccagcagaagcagccccucuccugcggcggccucgacgcccgcuacaacaucuccgucaucaacggcaccucccccuucgccuacgacuacgaccucacccacaucgucgccgccuaccaggagcgcaacgucaccaccguccucaacgaccccaaccccaucuggcucgucggccgcgccgccgacgcccccuucgucaucaacgccaucauccgcuaccccgucgaggucaucuccuaccagcccggcuucugggagauggucaaguucgccuggguccaguacgucuccauccuccucaucuuccucugggucuucgagcgcaucaagaucuucgucuuccagaaccaggucgucaccaccauccccgucaccgucaccccccgcggcgaccucugcaaggagcaccucuccuga

SEQ ID NO: 50882 - RNA, 330 nt, Artificial Sequence
  derived and/or modified sequence opt2 from TMEM233__Homo_sapiens__NP_001130006
augucccaguacgcccccucccccgacuucaagcgcgcccucgacuccucccccgaggccaacaccgaggacgacaagaccgaggaggacguccccaugcccaagaacuaccucuggcucaccaucgucuccugcuucugccccgccuaccccaucaacaucgucgcccucgucuucuccaucaugucccucaacuccuacaacgacggcgacuacgagggcgcccgccgccucggccgcaacgccaagugggucgccaucgccuccaucaucaucggccuccucaucaucggcaucuccugcgccguccacuucacccgcaacgccuga

SEQ ID NO: 50883 - RNA, 1227 nt, Artificial Sequence
  derived and/or modified sequence opt2 from TMEM237__Homo_sapiens__NP_001037850
augcgcaccgacuccggcgcccgccucgaggagggccaccuccgccccccccgcgcccucccccccguccccucccaggacgacaucccccucucccgccccaagaagaagaagccccgcaccaagaacacccccgccuccgccucccucgagggccucgcccagaccgccggccgccgccccuccgagggcaacgagcccuccaccaaggagcucaaggagcaccccgaggcccccguccagcgccgccagaagaagacccgccucccccucgagcucgagaccuccuccacccagaagaaguccuccuccuccucccuccuccgcaacgagaacggcaucgacgccgagcccgccgaggaggccgucauccagaagccccgccgcaagaccaagaagacccagcccgccgagcuccaguacgccaacgagcucggcgucgaggacgaggacaucaucaccgacgagcagaccaccgucgagcagcaguccgucuucaccgcccccaccggcaucucccagcccgucggcaaggucuucgucgagaagucccgccgcuuccaggccgccgaccgcuccgagcucaucaagaccaccgagaacaucgacgucuccauggacgucaagcccuccuggaccacccgcgacgucgcccucaccguccaccgcgccuuccgcaugaucggccucuucucccacggcuuccucgccggcugcgccgucuggaacaucgucgucaucuacguccucgccggcgaccagcucuccaaccucuccaaccuccuccagcaguacaagacccucgccuaccccuuccagucccuccucuaccuccuccucgcccucuccaccaucuccgccuucgaccgcaucgacuucgccaagaucuccgucgccauccgcaacuuccucgcccucgaccccaccgcccucgccuccuuccucuacuucaccgcccucauccucucccucucccagcagaugaccuccgaccgcauccaccucuacacccccuccuccgucaacggcucccucugggaggccggcaucgaggagcagauccuccagcccuggaucgucgucaaccucgucgucgcccuccucgucggccucuccuggcucuuccucuccuaccgccccggcauggaccucuccgaggagcucauguucuccuccgaggucgaggaguaccccgacaaggagaaggagaucaaggccuccuccuga

SEQ ID NO: 50884 - RNA, 891 nt, Artificial Sequence
  derived and/or modified sequence opt2 from TMEM241__Homo_sapiens__NP_116322
augugcguccgccgcucccucgucggccucaccuucugcaccugcuaccucgccuccuaccucaccaacaaguacguccucuccguccucaaguucaccuaccccacccucuuccagggcuggcagacccucaucggcggccuccuccuccacgucuccuggaagcucggcugggucgagaucaacuccuccucccgcucccacguccucgucuggcuccccgccuccguccucuucgucggcaucaucuacgccggcucccgcgcccucucccgccucgccauccccgucuuccucacccuccacaacgucgccgaggucaucaucugcggcuaccagaagugcuuccagaaggagaagaccucccccgccaagaucugcuccgcccuccuccuccucgccgccgccggcugccuccccuucaacgacucccaguucaaccccgacggcuacuucugggccaucauccaccuccucugcgucggcgccuacaagauccuccagaagucccagaagcccuccgcccucuccgacaucgaccagcaguaccucaacuacaucuucuccgucguccuccucgccuucgccucccaccccaccggcgaccucuucuccguccucgacuuccccuuccucuacuucuaccgcuuccacggcuccugcugcgccuccggcuuccucggcuucuuccucauguucuccaccgucaagcucaagaaccuccucgcccccggccagugcgccgccuggaucuucuucgccaagaucaucaccgccggccucuccauccuccucuucgacgccauccucaccuccgccaccaccggcugccuccuccucggcgcccucggcgaggcccuccucgucuucuccgagcgcaaguccuccuga

SEQ ID NO: 50885 - RNA, 387 nt, Artificial Sequence
  derived and/or modified sequence opt2 from TMEM244__Homo_sapiens__NP_001010876
auggcccuccagguccgcgucgcccccuccaaggucguccuccagaaguuccuccucugcgucauccucuucuacaccgucuacuacgucucccucuccaugggcugcgucauguucgagguccacgagcucaacguccucgcccccuucgacuucaagaccaaccccuccuggcucaacaucaacuacaagguccuccucgucuccaccgaggucaccuacuucgucugcggccucuucuucguccccgucgucgaggagugggucugggacuacgccaucuccgucaccauccuccacgucgccaucaccuccaccgucaugcucgaguucccccucaccucccacuggugggccgcccucggcaucuccaagcuccucgucuga

SEQ ID NO: 50886 - RNA, 2640 nt, Artificial Sequence
  derived and/or modified sequence opt2 from TMEM245__Homo_sapiens__NP_114401
auggccgacggcggcggccccaaggacgcccccucccuccgcuccucccccggccccgccccccgcgucccccgcgccgucggccccuccggcggcggcggcgagaccccccgcaccgccgcccucgcccuccgcuucgacaagcccaucaagcaggccuucuacaacaccggcgccguccucuucgucugccucugcugcggcgccgccguccucgucuacuucauccucgaggccuuccuccgcccccuccucugggccguccucugcggcaccuuccuccaccccuucaaguccucccucacccgccucggccgccacuggcuccagcgccuccaccgcgcccacacccccaucguccucgccgcccuccuccucccccucugcuucgucgacuacggcgucgaggcccucggcgagcaggcccuccgccgccgccgccuccuccuccuccucggcgccggcggcccccuccucuacggccucuacugccucggcuccuaccucggcguccagguccuccucguccacgccgccacccucaucugccgcggccucgacuacuucuccucccucuggaucuggacccucgucgucggcuacguccucaccgucuccuucaaguggaacgccuccaccgagcgcuaccuccgcgccgucuccauccccgucuggaucauccuccucuuccaccucgccucccucgccggcuccuggcgcauccccgucuuccucgucaucgucuuccucauguccgucggcacccucuacgagaagcagaacggcaaggaguccuccggcgccgagcuccccggccaggucaucuccauggccgccuccacccucgccaaccucgccaucuccaucaccggcuacgaguccuccuccgaggaccagcccuccacccagcccgccgaggccgucgaccgcggcgaguccgcccccacccucuccaccucccccucccccuccucccccucccccaccucccccucccccacccucggccgccgccgccccgagaucggcaccuuccuccgcaagaagaagaccuccgacaucuacuucgucucccucgucugggccaucgucgucaugcagaucuggcucaaccucuggaucguccagcuccuccccguccccaucgccgucuggauccucaagaagcucgucauccacuucggcgucgucgacuuccucgagaagcgcuaccacgucugguggggcaucaucgaguccuuccucaaggagcgccagggcgcccucgcccccuggcccaucgucggccucggcaaguuccuccucaaggucgacuccaagcucuggcacuggcucaacaagaagaugaucaucuggcucgagaagaugcucgacaagaucaucuccaucuucaucaucuuccuccucgucaucggcacccuccuccucgcccuccuccucaccgccaagguccaccaggaguccguccacaugaucgaggucaccuccaaccucaucaacgagacccucgccaaccaccccgagugggccaacuggcuccccgaggcccaggucguccagcgcgcccucaacuccgccgccaacaacgucuaccaguacggccgcgaguggaucacccacaagcuccacaagauccucggcgacaaggucaacaacaccgccgucaucgagaagcagguccucgagcucugggaccgccucuaccacuccugguucgucaagaacgucacccacuccggccgccacaagggccagaagcuccacgucucccgccagaacuccuggcucggcgacauccucgacuggcaggacaucgucuccuucguccacgagaacaucgagaccuuccucuccauccucgagucccucuggaucgucaugucccgcaacgucucccuccucuucaccaccgucaccacccuccucaccauccucuucuacuccggcaccgcccuccucaacuucguccucucccucaucaucuuccucaccacccucuucuaccuccucuccuccuccgacgaguacuacaagcccgucaagugggucaucucccucaccccccucucccagcccggccccuccuccaacaucaucggccaguccgucgaggaggccauccgcggcgucuucgacgccucccucaagauggccggcuucuacggccucuacaccuggcucacccacaccauguucggcaucaacaucgucuucauccccuccgcccucgccgccauccucggcgccguccccuuccucggcaccuacugggccgccguccccgccguccucgaccucuggcucacccagggccucggcugcaaggccauccuccuccucaucuuccaccuccuccccaccuacuucgucgacaccgccaucuacuccgacaucuccggcggcggccaccccuaccucaccggccucgccgucgccggcggcgccuacuaccucggccucgagggcgccaucaucggccccauccuccucugcauccucgucgucgccuccaacaucuacuccgccaugcucgucucccccaccaacuccguccccacccccaaccagacccccuggcccgcccagccccagcgcaccuuccgcgacaucuccgaggaccucaaguccuccgucggcuga

SEQ ID NO: 50887 - RNA, 1863 nt, Artificial Sequence
  derived and/or modified sequence opt2 from TMEM259__Homo_sapiens__NP_001028198
auguccgagcacgucgagcccgccgcccccggccccggccccaacggcggcggcggcggccccgcccccgcccgcggcccccgcacccccaaccucaaccccaacccccucaucaacguccgcgaccgccucuuccacgcccucuucuucaagauggccgucaccuacucccgccucuucccccccgccuuccgccgccucuucgaguucuucguccuccucaaggcccucuucguccucuucguccucgccuacauccacaucgucuucucccgcucccccaucaacugccucgagcacguccgcgacaaguggccccgcgagggcauccuccgcgucgagguccgccacaacuccucccgcgcccccgucuuccuccaguucugcgacuccggcggccgcggcuccuuccccggccucgccgucgagcccggcuccaaccucgacauggaggacgaggaggaggaggagcucaccauggagauguucggcaacuccuccaucaaguucgagcucgacaucgagcccaaggucuucaagccccccuccuccaccgaggcccucaacgacucccaggaguuccccuuccccgagacccccaccaaggucuggccccaggacgaguacaucgucgaguacucccucgaguacggcuuccuccgccucucccaggccacccgccagcgccucuccauccccgucauggucgucacccucgaccccacccgcgaccagugcuucggcgaccgcuucucccgccuccuccucgacgaguuccucggcuacgacgacauccucauguccuccgucaagggccucgccgagaacgaggagaacaagggcuuccuccgcaacgucgucuccggcgagcacuaccgcuucgucuccauguggauggcccgcaccuccuaccucgccgccuucgccaucauggucaucuucacccucuccgucuccaugcuccuccgcuacucccaccaccagaucuucgucuucaucgucgaccuccuccagaugcucgagaugaacauggccaucgccuuccccgccgccccccuccucaccgucauccucgcccucgucggcauggaggccaucauguccgaguucuucaacgacaccaccaccgccuucuacaucauccucaucgucuggcucgccgaccaguacgacgccaucugcugccacaccuccaccuccaagcgccacuggcuccgcuucuucuaccucuaccacuucgccuucuacgccuaccacuaccgcuucaacggccaguacuccucccucgcccucgucaccuccuggcucuucauccagcacuccaugaucuacuucuuccaccacuacgagcuccccgccauccuccagcagguccgcauccaggagaugcuccuccaggcccccccccucggccccggcacccccaccgcccuccccgacgacaugaacaacaacuccggcgcccccgccaccgcccccgacuccgccggccagccccccgcccucggccccgucucccccggcgccuccggcucccccggccccgucgccgccgcccccuccucccucgucgccgccgccgccuccgucgccgccgccgccggcggcgaccucggcuggauggccgagaccgccgccaucaucaccgacgccuccuuccucuccggccucuccgccucccuccucgagcgccgccccgccuccccccucggccccgccggcggccucccccacgccccccaggacuccgucccccccuccgacuccgccgccuccgacaccaccccccucggcgccgccgucggcggccccucccccgccuccauggcccccaccgaggcccccuccgaggucggcuccuga

SEQ ID NO: 50888 - RNA, 969 nt, Artificial Sequence
  derived and/or modified sequence opt2 from TMEM25__Homo_sapiens__NP_001137507
auggcccucccccccggccccgccgcccuccgccacacccuccuccuccuccccgcccuccucuccuccggcuggggcgagcucgagccccagaucgacggccagaccugggccgagcgcgcccuccgcgagaacgagcgccacgccuucaccugccgcgucgccggcggccccggcaccccccgccucgccugguaccucgacggccagcuccaggaggccuccaccucccgccuccucuccgucggcggcgaggccuucuccggcggcaccuccaccuucaccgucaccgcccaccgcgcccagcacgagcucaacugcucccuccaggacccccgcuccggccgcuccgccaacgccuccgucauccucaacguccaguucaagcccgagaucgcccaggucggcgccaaguaccaggaggcccagggccccggccuccucgucguccucuucgcccucguccgcgccaacccccccgccaacgucaccuggaucgaccaggacggccccgucaccgucaacaccuccgacuuccucguccucgacgcccagaacuaccccuggcucaccaaccacaccguccagcuccagcuccgcucccucgcccacaaccucuccgucgucgccaccaacgacgucggcgucaccuccgccucccuccccgcccccggccccucccgccaccccucccucaucuccuccgacuccaacaaccucaagcucaacaacguccgccucccccgcgagaacaugucccuccccuccaaccuccagcucaacgaccucacccccgacucccgcgccgucaagcccgccgaccgccagauggcccagaacaacucccgccccgagcuccucgaccccgagcccggcggccuccucaccucccagggcuucauccgccuccccguccucggcuacaucuaccgcgucuccuccgucuccuccgacgagaucuggcucuga

SEQ ID NO: 50889 - RNA, 339 nt, Artificial Sequence
  derived and/or modified sequence opt2 from TMEM261__Homo_sapiens__NP_219500
augggcucccgccucucccagcccuucgaguccuacaucaccgccccccccggcaccgccgccgcccccgccaagcccgccccccccgccacccccggcgcccccaccucccccgccgagcaccgccuccucaagaccugcugguccugccgcguccucuccggccucggccucaugggcgccggcggcuacgucuacugggucgcccgcaagcccaugaagaugggcuacccccccucccccuggaccaucacccagauggucaucggccucuccaucgccaccuggggcaucgucgucauggccgaccccaagggcaaggccuaccgcgucgucuga

SEQ ID NO: 50890 - RNA, 669 nt, Artificial Sequence
  derived and/or modified sequence opt2 from TMEM27__Homo_sapiens__NP_065716
augcucuggcuccucuucuuccucgucaccgccauccacgccgagcucugccagcccggcgccgagaacgccuucaagguccgccucuccauccgcaccgcccucggcgacaaggccuacgccugggacaccaacgaggaguaccucuucaaggccauggucgccuucuccaugcgcaagguccccaaccgcgaggccaccgagaucucccacguccuccucugcaacgucacccagcgcgucuccuucugguucgucgucaccgaccccuccaagaaccacacccuccccgccgucgagguccaguccgccauccgcaugaacaagaaccgcaucaacaacgccuucuuccucaacgaccagacccucgaguuccucaagauccccuccacccucgccccccccauggaccccuccguccccaucuggaucaucaucuucggcgucaucuucugcaucaucaucgucgccaucgcccuccucauccucuccggcaucuggcagcgccgccgcaagaacaaggagcccuccgaggucgacgacgccgaggacaagugcgagaacaugaucaccaucgagaacggcauccccuccgacccccucgacaugaagggcggccacaucaacgacgccuucaugaccgaggacgagcgccucaccccccucuga

SEQ ID NO: 50891 - RNA, 3963 nt, Artificial Sequence
  derived and/or modified sequence opt2 from TMEM2__Homo_sapiens__NP_001129292
auguacgccaccgacucccgcggccacucccccgccuuccuccagccccagaacggcaacucccgccaccccuccggcuacguccccggcaaggucgucccccuccgccccccccccccccccaagucccaggccuccgccaaguucaccuccauccgccgcgaggaccgcgccaccuucgccuucucccccgaggagcagcaggcccagcgcgagucccagaagcagaagcgccacaagaacaccuucaucugcuucgccaucaccuccuucuccuucuucaucgcccucgccaucauccucggcaucuccuccaaguacgcccccgacgagaacugccccgaccagaacccccgccuccgcaacugggaccccggccaggacuccgccaagcaggucgucaucaaggagggcgacaugcuccgccucaccuccgacgccaccguccacuccaucgucauccaggacggcggccuccucgucuucggcgacaacaaggacggcucccgcaacaucacccuccgcacccacuacauccucauccaggacggcggcgcccuccacaucggcgccgagaagugccgcuacaaguccaaggccaccaucacccucuacggcaaguccgacgagggcgaguccaugcccaccuucggcaagaaguucaucggcgucgaggccggcggcacccucgagcuccacggcgcccgcaaggccuccuggacccuccucgcccgcacccucaacuccuccggccuccccuucggcuccuacaccuucgagaaggacuucucccgcggccucaacguccgcgucaucgaccaggacaccgccaagauccucgaguccgagcgcuucgacacccacgaguaccgcaacgagucccgccgccuccaggaguuccuccgcuuccaggaccccggccgcaucgucgccaucgccgucggcgacuccgccgccaagucccuccuccagggcaccauccagaugauccaggagcgccucggcuccgagcucauccagggccucggcuaccgccaggccugggcccucgucggcgucaucgacggcggcuccaccuccugcaacgaguccguccgcaacuacgagaaccacuccuccggcggcaaggcccucgcccagcgcgaguucuacaccgucgacggccagaaguucuccgucaccgccuacuccgaguggaucgaggagaccccccaguuccuccacaugggcgagaucaucgacggcgucgacaugcgcgccgaggucggcauccucacccgcaacaucgucauccagggcgaggucgaggacuccugcuacgccgagaaccagugccaguucuucgacuacgacaccuucggcggccacaucaugaucaugaagaacuucaccuccguccaccucuccuacgucgagcucaagcacaugggccagcagcagaugggccgcuaccccguccacuuccaccucugcggcgacgucgacuacaagggcggcuaccgccacgccaccuucgucgacggccucuccauccaccacuccuucucccgcugcaucaccguccacggcaccaacggccuccucaucaaggacaccaucggcuucgacacccucggccacugcuucuuccucgaggacggcaucgagcagcgcaacacccucuuccacaaccucggccuccucaccaagcccggcacccuccuccccaccgaccgcaacaacuccaugugcaccaccaugcgcgacaaggucuucggcaacuacauccccguccccgccaccgacugcauggccgucuccaccuucuggaucgcccaccccaacaacaaccucaucaacaacgccgccgccggcucccaggacgccggcaucugguaccucuuccacaaggagcccaccggcgaguccuccggccuccagcuccucgccaagcccgagcucaccccccucggcaucuucuacaacaaccgcguccacuccaacuucaaggccggccucuucaucgacaagggcgucaagaccaccaacuccuccgccgccgacccccgcgaguaccucugccucgacaacuccgcccgcuuccgcccccaccaggacgccaaccccgagaagccccgcgucgccgcccucaucgaccgccucaucgccuucaagaacaacgacaacggcgccuggguccgcggcggcgacaucaucguccagaacuccgccuucgccgacaacggcaucggccucaccuucgccuccgacggcuccuuccccuccgacgagggcuccucccaggaggucuccgagucccucuucgucggcgagucccgcaacuacggcuuccagggcggccagaacaaguacgucggcaccggcggcaucgaccagaagccccgcacccucccccgcaaccgcaccuuccccauccgcggcuuccagaucuacgacggccccauccaccucacccgcuccaccuucaagaaguacguccccacccccgaccgcuacuccuccgccaucggcuuccucaugaagaacuccuggcagaucaccccccgcaacaacaucucccucgucaaguucggcccccacgucucccucaacgucuucuucggcaagcccggccccugguucgaggacugcgagauggacggcgacaagaacuccaucuuccacgacaucgacggcuccgucaccggcuacaaggacgccuacgucggccgcauggacaacuaccucauccgccaccccuccugcgucaacgucuccaaguggaacgccgucaucugcuccggcaccuacgcccaggucuacguccagaccugguccacccagaaccucuccaugaccaucacccgcgacgaguaccccuccaaccccaugguccuccgcggcaucaaccagaaggccgccuucccccaguaccagcccgucgucaugcucgagaagggcuacaccauccacuggaacggccccgccccccgcaccaccuuccucuaccucgucaacuucaacaagaacgacuggauccgcgucggccucugcuaccccuccaacaccuccuuccaggucaccuucggcuaccuccagcgccagaacggcucccucuccaagaucgaggaguacgagcccguccacucccucgaggagcuccagcgcaagcaguccgagcgcaaguucuacuucgacuccuccaccggccuccucuuccucuaccucaaggccaagucccaccgccacggccacuccuacugcuccucccagggcugcgagcgcgucaagauccaggccgccaccgacuccaaggacaucuccaacugcauggccaaggccuacccccaguacuaccgcaagcccuccgucgucaagcgcaugcccgccaugcucaccggccucugccagggcugcggcacccgccaggucgucuucaccuccgacccccacaaguccuaccuccccguccaguuccagucccccgacaaggccgagacccagcgcggcgaccccuccgucaucuccgucaacggcaccgacuucaccuuccgcuccgccggcguccuccuccucgucgucgaccccugcuccguccccuuccgccucaccgagaagaccgucuucccccucgccgacgucucccgcaucgaggaguaccucaagaccggcauccccccccgcuccaucguccuccucuccacccgcggcgagaucaagcagcucaacaucucccaccuccucgucccccucggccucgccaagcccgcccaccucuacgacaagggcuccaccaucuuccucggcuucuccggcaacuucaagcccuccuggaccaagcucuucaccucccccgccggccagggccucggcguccucgagcaguucaucccccuccagcucgacgaguacggcugcccccgcgccaccaccguccgccgccgcgaccucgagcuccucaagcaggccuccaaggcccacuga

SEQ ID NO: 50892 - RNA, 978 nt, Artificial Sequence
  derived and/or modified sequence opt2 from TMEM30A__Homo_sapiens__NP_001137430
auggccaugaacuacaacgccaaggacgaggucgacggcggcccccccugcgcccccggcggcaccgccaagacccgccgccccgacaacaccgccuucaagcagcagcgccuccccgccuggcagcccauccucaccgccggcaccguccuccccaucuucuucaucaucggccucaucuucauccccaucggcaucggcaucuucgucaccuccaacaacauccgcgagaucgagggcaacgucuucauguacuacggccucuccaacuucuaccagaaccaccgccgcuacgucaagucccgcgacgacucccagcucaacggcgacuccuccgcccuccucaaccccuccaaggagugcgagcccuaccgccgcaacgaggacaagcccaucgcccccugcggcgccaucgccaacuccauguucaacgacacccucgagcucuuccucaucggcaacgacuccuaccccauccccaucgcccucaagaagaagggcaucgccugguggaccgacaagaacgucaaguuccgcaacccccccggcggcgacaaccucgaggagcgcuucaagggcaccaccaagcccgucaacuggcucaagcccgucuacaugcucgacuccgaccccgacaacaacggcuucaucaacgaggacuucaucgucuggaugcgcaccgccgcccuccccaccuuccgcaagcucuaccgccucaucgagcgcaaguccgaccuccaccccacccuccccgccggccgcuacucccucaacgucaccuacaacuaccccguccacuacuucgacggccgcaagcgcaugauccucuccaccaucuccuggaugggcggcaagaaccccuuccucggcaucgccuacaucgccgucggcuccaucuccuuccuccucggcgucguccuccucgucaucaaccacaaguaccgcaacuccuccaacaccgccgacaucaccaucuga

SEQ ID NO: 50893 - RNA, 1056 nt, Artificial Sequence
  derived and/or modified sequence opt2 from TMEM30B__Homo_sapiens__NP_001017970
augaccugguccgccaccgcccgcggcgcccaccagcccgacaacaccgccuucacccagcagcgccuccccgccuggcagccccuccucuccgccuccaucgcccucccccucuucuucugcgccggccucgccuucaucggccucggccucggccucuacuacuccuccaacggcaucaaggagcucgaguacgacuacaccggcgaccccggcaccggcaacugcuccgucugcgccgccgccggccagggccgcgcccuccccccccccugcuccugcgccugguacuucucccuccccgagcucuuccagggccccgucuaccucuacuacgagcucaccaacuucuaccagaacaaccgccgcuacggcgucucccgcgacgacgcccagcucuccggccuccccuccgcccuccgccaccccgucaacgagugcgcccccuaccagcgcuccgccgccggccuccccaucgcccccugcggcgccaucgccaacucccucuucaacgacuccuucucccucuggcaccagcgccagcccggcggccccuacgucgaggucccccucgaccgcuccggcaucgccugguggaccgacuaccacgucaaguuccgcaaccccccccucgucaacggcucccucgcccucgccuuccagggcaccgcccccccccccaacuggcgccgccccgucuacgagcucucccccgaccccaacaacaccggcuucaucaaccaggacuucgucgucuggaugcgcaccgccgcccuccccaccuuccgcaagcucuacgcccgcauccgccagggcaacuacuccgccggccucccccgcggcgccuaccgcgucaacaucaccuacaacuaccccguccgcgccuucggcggccacaagcuccucaucuucuccuccaucuccuggaugggcggcaagaaccccuuccucggcaucgccuaccucgucgucggcucccucugcauccucaccggcuucgucaugcucgucgucuacauccgcuaccaggaccaggacgacgacgacgaggaguga

SEQ ID NO: 50894 - RNA, 573 nt, Artificial Sequence
  derived and/or modified sequence opt2 from TMEM37__Homo_sapiens__NP_899063
augaccgccgucggcguccaggcccagcgcccccucggccagcgccagccccgccgcuccuucuucgaguccuucauccgcacccucaucaucaccugcgucgcccucgccgucguccucuccuccgucuccaucugcgacggccacuggcuccucgccgaggaccgccucuucggccucuggcacuucugcaccaccaccaaccagaccaucugcuuccgcgaccucggccaggcccacguccccggccucgccgucggcaugggccucguccgcuccgucggcgcccucgccgucgucgccgccaucuucggccucgaguuccucauggucucccagcucugcgaggacaagcacucccagugcaagugggucaugggcuccauccuccuccucgucuccuucguccucuccuccggcggccuccucggcuucgucauccuccuccgcaaccaggucacccucaucggcuucacccucauguucuggugcgaguucaccgccuccuuccuccucuuccucaacgccaucuccggccuccacaucaacuccaucacccaccccugggaguga

SEQ ID NO: 50895 - RNA, 900 nt, Artificial Sequence
  derived and/or modified sequence opt2 from TMEM38A__Homo_sapiens__NP_076979
auggagcuccucuccgcccucucccucggcgagcucgcccucuccuucucccgcgucccccucuuccccgucuucgaccucuccuacuucaucgucuccauccucuaccucaaguacgagcccggcgccgucgagcucucccgccgccaccccaucgccuccuggcucugcgccaugcuccacugcuucggcuccuacauccucgccgaccuccuccucggcgagccccucaucgacuacuucuccaacaacuccuccauccuccucgccuccgccgucugguaccucaucuucuucugcccccucgaccucuucuacaagugcgucugcuuccuccccgucaagcucaucuucgucgccaugaaggaggucguccgcguccgcaagaucgccgucggcauccaccacgcccaccaccacuaccaccacggcugguucgucaugaucgccaccggcugggucaagggcuccggcgucgcccucauguccaacuucgagcagcuccuccgcggcgucuggaagcccgagaccaacgagauccuccacauguccuuccccaccaaggccucccucuacggcgccauccucuucacccuccagcagacccgcuggcuccccgucuccaaggccucccucaucuucaucuucacccucuucauggucuccugcaaggucuuccucaccgccacccacucccacuccucccccuucgacgcccucgagggcuacaucugccccguccucuucggcuccgccugcggcggcgaccaccaccacgacaaccacggcggcucccacuccggcggcggccccggcgcccagcacuccgccaugcccgccaaguccaaggaggagcucuccgagggcucccgcaagaagaaggccaagaaggccgacuga

SEQ ID NO: 50896 - RNA, 876 nt, Artificial Sequence
  derived and/or modified sequence opt2 from TMEM38B__Homo_sapiens__NP_060582
auggacucccccugggacgagcucgcccucgccuucucccgcaccuccauguuccccuucuucgacaucgcccacuaccucgucuccgucauggccgucaagcgccagcccggcgccgccgcccucgccuggaagaaccccaucuccuccugguucaccgccaugcuccacugcuucggcggcggcauccucuccugccuccuccucgccgagcccccccucaaguuccucgccaaccacaccaacauccuccucgccuccuccaucugguacaucaccuucuucugcccccacgaccucgucucccagggcuacuccuaccuccccguccagcuccucgccuccggcaugaaggaggucacccgcaccuggaagaucgucggcggcgucacccacgccaacuccuacuacaagaacggcuggaucgucaugaucgccaucggcugggcccgcggcgccggcggcaccaucaucaccaacuucgagcgccucgucaagggcgacuggaagcccgagggcgacgaguggcucaagauguccuaccccgccaaggucacccuccucggcuccgucaucuucaccuuccagcacacccagcaccucgccaucuccaagcacaaccucauguuccucuacaccaucuucaucgucgccaccaagaucaccaugaugaccacccagaccuccaccaugaccuucgcccccuucgaggacacccucuccuggaugcucuucggcuggcagcagcccuucuccuccugcgagaagaaguccgaggccaagucccccuccaacggcgucggcucccucgccuccaagcccgucgacgucgccuccgacaacgucaagaagaagcacaccaagaagaacgaguga

SEQ ID NO: 50897 - RNA, 1467 nt, Artificial Sequence
  derived and/or modified sequence opt2 from TMEM39A__Homo_sapiens__NP_060736
augcccggcggccgccgcggccccucccgccagcagcucucccgcuccgcccuccccucccuccagacccucgucggcggcggcugcggcaacggcaccggccuccgcaaccgcaacggcuccgccaucggccuccccgucccccccaucaccgcccucaucacccccggccccguccgccacugccagauccccgaccuccccgucgacggcucccuccucuucgaguuccucuucuucaucuaccuccucgucgcccucuucauccaguacaucaacaucuacaagaccgucuggugguaccccuacaaccaccccgccuccugcaccucccucaacuuccaccucaucgacuaccaccucgccgccuucaucaccgucaugcucgcccgccgccucgucugggcccucaucuccgaggccaccaaggccggcgccgccuccaugauccacuacaugguccucaucuccgcccgccucguccuccucacccucugcggcuggguccucugcuggacccucgucaaccucuuccgcucccacuccguccucaaccuccucuuccucggcuaccccuucggcgucuacgucccccucugcugcuuccaccaggacucccgcgcccaccuccuccucaccgacuacaacuacgucguccagcacgaggccgucgaggaguccgccuccaccgucggcggccucgccaaguccaaggacuuccucucccuccuccucgagucccucaaggagcaguucaacaacgccacccccauccccacccacuccugcccccucucccccgaccucauccgcaacgaggucgagugccucaaggccgacuucaaccaccgcaucaaggagguccucuucaacucccucuucuccgccuacuacgucgccuuccucccccucugcuucgucaaguccacccaguacuacgacaugcgcugguccugcgagcaccucaucauggucuggaucaacgccuucgucaugcucaccacccagcuccuccccuccaaguacugcgaccuccuccacaaguccgccgcccaccucggcaaguggcagaagcucgagcacggcuccuacuccaacgccccccagcacaucugguccgagaacaccaucuggccccagggcguccucguccgccacucccgcugccucuaccgcgccaugggccccuacaacgucgccguccccuccgacgucucccacgcccgcuucuacuuccucuuccaccgcccccuccgccuccucaaccuccucauccucaucgagggcuccgucgucuucuaccagcucuacucccuccuccgcuccgagaaguggaaccacacccucuccauggcccucauccucuucugcaacuacuacguccucuucaagcuccuccgcgaccgcaucguccucggccgcgccuacuccuacccccucaacuccuacgagcucaaggccaacuga

SEQ ID NO: 50898 - RNA, 750 nt, Artificial Sequence
  derived and/or modified sequence opt2 from TMEM40__Homo_sapiens__NP_001271335
auggccgaggccggcgccggcucccucucccuccccggcggcaaggccauggagaccuccgccuccuccucccagccccaggacaacucccagguccaccgcgagaccgaggacgucgacuacggcgagaccgacuuccacaagcaggacggcaaggccggccucuucucccaggagcaguacgagcgcaacaaguccuccuccuccuccuccuccuccuccuccuccuccuccuccuccuccuccuccuccuccuccgaguccaacgacgaggaccagcagccccgcgccaccggcaagcaccgccgcucccucggcgccggcuacccccacggcaacggcucccccggccccggccacggcgagcccgacguccucaaggacgagcuccagcucuacggcgacgcccccggcgaggucguccccuccggcgaguccggccuccgccgccgcggcuccgaccccgccuccggcgaggucgaggccucccagcuccgccgccucaacaucaagaaggacgacgaguucuuccacuucguccuccucugcuucgccaucggcgcccuccucgucugcuaccacuacuacgccgacugguucaugucccucggcgucggccuccucaccuucgccucccucgagaccgucggcaucuacuucggccucgucuaccgcauccacuccguccuccagggcuucaucccccucuuccagaaguuccgccucaccggcuuccgcaagaccgacuga

SEQ ID NO: 50899 - RNA, 1203 nt, Artificial Sequence
  derived and/or modified sequence opt2 from TMEM43__Homo_sapiens__NP_077310
auggccgccaacuacuccuccaccuccacccgccgcgagcacgucaaggucaagaccuccucccagcccggcuuccucgagcgccucuccgagaccuccggcggcauguucgucggccucauggccuuccuccucuccuucuaccucaucuucaccaacgagggccgcgcccucaagaccgccaccucccucgccgagggccucucccucgucgucucccccgacuccauccacuccgucgcccccgagaacgagggccgccucguccacaucaucggcgcccuccgcaccuccaagcuccucuccgaccccaacuacggcguccaccuccccgccgucaagcuccgccgccacgucgagauguaccagugggucgagaccgaggagucccgcgaguacaccgaggacggccaggucaagaaggagacccgcuacuccuacaacaccgaguggcgcuccgagaucaucaacuccaagaacuucgaccgcgagaucggccacaagaaccccuccgccauggccgucgaguccuucauggccaccgcccccuucguccagaucggccgcuucuuccucuccuccggccucaucgacaaggucgacaacuucaagucccucucccucuccaagcucgaggacccccacgucgacaucauccgccgcggcgacuucuucuaccacuccgagaaccccaaguaccccgaggucggcgaccuccgcgucuccuucuccuacgccggccucuccggcgacgaccccgaccucggccccgcccacgucgucaccgucaucgcccgccagcgcggcgaccagcucguccccuucuccaccaaguccggcgacacccuccuccuccuccaccacggcgacuucuccgccgaggaggucuuccaccgcgagcuccgcuccaacuccaugaagaccuggggccuccgcgccgccggcuggauggccauguucaugggccucaaccucaugacccgcauccucuacacccucgucgacugguuccccgucuuccgcgaccucgucaacaucggccucaaggccuucgccuucugcgucgccaccucccucacccuccucaccgucgccgccggcuggcucuucuaccgcccccucugggcccuccucaucgccggccucgcccucguccccauccucgucgcccgcacccgcguccccgccaagaagcucgaguga

SEQ ID NO: 50900 - RNA, 828 nt, Artificial Sequence
  derived and/or modified sequence opt2 from TMEM45A__Homo_sapiens__NP_060474
augggcaacuuccgcggccacgcccuccccggcaccuucuucuucaucaucggccucugguggugcaccaaguccauccucaaguacaucugcaagaagcagaagcgcaccugcuaccucggcuccaagacccucuucuaccgccucgagauccucgagggcaucaccaucgucggcauggcccucaccggcauggccggcgagcaguucauccccggcggcccccaccucaugcucuacgacuacaagcagggccacuggaaccagcuccucggcuggcaccacuucaccauguacuucuucuucggccuccucggcgucgccgacauccucugcuucaccaucuccucccuccccgucucccucaccaagcucaugcucuccaacgcccucuucgucgaggccuucaucuucuacaaccacacccacggccgcgagaugcucgacaucuucguccaccagcuccucguccucgucgucuuccucaccggccucgucgccuuccucgaguuccucguccgcaacaacguccuccucgagcuccuccgcuccucccucauccuccuccagggcuccugguucuuccagaucggcuucguccucuacccccccuccggcggccccgccugggaccucauggaccacgagaacauccucuuccucaccaucugcuucugcuggcacuacgccgucaccaucgucaucgucggcaugaacuacgccuucaucaccuggcucgucaagucccgccucaagcgccucugcuccuccgaggucggccuccucaagaacgccgagcgcgagcaggaguccgaggaggagauguga

SEQ ID NO: 50901 - RNA, 546 nt, Artificial Sequence
  derived and/or modified sequence opt2 from TMEM47__Homo_sapiens__NP_113630
auggccuccgccggcuccggcauggaggagguccgcgucuccguccucaccccccucaagcucgucggccucgucugcaucuuccucgcccucugccucgaccucggcgccguccucucccccgccugggucaccgccgaccaccaguacuaccucucccucugggaguccugccgcaagcccgccucccucgacaucuggcacugcgaguccacccucuccuccgacuggcagaucgccacccucgcccuccuccucggcggcgccgccaucauccucaucgccuuccucgucggccucaucuccaucugcgucggcucccgccgccgcuucuaccgccccgucgccgucaugcucuucgccgccgucguccuccaggucugcucccucguccucuaccccaucaaguucaucgagaccgucucccucaagaucuaccacgaguucaacuggggcuacggccucgccuggggcgccaccaucuucuccuucggcggcgccauccucuacugccucaaccccaagaacuacgaggacuacuacuga

SEQ ID NO: 50902 - RNA, 477 nt, Artificial Sequence
  derived and/or modified sequence opt2 from TMEM50B__Homo_sapiens__NP_006125
auggccggcuuccucgacaacuuccgcuggcccgagugcgagugcaucgacugguccgagcgccgcaacgccgucgccuccgucgucgccggcauccucuucuucaccggcugguggaucaugaucgacgccgccgucgucuaccccaagcccgagcagcucaaccacgccuuccacaccugcggcgucuucuccacccucgccuucuucaugaucaacgccgucuccaacgcccagguccgcggcgacuccuacgaguccggcugccucggccgcaccggcgcccgcgucuggcucuucaucggcuucaugcucauguucggcucccucaucgccuccauguggauccucuucggcgccuacgucacccagaacaccgacgucuaccccggccucgccgucuucuuccagaacgcccucaucuucuucuccacccucaucuacaaguucggccgcaccgaggagcucuggaccuga

SEQ ID NO: 50903 - RNA, 774 nt, Artificial Sequence
  derived and/or modified sequence opt2 from TMEM55A__Homo_sapiens__NP_061180
auggccgccgacggcgucgacgagcgcuccccccuccucuccgccucccacuccggcaacgucacccccaccgccccccccuaccuccaggaguccuccccccgcgccgagcuccccccccccuacaccgccaucgccucccccgacgccuccggcauccccgucaucaacugccgcgucugccagucccucaucaaccucgacggcaagcuccaccagcacgucgucaagugcaccgucugcaacgaggccacccccaucaagaacccccccaccggcaagaaguacguccgcugccccugcaacugccuccucaucugcaaggacaccucccgccgcaucggcugcccccgccccaacugccgccgcaucaucaaccucggccccgucaugcucaucuccgaggagcagcccgcccagcccgcccuccccauccagcccgagggcacccgcgucgucugcggccacugcggcaacaccuuccucuggauggagcuccgcuucaacacccucgccaagugcccccacugcaagaagaucuccuccgucggcuccgcccucccccgccgccgcugcugcgccuacaucaccaucggcaugaucugcaucuucaucggcgucggccucaccgucggcacccccgacuucgcccgccgcuuccgcgccaccuacgucuccugggccaucgccuaccuccucggccucaucugccucauccgcgccugcuacuggggcgccauccgcgucuccuaccccgagcacuccuucgccuga

SEQ ID NO: 50904 - RNA, 1464 nt, Artificial Sequence
  derived and/or modified sequence opt2 from TMEM57__Homo_sapiens__XP_011540006
augcgccuccgcaagcagaaggagguccagaaggagaacgaguucuacaugcagcuccuccagcaggcccucccccccgagcagcagaugcuccagaagcaggagaaggaggccgaggaggccgccaagggccuccccgacauggacuccuccauccucauccaccacaacggcggcauccccgccaacaagaagcucuccaccacccuccccgagaucgaguaccgcgagaagggcaaggagaaggacaaggacgccaagaagcacaaccucggcaucaacaacaacaacauccuccagcccgucgacuccaagauccaggagaucgaguacauggagaaccacaucaacuccaagcgccucaacaacgaccucgucggcuccaccgagaaccuccucaaggaggacuccugcaccgccuccuccaagaacuacaagaacgccuccggcgucgucaacuccuccccccgcucccacuccgccaccaacggcuccauccccuccuccuccuccaagaacgagaagaagcagaagugcaccuccaagucccccuccacccacaaggaccucauggagaacugcauccccaacaaccagcucuccaagcccgacgcccucguccgccucgagcaggacaucaagaagcucaaggccgaccuccaggccucccgccaggucgagcaggagcuccgcucccagaucuccucccucuccuccaccgagcgcggcauccgcuccgagaugggccagcuccgccaggagaacgagcuccuccagaacaagcuccacaacgccguccagaugaagcagaaggacaagcagaacaucucccagcucgagaagaagcucaaggccgagcaggaggcccgcuccuucgucgagaagcagcucauggaggagaagaagcgcaagaagcucgaggaggccaccgccgcccgcgccgucgccuucgccgccgccucccgcggcgagugcaccgagacccuccgcaaccgcauccgcgagcucgaggccgagggcaagaagcucaccauggacaugaaggucaaggaggaccagauccgcgagcucgagcucaagguccaggagcuccgcaaguacaaggagaacgagaaggacaccgagguccucauguccgcccucuccgccaugcaggacaagacccagcaccucgagaacucccucuccgccgagacccgcaucaagcucgaccucuucuccgcccucggcgacgccaagcgccagcucgagaucgcccagggccagauccuccagaaggaccaggagaucaaggaccucaagcagaagaucgccgaggucauggccgucaugcccuccaucaccuacuccgccgccaccuccccccucucccccgucuccccccacuacuccuccaaguucgucgagaccucccccuccggccucgaccccaacgccuccgucuaccagccccucaagaaguga

SEQ ID NO: 50905 - RNA, 1332 nt, Artificial Sequence
  derived and/or modified sequence opt2 from TMEM5__Homo_sapiens__NP_055069
augcgccucacccgcaagcgccucugcuccuuccucaucgcccucuacugccucuucucccucuacgccgccuaccacgucuucuucggccgccgccgccaggcccccgccggcuccccccgcggccuccgcaagggcgccgcccccgcccgcgagcgccgcggccgcgagcaguccacccucgaguccgaggaguggaaccccugggagggcgacgagaagaacgagcagcagcaccgcuucaagaccucccuccagauccucgacaaguccaccaagggcaagaccgaccucuccguccagaucuggggcaaggccgccaucggccucuaccucugggagcacaucuucgagggccuccucgaccccuccgacgucaccgcccaguggcgcgagggcaaguccaucgucggccgcacccaguacuccuucaucaccggccccgccgucauccccggcuacuucuccgucgacgucaacaacgucguccucauccucaacggccgcgagaaggccaagaucuucuacgccacccaguggcuccucuacgcccagaaccucguccagauccagaagcuccagcaccucgccgucguccuccucggcaacgagcacugcgacaacgaguggaucaaccccuuccucaagcgcaacggcggcuucgucgagcuccucuucaucaucuacgacucccccuggaucaacgacgucgacgucuuccaguggccccucggcgucgccaccuaccgcaacuuccccgucgucgaggccuccugguccaugcuccacgacgagcgccccuaccucugcaacuuccucggcaccaucuacgagaacuccucccgccaggcccucaugaacauccucaagaaggacggcaacgacaagcucugcugggucuccgcccgcgagcacuggcagccccaggagaccaacgagucccucaagaacuaccaggacgcccuccuccaguccgaccucacccucugccccgucggcgucaacaccgagugcuaccgcaucuacgaggccugcuccuacggcuccauccccgucgucgaggacgucaugaccgccggcaacugcggcaacaccuccguccaccacggcgccccccuccagcuccucaaguccaugggcgcccccuucaucuucaucaagaacuggaaggagcuccccgccguccucgagaaggagaagaccaucauccuccaggagaagaucgagcgccgcaagaugcuccuccagugguaccagcacuucaagaccgagcucaagaugaaguucaccaacauccucgaguccuccuuccucaugaacaacaaguccuga

SEQ ID NO: 50906 - RNA, 402 nt, Artificial Sequence
  derived and/or modified sequence opt2 from TMEM60__Homo_sapiens__NP_116325
augcgcaugucccucgcccagcgcguccuccucaccuggcucuucacccuccucuuccucaucaugcucguccucaagcucgacgagaaggcccccuggaacugguuccucaucuucauccccgucuggaucuucgacaccauccuccucguccuccucaucgucaagauggccggccgcugcaaguccggcuucgacccccgccacggcucccacaacaucaagaagaaggccugguaccucaucgccaugcuccucaagcucgccuucugccucgcccucugcgccaagcucgagcaguucaccaccaugaaccucuccuacgucuucaucccccucugggcccuccucgccggcgcccucaccgagcucggcuacaacgucuucuucguccgcgacuga

SEQ ID NO: 50907 - RNA, 1932 nt, Artificial Sequence
  derived and/or modified sequence opt2 from TMEM62__Homo_sapiens__NP_079232
auggccgccguccucgcccuccgcgucgucgccggccucgccgccgccgcccucgucgccaugcuccucgagcacuacggccucgccggccagcccuccccccucccccgccccgcccccccccgccgcccccaccccgcccccggccccggcgacuccaacaucuucuggggccuccagaucuccgacauccaccucucccgcuuccgcgaccccggccgcgccgucgaccucgagaaguucugcuccgagaccaucgacaucauccagcccgcccucguccucgccaccggcgaccucaccgacgccaagaccaaggagcagcucggcucccgccagcacgaggucgaguggcagaccuaccagggcauccucaagaagacccgcgucauggagaagaccaaguggcucgacaucaagggcaaccacgacgccuucaacauccccucccucgacuccaucaagaacuacuaccgcaaguacuccgccguccgccgcgacggcuccuuccacuacguccacuccacccccuucggcaacuacuccuucaucugcgucgacgccaccgucaaccccggccccaagcgccccuacaacuucuucggcauccucgacaagaagaagauggaggagcuccuccuccucgccaaggaguccucccgcuccaaccacaccaucugguucggccacuucaccaccuccaccauccucucccccucccccggcauccgcuccaucauguccuccgccaucgccuaccucugcggccaccuccacacccucggcggccucaugcccguccuccacacccgccacuuccagggcacccucgagcucgaggucggcgacuggaaggacaaccgccgcuaccgcaucuucgccuucgaccacgaccucuucuccuucgccgaccucaucuucggcaaguggcccgucguccucaucaccaaccccaagucccuccucuacuccugcggcgagcacgagccccucgagcgccuccuccacuccacccacauccgcguccucgccuucucccucuccuccaucaccuccgucaccgucaagaucgacggcguccaccucggccaggccguccacgucuccggccccaucuucguccucaaguggaacccccgcaacuacuccuccggcacccacaacaucgaggucaucguccaggacuccgccggccgcuccaaguccguccaccacaucuucuccguccaggagaacaaccaccucuccuucgacccccucgccuccuucauccuccgcaccgaccacuacaucauggcccgcguccucuucguccucaucguccucucccagcucaccauccucaucaucuuccgcuaccgcggcuaccccgagcucaaggagcccuccggcuucaucaaccucaccuccuucucccuccacguccucuccaagaucaacaucuucuacuacuccguccuccuccucacccucuacaccguccucggccccugguucuucggcgagaucaucgacggcaaguucggcugcugcuucuccuucggcaucuucgucaacggccacuuccuccagggcuccaucaccuucaucaucggcauccuccagcucgccuucuucaacaucccccucauggccuacaugugcuggucccuccuccagcgcugcuucggccacaacuuccgcucccaccuccaccagcgcaaguaccucaagaucaugcccguccaccuccucaugcuccuccucuacaucuggcaggucuacuccugcuacuuccucuacgccaccuacggcacccucgccuuccucuucuccccccuccgcaccuggcucacccuccucacccccguccucauccgcuacgucuggacccucaacuccaccaaguucggcaucuucaugguccagcucaagucccaccucuccuccuga

SEQ ID NO: 50908 - RNA, 2424 nt, Artificial Sequence
  derived and/or modified sequence opt2 from TMEM63A__Homo_sapiens__NP_055513
augauggacucccccuuccucgagcucuggcaguccaaggccgucuccauccgcgagcagcucggccucggcgaccgccccaacgacuccuacugcuacaacuccgccaagaacuccaccguccuccagggcgucaccuucggcggcauccccaccguccuccucaucgacgucuccugcuuccucuuccucauccucgucuucuccaucauccgccgccgcuucugggacuacggccgcaucgcccucgucuccgaggccgacuccgagucccgcuuccagcgccucuccuccaccuccuccuccggccagcaggacuucgagaacgagcucggcugcugccccuggcucaccgccaucuuccgccuccacgacgaccagauccucgaguggugcggcgaggacgccauccacuaccucuccuuccagcgccacaucaucuuccuccucgucgucgucuccuuccucucccucugcgucauccuccccgucaaccucuccggcgaccuccucgacaaggaccccuacuccuucggccgcaccaccaucgccaaccuccagaccgacaacgaccuccucuggcuccacaccaucuucgccgucaucuaccucuuccucaccgucggcuucaugcgccaccacacccaguccaucaaguacaaggaggagaaccucguccgccgcacccucuucaucaccggccucccccgcgacgcccgcaaggagaccgucgagucccacuuccgcgacgccuaccccaccugcgaggucgucgacguccagcucugcuacaacgucgccaagcucaucuaccucugcaaggagaagaagaagaccgagaagucccucaccuacuacaccaaccuccaggucaagaccggccagcgcacccucaucaaccccaagcccugcggccaguucugcugcugcgagguccucggcugcgagugggaggacgccaucuccuacuacacccgcaugaaggaccgccuccucgagcgcaucaccgaggaggagcgccacguccaggaccagccccucggcauggccuucgucaccuuccaggagaaguccauggccaccuacauccucaaggacuucaacgccugcaagugccagucccuccagugcaagggcgagccccagcccuccucccacucccgcgagcucuacaccuccaaguggaccgucaccuucgccgccgaccccgaggacaucugcuggaagaaccucuccauccagggccuccgcugguggcuccaguggcucggcaucaacuucacccucuuccucggccucuucuuccucaccacccccuccaucauccucuccaccauggacaaguucaacgucaccaagcccauccacgcccucaacaaccccaucaucucccaguucuuccccacccuccuccucugguccuucuccgcccuccuccccuccaucgucuacuacuccacccuccucgagucccacuggaccaaguccggcgagaaccagaucaugaugaccaaggucuacaucuuccucaucuucaugguccucauccuccccucccucggccucaccucccucgacuucuucuuccgcuggcucuucgacaagaccuccuccgaggccuccauccgccucgagugcgucuuccuccccgaccagggcgccuucuucgucaacuacgucaucgccuccgccuucaucggcaacggcauggagcuccuccgccuccccggccucauccucuacaccuuccgcaugaucauggccaagaccgccgccgaccgccgcaacgucaagcagaaccaggccuuccaguacgaguucggcgccauguacgccuggaugcucugcgucuucaccgucaucgucgccuacuccaucaccugccccaucaucgcccccuucggccucaucuacauccuccucaagcacauggucgaccgccacaaccucuacuucgucuaccuccccgccaagcucgagaagggcauccacuucgccgccgucaaccaggcccucgccgcccccauccucugccucuucuggcucuacuucuucuccuuccuccgccucggcaugaaggcccccgccacccucuucaccuuccucguccuccuccucaccauccucgucugccucgcccacaccugcuucggcugcuucaagcaccucuccccccucaacuacaagaccgaggagcccgccuccgacaagggcuccgaggccgaggcccacaugcccccccccuucacccccuacgucccccgcauccucaacggccucgccuccgagcgcaccgcccucuccccccagcagcagcagcagcagaccuacggcgccauccacaacaucuccggcaccauccccggccagugccucgcccaguccgccaccggcuccgucgccgccgccccccaggaggccuga

SEQ ID NO: 50909 - RNA, 2745 nt, Artificial Sequence
  derived and/or modified sequence opt2 from TMEM67__Homo_sapiens__NP_001135773
augucccucucccacuggcccuacuuccgccucguccucaacuuccgcccccaggucaucugccucccccagccccccaagguccucggcuaccgccucgagcccccccaccucacccucgccugcacccucgagggcauguacaacaucaucgaggagauccucgagcgcgacaucaacggcacccuccucucccaggccaccugcgagcucugcgacggcaacgagaacuccuucauggucgucaacgcccucggcgaccgcugcguccgcugcgagcccaccuucgucaacaccucccgcuccugcgccugcuccgagcccaacauccucaccggcggccucugcuucuccuccaccggcaacuucccccuccgccgcaucuccgccgcccgcuacggcgaggucggcaugucccucaccuccgagugguucgccaaguaccuccaguccuccgccgccgccugcugggucuacgccaaccucaccuccugccaggcccucggcaacaugugcgucaugaacaugaacuccuacgacuucgccaccuucgacgccugcggccucuuccaguucaucuucgagaacaccgccggccucuccaccguccacuccaucuccuucuggcgccagaaccuccccuggcucuucuacggcgaccagcucggccucgccccccagguccucuccuccaccucccuccccaccaacuucuccuucaagggcgagaaccagaacaccaagcucaaguucgucgccgccuccuacgacauccgcggcaacuuccucaaguggcagacccucgagggcggcguccuccagcucugccccgacaccgagacccgccucaacgccgccuacuccuucggcaccaccuaccagcagaacugcgagauccccaucuccaagauccucaucgacuuccccacccccaucuucuacgacgucuaccucgaguacaccgacgagaaccagcaccaguacauccucgccguccccguccucaaccucaaccuccagcacaacaagaucuucgucaaccaggacuccaacuccggcaaguggcuccucacccgccgcaucuuccucgucgacgccgucuccggccgcgagaacgaccucggcacccagccccgcgucauccgcgucgccacccagaucucccucuccguccaccucguccccaacaccaucaacggcaacaucuaccccccccucaucaccaucgccuacuccgacaucgacaucaaggacgccaacucccaguccgucaaggucuccuucuccgucaccuacgagauggaccacggcgaggcccacguccagaccgacaucgcccucggcguccucggcggccucgccguccucgccucccuccucaagaccgccggcuggaagcgccgcaucggcucccccaugaucgaccuccagaccgucgucaaguuccucgucuacuacgccggcgaccucgccaacgucuucuucaucaucaccgucggcaccggccucuacuggcucaucuucuucaaggcccagaaguccgucuccguccuccuccccaugcccauccaggaggagcgcuucgucaccuacgucggcugcgccuucgcccucaaggcccuccaguuccuccacaagcucaucucccagaucaccaucgacgucuucuucaucgacugggagcgccccaagggcaagguccucaaggccgucgagggcgagggcggcguccgcuccgccaccguccccgucuccaucuggcgcaccuacuucgucgccaacgaguggaacgagauccagaccguccgcaagaucaacucccucuuccagguccucaccguccucuucuuccucgaggucgucggcuucaagaaccucgcccucauggacuccuccuccucccucucccgcaacccccccuccuacaucgcccccuacuccugcauccuccgcuacgccgucuccgccgcccucuggcucgccaucggcaucauccaggucgucuucuucgccgucuucuacgagcgcuucaucgaggacaagauccgccaguucgucgaccucugcuccauguccaacaucuccgucuuccuccucucccacaagugcuucggcuacuacauccacggccgcuccguccacggccacgccgacaccaacauggaggagaugaacaugaaccucaagcgcgaggccgagaaccucugcucccagcgcggccucguccccaacaccgacggccagaccuucgagaucgccaucuccaaccagaugcgccagcacuacgaccgcauccacgagacccucauccgcaagaacggccccgcccgccuccucuccuccuccgccuccaccuucgagcaguccaucaaggccuaccacaugaugaacaaguuccucggcuccuucaucgaccacguccacaaggagauggacuacuucaucaaggacaagcuccuccucgagcgcauccucggcauggaguucauggagcccauggagaaguccaucuucuacaacgacgagggcuacuccuucuccuccguccucuacuacggcaacgaggccacccuccucaucuucgaccuccucuucuucugcgucgucgaccucgccugccagaacuucauccucgccuccuuccucaccuaccuccagcaggagaucuuccgcuacauccgcaacaccgucggccagaagaaccucgccuccaagacccucgucgaccagcgcuuccucaucuga

SEQ ID NO: 50910 - RNA, 324 nt, Artificial Sequence
  derived and/or modified sequence opt2 from TMEM70__Homo_sapiens__NP_001035703
augcucuuccucgcccucggcucccccugggccgucgagcucccccucugcggccgccgcaccgcccucugcgccgccgccgcccuccgcggcccccgcgccuccgucucccgcgccuccuccuccuccggccccuccggccccgucgccggcugguccaccggccccuccggcgccgcccgccuccuccgccgccccggccgcgcccagauccccgucuacugggagggcuacguccgcuuccucaacacccccuccgacaaguccgaggacggccgccucaucuacaccggcaacauggcccgcgccgucuucggcaaguga

SEQ ID NO: 50911 - RNA, 771 nt, Artificial Sequence
  derived and/or modified sequence opt2 from TMEM74B__Homo_sapiens__NP_001291677
augccccccgcccagggcuacgaguucgccgccgccaagggcccccgcgacgagcucggccccuccuuccccauggccuccccccccggccucgagcucaagacccucuccaacggcccccaggccccccgccgcuccgccccccucggccccgucgcccccacccgcgagggcgucgagaacgccugcuucuccuccgaggagcacgagacccacuuccagaaccccggcaacacccgccucggcuccucccccuccccccccggcggcgucuccucccucccccgcucccagcgcgacgaccucucccuccacuccgaggagggccccgcccucgagcccgucucccgccccgucgacuacggcuucgucuccgcccucgucuuccucgucuccggcauccuccucgucgucaccgccuacgccaucccccgcgaggcccgcgucaaccccgacaccgucaccgcccgcgagauggagcgccucgagauguacuacgcccgccucggcucccaccucgaccgcugcaucaucgccggccucggccuccucaccgucggcggcaugcuccucuccguccuccucauggucucccucugcaagggcgagcucuaccgccgccgcaccuucguccccggcaagggcucccgcaagaccuacggcuccaucaaccuccgcaugcgccagcucaacggcgacggcggccaggcccucgucgagaacgaggucguccaggucuccgagaccucccacacccuccagcgcuccuga

SEQ ID NO: 50912 - RNA, 1185 nt, Artificial Sequence
  derived and/or modified sequence opt2 from TMEM79__Homo_sapiens__NP_115699
augaccgagcaggagacccucgcccuccucgaggucaagcgcuccgacucccccgagaaguccuccccccaggcccucguccccaacggccgccagcccgagggcgagggcggcgccgagucccccggcgccgagucccuccgcgucggcuccuccgccggcucccccaccgccaucgagggcgccgaggacggccucgacuccaccgucuccgaggccgccacccuccccuggggcaccggcccccagcccuccgcccccuuccccgacccccccggcuggcgcgacaucgagcccgagccccccgaguccgagccccucaccaagcucgaggagcuccccgaggacgacgccaaccuccuccccgagaaggccgcccgcgccuucguccccaucgaccuccagugcaucgagcgccagccccaggaggaccucaucguccgcugcgaggccggcgagggcgagugccgcaccuucaugcccccccgcgucacccaccccgaccccaccgagcgcaagugggccgaggccgucguccgcccccccggcugcuccugcggcggcugcggcuccugcggcgaccgcgaguggcuccgcgccgucgccuccgucggcgccgcccucauccucuuccccugccuccucuacggcgccuacgccuuccuccccuucgacgucccccgccuccccaccauguccucccgccucaucuacacccuccgcugcggcgucuucgccaccuuccccaucguccucggcauccucgucuacggccucucccuccucugcuucuccgcccuccgccccuucggcgagccccgccgcgaggucgagauccaccgccgcuacgucgcccaguccguccagcucuucauccucuacuucuucaaccucgccguccucuccaccuaccucccccaggacacccucaagcuccucccccuccucaccggccucuucgccgucucccgccucaucuacuggcucaccuucgccgucggccgcuccuuccgcggcuucggcuacggccucaccuuccucccccuccucuccaugcucauguggaaccucuacuacauguucgucgucgagcccgagcgcaugcucaccgccaccgagucccgccucgacuaccccgaccacgcccgcuccgccuccgacuaccgcccccgccccuggggcuga

SEQ ID NO: 50913 - RNA, 546 nt, Artificial Sequence
  derived and/or modified sequence opt2 from TMEM87A__Homo_sapiens__NP_001103973
auggccgccgccgccuggcuccagguccuccccgucauccuccuccuccucggcgcccaccccuccccccucuccuucuucuccgccggccccgccaccgucgccgccgccgaccgcuccaaguggcacauccccauccccuccggcaagaacuacuucuccuucggcaagauccucuuccgcaacaccaccaucuuccucaaguucgacggcgagcccugcgaccucucccucaacaucaccugguaccucaaguccgccgacugcuacaacgagaucuacaacuucaaggccgaggaggucgagcucuaccucgagaagcucaaggagaagcgcggccucuccggcaaguaccagaccuccuccaagcucuuccagaacugcuccgagcucuucaagacccagaccuucuccggcgacuucaugcaccgccucccccuccucggcgagaagcaggaggccaaggagaacggcaccaaccucaccuucaucggcgacaagaccauccagaugcccuuccucaagaagcacuuccucgacugcuga

SEQ ID NO: 50914 - RNA, 480 nt, Artificial Sequence
  derived and/or modified sequence opt2 from TMEM88__Homo_sapiens__NP_981956
auggccgacguccccggcgcccagcgcgccguccccggcgacggccccgagccccgcgacccccucgacugcugggccugcgccguccucgucaccgcccagaaccuccucgucgccgccuucaaccuccuccuccucguccucguccucggcaccauccuccuccccgccgucaccaugcucggcuucggcuuccucugccacucccaguuccuccgcucccaggccccccccugcaccgcccaccuccgcgaccccggcuucaccgcccuccucgucaccggcuuccuccuccucgucccccuccucguccucgcccucgccuccuaccgccgccucugccuccgccuccgccucgccgacugccucguccccuacucccgcgcccucuaccgccgccgccgcgccccccagccccgccagauccgcgccucccccggcucccaggccguccccaccuccggcaaggucugggucuga

SEQ ID NO: 50915 - RNA, 480 nt, Artificial Sequence
  derived and/or modified sequence opt2 from TMEM89__Homo_sapiens__NP_001008270
augcuccacguccucgccucccucccccuccuccuccuccucgucaccuccgccuccacccacgccuggucccgcccccucugguaccaggucggccucgaccuccagcccuggggcugccagcccaaguccgucgagggcugccgcggcggccucuccugccccggcuacuggcucggccccggcgccucccgcaucuaccccgucgccgccgucaugaucaccaccaccaugcucaugaucugccgcaagauccuccagggccgccgccgcucccaggccaccaagggcgagcacccccaggucaccaccgagcccugcggccccuggaagcgccgcgcccccaucuccgaccacacccuccuccgcggcguccuccacaugcucgacgcccuccucguccacaucgagggccaccuccgccaccucgccacccagcgccagauccagaucaagggcaccuccacccaguccggcuga

SEQ ID NO: 50916 - RNA, 1419 nt, Artificial Sequence
  derived and/or modified sequence opt2 from TMEM8B__Homo_sapiens__NP_001036055
augaacaugccccagucccucggcaaccagccccucccccccgagccccccucccucggcacccccgccgagggccccggcaccaccuccccccccgagcacugcuggcccguccgccccacccuccgcaacgagcucgacaccuucuccguccacuucuacaucuucuucggccccuccgucgcccucccccccgagcgccccgccgucuucgccaugcgccuccuccccguccucgacuccggcggcguccucucccucgagcuccagcucaacgccuccuccguccgccaggagaacgucaccgucuucggcugccucacccacgaggucccccucucccucggcgacgccgccgucaccugcuccaaggagucccucgccggcuuccuccucuccgucuccgccaccacccgcgucgcccgccuccgcauccccuucccccagaccggcaccugguuccucgcccuccgcucccucugcggcgucggcccccgcuucguccgcugccgcaacgccaccgccgagguccgcaugcgcaccuuccucucccccugcgucgacgacugcggccccuacggccagugcaagcuccuccgcacccacaacuaccucuacgccgccugcgagugcaaggccggcuggcgcggcuggggcugcaccgacuccgccgacgcccucaccuacggcuuccagcuccucuccacccuccuccucugccucuccaaccucauguuccucccccccgucguccucgccauccgcucccgcuacguccucgaggccgccgucuacaccuucaccauguucuucuccaccuucuaccacgccugcgaccagcccggcaucgucgucuucugcaucauggacuacgacguccuccaguucugcgacuuccucggcucccucauguccgucugggucaccgucaucgccauggcccgccuccagcccgucgucaagcagguccucuaccuccucggcgccaugcuccucuccauggcccuccagcucgaccgccacggccucuggaaccuccucggccccucccucuucgcccucggcauccucgccaccgccuggaccguccgcuccguccgccgccgccacugcuacccccccaccuggcgccgcuggcucuucuaccucugccccggcucccucaucgccggcuccgccguccuccucuacgccuucgucgagacccgcgacaacuacuucuacauccacuccaucuggcacaugcucaucgccggcuccgucggcuuccuccuccccccccgcgccaagaccgaccacggcguccccuccggcgcccgcgcccgcggcugcggcuaccagcucugcaucaacgagcaggaggagcucggccucgucggccccggcggcgccaccgucuccuccaucugcgccuccuga

SEQ ID NO: 50917 - RNA, 531 nt, Artificial Sequence
  derived and/or modified sequence opt2 from TMEM95__Homo_sapiens__NP_001307365
auguggcgccucgcccucggcggcgucuuccucgccgccgcccaggccugcgucuucugccgccuccccgcccacgaccucuccggccgccucgcccgccucugcucccagauggaggcccgccagaaggagugcggcgccucccccgacuucuccgccuucgcccucgacgaggucuccaugaacaaggucaccgagaagacccaccgcguccuccgcgucauggagaucaaggaggccgucuccucccuccccuccuacugguccuggcuccgcaagaccaagcuccccgaguacacccgcgaggcccucugcccccccgccugccgcggcuccaccacccucuacaacugcuccaccugcaagggcaccgaggucuccugcuggccccgcaagcgcugcuuccccggcucccaggaccucugggaggccaagauccuccuccucuccaucuucggcgccuuccuccuccucggcguccucucccuccucgucgagucccaccaccuccaggccaaguccggccucuga

SEQ ID NO: 50918 - RNA, 531 nt, Artificial Sequence
  derived and/or modified sequence opt2 from TMEM97__Homo_sapiens__NP_055388
augggcgcccccgccacccgccgcugcgucgaguggcuccucggccucuacuuccucucccacauccccaucacccucuucauggaccuccaggccguccucccccgcgagcucuaccccgucgaguuccgcaaccuccucaagugguacgccaaggaguucaaggacccccuccuccaggagccccccgccugguucaaguccuuccucuucugcgagcucgucuuccagcuccccuucuuccccaucgccaccuacgccuuccucaagggcuccugcaaguggauccgcacccccgccaucaucuacuccguccacaccaugaccacccucauccccauccucuccaccuuccucuucgaggacuucuccaaggccuccggcuucaagggccagcgccccgagacccuccacgagcgccucacccucgucuccgucuacgcccccuaccuccucauccccuucauccuccucaucuucaugcuccgcucccccuacuacaaguacgaggagaagcgcaagaagaaguga

SEQ ID NO: 50919 - RNA, 681 nt, Artificial Sequence
  derived and/or modified sequence opt2 from TMEM98__Homo_sapiens__NP_001288675
auggagaccgucgucaucgucgccaucggcguccucgccaccaucuuccucgccuccuucgccgcccucguccucgucugccgccagcgcuacugccgcccccgcgaccuccuccagcgcuacgacuccaagcccaucgucgaccucaucggcgccauggagacccaguccgagcccuccgagcucgagcucgacgacgucgucaucaccaacccccacaucgaggccauccucgagaacgaggacuggaucgaggacgccuccggccucaugucccacugcaucgccauccucaagaucugccacacccucaccgagaagcucgucgccaugaccaugggcuccggcgccaagaugaagaccuccgccuccgucuccgacaucaucgucgucgccaagcgcaucuccccccgcgucgacgacgucgucaaguccauguaccccccccucgaccccaagcuccucgacgcccgcaccaccgcccuccuccucuccgucucccaccucguccucgucacccgcaacgccugccaccucaccggcggccucgacuggaucgaccagucccucuccgccgccgaggagcaccucgagguccuccgcgaggccgcccucgccuccgagcccgacaagggccuccccggccccgagggcuuccuccaggagcaguccgccaucuga

SEQ ID NO: 50920 - RNA, 3282 nt, Artificial Sequence
  derived and/or modified sequence opt2 from TMF1__Homo_sapiens__NP_009045
auguccugguucaacgccucccagcucuccuccuucgccaagcaggcccucucccaggcccagaaguccaucgaccgcguccucgacauccaggaggaggagcccuccaucugggccgagaccauccccuacggcgagcccggcaucuccucccccgucuccggcggcugggacaccuccaccuggggccucaaguccaacaccgagccccaguccccccccaucgccucccccaaggccaucaccaagcccguccgccgcaccgucgucgacgaguccgagaacuucuucuccgccuuccucucccccaccgacguccagaccauccagaagucccccgucgucuccaagccccccgccaagucccagcgccccgaggaggaggucaaguccucccuccacgagucccuccacaucggccagucccgcacccccgagaccaccgagucccaggucaaggacuccucccucugcgucuccggcgagacccucgccgccggcaccuccucccccaagaccgagggcaagcacgaggagaccgucaacaaggaguccgacaugaagguccccaccgucucccucaaggucuccgaguccgucaucgacgucaagaccaccauggaguccaucuccaacaccuccacccagucccucaccgccgagaccaaggacaucgcccucgagcccaaggagcagaagcacgaggaccgccaguccaacacccccuccccccccgucuccaccuucuccuccggcaccuccaccaccuccgacaucgagguccucgaccacgaguccgucaucuccgaguccuccgccuccucccgccaggagaccaccgacuccaaguccucccuccaccucaugcagaccuccuuccagcuccucuccgccuccgccugccccgaguacaaccgccucgacgacuuccagaagcucaccgaguccugcugcuccuccgacgccuucgagcgcaucgacuccuucuccguccagucccucgacucccgcuccgucuccgagaucaacuccgacgacgagcucuccggcaagggcuacgcccucguccccaucaucgucaacuccuccacccccaaguccaagaccgucgaguccgccgagggcaaguccgaggaggucaacgagacccucgucauccccaccgaggaggccgagauggaggaguccggccgcuccgccacccccgucaacugcgagcagcccgacauccucgucuccuccacccccaucaacgagggccagaccguccucgacaaggucgccgagcagugcgagcccgccgagucccagcccgaggcccucuccgagaaggaggacgucugcaagaccgucgaguuccucaacgagaagcucgagaagcgcgaggcccagcuccucucccucuccaaggagaaggcccuccucgaggaggccuucgacaaccucaaggacgagauguuccgcgucaaggaggaguccuccuccaucuccucccucaaggacgaguucacccagcgcaucgccgaggccgagaagaagguccagcucgccugcaaggagcgcgacgccgccaagaaggagaucaagaacaucaaggaggagcucgccacccgccucaacuccuccgagaccgccgaccuccucaaggagaaggacgagcagauccgcggccucauggaggagggcgagaagcucuccaagcagcagcuccacaacuccaacaucaucaagaagcuccgcgccaaggacaaggagaacgagaacauggucgccaagcucaacaagaaggucaaggagcucgaggaggagcuccagcaccucaagcagguccucgacggcaaggaggaggucgagaagcagcaccgcgagaacaucaagaagcucaacuccauggucgagcgccaggagaaggaccucggccgccuccaggucgacauggacgagcucgaggagaagaaccgcuccauccaggccgcccucgacuccgccuacaaggagcucaccgaccuccacaaggccaacgccgccaaggacuccgaggcccaggaggccgcccucucccgcgagaugaaggccaaggaggagcucuccgccgcccucgagaaggcccaggaggaggcccgccagcagcaggagacccucgccauccaggucggcgaccuccgccucgcccuccagcgcaccgagcaggccgccgcccgcaaggaggacuaccuccgccacgagaucggcgagcuccagcagcgccuccaggaggccgagaaccgcaaccaggagcucucccaguccgucuccuccaccacccgcccccuccuccgccagaucgagaaccuccaggccacccucggcucccagaccuccuccugggagaagcucgagaagaaccucuccgaccgccucggcgagucccagacccuccucgccgccgccgucgagcgcgagcgcgccgccaccgaggagcuccucgccaacaagauccagauguccuccauggagucccagaacucccuccuccgccaggagaacucccgcuuccaggcccagcucgaguccgagaagaaccgccucugcaagcucgaggacgagaacaaccgcuaccaggucgagcucgagaaccucaaggacgaguacguccgcacccucgaggagacccgcaaggagaagacccuccucaacucccagcucgagauggagcgcaugaaggucgagcaggagcgcaagaaggccaucuucacccaggagaccaucaaggagaaggagcgcaagcccuucuccgucuccuccacccccaccaugucccgcuccuccuccaucuccggcgucgacauggccggccuccagaccuccuuccucucccaggacgagucccacgaccacuccuucggccccaugcccaucuccgccaacggcuccaaccucuacgacgccguccgcaugggcgccggcuccuccaucaucgagaaccuccagucccagcucaagcuccgcgagggcgagaucacccaccuccagcucgagaucggcaaccucgagaagacccgcuccaucauggccgaggagcucgucaagcucaccaaccagaacgacgagcucgaggagaaggucaaggagauccccaagcuccgcacccagcuccgcgaccucgaccagcgcuacaacaccauccuccagauguacggcgagaaggccgaggaggccgaggagcuccgccucgaccucgaggacgucaagaacauguacaagacccagaucgacgagcuccuccgccagucccucuccuga

SEQ ID NO: 50921 - RNA, 471 nt, Artificial Sequence
  derived and/or modified sequence opt2 from TMIE__Homo_sapiens__NP_671729
auggccggcuggcccggcgccggcccccucugcguccucggcggcgccgcccucggcgucugccucgccggcgucgccggccagcucgucgagcccuccaccgccccccccaagcccaagccccccccccucaccaaggagaccgucgucuucugggacaugcgccucuggcacgucgucggcaucuucucccucuucguccucuccaucaucaucacccucugcugcgucuucaacugccgcgucccccgcacccgcaaggagaucgaggcccgcuaccuccagcgcaaggccgccaagauguacaccgacaagcucgagaccguccccccccucaacgagcucaccgagguccccggcgaggacaagaagaagaagaagaagaagaagaaggacuccgucgacaccgucgccaucaaggucgaggaggacgagaagaacgaggccaagaagaagaagggcgagaaguga

SEQ ID NO: 50922 - RNA, 849 nt, Artificial Sequence
  derived and/or modified sequence opt2 from TMIGD2__Homo_sapiens__NP_653216
augggcucccccggcaugguccucggccuccucguccagaucugggcccuccaggaggccuccucccucuccguccagcagggccccaaccuccuccagguccgccagggcucccaggccacccucgucugccaggucgaccaggccaccgccugggagcgccuccgcgucaaguggaccaaggacggcgccauccucugccagcccuacaucaccaacggcucccucucccucggcgucugcggcccccagggccgccucuccuggcaggcccccucccaccucacccuccagcucgaccccgucucccucaaccacuccggcgccuacgucugcugggccgccgucgagauccccgagcucgaggaggccgagggcaacaucacccgccucuucgucgaccccgacgaccccacccagaaccgcaaccgcaucgccuccuuccccggcuuccucuucguccuccucggcgucggcuccaugggcgucgccgccaucgucuggggcgccugguucuggggccgccgcuccugccagcagcgcgacuccggcaacucccccggcaacgccuucuacuccaacguccucuaccgcccccgcggcgcccccaagaaguccgaggacugcuccggcgagggcaaggaccagcgcggccaguccaucuacuccaccuccuucccccagcccgccccccgccagccccaccucgccucccgccccugccccuccccccgccccugccccuccccccgccccggccaccccgucuccaugguccgcgucuccccccgccccucccccacccagcagccccgccccaagggcuuccccaaggucggcgaggaguga

SEQ ID NO: 50923 - RNA, 537 nt, Artificial Sequence
  derived and/or modified sequence opt2 from TMIGD3__Homo_sapiens__NP_001289609
auggagggcucccccgccggccccaucgagcagaaggaggcccgcugggaguccuccugggaggagcagcccgacuggacccucggcugccucucccccgagucccacaccaaccacgucgcccuccgcgacaccggcaaccagcucaucgucaccauguccugccucaccaaggaggacaccggcugguacuggugcggcauccagcgcgacuucgcccgcgacgacauggacuucaccgagcucaucgucaccgacgacaagggcacccucgccaacgacuucugguccggcaaggaccucuccggcaacaagacccgcuccugcaaggcccccaaggucguccgcaaggccgaccgcucccgcaccuccauccucaucaucugcauccucaucaccggccucggcaucaucuccgucaucucccaccucaccaagcgccgccgcucccagcgcaaccgccgcgucggcaacacccucaagcccuucucccgcguccucacccccaaggagauggcccccaccgagcagauguga

SEQ ID NO: 50924 - RNA, 1131 nt, Artificial Sequence
  derived and/or modified sequence opt2 from TMLHE__Homo_sapiens__NP_001171726
augugguaccaccgccucucccaccuccacucccgccuccaggaccuccucaagggcggcgucaucuaccccgcccucccccagcccaacuucaagucccuccucccccucgccguccacuggcaccacaccgccuccaagucccucaccugcgccuggcagcagcacgaggaccacuucgagcucaaguacgccaacaccgucaugcgcuucgacuacgucuggcuccgcgaccacugccgcuccgccuccugcuacaacuccaagacccaccagcgcucccucgacaccgccuccgucgaccucugcaucaagcccaagaccauccgccucgacgagaccacccucuucuucaccuggcccgacggccacgucaccaaguacgaccucaacuggcucgucaagaacuccuacgagggccagaagcagaaggucauccagccccgcauccucuggaacgccgagaucuaccagcaggcccagguccccuccgucgacugccaguccuuccucgagaccaacgagggccucaagaaguuccuccagaacuuccuccucuacggcaucgccuucgucgagaacgucccccccacccaggagcacaccgagaagcucgccgagcgcaucucccucauccgcgagaccaucuacggccgcaugugguacuucaccuccgacuucucccgcggcgacaccgccuacaccaagcucgcccucgaccgccacaccgacaccaccuacuuccaggagcccugcggcauccaggucuuccacugccucaagcacgagggcaccggcggccgcacccuccucgucgacggcuucuacgccgccgagcagguccuccagaaggcccccgaggaguucgagcuccucuccaaggucccccucaagcacgaguacaucgaggacgucggcgagugccacaaccacaugaucggcaucggccccguccucaacaucuaccccuggaacaaggagcucuaccucauccgccucuucaaggagaagcagaacaccgucaaccgccaguggaacuccucccuccagugcgacauccccgagcgcauccucaccuaccgccacuucgucuccggcaccuccaucgagcaccgcggcucccucaucuga

SEQ ID NO: 50925 - RNA, 1080 nt, Artificial Sequence
  derived and/or modified sequence opt2 from TMOD1__Homo_sapiens__NP_001159588
auguccuaccgccgcgagcucgagaaguaccgcgaccucgacgaggacgagauccucggcgcccucaccgaggaggagcuccgcacccucgagaacgagcucgacgagcucgaccccgacaacgcccuccuccccgccggccuccgccagaaggaccagaccaccaaggcccccaccggccccuucaagcgcgaggagcuccucgaccaccucgagaagcaggccaaggaguucaaggaccgcgaggaccucguccccuacaccggcgagaagcgcggcaaggucuggguccccaagcagaagccccucgaccccguccucgaguccgucacccucgagcccgagcucgaggaggcccucgccaacgccuccgacgccgagcucugcgacaucgccgccauccucggcaugcacacccucauguccaaccagcaguacuaccaggcccucuccuccuccuccaucaugaacaaggagggccucaacuccgucaucaagcccacccaguacaagcccguccccgacgaggagcccaacuccaccgacgucgaggagacccucgagcgcaucaagaacaacgaccccaagcucgaggaggucaaccucaacaacauccgcaacauccccauccccacccucaaggccuacgccgaggcccucaaggagaacuccuacgucaagaaguucuccaucgucggcacccgcuccaacgaccccgucgccuacgcccucgccgagaugcucaaggagaacaagguccucaagacccucaacgucgaguccaacuucaucuccggcgccggcauccuccgccucgucgaggcccuccccuacaacaccucccucgucgagaugaagaucgacaaccagucccagccccucggcaacaaggucgagauggagaucgucuccaugcucgagaagaacgccacccuccucaaguucggcuaccacuucacccagcagggcccccgccuccgcgccuccaacgccaugaugaacaacaacgaccucguccgcaagcgccgccucgccgaccucaccggccccaucauccccaagugccgcuccggcgucuga

SEQ ID NO: 50926 - RNA, 948 nt, Artificial Sequence
  derived and/or modified sequence opt2 from TMOD2__Homo_sapiens__NP_001136357
auggcccuccccuuccagaaggagcucgagaaguacaagaacaucgacgaggacgagcuccucggcaagcucuccgaggaggagcucaagcagcucgagaacguccucgacgaccucgaccccgaguccgccaugcuccccgccggcuuccgccagaaggaccagacccagaaggccgccaccggccccuucgaccgcgagcaccuccucauguaccucgagaaggaggcccucgagcagaaggaccgcgaggacuucguccccuucaccggcgagaagaagggccgcgucuucauccccaaggagaagcccaucgagacccgcaaggaggagaaggucacccucgaccccgagcucgaggaggcccucgccuccgccuccgacaccgagcucuacgaccucgccgccguccucggcguccacaaccuccucaacaaccccaaguucgacgaggagaccgccaacaacaagggcggcaagggccccguccgcaacgucgucaagggcgagaaggucaagcccgucuucgaggagccccccaaccccaccaacgucgagaucucccuccagcagaugaaggccaacgaccccucccuccaggaggucaaccucaacaacaucaaggccuucgccgacaugcucaaggucaacaagacccucaccucccucaacaucgaguccaacuucaucaccggcaccggcauccucgcccucgucgaggcccucaaggagaacgacacccucaccgagaucaagaucgacaaccagcgccagcagcucggcaccgccgucgagauggagaucgcccagaugcucgaggagaacucccgcauccucaaguucggcuaccaguucaccaagcagggcccccgcacccgcgucgccgccgccaucaccaagaacaacgaccucguccgcaagaagcgcgucgaggccgaccgccgcuga

SEQ ID NO: 50927 - RNA, 1059 nt, Artificial Sequence
  derived and/or modified sequence opt2 from TMOD3__Homo_sapiens__NP_055362
auggcccuccccuuccgcaaggaccucgagaaguacaaggaccucgacgaggacgagcuccucggcaaccucuccgagaccgagcucaagcagcucgagaccguccucgacgaccucgaccccgagaacgcccuccuccccgccggcuuccgccagaagaaccagaccuccaaguccaccaccggccccuucgaccgcgagcaccuccucuccuaccucgagaaggaggcccucgagcacaaggaccgcgaggacuacguccccuacaccggcgagaagaagggcaagaucuucauccccaagcagaagcccguccagaccuucaccgaggagaaggucucccucgaccccgagcucgaggaggcccucaccuccgccuccgacaccgagcucugcgaccucgccgccauccucggcaugcacaaccucaucaccaacaccaaguucugcaacaucaugggcuccuccaacggcgucgaccaggagcacuucuccaacgucgucaagggcgagaagauccuccccgucuucgacgagccccccaaccccaccaacgucgaggagucccucaagcgcaccaaggagaacgacgcccaccucgucgaggucaaccucaacaacaucaagaacauccccauccccacccucaaggacuucgccaaggcccucgagaccaacacccacgucaagugcuucucccucgccgccacccgcuccaacgaccccgucgccaccgccuucgccgagaugcucaaggucaacaagacccucaagucccucaacgucgaguccaacuucaucaccggcgucggcauccucgcccucaucgacgcccuccgcgacaacgagacccucgccgagcucaagaucgacaaccagcgccagcagcucggcaccgccgucgagcucgagauggccaagaugcucgaggagaacaccaacauccucaaguucggcuaccaguucacccagcagggcccccgcacccgcgccgccaacgccaucaccaagaacaacgaccucguccgcaagcgccgcgucgagggcgaccaccaguga

SEQ ID NO: 50928 - RNA, 1038 nt, Artificial Sequence
  derived and/or modified sequence opt2 from TMOD4__Homo_sapiens__NP_037485
auguccuccuaccagaaggagcucgagaaguaccgcgacaucgacgaggacgagauccuccgcacccucucccccgaggagcucgagcagcucgacugcgagcuccaggagauggaccccgagaacaugcuccuccccgccggccuccgccagcgcgaccagaccaagaagucccccaccggcccccucgaccgcgaggcccuccuccaguaccucgagcagcaggcccucgaggucaaggagcgcgacgaccucguccccuucaccggcgagaagaagggcaagcccuacauccagcccaagcgcgagauccccgccgaggagcagaucacccucgagcccgagcucgaggaggcccucgcccacgccaccgacgccgagaugugcgacaucgccgccauccucgacauguacacccucauguccaacaagcaguacuacgacgcccucugcuccggcgagaucugcaacaccgagggcaucuccuccgucguccagcccgacaaguacaagcccguccccgacgagccccccaaccccaccaacaucgaggagauccucaagcgcguccgcuccaacgacaaggagcucgaggaggucaaccucaacaacauccaggacauccccauccccaugcucuccgagcucugcgaggccaugaaggccaacaccuacguccgcuccuucucccucgucgccacccgcuccggcgaccccaucgccaacgccgucgccgacaugcuccgcgagaaccgcucccuccagucccucaacaucgaguccaacuucaucuccuccaccggccucauggccguccucaaggccguccgcgagaacgccacccucaccgagcuccgcgucgacaaccagcgccaguggcccggcgacgccgucgagauggagauggccaccguccucgagcagugccccuccaucguccgcuucggcuaccacuucacccagcagggcccccgcgcccgcgccgcccaggccaugacccgcaacaacgagcuccgccgccagcagaagaagcgcuga

SEQ ID NO: 50929 - RNA, 1365 nt, Artificial Sequence
  derived and/or modified sequence opt2 from TMPO__Homo_sapiens__NP_001027454
augcccgaguuccucgaggaccccuccguccucaccaaggacaagcucaaguccgagcucgucgccaacaacgucacccuccccgccggcgagcagcgcaaggacgucuacguccagcucuaccuccagcaccucaccgcccgcaaccgccccccccuccccgccggcaccaacuccaagggcccccccgacuucuccuccgacgaggagcgcgagcccacccccguccucggcuccggcgccgccgccgccggccgcucccgcgccgccgucggccgcaaggccaccaagaagaccgacaagccccgccaggaggacaaggacgaccucgacgucaccgagcucaccaacgaggaccuccucgaccagcucgucaaguacggcgucaaccccggccccaucgucggcaccacccgcaagcucuacgagaagaagcuccucaagcuccgcgagcagggcaccgagucccgcuccuccaccccccuccccaccaucuccuccuccgccgagaacacccgccagaacggcuccaacgacuccgaccgcuacuccgacaacgaggaggacuccaagaucgagcucaagcucgagaagcgcgagccccucaagggccgcgccaagacccccgucacccucaagcagcgccgcgucgagcacaaccaguccuacucccaggccggcaucaccgagaccgaguggaccuccggcuccuccaagggcggcccccuccaggcccucacccgcgaguccacccgcggcucccgccgcaccccccgcaagcgcgucgagaccuccgagcacuuccgcaucgacggccccgucaucuccgaguccacccccaucgccgagaccaucauggccuccuccaacgagucccucgucgucaaccgcgucaccggcaacuucaagcacgccucccccauccuccccaucaccgaguucuccgacaucccccgccgcgcccccaagaagccccucacccgcgccgaggucggcgagaagaccgaggagcgccgcgucgagcgcgacauccucaaggagauguuccccuacgaggccuccacccccaccggcaucuccgccuccugccgccgccccaucaagggcgccgccggccgcccccucgagcucuccgacuuccgcauggaggaguccuucuccuccaaguacguccccaaguacgucccccucgccgacgucaaguccgagaagaccaagaagggccgcuccauccccgucuggaucaagauccuccucuucgucgucgucgccgucuuccucuuccucgucuaccaggccauggagaccaaccaggucaaccccuucuccaacuuccuccacgucgacccccgcaaguccaacuga

SEQ ID NO: 50930 - RNA, 1257 nt, Artificial Sequence
  derived and/or modified sequence opt2 from TMPRSS11A__Homo_sapiens__NP_001107859
augauguaccgcaccgucggcuucggcacccgcucccgcaaccucaagcccuggaugaucgccguccucaucguccucucccucaccgucgucgccgucaccaucggccuccucguccacuuccucgucuucgaccagaagaaggaguacuaccacggcuccuucaagauccucgacccccagaucaacaacaacuucggccaguccaacaccuaccagcucaaggaccuccgcgagaccaccgagaaccucgucgacgagaucuucaucgacuccgccuggaagaagaacuacaucaagaaccaggucguccgccucacccccgaggaggacggcgucaaggucgacgucaucauggucuuccaguuccccuccaccgagcagcgcgccguccgcgagaagaagauccaguccauccucaaccagaagauccgcaaccuccgcgcccuccccaucaacgccuccuccguccaggucaacgccauguccuccuccaccggcgagcucaccguccaggccuccugcggcaagcgcgucgucccccucaacgucaaccgcaucgccuccggcgucaucgcccccaaggccgccuggcccuggcaggccucccuccaguacgacaacauccaccagugcggcgccacccucaucuccaacaccuggcucgucaccgccgcccacugcuuccagaaguacaagaacccccaccaguggaccgucuccuucggcaccaagaucaaccccccccucaugaagcgcaacguccgccgcuucaucauccacgagaaguaccgcuccgccgcccgcgaguacgacaucgccgucguccaggucuccucccgcgucaccuucuccgacgacauccgccagaucugccuccccgaggccuccgccuccuuccagcccaaccucaccguccacaucaccggcuucggcgcccucuacuacggcggcgagucccagaacgaccuccgcgaggcccgcgucaagaucaucuccgacgacgucugcaagcagccccaggucuacggcaacgacaucaagcccggcauguucugcgccggcuacauggagggcaucuacgacgccugccgcggcgacuccggcggcccccucgucacccgcgaccucaaggacaccugguaccucaucggcaucgucuccuggggcgacaacugcggccagaaggacaagcccggcgucuacacccaggucaccuacuaccgcaacuggaucgccuccaagaccggcaucuga

SEQ ID NO: 50931 - RNA, 1251 nt, Artificial Sequence
  derived and/or modified sequence opt2 from TMPRSS11B__Homo_sapiens__NP_872308
auguaccgccacggcaucuccucccagcgcuccuggccccucuggaccaccaucuucaucuuccucggcgucgccgccauccucggcgucaccaucggccuccucguccacuuccucgccgucgagaagaccuacuacuaccagggcgacuuccacaucuccggcgucaccuacaacgacaacugcgagaacgccgccucccaggccuccaccaaccucuccaaggacaucgagaccaagaugcucaacgccuuccagaacuccuccaucuacaaggaguacgucaaguccgaggucaucaagcuccuccccaacgccaacggcuccaacguccagcuccagcucaaguucaaguucccccccgccgagggcgucuccaugcgcaccaagaucaaggccaagcuccaccagaugcucaagaacaacauggccuccuggaacgccguccccgccuccaucaagcucauggagaucuccaaggccgccuccgagaugcucaccaacaacugcugcggccgccaggucgccaacuccaucaucaccggcaacaagaucgucaacggcaaguccucccucgagggcgccuggcccuggcaggccuccaugcaguggaagggccgccacuacugcggcgccucccucaucuccucccgcuggcuccucuccgccgcccacugcuucgccaagaagaacaacuccaaggacuggaccgucaacuucggcaucgucgucaacaagcccuacaugacccgcaagguccagaacaucaucuuccacgagaacuacuccucccccggccuccacgacgacaucgcccucguccagcucgccgaggaggucuccuucaccgaguacauccgcaagaucugccuccccgaggccaagaugaagcucuccgagaacgacaacgucgucgucaccggcuggggcacccucuacaugaacggcuccuuccccgucauccuccaggaggacuuccucaagaucaucgacaacaagaucugcaacgccuccuacgccuacuccggcuucgucaccgacaccaugcucugcgccggcuucauguccggcgaggccgacgccugccagaacgacuccggcggcccccucgccuaccccgacucccgcaacaucuggcaccucgucggcaucgucuccuggggcgacggcugcggcaagaagaacaagcccggcgucuacacccgcgucaccuccuaccgcaacuggaucaccuccaagaccggccucuga

SEQ ID NO: 50932 - RNA, 1257 nt, Artificial Sequence
  derived and/or modified sequence opt2 from TMPRSS11D__Homo_sapiens__NP_004253
auguaccgccccgcccgcgucaccuccaccucccgcuuccucaaccccuacgucgucugcuucaucgucgucgccggcgucgucauccucgccgucaccaucgcccuccucgucuacuuccucgccuucgaccagaaguccuacuucuaccgcuccuccuuccagcuccucaacgucgaguacaacucccagcucaacucccccgccacccaggaguaccgcacccucuccggccgcaucgagucccucaucaccaagaccuucaaggaguccaaccuccgcaaccaguucauccgcgcccacgucgccaagcuccgccaggacggcuccggcguccgcgccgacgucgucaugaaguuccaguucacccgcaacaacaacggcgccuccaugaagucccgcaucgaguccguccuccgccagaugcucaacaacuccggcaaccucgagaucaaccccuccaccgagaucaccucccucaccgaccaggccgccgccaacuggcucaucaacgagugcggcgccggccccgaccucaucacccucuccgagcagcgcauccucggcggcaccgaggccgaggagggcuccuggcccuggcaggucucccuccgccucaacaacgcccaccacugcggcggcucccucaucaacaacauguggauccucaccgccgcccacugcuuccgcuccaacuccaacccccgcgacuggaucgccaccuccggcaucuccaccaccuuccccaagcuccgcaugcgcguccgcaacauccucauccacaacaacuacaaguccgccacccacgagaacgacaucgcccucguccgccucgagaacuccgucaccuucaccaaggacauccacuccgucugccuccccgccgccacccagaacaucccccccggcuccaccgccuacgucaccggcuggggcgcccaggaguacgccggccacaccguccccgagcuccgccagggccagguccgcaucaucuccaacgacgucugcaacgccccccacuccuacaacggcgccauccucuccggcaugcucugcgccggcgucccccagggcggcgucgacgccugccagggcgacuccggcggcccccucguccaggaggacucccgccgccucugguucaucgucggcaucgucuccuggggcgaccagugcggccuccccgacaagcccggcgucuacacccgcgucaccgccuaccucgacuggauccgccagcagaccggcaucuga

SEQ ID NO: 50933 - RNA, 1272 nt, Artificial Sequence
  derived and/or modified sequence opt2 from TMPRSS11E__Homo_sapiens__NP_054777
augauguaccgccccgacgucguccgcgcccgcaagcgcgucugcugggagcccugggucaucggccucgucaucuucaucucccucaucguccucgccgucugcaucggccucaccguccacuacguccgcuacaaccagaagaagaccuacaacuacuacuccacccucuccuucaccaccgacaagcucuacgccgaguucggccgcgaggccuccaacaacuucaccgagaugucccagcgccucgaguccauggucaagaacgccuucuacaaguccccccuccgcgaggaguucgucaagucccaggucaucaaguucucccagcagaagcacggcguccucgcccacaugcuccucaucugccgcuuccacuccaccgaggaccccgagaccgucgacaagaucguccagcucguccuccacgagaagcuccaggacgccgucggcccccccaaggucgacccccacuccgucaagaucaagaagaucaacaagaccgagaccgacuccuaccucaaccacugcugcggcacccgccgcuccaagacccucggccagucccuccgcaucgucggcggcaccgaggucgaggagggcgaguggcccuggcaggccucccuccagugggacggcucccaccgcugcggcgccacccucaucaacgccaccuggcucgucuccgccgcccacugcuucaccaccuacaagaaccccgcccgcuggaccgccuccuucggcgucaccaucaagcccuccaagaugaagcgcggccuccgccgcaucaucguccacgagaaguacaagcaccccucccacgacuacgacaucucccucgccgagcucuccucccccguccccuacaccaacgccguccaccgcgucugccuccccgacgccuccuacgaguuccagcccggcgacgucauguucgucaccggcuucggcgcccucaagaacgacggcuacucccagaaccaccuccgccaggcccaggucacccucaucgacgccaccaccugcaacgagccccaggccuacaacgacgccaucaccccccgcaugcucugcgccggcucccucgagggcaagaccgacgccugccagggcgacuccggcggcccccucgucuccuccgacgcccgcgacaucugguaccucgccggcaucgucuccuggggcgacgagugcgccaagcccaacaagcccggcgucuacacccgcgucaccgcccuccgcgacuggaucaccuccaagaccggcaucuga

SEQ ID NO: 50934 - RNA, 1704 nt, Artificial Sequence
  derived and/or modified sequence opt2 from TMPRSS13__Homo_sapiens__NP_001070731
auggagcgcgacucccacggcaacgccucccccgcccgcacccccuccgccggcgccucccccgcccaggccucccccgccggcaccccccccggccgcgccucccccgcccaggccucccccgcccaggccucccccgccggcaccccccccggccgcgccucccccgcccaggccucccccgccggcaccccccccggccgcgccucccccggccgcgccucccccgcccaggccucccccgcccaggccucccccgcccgcgccucccccgcccucgccucccucucccgcuccuccuccggccgcuccuccuccgcccgcuccgccuccgucaccaccucccccacccgcgucuaccucguccgcgccacccccgucggcgccguccccauccgcuccucccccgcccgcuccgcccccgccacccgcgccacccgcgagucccccggcaccucccuccccaaguucaccuggcgcgagggccagaagcagcucccccucaucggcugcguccuccuccucaucgcccucgucgucucccucaucauccucuuccaguucuggcagggccacaccggcauccgcuacaaggagcagcgcgaguccugccccaagcacgccguccgcugcgacggcgucgucgacugcaagcucaaguccgacgagcucggcugcguccgcuucgacugggacaagucccuccucaagaucuacuccggcuccucccaccaguggcuccccaucugcuccuccaacuggaacgacuccuacuccgagaagaccugccagcagcucggcuucgaguccgcccaccgcaccaccgaggucgcccaccgcgacuucgccaacuccuucuccauccuccgcuacaacuccaccauccaggagucccuccaccgcuccgagugccccucccagcgcuacaucucccuccagugcucccacugcggccuccgcgccaugaccggccgcaucgucggcggcgcccucgccuccgacuccaaguggcccuggcaggucucccuccacuucggcaccacccacaucugcggcggcacccucaucgacgcccaguggguccucaccgccgcccacugcuucuucgucacccgcgagaagguccucgagggcuggaaggucuacgccggcaccuccaaccuccaccagcuccccgaggccgccuccaucgccgagaucaucaucaacuccaacuacaccgacgaggaggacgacuacgacaucgcccucaugcgccucuccaagccccucacccucuccgcccacauccaccccgccugccuccccaugcacggccagaccuucucccucaacgagaccugcuggaucaccggcuucggcaagacccgcgagaccgacgacaagaccucccccuuccuccgcgagguccaggucaaccucaucgacuucaagaagugcaacgacuaccucgucuacgacuccuaccucaccccccgcaugaugugcgccggcgaccuccgcggcggccgcgacuccugccagggcgacuccggcggcccccucgucugcgagcagaacaaccgcugguaccucgccggcgucaccuccuggggcaccggcugcggccagcgcaacaagcccggcgucuacaccaaggucaccgagguccuccccuggaucuacuccaagauggaguccgagguccgcuuccgcaaguccuga

SEQ ID NO: 50935 - RNA, 3060 nt, Artificial Sequence
  derived and/or modified sequence opt2 from TMPRSS15__Homo_sapiens__NP_002763
augggcuccaagcgcggcaucuccucccgccaccacucccucuccuccuacgagaucauguucgccgcccucuucgccauccucgucguccucugcgccggccucaucgccgucuccugccucaccaucaaggagucccagcgcggcgccgcccucggccagucccacgaggcccgcgccaccuucaagaucaccuccggcgucaccuacaaccccaaccuccaggacaagcucuccgucgacuucaagguccucgccuucgaccuccagcagaugaucgacgagaucuuccucuccuccaaccucaagaacgaguacaagaacucccgcguccuccaguucgagaacggcuccaucaucgucgucuucgaccucuucuucgcccagugggucuccgacgagaacgucaaggaggagcucauccagggccucgaggccaacaaguccucccagcucgucaccuuccacaucgaccucaacuccgucgacauccucgacaagcucaccaccaccucccaccucgccacccccggcaacgucuccaucgagugccuccccggcuccucccccugcaccgacgcccucaccugcaucaaggccgaccucuucugcgacggcgaggucaacugccccgacggcuccgacgaggacaacaagaugugcgccaccgucugcgacggccgcuuccuccucaccggcuccuccggcuccuuccaggccacccacuaccccaagcccuccgagaccuccgucgucugccaguggaucauccgcgucaaccagggccucuccaucaagcucuccuucgacgacuucaacaccuacuacaccgacauccucgacaucuacgagggcgucggcuccuccaagauccuccgcgccuccaucugggagaccaaccccggcaccauccgcaucuucuccaaccaggucaccgccaccuuccucaucgaguccgacgaguccgacuacgucggcuucaacgccaccuacaccgccuucaacuccuccgagcucaacaacuacgagaagaucaacugcaacuucgaggacggcuucugcuucuggguccaggaccucaacgacgacaacgagugggagcgcauccagggcuccaccuucucccccuucaccggccccaacuucgaccacaccuucggcaacgccuccggcuucuacaucuccacccccaccggccccggcggccgccaggagcgcgucggccuccucucccucccccucgaccccacccucgagcccgccugccucuccuucugguaccacauguacggcgagaacguccacaagcucuccaucaacaucuccaacgaccagaacauggagaagaccgucuuccagaaggagggcaacuacggcgacaacuggaacuacggccaggucacccucaacgagaccgucaaguucaaggucgccuucaacgccuucaagaacaagauccucuccgacaucgcccucgacgacaucucccucaccuacggcaucugcaacggcucccucuaccccgagcccacccucguccccacccccccccccgagcuccccaccgacugcggcggccccuucgagcucugggagcccaacaccaccuucuccuccaccaacuuccccaacuccuaccccaaccucgccuucugcgucuggauccucaacgcccagaagggcaagaacauccagcuccacuuccaggaguucgaccucgagaacaucaacgacgucgucgagauccgcgacggcgaggaggccgacucccuccuccucgccgucuacaccggccccggccccgucaaggacgucuucuccaccaccaaccgcaugaccguccuccucaucaccaacgacguccucgcccgcggcggcuucaaggccaacuucaccaccggcuaccaccucggcauccccgagcccugcaaggccgaccacuuccagugcaagaacggcgagugcgucccccucgucaaccucugcgacggccaccuccacugcgaggacggcuccgacgaggccgacugcguccgcuucuucaacggcaccaccaacaacaacggccucguccgcuuccgcauccaguccaucuggcacaccgccugcgccgagaacuggaccacccagaucuccaacgacgucugccagcuccucggccucggcuccggcaacuccuccaagcccaucuucuccaccgacggcggccccuucgucaagcucaacaccgcccccgacggccaccucauccucacccccucccagcagugccuccaggacucccucauccgccuccagugcaaccacaaguccugcggcaagaagcucgccgcccaggacaucacccccaagaucgucggcggcuccaacgccaaggagggcgccuggcccugggucgucggccucuacuacggcggccgccuccucugcggcgccucccucgucuccuccgacuggcucgucuccgccgcccacugcgucuacggccgcaaccucgagcccuccaaguggaccgccauccucggccuccacaugaaguccaaccucaccuccccccagaccgucccccgccucaucgacgagaucgucaucaacccccacuacaaccgccgccgcaaggacaacgacaucgccaugaugcaccucgaguucaaggucaacuacaccgacuacauccagcccaucugccuccccgaggagaaccaggucuucccccccggccgcaacugcuccaucgccggcuggggcaccgucgucuaccagggcaccaccgccaacauccuccaggaggccgacgucccccuccucuccaacgagcgcugccagcagcagaugcccgaguacaacaucaccgagaacaugaucugcgccggcuacgaggagggcggcaucgacuccugccagggcgacuccggcggcccccucaugugccaggagaacaaccgcugguuccucgccggcgucaccuccuucggcuacaagugcgcccuccccaaccgccccggcgucuacgcccgcgucucccgcuucaccgaguggauccaguccuuccuccacuga

SEQ ID NO: 50936 - RNA, 1590 nt, Artificial Sequence
  derived and/or modified sequence opt2 from TMPRSS2__Homo_sapiens__NP_001128571
augccccccgccccccccggcggcgaguccggcugcgaggagcgcggcgccgccggccacaucgagcacucccgcuaccucucccuccucgacgccgucgacaacuccaagauggcccucaacuccggcuccccccccgccaucggccccuacuacgagaaccacggcuaccagcccgagaaccccuaccccgcccagcccaccgucguccccaccgucuacgagguccaccccgcccaguacuaccccucccccgucccccaguacgccccccgcguccucacccaggccuccaaccccgucgucugcacccagcccaagucccccuccggcaccgucugcaccuccaagaccaagaaggcccucugcaucacccucacccucggcaccuuccucgucggcgccgcccucgccgccggccuccucuggaaguucaugggcuccaagugcuccaacuccggcaucgagugcgacuccuccggcaccugcaucaaccccuccaacuggugcgacggcgucucccacugccccggcggcgaggacgagaaccgcugcguccgccucuacggccccaacuucauccuccaggucuacuccucccagcgcaaguccuggcaccccgucugccaggacgacuggaacgagaacuacggccgcgccgccugccgcgacaugggcuacaagaacaacuucuacuccucccagggcaucgucgacgacuccggcuccaccuccuucaugaagcucaacaccuccgccggcaacgucgacaucuacaagaagcucuaccacuccgacgccugcuccuccaaggccgucgucucccuccgcugcaucgccugcggcgucaaccucaacuccucccgccagucccgcaucgucggcggcgaguccgcccuccccggcgccuggcccuggcaggucucccuccacguccagaacguccacgucugcggcggcuccaucaucacccccgaguggaucgucaccgccgcccacugcgucgagaagccccucaacaaccccuggcacuggaccgccuucgccggcauccuccgccaguccuucauguucuacggcgccggcuaccaggucgagaaggucaucucccaccccaacuacgacuccaagaccaagaacaacgacaucgcccucaugaagcuccagaagccccucaccuucaacgaccucgucaagcccgucugccuccccaaccccggcaugaugcuccagcccgagcagcucugcuggaucuccggcuggggcgccaccgaggagaagggcaagaccuccgagguccucaacgccgccaagguccuccucaucgagacccagcgcugcaacucccgcuacgucuacgacaaccucaucacccccgccaugaucugcgccggcuuccuccagggcaacgucgacuccugccagggcgacuccggcggcccccucgucaccuccaagaacaacaucugguggcucaucggcgacaccuccuggggcuccggcugcgccaaggccuaccgccccggcgucuacggcaacgucauggucuucaccgacuggaucuaccgccagaugcgcgccgacggcuga

SEQ ID NO: 50937 - RNA, 1362 nt, Artificial Sequence
  derived and/or modified sequence opt2 from TMPRSS3__Homo_sapiens__NP_001243246
augggcgagaacgacccccccgccgucgaggcccccuucuccuuccgcucccucuucggccucgacgaccucaagaucucccccgucgcccccgacgccgacgccgucgccgcccagauccucucccuccucccccucaaguucuuccccaucaucgucaucggcaucaucgcccucauccucgcccucgccaucggccucggcauccacuucgacugcuccggcaaguaccgcugccgcuccuccuucaagugcaucgagcucaucgcccgcugcgacggcgucuccgacugcaaggacggcgaggacgaguaccgcugcguccgcgucggcggccagaacgccguccuccaggucuucaccgccgccuccuggaagaccaugugcuccgacgacuggaagggccacuacgccaacgucgccugcgcccagcucggcuuccccuccuacgucuccuccgacaaccuccgcgucuccucccucgagggccaguuccgcgaggaguucgucuccaucgaccaccuccuccccgacgacaaggucaccgcccuccaccacuccgucuacguccgcgagggcugcgccuccggccacgucgucacccuccagugcaccgccugcggccaccgccgcggcuacuccucccgcaucgucggcggcaacaugucccuccucucccaguggcccuggcaggccucccuccaguuccagggcuaccaccucugcggcggcuccgucaucaccccccucuggaucaucaccgccgcccacugcgucuacgaccucuaccuccccaaguccuggaccauccaggucggccucgucucccuccucgacaaccccgcccccucccaccucgucgagaagaucgucuaccacuccaaguacaagcccaagcgccucggcaacgacaucgcccucaugaagcucgccggcccccucaccuucaacgagaugauccagcccgucugccuccccaacuccgaggagaacuuccccgacggcaaggucugcuggaccuccggcuggggcgccaccgaggacggcggcgacgccucccccguccucaaccacgccgccgucccccucaucuccaacaagaucugcaaccaccgcgacgucuacggcggcaucaucucccccuccaugcucugcgccggcuaccucaccggcggcgucgacuccugccagggcgacuccggcggcccccucgucugccaggagcgccgccucuggaagcucgucggcgccaccuccuucggcaucggcugcgccgaggucaacaagcccggcgucuacacccgcgucaccuccuuccucgacuggauccacgagcagauggagcgcgaccucaagaccuga

SEQ ID NO: 50938 - RNA, 1299 nt, Artificial Sequence
  derived and/or modified sequence opt2 from TMPRSS4__Homo_sapiens__NP_001077416
augcuccaggaccccgacuccgaccagccccucaacucccucgacgucaagccccuccgcaagccccgcauccccauggagaccuuccgcaaggucggcauccccaucaucaucgcccuccucucccucgccuccaucaucaucgucgucguccucaucaaggucauccucgacaaguacuacuuccucugcggccagccccuccacuucaucccccgcaagcagcucugcgacggcgagcucgacugcccccucggcgaggacgaggagcacugcgucaaguccuuccccgagggccccgccgucgccguccgccucuccaaggaccgcuccacccuccagguccucgacuccgccaccggcaacugguucuccgccugcuucgacaacuucaccgaggcccucgccgagaccgccugccgccagaugggcuacucccgcgccgucgagaucggccccgaccaggaccucgacgucgucgagaucaccgagaacucccaggagcuccgcaugcgcaacuccuccggccccugccucuccggcucccucgucucccuccacugccucgccugcggcaagucccucaagaccccccgcgucgucggcggcgaggaggccuccgucgacuccuggcccuggcaggucuccauccaguacgacaagcagcacgucugcggcggcuccauccucgacccccacuggguccucaccgccgcccacugcuuccgcaagcacaccgacgucuucaacuggaagguccgcgccggcuccgacaagcucggcuccuuccccucccucgccgucgccaagaucaucaucaucgaguucaaccccauguaccccaaggacaacgacaucgcccucaugaagcuccaguucccccucaccuucuccggcaccguccgccccaucugccuccccuucuucgacgaggagcucacccccgccaccccccucuggaucaucggcuggggcuucaccaagcagaacggcggcaagauguccgacauccuccuccaggccuccguccaggucaucgacuccacccgcugcaacgccgacgacgccuaccagggcgaggucaccgagaagaugaugugcgccggcauccccgagggcggcgucgacaccugccagggcgacuccggcggcccccucauguaccaguccgaccaguggcacgucgucggcaucgucuccuggggcuacggcugcggcggccccuccacccccggcgucuacaccaaggucuccgccuaccucaacuggaucuacaacgucuggaaggccgagcucuga

SEQ ID NO: 50939 - RNA, 2436 nt, Artificial Sequence
  derived and/or modified sequence opt2 from TMPRSS6__Homo_sapiens__NP_705837
augcuccuccucuuccacuccaagcgcaugcccgucgccgaggccccccaggucgccggcggccagggcgacggcggcgacggcgaggaggccgagcccgagggcauguucaaggccugcgaggacuccaagcgcaaggcccgcggcuaccuccgccucgucccccucuucguccuccucgcccuccucguccucgccuccgccggcguccuccucugguacuuccucggcuacaaggccgaggucauggucucccaggucuacuccggcucccuccgcguccucaaccgccacuucucccaggaccucacccgccgcgaguccuccgccuuccgcuccgagaccgccaaggcccagaagaugcucaaggagcucaucaccuccacccgccucggcaccuacuacaacuccuccuccgucuacuccuucggcgagggcccccucaccugcuucuucugguucauccuccagauccccgagcaccgccgccucaugcucucccccgaggucguccaggcccuccucgucgaggagcuccucuccaccgucaacuccuccgccgccguccccuaccgcgccgaguacgaggucgaccccgagggccucgucauccucgaggccuccgucaaggacaucgccgcccucaacuccacccucggcugcuaccgcuacuccuacgucggccagggccagguccuccgccucaagggccccgaccaccucgccuccuccugccucuggcaccuccagggccccaaggaccucaugcucaagcuccgccucgaguggacccucgccgagugccgcgaccgccucgccauguacgacgucgccggcccccucgagaagcgccucaucaccuccgucuacggcugcucccgccaggagcccgucgucgagguccucgccuccggcgccaucauggccgucgucuggaagaagggccuccacuccuacuacgaccccuucguccucuccguccagcccgucgucuuccaggccugcgaggucaaccucacccucgacaaccgccucgacucccagggcguccucuccacccccuacuuccccuccuacuacuccccccagacccacugcuccuggcaccucaccguccccucccucgacuacggccucgcccucugguucgacgccuacgcccuccgccgccagaaguacgaccuccccugcacccagggccaguggaccauccagaaccgccgccucugcggccuccgcauccuccagcccuacgccgagcgcauccccgucgucgccaccgccggcaucaccaucaacuucaccucccagaucucccucaccggccccggcguccgcguccacuacggccucuacaaccaguccgaccccugccccggcgaguuccucugcuccgucaacggccucugcguccccgccugcgacggcgucaaggacugccccaacggccucgacgagcgcaacugcgucugccgcgccaccuuccagugcaaggaggacuccaccugcaucucccuccccaaggucugcgacggccagcccgacugccucaacggcuccgacgaggagcagugccaggagggcguccccugcggcaccuucaccuuccagugcgaggaccgcuccugcgucaagaagcccaacccccagugcgacggccgccccgacugccgcgacggcuccgacgaggagcacugcgacugcggccuccagggccccuccucccgcaucgucggcggcgccgucuccuccgagggcgaguggcccuggcaggccucccuccagguccgcggccgccacaucugcggcggcgcccucaucgccgaccgcugggucaucaccgccgcccacugcuuccaggaggacuccauggccuccaccguccucuggaccgucuuccucggcaaggucuggcagaacucccgcuggcccggcgaggucuccuucaaggucucccgccuccuccuccaccccuaccacgaggaggacucccacgacuacgacgucgcccuccuccagcucgaccaccccgucguccgcuccgccgccguccgccccgucugccuccccgcccgcucccacuucuucgagcccggccuccacugcuggaucaccggcuggggcgcccuccgcgagggcggccccaucuccaacgcccuccagaaggucgacguccagcucaucccccaggaccucugcuccgaggucuaccgcuaccaggucaccccccgcaugcucugcgccggcuaccgcaagggcaagaaggacgccugccagggcgacuccggcggcccccucgucugcaaggcccucuccggccgcugguuccucgccggccucgucuccuggggccucggcugcggccgccccaacuacuucggcgucuacacccgcaucaccggcgucaucuccuggauccagcaggucgucaccuga

SEQ ID NO: 50940 - RNA, 2154 nt, Artificial Sequence
  derived and/or modified sequence opt2 from TMPRSS7__Homo_sapiens__NP_001036040
auguuccgcaucaccaacaucgaguuccuccccgaguaccgccagaaggagucccgcgaguuccucuccgucucccgcaccguccagcaggucaucaaccucgucuacaccaccuccgccuucuccaaguucuacgagcaguccgucgucgccgacgucuccaacaacaagggcggccuccucguccacuucuggaucgucuucgucaugccccgcgccaagggccacaucuucugcgaggacugcgucgccgccauccucaaggacuccauccagaccuccaucaucaaccgcaccuccgucggcucccuccagggccucgccgucgacauggacuccgucguccucaacgacaagggcugcucccaguacuucuacgccgagcaccucucccuccacuacccccucgagaucuccgccgccuccggccgccucaugugccacuucaagcucgucgccaucgucggcuaccucauccgccucuccaucaaguccauccagaucgaggccgacaacugcgucaccgacucccucaccaucuacgacucccuccuccccauccgcuccuccauccucuaccgcaucugcgagcccacccgcacccucauguccuucgucuccaccaacaaccucaugcucgucaccuucaaguccccccacauccgccgccucuccggcauccgcgccuacuucgaggucauccccgagcagaagugcgagaacaccguccucgucaaggacaucaccggcuucgagggcaagaucuccucccccuacuaccccuccuacuacccccccaagugcaagugcaccuggaaguuccagaccucccucuccacccucggcaucgcccucaaguucuacaacuacuccaucaccaagaaguccaugaagggcugcgagcacggcuggugggagaucaacgagcacauguacugcggcuccuacauggaccaccagaccaucuuccgcguccccuccccccucguccacauccagcuccagugcuccucccgccucuccgacaagccccuccucgccgaguacggcuccuacaacaucucccagcccugccccgucggcuccuuccgcugcuccuccggccucugcgucccccaggcccagcgcugcgacggcgucaacgacugcuucgacgaguccgacgagcucuucugcgucuccccccagcccgccugcaacaccuccuccuuccgccagcacggcccccucaucugcgacggcuuccgcgacugcgagaacggccgcgacgagcagaacugcacccaguccauccccugcaacaaccgcaccuucaagugcggcaacgacaucugcuuccgcaagcagaacgccaagugcgacggcaccgucgacugccccgacggcuccgacgaggagggcugcaccugcucccgcuccuccuccgcccuccaccgcaucaucggcggcaccgacacccucgagggcggcuggcccuggcaggucucccuccacuucgucggcuccgccuacugcggcgccuccgucaucucccgcgaguggcuccucuccgccgcccacugcuuccacggcaaccgccucuccgaccccacccccuggaccgcccaccucggcauguacguccagggcaacgccaaguucgucucccccguccgccgcaucgucguccacgaguacuacaacucccagaccuucgacuacgacaucgcccuccuccagcucuccaucgccuggcccgagacccucaagcagcucauccagcccaucugcaucccccccaccggccagcgcguccgcuccggcgagaagugcugggucaccggcuggggccgccgccacgaggccgacaacaagggcucccucguccuccagcaggccgaggucgagcucaucgaccagacccucugcgucuccaccuacggcaucaucaccucccgcaugcucugcgccggcaucauguccggcaagcgcgacgccugcaagggcgacuccggcggcccccucuccugccgccgcaaguccgacggcaaguggauccucaccggcaucgucuccuggggccacggcuccggccgccccaacuuccccggcgucuacacccgcgucuccaacuucguccccuggauccacaaguacguccccucccuccucuga

SEQ ID NO: 50941 - RNA, 3180 nt, Artificial Sequence
  derived and/or modified sequence opt2 from TMPRSS9__Homo_sapiens__NP_892018
auggagcccaccgucgccgacguccaccucgucccccgcaccaccaaggagguccccgcccucgacgccgccugcugccgcgccgccuccaucggcgucgucgccaccucccucgucguccucacccucggcguccuccucgccuuccucuccacccagggcuuccacgucgaccacaccgccgagcuccgcggcauccgcuggaccuccucccuccgccgcgagaccuccgacuaccaccgcacccucacccccacccucgaggcccuccuccacuuccuccuccgcccccuccagacccucucccucggccucgaggaggagcuccuccagcgcggcauccgcgcccgccuccgcgagcacggcaucucccucgccgccuacggcaccaucgucuccgccgagcucaccggccgccacaagggcccccucgccgagcgcgacuucaaguccggccgcugccccggcaacuccuucuccugcggcaacucccagugcgucaccaaggucaaccccgagugcgacgaccaggaggacugcuccgacggcuccgacgaggcccacugcgagugcggccuccagcccgccuggcgcauggccggccgcaucgucggcggcauggaggccucccccggcgaguuccccuggcaggccucccuccgcgagaacaaggagcacuucugcggcgccgccaucaucaacgcccgcuggcucgucuccgccgcccacugcuucaacgaguuccaggaccccaccaagugggucgccuacgucggcgccaccuaccucuccggcuccgaggccuccaccguccgcgcccaggucguccagaucgucaagcacccccucuacaacgccgacaccgccgacuucgacgucgccguccucgagcucaccuccccccuccccuucggccgccacauccagcccgucugccuccccgccgccacccacaucuucccccccuccaagaagugccucaucuccggcuggggcuaccucaaggaggacuuccucgucaagcccgagguccuccagaaggccaccgucgagcuccucgaccaggcccucugcgccucccucuacggccacucccucaccgaccgcauggucugcgccggcuaccucgacggcaaggucgacuccugccagggcgacuccggcggcccccucgucugcgaggagcccuccggccgcuucuuccucgccggcaucgucuccuggggcaucggcugcgccgaggcccgccgccccggcgucuacgcccgcgucacccgccuccgcgacuggauccucgaggccaccaccaaggccuccaugccccucgcccccaccauggcccccgcccccgccgcccccuccaccgccuggcccaccucccccgagucccccgucgucuccacccccaccaaguccaugcaggcccucuccaccgucccccucgacugggucaccguccccaagcuccaggagugcggcgcccgccccgccauggagaagcccacccgcgucgucggcggcuucggcgccgccuccggcgagguccccuggcaggucucccucaaggagggcucccgccacuucugcggcgccaccgucgucggcgaccgcuggcuccucuccgccgcccacugcuucaaccacaccaaggucgagcagguccgcgcccaccucggcaccgccucccuccucggccucggcggcucccccgucaagaucggccuccgccgcgucguccuccacccccucuacaaccccggcauccucgacuucgaccucgccguccucgagcucgccuccccccucgccuucaacaaguacauccagcccgucugccucccccucgccauccagaaguuccccgucggccgcaagugcaugaucuccggcuggggcaacacccaggagggcaacgccaccaagcccgagcuccuccagaaggccuccgucggcaucaucgaccagaagaccugcuccguccucuacaacuucucccucaccgaccgcaugaucugcgccggcuuccucgagggcaaggucgacuccugccagggcgacuccggcggcccccucgccugcgaggaggcccccggcgucuucuaccucgccggcaucgucuccuggggcaucggcugcgcccaggucaagaagcccggcgucuacacccgcaucacccgccucaagggcuggauccucgagaucauguccucccagccccuccccauguccccccccuccaccacccgcaugcucgccaccaccuccccccgcaccaccgccggccucaccguccccggcgccacccccucccgccccacccccggcgccgccucccgcgucaccggccagcccgccaacuccacccucuccgccgucuccaccaccgcccgcggccagacccccuuccccgacgcccccgaggccaccacccacacccagcuccccgacugcggccucgcccccgccgcccucacccgcaucgucggcggcuccgccgccggccgcggcgaguggcccuggcaggucucccucuggcuccgccgccgcgagcaccgcugcggcgccguccucgucgccgagcgcuggcuccucuccgccgcccacugcuucgacgucuacggcgaccccaagcagugggccgccuuccucggcacccccuuccucuccggcgccgagggccagcucgagcgcgucgcccgcaucuacaagcaccccuucuacaaccucuacacccucgacuacgacgucgcccuccucgagcucgccggccccguccgccgcucccgccucguccgccccaucugccuccccgagcccgccccccgcccccccgacggcacccgcugcgucaucaccggcuggggcuccguccgcgagggcggcuccauggcccgccagcuccagaaggccgccguccgccuccucuccgagcagaccugccgccgcuucuaccccguccagaucuccucccgcaugcucugcgccggcuucccccagggcggcgucgacuccugcuccggcgacgccggcggcccccucgccugccgcgagcccuccggccgcuggguccucaccggcgucaccuccuggggcuacggcugcggccgcccccacuuccccggcgucuacacccgcgucgccgccguccgcggcuggaucggccagcacauccaggaguga

SEQ ID NO: 50942 - RNA, 135 nt, Artificial Sequence
  derived and/or modified sequence opt2 from TMSB10__Homo_sapiens__NP_066926
auggccgacaagcccgacaugggcgagaucgccuccuucgacaaggccaagcucaagaagaccgagacccaggagaagaacacccuccccaccaaggagaccaucgagcaggagaagcgcuccgagaucuccuga

SEQ ID NO: 50943 - RNA, 138 nt, Artificial Sequence
  derived and/or modified sequence opt2 from TMSB15B__Homo_sapiens__NP_919305
auguccgacaagcccgaccucuccgaggucgagaaguucgaccgcuccaagcucaagaagaccaacaccgaggagaagaacacccuccccuccaaggagaccauccagcaggagaaggagugcguccagaccuccuga

SEQ ID NO: 50944 - RNA, 135 nt, Artificial Sequence
  derived and/or modified sequence opt2 from TMSB4X__Homo_sapiens__NP_066932
auguccgacaagcccgacauggccgagaucgagaaguucgacaaguccaagcucaagaagaccgagacccaggagaagaacccccuccccuccaaggagaccaucgagcaggagaagcaggccggcgaguccuga

SEQ ID NO: 50945 - RNA, 2649 nt, Artificial Sequence
  derived and/or modified sequence opt2 from TMTC1__Homo_sapiens__NP_001180380
auggucgucaccaccuccgcccgcggcggcggcggcgaccgcacccccucccgccgccgcggcugcggccucgcccccgccggcgccgccgcccuccucgccggcgccuccugccucugcuacggccgcucccuccagggcgaguucguccacgacgacgucugggccaucgucaacaaccccgacguccgccccggcgccccccuccgcuggggcaucuucaccaacgacuucuggggcaagggcauggccgagaacaccucccacaaguccuaccgcccccucugcguccucaccuucaagcucaacaucuuccucaccggcaugaaccccuucuacuuccacgccgucaacaucauccuccacugccucgucacccucguccucauguacaccugcgacaagaccgucuucaagaaccgcggccucgccuucgucaccgcccuccucuucgccguccaccccauccacaccgaggccgucgccggcaucgucggccgcgccgacguccucgccugccuccucuuccuccucgccuuccucuccuacaaccgcucccucgaccagggcugcgucggcggcuccuuccccuccaccgucucccccuucuuccuccuccucucccucuuccucggcaccugcgccaugcucgucaaggagaccggcaucaccgucuucggcgucugccucgucuacgaccucuucucccucuccaacaagcaggacaaguccuccaacggcgcccucugcccccgcuccccccagcagcccggcuccccccagcccuccucccuccccggccacccccaccgcgagaacggcaagcagcagcgcuucccccacaagggcgccuggggcggcugccacuccccccucccccccgagcccaaguccuccggcuuccccgucuccccccgcgccgucugguccaugaugcgcuuccucaccuacuccuaccuccucgccuucaacgucuggcuccuccucgcccccgucacccucugcuacgacuggcaggucggcuccaucccccucgucgagaccaucugggacaugcgcaaccucgccaccaucuuccucgccgucgucauggcccuccucucccuccacugccucgccgccuucaagcgccucgagcacaaggagguccucgucggccuccucuuccucgucuuccccuucauccccgccuccaaccucuucuuccgcgucggcuucgucgucgccgagcgcguccucuacaugcccuccaugggcuacugcauccucuucguccacggccucuccaagcucugcaccuggcucaaccgcugcggcgccaccacccucaucgucuccaccguccuccuccuccuccucuucuccuggaagaccgucaagcagaacgagaucuggcucucccgcgagucccucuuccgcuccggcguccagacccucccccacaacgccaagguccacuacaacuacgccaacuuccucaaggaccagggccgcaacaaggaggccaucuaccacuaccgcaccgcccucaagcucuacccccgccacgccuccgcccucaacaaccucggcacccucacccgcgacaccgccgaggccaagauguacuaccagcgcgcccuccagcuccacccccagcacaaccgcgcccucuucaaccucggcaaccuccucaagucccaggagaagaaggaggaggccaucacccuccucaaggacuccaucaaguacggccccgaguucgccgacgccuacuccucccucgccucccuccucgccgagcaggagcgcuucaaggaggccgaggagaucuaccagaccggcaucaagaacugccccgacuccuccgaccuccacaacaacuacggcgucuuccucgucgacaccggccuccccgagaaggccgucgcccacuaccagcaggccaucaagcucucccccucccaccacgucgccauggucaaccucggccgccucuaccgcucccucggcgagaacuccauggccgaggagugguacaagcgcgcccuccaggucgcccacaaggccgagauccucuccccccucggcgcccucuacuacaacaccggccgcuacgaggaggcccuccagaucuaccaggaggccgccgcccuccagcccucccagcgcgagcuccgccucgcccucgcccagguccucgccgucaugggccagaccaaggaggccgagaagaugaccaaccacaucgucuccgaggagaccggcugccucgagugcuaccgccuccucuccgccaucuacuccaagcaggagaaccacgacaaggcccucgacgccaucgacaaggcccuccagcucaagcccaaggaccccaaggucaucuccgagcucuucuucaccaagggcaaccagcuccgcgagcagaaccuccucgacaaggccuucgaguccuaccgcgucgccguccagcucaaccccgaccaggcccaggccuggaugaacaugggcggcauccagcacaucaagggcaaguacgucuccgcccgcgccuacuacgagcgcgcccuccagcucguccccgacuccaagcuccucaaggagaaccucgccaagcucgaccgccucgagaagcgccuccaggagguccgcgagaaggaccagaccuga

SEQ ID NO: 50946 - RNA, 2511 nt, Artificial Sequence
  derived and/or modified sequence opt2 from TMTC2__Homo_sapiens__NP_689801
augaucgccgagcucgucuccuccgcccucggccucgcccucuaccucaacacccucuccgccgacuucugcuacgacgacucccgcgccaucaagaccaaccaggaccuccuccccgagacccccuggacccacaucuucuacaacgacuucuggggcacccuccucacccacuccggcucccacaaguccuaccgcccccucugcacccucuccuuccgccucaaccacgccaucggcggccucaaccccugguccuaccaccucgucaacguccuccuccacgccgccgucaccggccucuucaccuccuucuccaagauccuccucggcgacggcuacuggaccuucauggccggccucauguucgccucccaccccauccacaccgaggccgucgccggcaucgucggccgcgccgacgucggcgccucccucuucuuccuccucucccuccucugcuacaucaagcacugcuccacccgcggcuacuccgcccgcaccuggggcugguuccucggcuccggccucugcgccggcugcuccaugcucuggaaggagcagggcgucaccguccucgccgucuccgccgucuacgacgucuucgucuuccaccgccucaagaucaagcagauccuccccaccaucuacaagcgcaagaaccucucccucuuccucuccaucucccuccucaucuucuggggcuccucccuccucggcgcccgccucuacuggaugggcaacaagccccccuccuucuccaacuccgacaaccccgccgccgacuccgacucccuccucacccgcacccucaccuucuucuaccuccccaccaagaaccucuggcuccuccucugccccgacacccucuccuucgacugguccauggacgccgucccccuccucaagaccgucugcgacuggcgcaaccuccacaccgucgccuucuacaccggccuccuccuccucgccuacuacggccucaagucccccuccgucgaccgcgagugcaacggcaagaccgucaccaacggcaagcagaacgccaacggccacuccugccucuccgacgucgaguaccagaacuccgagaccaaguccuccuucgccuccaaggucgagaacggcaucaagaacgacgucucccagcgcacccagcuccccuccaccgagaacaucgucguccucucccucucccuccucaucauccccuucguccccgccaccaaccucuucuucuacgucggcuucgucaucgccgagcgcguccucuacauccccuccaugggcuucugccuccucaucaccgucggcgcccgcgcccucuacgucaagguccagaagcgcuuccucaagucccucaucuucuacgccaccgccacccucaucgucuucuacggccucaagaccgccauccgcaacggcgacuggcagaacgaggagaugcucuaccgcuccggcaucaaggucaaccccgccaaggccuggggcaaccucggcaacguccucaagucccaguccaagaucuccgaggccgaguccgccuaccgcaacgcccucuacuaccgcuccaacauggccgacaugcucuacaaccucggccuccuccuccaggagaacucccgcuucgccgaggcccuccacuacuacaagcucgccaucggcucccgccccacccucgccuccgccuaccucaacaccggcaucauccucaugaaccagggccgcaccgaggaggcccgccgcaccuuccucaagugcuccgagauccccgacgagaaccucaaggacccccacgcccacaaguccuccgucaccuccugccucuacaaccucggcaagcucuaccacgagcagggccacuacgaggaggcccucuccgucuacaaggaggccauccagaagaugccccgccaguucgccccccagucccucuacaacaugaugggcgaggccuacaugcgccucuccaagcuccccgaggccgagcacugguacauggagucccuccgcuccaagaccgaccacauccccgcccaccucaccuacggcaagcuccucgcccucaccggccgcaaguccgaggccgagaagcucuuccucaaggccaucgagcucgaccccaccaagggcaacugcuacaugcacuacggccaguuccuccucgaggaggcccgccucaucgaggccgccgagauggccaagaaggccgccgagcucgacuccaccgaguucgacgucgucuucaacgccgcccacaugcuccgccaggccucccucaacgaggccgccgagaaguacuacgaccucgccgcccgccuccgccccaacuaccccgccgcccucaugaaccucggcgccauccuccaccucaacggccgccuccagaaggccgaggccaacuaccuccgcgcccuccagcucaagcccgacgacgucaucacccaguccaaccuccgcaagcucuggaacaucauggagaagcagggccucaagaccuccaagaccuga

SEQ ID NO: 50947 - RNA, 2745 nt, Artificial Sequence
  derived and/or modified sequence opt2 from TMTC3__Homo_sapiens__NP_861448
auggccaacaucaaccucaaggagaucacccucaucgucggcgucgucaccgccugcuacuggaacucccucuucugcggcuucgucuucgacgacgucuccgccauccucgacaacaaggaccuccaccccuccaccccccucaagacccucuuccagaacgacuucuggggcacccccauguccgaggagcgcucccacaaguccuaccgcccccucaccguccucaccuuccgccucaacuaccuccucuccgagcucaagcccauguccuaccaccuccucaacaugaucuuccacgccgucgucuccgucaucuuccucaaggucugcaagcucuuccucgacaacaaguccuccgucaucgccucccuccucuucgccguccaccccauccacaccgaggccgucaccggcgucgucggccgcgccgagcuccucuccuccaucuucuuccucgccgccuuccucuccuacacccgcuccaagggccccgacaacuccaucaucuggacccccaucgcccucaccgucuuccucgucgccgucgccacccucugcaaggagcagggcaucaccgucgucggcaucugcugcgucuacgaggucuucaucgcccagggcuacacccucccccuccucugcaccaccgccggccaguuccuccgcggcaagggcuccauccccuucuccaugcuccagacccucgucaagcucaucguccucauguucuccacccuccuccucgucgucauccgcguccaggucauccagucccagcuccccgucuucacccgcuucgacaaccccgccgccgucucccccacccccacccgccagcucaccuucaacuaccuccuccccgucaacgccuggcuccuccucaaccccuccgagcucugcugcgacuggaccaugggcaccaucccccucaucgagucccuccucgacauccgcaaccucgccaccuucaccuucuucugcuuccucggcaugcucggcgucuucuccauccgcuacuccggcgacuccuccaagaccguccucauggcccucugccucauggcccuccccuucauccccgccuccaaccucuucuuccccgucggcuucgucgucgccgagcgcguccucuacguccccuccaugggcuucugcauccucgucgcccacggcuggcagaagaucuccaccaaguccgucuucaagaagcucuccuggaucugccucuccauggucauccucacccacucccucaagaccuuccaccgcaacugggacugggaguccgaguacacccucuucauguccgcccucaaggucaacaagaacaacgccaagcucuggaacaacgucggccacgcccucgagaacgagaagaacuucgagcgcgcccucaaguacuuccuccaggccacccacguccagcccgacgacaucggcgcccacaugaacgucggccgcaccuacaagaaccucaaccgcaccaaggaggccgaggaguccuacaugauggccaagucccucaugccccagaucauccccggcaagaaguacgccgcccgcaucgcccccaaccaccucaacgucuacaucaaccucgccaaccucauccgcgccaacgagucccgccucgaggaggccgaccagcucuaccgccaggccaucuccaugcgccccgacuucaagcaggccuacaucucccgcggcgagcuccuccucaagaugaacaagccccucaaggccaaggaggccuaccucaaggcccucgagcucgaccgcaacaacgccgaccucugguacaaccucgccaucguccacaucgagcucaaggagcccaacgaggcccucaagaacuucaaccgcgcccucgagcucaaccccaagcacaagcucgcccucuucaacuccgccaucgucaugcaggaguccggcgaggucaagcuccgccccgaggcccgcaagcgccuccucuccuacaucaacgaggagccccucgacgccaacggcuacuucaaccucggcaugcucgccauggacgacaagaaggacaacgaggccgagaucuggaugaagaaggccaucaagcuccaggccgacuuccgcuccgcccucuucaaccucgcccuccucuacucccagaccgccaaggagcucaaggcccuccccauccucgaggagcuccuccgcuacuaccccgaccacaucaagggccucauccucaagggcgacauccucaugaaccagaagaaggacauccucggcgccaagaagugcuucgagcgcauccucgagauggaccccuccaacguccagggcaagcacaaccucugcgucgucuacuucgaggagaaggaccuccucaaggccgagcgcugccuccucgagacccucgcccucgccccccacgaggaguacauccagcgccaccucaacaucguccgcgacaagaucuccuccuccuccuucaucgagcccaucuuccccaccuccaagaucuccuccgucgagggcaagaagauccccaccgaguccgucaaggagauccgcggcgagucccgccagacccagaucgucaagaccuccgacaacaagucccaguccaaguccaacaagcagcucggcaagaacggcgacgaggagaccccccacaagaccaccaaggacaucaaggagaucgagaagaagcgcgucgccgcccucaagcgccucgaggagaucgagcgcauccucaacggcgaguga

SEQ ID NO: 50948 - RNA, 843 nt, Artificial Sequence
  derived and/or modified sequence opt2 from TMX1__Homo_sapiens__NP_110382
auggcccccuccggcucccucgccgucccccucgccguccucguccuccuccucuggggcgcccccuggacccacggccgccgcuccaacguccgcgucaucaccgacgagaacuggcgcgagcuccucgagggcgacuggaugaucgaguucuacgcccccuggugccccgccugccagaaccuccagcccgagugggaguccuucgccgaguggggcgaggaccucgaggucaacaucgccaaggucgacgucaccgagcagcccggccucuccggccgcuucaucaucaccgcccuccccaccaucuaccacugcaaggacggcgaguuccgccgcuaccagggcccccgcaccaagaaggacuucaucaacuucaucuccgacaaggaguggaaguccaucgagcccgucuccuccugguucggccccggcuccguccucauguccuccauguccgcccucuuccagcucuccauguggauccgcaccugccacaacuacuucaucgaggaccucggccuccccgucuggggcuccuacaccgucuucgcccucgccacccucuucuccggccuccuccucggccucugcaugaucuucgucgccgacugccucugccccuccaagcgccgccgcccccagcccuaccccuaccccuccaagaagcuccucuccgaguccgcccagccccucaagaaggucgaggaggagcaggaggccgacgaggaggacgucuccgaggaggaggccgaguccaaggagggcaccaacaaggacuucccccagaacgccauccgccagcgcucccucggccccucccucgccaccgacaaguccuga

SEQ ID NO: 50949 - RNA, 777 nt, Artificial Sequence
  derived and/or modified sequence opt2 from TMX2__Homo_sapiens__NP_001137484
auggccguccucgccccccucaucgcccucgucuacuccgucccccgccucucccgcuggcucgcccagcccuacuaccuccucuccgcccuccucuccgccgccuuccuccucguccgcaagcuccccccccucugccacggccuccccacccagcgcgaggacggcaaccccugcgacuucgacuggcgcgaggucgagauccucauguuccucuccgccaucgucaugaugaagaaccgccgcuccauguuccucaugaccugcaagcccccccucuacaugggccccgaguacaucaaguacuucaacgacaagaccaucgacgaggagcucgagcgcgacaagcgcgucaccuggaucgucgaguucuucgccaacugguccaacgacugccaguccuucgcccccaucuacgccgaccucucccucaaguacaacugcaccggccucaacuucggcaaggucgacgucggccgcuacaccgacgucuccacccgcuacaaggucuccaccuccccccucaccaagcagcuccccacccucauccucuuccagggcggcaaggaggccaugcgccgcccccagaucgacaagaagggccgcgccgucuccuggaccuucuccgaggagaacgucauccgcgaguucaaccucaacgagcucuaccagcgcgccaagaagcucuccaaggccggcgacaacauccccgaggagcagcccgucgccuccacccccaccaccgucuccgacggcgagaacaagaaggacaaguga

SEQ ID NO: 50950 - RNA, 1365 nt, Artificial Sequence
  derived and/or modified sequence opt2 from TMX3__Homo_sapiens__NP_061895
auggccgccuggaaguccuggaccgcccuccgccucugcgccaccgucgucguccucgacauggucgucugcaagggcuucgucgaggaccucgacgaguccuucaaggagaaccgcaacgacgacaucuggcucgucgacuucuacgcccccuggugcggccacugcaagaagcucgagcccaucuggaacgaggucggccucgagaugaaguccaucggcucccccgucaaggucggcaagauggacgccaccuccuacuccuccaucgccuccgaguucggcguccgcggcuaccccaccaucaagcuccucaagggcgaccucgccuacaacuaccgcggcccccgcaccaaggacgacaucaucgaguucgcccaccgcgucuccggcgcccucauccgcccccuccccucccagcagauguucgagcacaugcagaagcgccaccgcgucuucuucgucuacgucggcggcgaguccccccucaaggagaaguacaucgacgccgccuccgagcucaucgucuacaccuacuucuucuccgccuccgaggaggucguccccgaguacgucacccucaaggagaugcccgccguccucgucuucaaggacgagaccuacuucgucuacgacgaguacgaggacggcgaccucuccuccuggaucaaccgcgagcgcuuccagaacuaccucgccauggacggcuuccuccucuacgagcucggcgacaccggcaagcucgucgcccucgccgucaucgacgagaagaacaccuccgucgagcacacccgccucaaguccaucauccaggaggucgcccgcgacuaccgcgaccucuuccaccgcgacuuccaguucggccacauggacggcaacgacuacaucaacacccuccucauggacgagcucaccguccccaccgucgucguccucaacaccuccaaccagcaguacuuccuccucgaccgccagaucaagaacgucgaggacaugguccaguucaucaacaacauccucgacggcaccgucgaggcccagggcggcgacuccauccuccagcgccucaagcgcaucgucuucgacgccaaguccaccaucgucuccaucuucaaguccuccccccucaugggcugcuuccucuucggccucccccucggcgucaucuccaucaugugcuacggcaucuacaccgccgacaccgacggcggcuacaucgaggagcgcuacgaggucuccaaguccgagaacgagaaccaggagcagaucgaggaguccaaggagcagcaggagcccuccuccggcggcuccgucguccccaccguccaggagcccaaggacguccucgagaagaagaaggacuga

SEQ ID NO: 50951 - RNA, 6606 nt, Artificial Sequence
  derived and/or modified sequence opt2 from TNC__Homo_sapiens__NP_002151
augggcgccaugacccagcuccucgccggcgucuuccucgccuuccucgcccucgccaccgagggcggcguccucaagaaggucauccgccacaagcgccaguccggcgucaacgccacccuccccgaggagaaccagcccgucgucuucaaccacgucuacaacaucaagcuccccgucggcucccagugcuccgucgaccucgaguccgccuccggcgagaaggaccucgccccccccuccgagcccuccgaguccuuccaggagcacaccgucgacggcgagaaccagaucgucuucacccaccgcaucaacaucccccgccgcgccugcggcugcgccgccgcccccgacgucaaggagcuccucucccgccucgaggagcucgagaaccucgucuccucccuccgcgagcagugcaccgccggcgccggcugcugccuccagcccgccaccggccgccucgacacccgccccuucugcuccggccgcggcaacuucuccaccgagggcugcggcugcgucugcgagcccggcuggaagggccccaacugcuccgagcccgagugccccggcaacugccaccuccgcggccgcugcaucgacggccagugcaucugcgacgacggcuucaccggcgaggacugcucccagcucgccugccccuccgacugcaacgaccagggcaagugcgucaacggcgucugcaucugcuucgagggcuacgccggcgccgacugcucccgcgagaucugccccguccccugcuccgaggagcacggcaccugcgucgacggccucugcgucugccacgacggcuucgccggcgacgacugcaacaagccccucugccucaacaacugcuacaaccgcggccgcugcgucgagaacgagugcgucugcgacgagggcuucaccggcgaggacugcuccgagcucaucugccccaacgacugcuucgaccgcggccgcugcaucaacggcaccugcuacugcgaggagggcuucaccggcgaggacugcggcaagcccaccugcccccacgccugccacacccagggccgcugcgaggagggccagugcgucugcgacgagggcuucgccggcgucgacugcuccgagaagcgcugccccgccgacugccacaaccgcggccgcugcgucgacggccgcugcgagugcgacgacggcuucaccggcgccgacugcggcgagcucaagugccccaacggcugcuccggccacggccgcugcgucaacggccagugcgucugcgacgagggcuacaccggcgaggacugcucccagcuccgcugccccaacgacugccacucccgcggccgcugcgucgagggcaagugcgucugcgagcagggcuucaagggcuacgacugcuccgacauguccugccccaacgacugccaccagcacggccgcugcgucaacggcaugugcgucugcgacgacggcuacaccggcgaggacugccgcgaccgccagugcccccgcgacugcuccaaccgcggccucugcgucgacggccagugcgucugcgaggacggcuucaccggccccgacugcgccgagcucuccugccccaacgacugccacggccagggccgcugcgucaacggccagugcgucugccacgagggcuucaugggcaaggacugcaaggagcagcgcugccccuccgacugccacggccagggccgcugcgucgacggccagugcaucugccacgagggcuucaccggccucgacugcggccagcacuccugccccuccgacugcaacaaccucggccagugcgucuccggccgcugcaucugcaacgagggcuacuccggcgaggacugcuccgaggucuccccccccaaggaccucgucgucaccgaggucaccgaggagaccgucaaccucgccugggacaacgagaugcgcgucaccgaguaccucgucgucuacacccccacccacgagggcggccucgagaugcaguuccgcguccccggcgaccagaccuccaccaucauccaggagcucgagcccggcgucgaguacuucauccgcgucuucgccauccucgagaacaagaaguccauccccgucuccgcccgcgucgccaccuaccuccccgcccccgagggccucaaguucaaguccaucaaggagaccuccgucgaggucgagugggacccccucgacaucgccuucgagaccugggagaucaucuuccgcaacaugaacaaggaggacgagggcgagaucaccaagucccuccgccgccccgagaccuccuaccgccagaccggccucgcccccggccaggaguacgagaucucccuccacaucgucaagaacaacacccgcggccccggccucaagcgcgucaccaccacccgccucgacgcccccucccagaucgaggucaaggacgucaccgacaccaccgcccucaucaccugguucaagccccucgccgagaucgacggcaucgagcucaccuacggcaucaaggacguccccggcgaccgcaccaccaucgaccucaccgaggacgagaaccaguacuccaucggcaaccucaagcccgacaccgaguacgaggucucccucaucucccgccgcggcgacauguccuccaaccccgccaaggagaccuucaccaccggccucgacgccccccgcaaccuccgccgcgucucccagaccgacaacuccaucacccucgaguggcgcaacggcaaggccgccaucgacuccuaccgcaucaaguacgcccccaucuccggcggcgaccacgccgaggucgacguccccaagucccagcaggccaccaccaagaccacccucaccggccuccgccccggcaccgaguacggcaucggcgucuccgccgucaaggaggacaaggaguccaaccccgccaccaucaacgccgccaccgagcucgacacccccaaggaccuccaggucuccgagaccgccgagaccucccucacccuccucuggaagaccccccucgccaaguucgaccgcuaccgccucaacuacucccuccccaccggccagugggucggcguccagcucccccgcaacaccaccuccuacguccuccgcggccucgagcccggccaggaguacaacguccuccucaccgccgagaagggccgccacaaguccaagcccgcccgcgucaaggccuccaccgagcaggcccccgagcucgagaaccucaccgucaccgaggucggcugggacggccuccgccucaacuggaccgccgccgaccaggccuacgagcacuucaucauccagguccaggaggccaacaaggucgaggccgcccgcaaccucaccguccccggcucccuccgcgccgucgacauccccggccucaaggccgccacccccuacaccgucuccaucuacggcgucauccagggcuaccgcacccccguccucuccgccgaggccuccaccggcgagacccccaaccucggcgaggucgucgucgccgaggucggcugggacgcccucaagcucaacuggaccgcccccgagggcgccuacgaguacuucuucauccagguccaggaggccgacaccgucgaggccgcccagaaccucaccguccccggcggccuccgcuccaccgaccuccccggccucaaggccgccacccacuacaccaucaccauccgcggcgucacccaggacuucuccaccaccccccucuccgucgagguccucaccgaggagguccccgacaugggcaaccucaccgucaccgaggucuccugggacgcccuccgccucaacuggaccacccccgacggcaccuacgaccaguucaccauccagguccaggaggccgaccaggucgaggaggcccacaaccucaccguccccggcucccuccgcuccauggagauccccggccuccgcgccggcacccccuacaccgucacccuccacggcgagguccgcggccacuccacccgcccccucgccgucgaggucgucaccgaggaccucccccagcucggcgaccucgccgucuccgaggucggcugggacggccuccgccucaacuggaccgccgccgacaacgccuacgagcacuucgucauccagguccaggaggucaacaaggucgaggccgcccagaaccucacccuccccggcucccuccgcgccgucgacauccccggccucgaggccgccacccccuaccgcgucuccaucuacggcgucauccgcggcuaccgcacccccguccucuccgccgaggccuccaccgccaaggagcccgagaucggcaaccucaacgucuccgacaucacccccgaguccuucaaccucuccuggauggccaccgacggcaucuucgagaccuucaccaucgagaucaucgacuccaaccgccuccucgagaccgucgaguacaacaucuccggcgccgagcgcaccgcccacaucuccggccucccccccuccaccgacuucaucgucuaccucuccggccucgcccccuccauccgcaccaagaccaucuccgccaccgccaccaccgaggcccucccccuccucgagaaccucaccaucuccgacaucaaccccuacggcuucaccgucuccuggauggccuccgagaacgccuucgacuccuuccucgucaccgucgucgacuccggcaagcuccucgacccccaggaguucacccucuccggcacccagcgcaagcucgagcuccgcggccucaucaccggcaucggcuacgaggucauggucuccggcuucacccagggccaccagaccaagccccuccgcgccgagaucgucaccgaggccgagcccgaggucgacaaccuccucgucuccgacgccacccccgacggcuuccgccucuccuggaccgccgacgagggcgucuucgacaacuucguccucaagauccgcgacaccaagaagcaguccgagccccucgagaucacccuccucgcccccgagcgcacccgcgacaucaccggccuccgcgaggccaccgaguacgagaucgagcucuacggcaucuccaagggccgccgcucccagaccgucuccgccaucgccaccaccgccaugggcucccccaaggaggucaucuucuccgacaucaccgagaacuccgccaccgucuccuggcgcgcccccaccgcccaggucgaguccuuccgcaucaccuacguccccaucaccggcggcacccccuccauggucaccgucgacggcaccaagacccagacccgccucgucaagcucauccccggcgucgaguaccucgucuccaucaucgccaugaagggcuucgaggaguccgagcccgucuccggcuccuucaccaccgcccucgacggccccuccggccucgucaccgccaacaucaccgacuccgaggcccucgcccgcuggcagcccgccaucgccaccgucgacuccuacgucaucuccuacaccggcgagaagguccccgagaucacccgcaccgucuccggcaacaccgucgaguacgcccucaccgaccucgagcccgccaccgaguacacccuccgcaucuucgccgagaagggcccccagaaguccuccaccaucaccgccaaguucaccaccgaccucgacuccccccgcgaccucaccgccaccgagguccaguccgagaccgcccuccucaccuggcgccccccccgcgccuccgucaccggcuaccuccucgucuacgaguccgucgacggcaccgucaaggaggucaucgucggccccgacaccaccuccuacucccucgccgaccucucccccuccacccacuacaccgccaagauccaggcccucaacggcccccuccgcuccaacaugauccagaccaucuucaccaccaucggccuccucuaccccuuccccaaggacugcucccaggccaugcucaacggcgacaccaccuccggccucuacaccaucuaccucaacggcgacaaggccgaggcccucgaggucuucugcgacaugaccuccgacggcggcggcuggaucgucuuccuccgccgcaagaacggccgcgagaacuucuaccagaacuggaaggccuacgccgccggcuucggcgaccgccgcgaggaguucuggcucggccucgacaaccucaacaagaucaccgcccagggccaguacgagcuccgcgucgaccuccgcgaccacggcgagaccgccuucgccgucuacgacaaguucuccgucggcgacgccaagacccgcuacaagcucaaggucgagggcuacuccggcaccgccggcgacuccauggccuaccacaacggccgcuccuucuccaccuucgacaaggacaccgacuccgccaucaccaacugcgcccucuccuacaagggcgccuucugguaccgcaacugccaccgcgucaaccucaugggccgcuacggcgacaacaaccacucccagggcgucaacugguuccacuggaagggccacgagcacuccauccaguucgccgagaugaagcuccgccccuccaacuuccgcaaccucgagggccgccgcaagcgcgccuga

SEQ ID NO: 50952 - RNA, 951 nt, Artificial Sequence
  derived and/or modified sequence opt2 from TNFAIP1__Homo_sapiens__NP_066960
auguccggcgacaccugccucugccccgccuccggcgccaagcccaagcucuccggcuucaagggcggcggccucggcaacaaguacguccagcucaacgucggcggcucccucuacuacaccaccguccgcgcccucacccgccacgacaccaugcucaaggccauguucuccggccgcauggagguccucaccgacaaggagggcuggauccucaucgaccgcugcggcaagcacuucggcaccauccucaacuaccuccgcgacgacaccaucacccucccccagaaccgccaggagaucaaggagcucauggccgaggccaaguacuaccucauccagggccucgucaacaugugccaguccgcccuccaggacaagaaggacuccuaccagcccgucugcaacauccccaucaucaccucccucaaggaggaggagcgccucaucgaguccuccaccaagcccgucgucaagcuccucuacaaccgcuccaacaacaaguacuccuacaccuccaacuccgacgaccaccuccucaagaacaucgagcucuucgacaagcucucccuccgcuucaacggccgcguccucuucaucaaggacgucaucggcgacgagaucugcugcugguccuucuacggccagggccgcaagcucgccgaggucugcugcaccuccaucgucuacgccaccgagaagaagcagaccaaggucgaguuccccgaggcccgcaucuacgaggagacccucaacguccuccucuacgagaccccccgcguccccgacaacucccuccucgaggccaccucccgcucccgcucccaggccucccccuccgaggacgaggagaccuucgagcuccgcgaccgcguccgccgcauccacgucaagcgcuacuccaccuacgacgaccgccagcucggccaccaguccacccaccgcgacuga

SEQ ID NO: 50953 - RNA, 1965 nt, Artificial Sequence
  derived and/or modified sequence opt2 from TNFAIP2__Homo_sapiens__NP_006282
auguccgaggccuccuccgaggaccucguccccccccucgaggccggcgccgcccccuaccgcgaggaggaggaggccgccaagaagaagaaggagaagaagaagaaguccaagggccucgccaacgucuucugcgucuucaccaagggcaagaagaagaagggccagcccuccuccgccgagcccgaggacgccgccggcucccgccagggccucgacggccccccccccaccgucgaggagcucaaggccgcccucgagcgcggccagcucgaggccgcccgcccccuccucgcccucgagcgcgagcucgccgccgccgccgccgccggcggcgucuccgaggaggagcucguccgccgccaguccaaggucgaggcccucuacgagcuccuccgcgaccagguccucggcguccuccgccgcccccucgaggccccccccgagcgccuccgccaggcccucgccgucgucgccgagcaggagcgcgaggaccgccaggccgccgccgccggccccggcaccuccggccucgccgccacccgcccccgccgcuggcuccagcucuggcgccgcggcgucgccgaggccgccgaggagcgcaugggccagcgccccgccgccggcgccgagguccccgaguccgucuuccuccaccucggccgcaccaugaaggaggaccucgaggccgucgucgagcgccucaagccccucuuccccgccgaguucggcgucgucgccgccuacgccgaguccuaccaccagcacuucgccgcccaccucgccgccgucgcccaguucgagcucugcgagcgcgacaccuacaugcuccuccucuggguccagaaccucuaccccaacgacaucaucaacucccccaagcucgucggcgagcuccagggcaugggccucggcucccuccuccccccccgccagauccgccuccucgaggccaccuuccucuccuccgaggccgccaacguccgcgagcucauggaccgcgcccucgagcucgaggcccgccgcugggccgaggacguccccccccagcgccucgacggccacugccacuccgagcucgccaucgacaucauccagaucaccucccaggcccaggccaaggccgaguccaucacccucgaccucggcucccagaucaagcgcguccuccucgucgagcuccccgccuuccuccgcuccuaccagcgcgccuucaacgaguuccucgagcgcggcaagcagcucaccaacuaccgcgccaacgucaucgccaacaucaacaacugccucuccuuccgcauguccauggagcagaacuggcaggucccccaggacacccucucccuccuccucggcccccucggcgagcucaagucccacggcuucgacacccuccuccagaaccuccacgaggaccucaagccccucuucaagcgcuucacccacacccgcugggccgcccccgucgagacccucgagaacaucaucgccaccgucgacacccgccuccccgaguucuccgagcuccagggcugcuuccgcgaggagcucauggaggcccuccaccuccaccucgucaaggaguacaucauccagcucuccaagggccgccucguccucaagaccgccgagcagcagcagcagcucgccggcuacauccucgccaacgccgacaccauccagcacuucugcacccagcacggcucccccgccaccuggcuccagcccgcccuccccacccucgccgagaucauccgccuccaggaccccuccgccaucaagaucgaggucgccaccuacgccaccugcuaccccgacuucuccaagggccaccucuccgccauccucgccaucaagggcaaccucuccaacuccgaggucaagcgcauccgcuccauccucgacgucuccaugggcgcccaggagcccucccgcccccucuucucccucaucaaggucggcuga

SEQ ID NO: 50954 - RNA, 2373 nt, Artificial Sequence
  derived and/or modified sequence opt2 from TNFAIP3__Homo_sapiens__NP_006281
auggccgagcagguccucccccaggcccucuaccucuccaacaugcgcaaggccgucaagauccgcgagcgcacccccgaggacaucuucaagcccaccaacggcaucauccaccacuucaagaccaugcaccgcuacacccucgagauguuccgcaccugccaguucugcccccaguuccgcgagaucauccacaaggcccucaucgaccgcaacauccaggccacccucgagucccagaagaagcucaacuggugccgcgagguccgcaagcucgucgcccucaagaccaacggcgacggcaacugccucaugcacgccaccucccaguacauguggggcguccaggacaccgaccucguccuccgcaaggcccucuucuccacccucaaggagaccgacacccgcaacuucaaguuccgcuggcagcucgagucccucaagucccaggaguucgucgagaccggccucugcuacgacacccgcaacuggaacgacgagugggacaaccucaucaagauggccuccaccgacacccccauggcccgcuccggccuccaguacaacucccucgaggagauccacaucuucguccucugcaacauccuccgccgccccaucaucgucaucuccgacaagaugcuccgcucccucgaguccggcuccaacuucgccccccucaaggucggcggcaucuaccucccccuccacuggcccgcccaggagugcuaccgcuaccccaucguccucggcuacgacucccaccacuucgucccccucgucacccucaaggacuccggccccgagauccgcgccgucccccucgucaaccgcgaccgcggccgcuucgaggaccucaagguccacuuccucaccgaccccgagaacgagaugaaggagaagcuccucaaggaguaccucauggucaucgagauccccguccagggcugggaccacggcaccacccaccucaucaacgccgccaagcucgacgaggccaaccuccccaaggagaucaaccucgucgacgacuacuucgagcucguccagcacgaguacaagaaguggcaggagaacuccgagcagggccgccgcgagggccacgcccagaaccccauggagcccuccgucccccagcucucccucauggacgucaagugcgagacccccaacugccccuucuucauguccgucaacacccagccccucugccacgagugcuccgagcgccgccagaagaaccagaacaagcuccccaagcucaacuccaagcccggccccgagggccuccccggcauggcccucggcgccucccgcggcgaggccuacgagccccucgccuggaaccccgaggaguccaccggcggcccccacuccgccccccccaccgcccccucccccuuccucuucuccgagaccaccgccaugaagugccgcucccccggcugccccuucacccucaacguccagcacaacggcuucugcgagcgcugccacaacgcccgccagcuccacgccucccacgcccccgaccacacccgccaccucgaccccggcaagugccaggccugccuccaggacgucacccgcaccuucaacggcaucugcuccaccugcuucaagcgcaccaccgccgaggccuccuccucccucuccaccucccucccccccuccugccaccagcgcuccaaguccgaccccucccgccucguccgcucccccuccccccacuccugccaccgcgccggcaacgacgcccccgccggcugccucucccaggccgcccgcacccccggcgaccgcaccggcaccuccaagugccgcaaggccggcugcgucuacuucggcacccccgagaacaagggcuucugcacccucugcuucaucgaguaccgcgagaacaagcacuucgccgccgccuccggcaaggucucccccaccgccucccgcuuccagaacaccauccccugccucggccgcgagugcggcacccucggcuccaccauguucgagggcuacugccagaagugcuucaucgaggcccagaaccagcgcuuccacgaggccaagcgcaccgaggagcagcuccgcuccucccagcgccgcgacgucccccgcaccacccaguccaccucccgccccaagugcgcccgcgccuccugcaagaacauccucgccugccgcuccgaggagcucugcauggagugccagcaccccaaccagcgcaugggccccggcgcccaccgcggcgagcccgcccccgaggacccccccaagcagcgcugccgcgcccccgccugcgaccacuucggcaacgccaagugcaacggcuacugcaacgagugcuuccaguucaagcagauguacggcuga

SEQ ID NO: 50955 - RNA, 834 nt, Artificial Sequence
  derived and/or modified sequence opt2 from TNFAIP6__Homo_sapiens__NP_009046
augaucauccucaucuaccucuuccuccuccucugggaggacacccagggcuggggcuucaaggacggcaucuuccacaacuccaucuggcucgagcgcgccgccggcgucuaccaccgcgaggcccgcuccggcaaguacaagcucaccuacgccgaggccaaggccgucugcgaguucgagggcggccaccucgccaccuacaagcagcucgaggccgcccgcaagaucggcuuccacgucugcgccgccggcuggauggccaagggccgcgucggcuaccccaucgucaagcccggccccaacugcggcuucggcaagaccggcaucaucgacuacggcauccgccucaaccgcuccgagcgcugggacgccuacugcuacaacccccacgccaaggagugcggcggcgucuucaccgaccccaagcagaucuucaagucccccggcuuccccaacgaguacgaggacaaccagaucugcuacuggcacauccgccucaaguacggccagcgcauccaccucuccuuccucgacuucgaccucgaggacgaccccggcugccucgccgacuacgucgagaucuacgacuccuacgacgacguccacggcuucgucggccgcuacugcggcgacgagcuccccgacgacaucaucuccaccggcaacgucaugacccucaaguuccucuccgacgccuccgucaccgccggcggcuuccagaucaaguacgucgccauggaccccgucuccaaguccucccagggcaagaacaccuccaccaccuccaccggcaacaagaacuuccucgccggccgcuucucccaccucuga

SEQ ID NO: 50956 - RNA, 567 nt, Artificial Sequence
  derived and/or modified sequence opt2 from TNFAIP8__Homo_sapiens__NP_001071122
auggccaccgacgucuucaacuccaagaaccucgccguccaggcccagaagaagauccucggcaagauggucuccaaguccaucgccaccacccucaucgacgacaccuccuccgagguccucgacgagcucuaccgcgucacccgcgaguacacccagaacaagaaggaggccgagaagaucaucaagaaccucaucaagaccgucaucaagcucgccauccucuaccgcaacaaccaguucaaccaggacgagcucgcccucauggagaaguucaagaagaagguccaccagcucgccaugaccgucgucuccuuccaccaggucgacuacaccuucgaccgcaacguccucucccgccuccucaacgagugccgcgagaugcuccaccagaucauccagcgccaccucaccgccaagucccacggccgcgucaacaacgucuucgaccacuucuccgacugcgaguuccucgccgcccucuacaaccccuucggcaacuucaagccccaccuccagaagcucugcgacggcaucaacaagaugcucgacgaggagaacaucuga

SEQ ID NO: 50957 - RNA, 555 nt, Artificial Sequence
  derived and/or modified sequence opt2 from TNFAIP8L2__Homo_sapiens__NP_078851
auggaguccuucuccuccaagucccucgcccuccaggccgagaagaagcuccucuccaagauggccggccgcuccgucgcccaccucuucaucgacgagaccuccuccgagguccucgacgagcucuaccgcgucuccaaggaguacacccacucccgcccccaggcccagcgcgucaucaaggaccucaucaaggucgccaucaaggucgccguccuccaccgcaacggcuccuucggccccuccgagcucgcccucgccacccgcuuccgccagaagcuccgccagggcgccaugaccgcccucuccuucggcgaggucgacuucaccuucgaggccgccguccucgccggccuccucaccgagugccgcgacguccuccucgagcucgucgagcaccaccucacccccaagucccacggccgcauccgccacgucuucgaccacuucuccgaccccggccuccucaccgcccucuacggccccgacuucacccagcaccucggcaagaucugcgacggccuccgcaagcuccucgacgagggcaagcucuga

SEQ ID NO: 50958 - RNA, 879 nt, Artificial Sequence
  derived and/or modified sequence opt2 from TNFAIP8L3__Homo_sapiens__NP_997264
augggcaagccccgccagaaccccuccacccucgucuccacccucugcgaggccgagcccaagggcaagcucugggucaacggcuacgccggcacccagggcacccgcgacgccacccuccagacccgccucaucccccucuccuuccaccuccagcgcggcaagggccucgccgccccccucuccgcccucuccgccccccgccuccccgagcgccccgccgacggccgcgucgccgucgacgcccagcccgccgcccgcuccauggacuccgacuccggcgagcaguccgagggcgagcccgucaccgccgccggccccgacgucuucuccuccaagucccucgcccuccaggcccagaagaagauccucuccaagaucgccuccaagaccgucgccaacaugcucaucgacgacaccuccuccgagaucuucgacgagcucuacaaggucaccaaggagcacacccacaacaagaaggaggcccacaagaucaugaaggaccucaucaaggucgccaucaagaucggcauccucuaccgcaacaaccaguucucccaggaggagcucgucaucgucgagaaguuccgcaagaagcucaaccagaccgccaugaccaucgucuccuucuacgaggucgaguacaccuucgaccgcaacguccucuccaaccuccuccacgagugcaaggaccucguccacgagcucguccagcgccaccucaccccccgcacccacggccgcaucaaccacgucuucaaccacuucgccgacgucgaguuccucuccacccucuacucccucgacggcgacugccgccccaaccucaagcgcaucugcgagggcaucaacaagcuccucgacgagaagguccucuga

SEQ ID NO: 50959 - RNA, 702 nt, Artificial Sequence
  derived and/or modified sequence opt2 from TNF__Homo_sapiens__NP_000585
auguccaccgaguccaugauccgcgacgucgagcucgccgaggaggcccuccccaagaagaccggcggcccccagggcucccgccgcugccucuuccucucccucuucuccuuccucaucgucgccggcgccaccacccucuucugccuccuccacuucggcgucaucggcccccagcgcgaggaguucccccgcgaccucucccucaucuccccccucgcccaggccguccgcuccuccucccgcacccccuccgacaagcccgucgcccacgucgucgccaacccccaggccgagggccagcuccaguggcucaaccgccgcgccaacgcccuccucgccaacggcgucgagcuccgcgacaaccagcucgucguccccuccgagggccucuaccucaucuacucccagguccucuucaagggccagggcugccccuccacccacguccuccucacccacaccaucucccgcaucgccgucuccuaccagaccaaggucaaccuccucuccgccaucaagucccccugccagcgcgagacccccgagggcgccgaggccaagcccugguacgagcccaucuaccucggcggcgucuuccagcucgagaagggcgaccgccucuccgccgagaucaaccgccccgacuaccucgacuucgccgaguccggccaggucuacuucggcaucaucgcccucuga

SEQ ID NO: 50960 - RNA, 1407 nt, Artificial Sequence
  derived and/or modified sequence opt2 from TNFRSF10A__Homo_sapiens__NP_003835
auggcccccccccccgcccgcguccaccucggcgccuuccucgccgucacccccaaccccggcuccgccgccuccggcaccgaggccgccgccgccacccccuccaaggucuggggcuccuccgccggccgcaucgagccccgcggcggcggccgcggcgcccuccccaccuccaugggccagcacggccccuccgcccgcgcccgcgccggccgcgcccccggcccccgccccgcccgcgaggccuccccccgccuccgcguccacaagaccuucaaguucgucgucgucggcguccuccuccaggucguccccuccuccgccgccaccaucaagcuccacgaccaguccaucggcacccagcagugggagcacuccccccucggcgagcucugcccccccggcucccaccgcuccgagcaccccggcgccugcaaccgcugcaccgagggcgucggcuacaccaacgccuccaacaaccucuucgccugccuccccugcaccgccugcaaguccgacgaggaggagcgcucccccugcaccaccacccgcaacaccgccugccagugcaagcccggcaccuuccgcaacgacaacuccgccgagaugugccgcaagugcucccgcggcugcccccgcggcauggucaaggucaaggacugcacccccugguccgacaucgagugcguccacaaggaguccggcaacggccacaacaucugggucauccucgucgucacccucgucgucccccuccuccucgucgccguccucaucgucugcugcugcaucggcuccggcugcggcggcgaccccaagugcauggaccgcgucugcuucuggcgccucggccuccuccgcggccccggcgccgaggacaacgcccacaacgagauccucuccaacgccgacucccucuccaccuucgucuccgagcagcagauggagucccaggagcccgccgaccucaccggcgucaccguccagucccccggcgaggcccagugccuccucggccccgccgaggccgagggcucccagcgccgccgccuccucguccccgccaacggcgccgaccccaccgagacccucaugcucuucuucgacaaguucgccaacaucguccccuucgacuccugggaccagcucaugcgccagcucgaccucaccaagaacgagaucgacgucguccgcgccggcaccgccggccccggcgacgcccucuacgccaugcucaugaagugggucaacaagaccggccgcaacgccuccauccacacccuccucgacgcccucgagcgcauggaggagcgccacgcccgcgagaagauccaggaccuccucgucgacuccggcaaguucaucuaccucgaggacggcaccggcuccgccgucucccucgaguga

SEQ ID NO: 50961 - RNA, 1323 nt, Artificial Sequence
  derived and/or modified sequence opt2 from TNFRSF10B__Homo_sapiens__NP_003833
auggagcagcgcggccagaacgcccccgccgccuccggcgcccgcaagcgccacggccccggcccccgcgaggcccgcggcgcccgccccggcccccgcguccccaagacccucguccucgucgucgccgccguccuccuccucgucuccgccgaguccgcccucaucacccagcaggaccucgccccccagcagcgcgccgccccccagcagaagcgcuccucccccuccgagggccucugcccccccggccaccacaucuccgaggacggccgcgacugcaucuccugcaaguacggccaggacuacuccacccacuggaacgaccuccucuucugccuccgcugcacccgcugcgacuccggcgaggucgagcucucccccugcaccaccacccgcaacaccgucugccagugcgaggagggcaccuuccgcgaggaggacucccccgagaugugccgcaagugccgcaccggcugcccccgcggcauggucaaggucggcgacugcacccccugguccgacaucgagugcguccacaaggaguccggcaccaagcacuccggcgagguccccgccgucgaggagaccgucaccuccucccccggcacccccgccucccccugcucccucuccggcaucaucaucggcgucaccgucgccgccgucguccucaucgucgccgucuucgucugcaagucccuccucuggaagaagguccuccccuaccucaagggcaucugcuccggcggcggcggcgaccccgagcgcgucgaccgcuccucccagcgccccggcgccgaggacaacguccucaacgagaucgucuccauccuccagcccacccagguccccgagcaggagauggagguccaggagcccgccgagcccaccggcgucaacaugcucucccccggcgaguccgagcaccuccucgagcccgccgaggccgagcgcucccagcgccgccgccuccucguccccgccaacgagggcgaccccaccgagacccuccgccagugcuucgacgacuucgccgaccucguccccuucgacuccugggagccccucaugcgcaagcucggccucauggacaacgagaucaaggucgccaaggccgaggccgccggccaccgcgacacccucuacaccaugcucaucaagugggucaacaagaccggccgcgacgccuccguccacacccuccucgacgcccucgagacccucggcgagcgccucgccaagcagaagaucgaggaccaccuccucuccuccggcaaguucauguaccucgagggcaacgccgacuccgccauguccuga

SEQ ID NO: 50962 - RNA, 780 nt, Artificial Sequence
  derived and/or modified sequence opt2 from TNFRSF10C__Homo_sapiens__NP_003832
auggcccgcauccccaagacccucaaguucgucgucgucaucgucgccguccuccuccccguccucgccuacuccgccaccaccgcccgccaggaggaggucccccagcagaccgucgccccccagcagcagcgccacuccuucaagggcgaggagugccccgccggcucccaccgcuccgagcacaccggcgccugcaaccccugcaccgagggcgucgacuacaccaacgccuccaacaacgagcccuccugcuuccccugcaccgucugcaaguccgaccagaagcacaaguccuccugcaccaugacccgcgacaccgucugccagugcaaggagggcaccuuccgcaacgagaacucccccgagaugugccgcaagugcucccgcugccccuccggcgagguccaggucuccaacugcaccuccugggacgacauccagugcgucgaggaguucggcgccaacgccaccgucgagacccccgccgccgaggagaccaugaacaccucccccggcacccccgcccccgccgccgaggagaccaugaacaccucccccggcacccccgcccccgccgccgaggagaccaugaccaccucccccggcacccccgcccccgccgccgaggagaccaugaccaccucccccggcacccccgcccccgccgccgaggagaccaugaccaccucccccggcacccccgccuccucccacuaccucuccugcaccaucgucggcaucaucguccucaucguccuccucaucgucuucgucuga

SEQ ID NO: 50963 - RNA, 1161 nt, Artificial Sequence
  derived and/or modified sequence opt2 from TNFRSF10D__Homo_sapiens__NP_003831
augggccucuggggccaguccguccccaccgccuccuccgcccgcgccggccgcuaccccggcgcccgcaccgccuccggcacccgccccuggcuccucgaccccaagauccucaaguucgucgucuucaucgucgccguccuccuccccguccgcgucgacuccgccaccaucccccgccaggacgaggucccccagcagaccgucgccccccagcagcagcgccgcucccucaaggaggaggagugccccgccggcucccaccgcuccgaguacaccggcgccugcaaccccugcaccgagggcgucgacuacaccaucgccuccaacaaccuccccuccugccuccucugcaccgucugcaaguccggccagaccaacaaguccuccugcaccaccacccgcgacaccgucugccagugcgagaagggcuccuuccaggacaagaacucccccgagaugugccgcaccugccgcaccggcugcccccgcggcauggucaaggucuccaacugcaccccccgcuccgacaucaagugcaagaacgaguccgccgccuccuccaccggcaagacccccgccgccgaggagaccgucaccaccauccucggcaugcucgccucccccuaccacuaccucaucaucaucgucguccucgucaucauccucgccgucgucgucgucggcuucuccugccgcaagaaguucaucuccuaccucaagggcaucugcuccggcggcggcggcggccccgagcgcguccaccgcguccucuuccgccgccgcuccugccccucccgcguccccggcgccgaggacaacgcccgcaacgagacccucuccaaccgcuaccuccagcccacccaggucuccgagcaggagauccagggccaggagcucgccgagcucaccggcgucaccgucgagcuccccgaggagccccagcgccuccucgagcaggccgaggccgagggcugccagcgccgccgccuccucguccccgucaacgacgccgacuccgccgacaucuccacccuccucgacgccuccgccacccucgaggagggccacgccaaggagaccauccaggaccagcucgucggcuccgagaagcucuucuacgaggaggacgaggccggcuccgccaccuccugccucuga

SEQ ID NO: 50964 - RNA, 900 nt, Artificial Sequence
  derived and/or modified sequence opt2 from TNFRSF11A__Homo_sapiens__NP_001257880
auggccccccgcgcccgccgccgccgcccccucuucgcccuccuccuccucugcgcccuccucgcccgccuccaggucgcccuccagaucgccccccccugcaccuccgagaagcacuacgagcaccucggccgcugcugcaacaagugcgagcccggcaaguacauguccuccaagugcaccaccaccuccgacuccgucugccuccccugcggccccgacgaguaccucgacuccuggaacgaggaggacaagugccuccuccacaaggucugcgacaccggcaaggcccucgucgccgucgucgccggcaacuccaccaccccccgccgcugcgccugcaccgccggcuaccacuggucccaggacugcgagugcugccgccgcaacaccgagugcgcccccggccucggcgcccagcacccccuccagcucaacaaggacaccgucugcaagcccugccucgccggcuacuucuccgacgccuucuccuccaccgacaagugccgccccuggaccaacugcaccuuccucggcaagcgcgucgagcaccacggcaccgagaaguccgacgccgucugcuccuccucccuccccgcccgcaagccccccaacggcaacgucaccggcaacuccaacuccaccuucaucuccuccggccaggucaugaacuucaagggcgacaucaucgucgucuacgucucccagaccucccaggagggcgccgccgccgccgccgagcccaugggccgccccguccaggaggagacccucgcccgccgcgacuccuucgccggcaacggcccccgcuuccccgaccccugcggcggccccgagggccuccgcgagcccgagaaggccucccgccccguccaggagcagggcggcgccaaggccuga

SEQ ID NO: 50965 - RNA, 1206 nt, Artificial Sequence
  derived and/or modified sequence opt2 from TNFRSF11B__Homo_sapiens__NP_002537
augaacaaccuccucugcugcgcccucgucuuccucgacaucuccaucaaguggaccacccaggagaccuucccccccaaguaccuccacuacgacgaggagaccucccaccagcuccucugcgacaagugcccccccggcaccuaccucaagcagcacugcaccgccaaguggaagaccgucugcgcccccugccccgaccacuacuacaccgacuccuggcacaccuccgacgagugccucuacugcucccccgucugcaaggagcuccaguacgucaagcaggagugcaaccgcacccacaaccgcgucugcgagugcaaggagggccgcuaccucgagaucgaguucugccucaagcaccgcuccugcccccccggcuucggcgucguccaggccggcacccccgagcgcaacaccgucugcaagcgcugccccgacggcuucuucuccaacgagaccuccuccaaggcccccugccgcaagcacaccaacugcuccgucuucggccuccuccucacccagaagggcaacgccacccacgacaacaucugcuccggcaacuccgaguccacccagaagugcggcaucgacgucacccucugcgaggaggccuucuuccgcuucgccguccccaccaaguucacccccaacuggcucuccguccucgucgacaaccuccccggcaccaaggucaacgccgaguccgucgagcgcaucaagcgccagcacuccucccaggagcagaccuuccagcuccucaagcucuggaagcaccagaacaaggaccaggacaucgucaagaagaucauccaggacaucgaccucugcgagaacuccguccagcgccacaucggccacgccaaccucaccuucgagcagcuccgcucccucauggagucccuccccggcaagaaggucggcgccgaggacaucgagaagaccaucaaggccugcaagcccuccgaccagauccucaagcuccucucccucuggcgcaucaagaacggcgaccaggacacccucaagggccucaugcacgcccucaagcacuccaagaccuaccacuuccccaagaccgucacccagucccucaagaagaccauccgcuuccuccacuccuucaccauguacaagcucuaccagaagcucuuccucgagaugaucggcaaccagguccaguccgucaagaucuccugccucuga

SEQ ID NO: 50966 - RNA, 390 nt, Artificial Sequence
  derived and/or modified sequence opt2 from TNFRSF12A__Homo_sapiens__NP_057723
auggcccgcggcucccuccgccgccuccuccgccuccucguccucggccucuggcucgcccuccuccgcuccgucgccggcgagcaggcccccggcaccgcccccugcucccgcggcuccuccugguccgccgaccucgacaagugcauggacugcgccuccugccgcgcccgcccccacuccgacuucugccucggcugcgccgccgccccccccgcccccuuccgccuccucuggcccauccucggcggcgcccucucccucaccuucguccucggccuccucuccggcuuccucgucuggcgccgcugccgccgccgcgagaaguucaccacccccaucgaggagaccggcggcgagggcugccccgccgucgcccucauccaguga

SEQ ID NO: 50967 - RNA, 882 nt, Artificial Sequence
  derived and/or modified sequence opt2 from TNFRSF13B__Homo_sapiens__NP_036584
auguccggccucggccgcucccgccgcggcggccgcucccgcgucgaccaggaggagcgcuucccccagggccucuggaccggcgucgccaugcgcuccugccccgaggagcaguacugggacccccuccucggcaccugcauguccugcaagaccaucugcaaccaccagucccagcgcaccugcgccgccuucugccgcucccucuccugccgcaaggagcagggcaaguucuacgaccaccuccuccgcgacugcaucuccugcgccuccaucugcggccagcaccccaagcagugcgccuacuucugcgagaacaagcuccgcucccccgucaaccucccccccgagcuccgccgccagcgcuccggcgaggucgagaacaacuccgacaacuccggccgcuaccagggccucgagcaccgcggcuccgaggccucccccgcccuccccggccucaagcucuccgccgaccaggucgcccucgucuacuccacccucggccucugccucugcgccguccucugcugcuuccucgucgccgucgccugcuuccucaagaagcgcggcgaccccugcuccugccagccccgcucccgcccccgccagucccccgccaaguccucccaggaccacgccauggaggccggcucccccgucuccaccucccccgagcccgucgagaccugcuccuucugcuuccccgagugccgcgcccccacccaggaguccgccgucacccccggcacccccgaccccaccugcgccggccgcuggggcugccacacccgcaccaccguccuccagcccugcccccacauccccgacuccggccucggcaucgucugcguccccgcccaggagggcggccccggcgccuga

SEQ ID NO: 50968 - RNA, 555 nt, Artificial Sequence
  derived and/or modified sequence opt2 from TNFRSF13C__Homo_sapiens__NP_443177
augcgccgcggcccccgcucccuccgcggccgcgacgcccccgcccccacccccugcguccccgccgagugcuucgaccuccucguccgccacugcgucgccugcggccuccuccgcaccccccgccccaagcccgccggcgccuccucccccgccccccgcaccgcccuccagccccaggaguccgucggcgccggcgccggcgaggccgcccucccccuccccggccuccucuucggcgcccccgcccuccucggccucgcccucguccucgcccucguccucgucggccucgucuccuggcgccgccgccagcgccgccuccgcggcgccuccuccgccgaggcccccgacggcgacaaggacgcccccgagccccucgacaaggucaucauccucucccccggcaucuccgacgccaccgcccccgccuggcccccccccggcgaggaccccggcaccaccccccccggccacuccguccccguccccgccaccgagcucggcuccaccgagcucgucaccaccaagaccgccggccccgagcagcaguga

SEQ ID NO: 50969 - RNA, 555 nt, Artificial Sequence
  derived and/or modified sequence opt2 from TNFRSF14__Homo_sapiens__NP_001284534
auggagccccccggcgacuggggccccccccccuggcgcuccacccccaagaccgacguccuccgccucguccucuaccucaccuuccucggcgcccccugcuacgcccccgcccuccccuccugcaaggaggacgaguaccccgucggcuccgagugcugccccaagugcucccccggcuaccgcgucaaggaggccugcggcgagcucaccggcaccgucugcgagcccugcccccccggcaccuacaucgcccaccucaacggccucuccaagugccuccagugccagaugugcgaccccgccaugggccuccgcgccucccgcaacugcucccgcaccgagaacgccgucugcggcugcucccccggccacuucugcaucguccaggacggcgaccacugcgccgccugccgcgccuacgccaccuccucccccggccagcgcguccagaagggcggcaccgagucccaggacacccucugccagaacugcccccccggcaccuucucccccaacggcacccucgaggagugccagcaccagaccaaguga

SEQ ID NO: 50970 - RNA, 858 nt, Artificial Sequence
  derived and/or modified sequence opt2 from TNFRSF19__Homo_sapiens__NP_001191388
auggagugcguccccugcggcgacccccccccccccuacgagccccacugcgccuccaaggucaaccucgucaagaucgccuccaccgccuccuccccccgcgacaccgcccucgccgccgucaucugcuccgcccucgccaccguccuccucgcccuccucauccucugcgucaucuacugcaagcgccaguucauggagaagaagcccuccuggucccuccgcucccaggacauccaguacaacggcuccgagcucuccugcuucgaccgcccccagcuccacgaguacgcccaccgcgccugcugccagugccgccgcgacuccguccagaccugcggccccguccgccuccuccccuccaugugcugcgaggaggccugcucccccaaccccgccacccucggcugcggcguccacuccgccgccucccuccaggcccgcaacgccggccccgccggcgagaugguccccaccuucuucggcucccucacccaguccaucugcggcgaguucuccgacgccuggccccucaugcagaaccccaugggcggcgacaacaucuccuucugcgacuccuaccccgagcucaccggcgaggacauccacucccucaaccccgagcucgaguccuccaccucccucgacuccaacuccucccaggaccucgucggcggcgccguccccguccagucccacuccgagaacuucaccgccgccaccgaccucucccgcuacaacaacacccucgucgaguccgccuccacccaggacgcccucaccaugcgcucccagcucgaccaggaguccggcgccgucauccaccccgccacccagaccucccuccaggaggccuga

SEQ ID NO: 50971 - RNA, 1368 nt, Artificial Sequence
  derived and/or modified sequence opt2 from TNFRSF1A__Homo_sapiens__NP_001056
augggccucuccaccguccccgaccuccuccucccccucguccuccucgagcuccucgucggcaucuaccccuccggcgucaucggccucgucccccaccucggcgaccgcgagaagcgcgacuccgucugcccccagggcaaguacauccacccccagaacaacuccaucugcugcaccaagugccacaagggcaccuaccucuacaacgacugccccggccccggccaggacaccgacugccgcgagugcgaguccggcuccuucaccgccuccgagaaccaccuccgccacugccucuccugcuccaagugccgcaaggagaugggccaggucgagaucuccuccugcaccgucgaccgcgacaccgucugcggcugccgcaagaaccaguaccgccacuacugguccgagaaccucuuccagugcuucaacugcucccucugccucaacggcaccguccaccucuccugccaggagaagcagaacaccgucugcaccugccacgccggcuucuuccuccgcgagaacgagugcgucuccugcuccaacugcaagaagucccucgagugcaccaagcucugccucccccagaucgagaacgucaagggcaccgaggacuccggcaccaccguccuccucccccucgucaucuucuucggccucugccuccucucccuccucuucaucggccucauguaccgcuaccagcgcuggaaguccaagcucuacuccaucgucugcggcaaguccacccccgagaaggagggcgagcucgagggcaccaccaccaagccccucgcccccaaccccuccuucucccccacccccggcuucacccccacccucggcuucucccccguccccuccuccaccuucaccuccuccuccaccuacacccccggcgacugccccaacuucgccgccccccgccgcgaggucgccccccccuaccagggcgccgaccccauccucgccaccgcccucgccuccgaccccauccccaacccccuccagaagugggaggacuccgcccacaagccccagucccucgacaccgacgaccccgccacccucuacgccgucgucgagaacguccccccccuccgcuggaaggaguucguccgccgccucggccucuccgaccacgagaucgaccgccucgagcuccagaacggccgcugccuccgcgaggcccaguacuccaugcucgccaccuggcgccgccgcaccccccgccgcgaggccacccucgagcuccucggccgcguccuccgcgacauggaccuccucggcugccucgaggacaucgaggaggcccucugcggccccgccgcccucccccccgcccccucccuccuccgcuga

SEQ ID NO: 50972 - RNA, 1389 nt, Artificial Sequence
  derived and/or modified sequence opt2 from TNFRSF1B__Homo_sapiens__XP_011540365
auggcccccgucgccgucugggccgcccucgccgucggccucgagcucugggccgccgcccacgcccuccccgcccaggucgccuucacccccuacgcccccgagcccggcuccaccugccgccuccgcgaguacuacgaccagaccgcccagaugugcugcuccaagugcucccccggccagcacgccaaggucuucugcaccaagaccuccgacaccgucugcgacuccugcgaggacuccaccuacacccagcucuggaacuggguccccgagugccucuccugcggcucccgcugcuccuccgaccaggucgagacccaggccugcacccgcgagcagaaccgcaucugcaccugccgccccggcugguacugcgcccucuccaagcaggagggcugccgccucugcgccccccuccgcaagugccgccccggcuucggcgucgcccgccccggcaccgagaccuccgacgucgucugcaagcccugcgcccccggcaccuucuccaacaccaccuccuccaccgacaucugccgcccccaccagaucugcaacgucgucgccauccccggcaacgccuccauggacgccgucugcaccuccaccucccccacccgcuccauggcccccggcgccguccaccucccccagcccgucuccacccgcucccagcacacccagcccacccccgagcccuccaccgcccccuccaccuccuuccuccuccccaugggccccuccccccccgccgagggcuccaccggcgacuucgcccuccccgucggccucaucgucggcgucaccgcccucggccuccucaucaucggcgucgucaacugcgucaucaugacccaggucaagaagaagccccucugccuccagcgcgaggccaaggucccccaccuccccgccgacaaggcccgcggcacccagggccccgagcagcagcaccuccucaucaccgcccccuccuccuccuccuccucccucgaguccuccgccuccgcccucgaccgccgcgcccccacccgcaaccagccccaggcccccggcgucgaggccuccggcgccggcgaggcccgcgccuccaccggcuccuccgccgacuccucccccggcggccacggcacccaggucaacgucaccugcaucgucaacgucugcuccuccuccgaccacuccucccagugcuccucccaggccuccuccaccaugggcgacaccgacuccucccccuccgagucccccaaggacgagcagguccccuucuccaaggaggagugcgccuuccgcucccagcucgagacccccgagacccuccucggcuccaccgaggagaagccccucccccucggcguccccgacgccggcaugaagcccuccuga

SEQ ID NO: 50973 - RNA, 1968 nt, Artificial Sequence
  derived and/or modified sequence opt2 from TNFRSF21__Homo_sapiens__NP_055267
augggcaccucccccuccuccuccaccgcccucgccuccugcucccgcaucgcccgccgcgccaccgccaccaugaucgccggcucccuccuccuccucggcuuccucuccaccaccaccgcccagcccgagcagaaggccuccaaccucaucggcaccuaccgccacgucgaccgcgccaccggccagguccucaccugcgacaagugccccgccggcaccuacgucuccgagcacugcaccaacaccucccuccgcgucugcuccuccugccccgucggcaccuucacccgccacgagaacggcaucgagaagugccacgacugcucccagcccugccccuggcccaugaucgagaagcuccccugcgccgcccucaccgaccgcgagugcaccugcccccccggcauguuccaguccaacgccaccugcgccccccacaccgucugccccgucggcuggggcguccgcaagaagggcaccgagaccgaggacguccgcugcaagcagugcgcccgcggcaccuucuccgacguccccuccuccgucaugaagugcaaggccuacaccgacugccucucccagaaccucgucgucaucaagcccggcaccaaggagaccgacaacgucugcggcacccuccccuccuucuccuccuccaccucccccucccccggcaccgccaucuucccccgccccgagcacauggagacccacgagguccccuccuccaccuacguccccaagggcaugaacuccaccgaguccaacuccuccgccuccguccgccccaagguccucuccuccauccaggagggcaccguccccgacaacaccuccuccgcccgcggcaaggaggacgucaacaagacccuccccaaccuccaggucgucaaccaccagcagggcccccaccaccgccacauccucaagcuccuccccuccauggaggccaccggcggcgagaaguccuccacccccaucaagggccccaagcgcggccacccccgccagaaccuccacaagcacuucgacaucaacgagcaccuccccuggaugaucguccucuuccuccuccucguccucgucgucaucgucgucugcuccauccgcaaguccucccgcacccucaagaagggcccccgccaggaccccuccgccaucgucgagaaggccggccucaagaaguccaugacccccacccagaaccgcgagaaguggaucuacuacugcaacggccacggcaucgacauccucaagcucgucgccgcccaggucggcucccaguggaaggacaucuaccaguuccucugcaacgccuccgagcgcgaggucgccgccuucuccaacggcuacaccgccgaccacgagcgcgccuacgccgcccuccagcacuggaccauccgcggccccgaggccucccucgcccagcucaucuccgcccuccgccagcaccgccgcaacgacgucgucgagaagauccgcggccucauggaggacaccacccagcucgagaccgacaagcucgcccuccccaugucccccuccccccucucccccucccccauccccucccccaacgccaagcucgagaacuccgcccuccucaccgucgagcccuccccccaggacaagaacaagggcuucuucgucgacgaguccgagccccuccuccgcugcgacuccaccuccuccggcuccuccgcccucucccgcaacggcuccuucaucaccaaggagaagaaggacaccguccuccgccagguccgccucgaccccugcgaccuccagcccaucuucgacgacaugcuccacuuccucaaccccgaggagcuccgcgucaucgaggagaucccccaggccgaggacaagcucgaccgccucuucgagaucaucggcgucaagucccaggaggccucccagacccuccucgacuccgucuacucccaccuccccgaccuccucuga

SEQ ID NO: 50974 - RNA, 903 nt, Artificial Sequence
  derived and/or modified sequence opt2 from TNFRSF6B__Homo_sapiens__NP_003814
augcgcgcccucgagggccccggccucucccuccucugccucguccucgcccuccccgcccuccuccccguccccgccguccgcggcgucgccgagacccccaccuaccccuggcgcgacgccgagaccggcgagcgccucgucugcgcccagugcccccccggcaccuucguccagcgccccugccgccgcgacucccccaccaccugcggccccugccccccccgccacuacacccaguucuggaacuaccucgagcgcugccgcuacugcaacguccucugcggcgagcgcgaggaggaggcccgcgccugccacgccacccacaaccgcgccugccgcugccgcaccggcuucuucgcccacgccggcuucugccucgagcacgccuccugcccccccggcgccggcgucaucgcccccggcacccccucccagaacacccagugccagcccugcccccccggcaccuucuccgccuccuccuccuccuccgagcagugccagccccaccgcaacugcaccgcccucggccucgcccucaacguccccggcuccuccucccacgacacccucugcaccuccugcaccggcuucccccucuccacccgcguccccggcgccgaggagugcgagcgcgccgucaucgacuucgucgccuuccaggacaucuccaucaagcgccuccagcgccuccuccaggcccucgaggcccccgagggcuggggccccaccccccgcgccggccgcgccgcccuccagcucaagcuccgccgccgccucaccgagcuccucggcgcccaggacggcgcccuccucguccgccuccuccaggcccuccgcgucgcccgcaugcccggccucgagcgcuccguccgcgagcgcuuccuccccguccacuga

SEQ ID NO: 50975 - RNA, 1785 nt, Artificial Sequence
  derived and/or modified sequence opt2 from TNFRSF8__Homo_sapiens__XP_011540743
augcgcguccuccucgccgcccucggccuccucuuccucggcgcccuccgcgccuucccccaggaccgccccuucgaggacaccugccacggcaaccccucccacuacuacgacaaggccguccgccgcugcugcuaccgcugccccaugggccucuuccccacccagcagugcccccagcgccccaccgacugccgcaagcagugcgagcccgacuacuaccucgacgaggccgaccgcugcaccgccugcgucaccugcucccgcgacgaccucgucgagaagacccccugcgccuggaacuccucccgcgucugcgagugccgccccggcauguucugcuccaccuccgccgucaacuccugcgcccgcugcuucuuccacuccgucugccccgccggcaugaucgucaaguuccccggcaccgcccagaagaacaccgucugcgagcccgccucccccggcgucucccccgccugcgccucccccgagaacugcaaggagcccuccuccggcaccaucccccaggccaagcccacccccgucucccccgccaccuccuccgccuccaccaugcccguccgcggcggcacccgccucgcccaggaggccgccuccaagcucacccgcgcccccgacucccccuccuccgucggccgccccuccuccgaccccggccucucccccacccagcccugccccgagggcuccggcgacugccgcaagcagugcgagcccgacuacuaccucgacgaggccggccgcugcaccgccugcgucuccugcucccgcgacgaccucgucgagaagacccccugcgccuggaacuccucccgcaccugcgagugccgccccggcaugaucugcgccaccuccgccaccaacuccugcgcccgcugcguccccuaccccaucugcgccgccgagaccgucaccaagccccaggacauggccgagaaggacaccaccuucgaggcccccccccucggcacccagcccgacugcaaccccacccccgagaacggcgaggcccccgccuccaccucccccacccagucccuccucgucgacucccaggccuccaagacccuccccauccccaccuccgcccccgucgcccucuccuccaccggcaagcccguccucgacgccggccccguccucuucugggucauccucguccucgucgucgucgucggcuccuccgccuuccuccucugccaccgccgcgccugccgcaagcgcauccgccagaagcuccaccucugcuaccccguccagaccucccagcccaagcucgagcucgucgacucccgcccccgccgcuccuccacccuccgcuccggcgccuccgucaccgagcccgucgccgaggagcgcggccucaugucccagccccucauggagaccugccacuccgucggcgccgccuaccucgagucccucccccuccaggacgccucccccgccggcggccccuccuccccccgcgaccuccccgagccccgcgucuccaccgagcacaccaacaacaagaucgagaagaucuacaucaugaaggccgacaccgucaucgucggcaccgucaaggccgagcuccccgagggccgcggccucgccggccccgccgagcccgagcucgaggaggagcucgaggccgaccacaccccccacuaccccgagcaggagaccgagcccccccucggcuccugcuccgacgucaugcucuccgucgaggaggagggcaaggaggacccccuccccaccgccgccuccggcaaguga

SEQ ID NO: 50976 - RNA, 306 nt, Artificial Sequence
  derived and/or modified sequence opt2 from TNFSF10__Homo_sapiens__NP_001177871
auggccaugauggagguccagggcggccccucccucggccagaccugcguccucaucgucaucuucaccguccuccuccagucccucugcgucgccgucaccuacgucuacuucaccaacgagcucaagcagaugcaggacaaguacuccaaguccggcaucgccugcuuccucaaggaggacgacuccuacugggaccccaacgacgaggaguccaugaacucccccugcuggcaggucaaguggcagcuccgccagcucguccgcaagaccccccgcaugaagcgccucugggccgccaaguga

SEQ ID NO: 50977 - RNA, 954 nt, Artificial Sequence
  derived and/or modified sequence opt2 from TNFSF11__Homo_sapiens__NP_003692
augcgccgcgccucccgcgacuacaccaaguaccuccgcggcuccgaggagaugggcggcggccccggcgccccccacgagggcccccuccacgccccccccccccccgccccccaccagccccccgccgccucccgcuccauguucgucgcccuccucggccucggccucggccaggucgucugcuccgucgcccucuucuucuacuuccgcgcccagauggaccccaaccgcaucuccgaggacggcacccacugcaucuaccgcauccuccgccuccacgagaacgccgacuuccaggacaccacccucgagucccaggacaccaagcucauccccgacuccugccgccgcaucaagcaggccuuccagggcgccguccagaaggagcuccagcacaucgucggcucccagcacauccgcgccgagaaggccauggucgacggcuccuggcucgaccucgccaagcgcuccaagcucgaggcccagcccuucgcccaccucaccaucaacgccaccgacauccccuccggcucccacaaggucucccucuccuccugguaccacgaccgcggcugggccaagaucuccaacaugaccuucuccaacggcaagcucaucgucaaccaggacggcuucuacuaccucuacgccaacaucugcuuccgccaccacgagaccuccggcgaccucgccaccgaguaccuccagcucauggucuacgucaccaagaccuccaucaagauccccuccucccacacccucaugaagggcggcuccaccaaguacugguccggcaacuccgaguuccacuucuacuccaucaacgucggcggcuucuucaagcuccgcuccggcgaggagaucuccaucgaggucuccaaccccucccuccucgaccccgaccaggacgccaccuacuucggcgccuucaagguccgcgacaucgacuga

SEQ ID NO: 50978 - RNA, 750 nt, Artificial Sequence
  derived and/or modified sequence opt2 from TNFSF12__Homo_sapiens__NP_003800
auggccgcccgccgcucccagcgccgccgcggccgccgcggcgagcccggcaccgcccuccucgucccccucgcccucggccucggccucgcccucgccugccucggccuccuccucgccgucgucucccucggcucccgcgccucccucuccgcccaggagcccgcccaggaggagcucgucgccgaggaggaccaggaccccuccgagcucaacccccagaccgaggagucccaggaccccgcccccuuccucaaccgccucguccgcccccgccgcuccgcccccaagggccgcaagacccgcgcccgccgcgccaucgccgcccacuacgagguccacccccgccccggccaggacggcgcccaggccggcgucgacggcaccgucuccggcugggaggaggcccgcaucaacuccuccuccccccuccgcuacaaccgccagaucggcgaguucaucgucacccgcgccggccucuacuaccucuacugccagguccacuucgacgagggcaaggccgucuaccucaagcucgaccuccucgucgacggcguccucgcccuccgcugccucgaggaguucuccgccaccgccgccuccucccucggcccccagcuccgccucugccaggucuccggccuccucgcccuccgccccggcuccucccuccgcauccgcacccuccccugggcccaccucaaggccgcccccuuccucaccuacuucggccucuuccagguccacuga

SEQ ID NO: 50979 - RNA, 993 nt, Artificial Sequence
  derived and/or modified sequence opt2 from TNFSF12-TNFSF13__Homo_sapiens__NP_742086
auggccgcccgccgcucccagcgccgccgcggccgccgcggcgagcccggcaccgcccuccucgucccccucgcccucggccucggccucgcccucgccugccucggccuccuccucgccgucgucucccucggcucccgcgccucccucuccgcccaggagcccgcccaggaggagcucgucgccgaggaggaccaggaccccuccgagcucaacccccagaccgaggagucccaggaccccgcccccuuccucaaccgccucguccgcccccgccgcuccgcccccaagggccgcaagacccgcgcccgccgcgccaucgccgcccacuacgagguccacccccgccccggccaggacggcgcccaggccggcgucgacggcaccgucuccggcugggaggaggcccgcaucaacuccuccuccccccuccgcuacaaccgccagaucggcgaguucaucgucacccgcgccggccucuacuaccucuacugccaguccuccgacgcccucgaggccugggagaacggcgagcgcucccgcaagcgccgcgccguccucacccagaagcagaagaagcagcacuccguccuccaccucguccccaucaacgccaccuccaaggacgacuccgacgucaccgaggucauguggcagcccgcccuccgccgcggccgcggccuccaggcccagggcuacggcguccgcauccaggacgccggcgucuaccuccucuacucccagguccucuuccaggacgucaccuucaccaugggccaggucgucucccgcgagggccagggccgccaggagacccucuuccgcugcauccgcuccaugcccucccaccccgaccgcgccuacaacuccugcuacuccgccggcgucuuccaccuccaccagggcgacauccucuccgucaucaucccccgcgcccgcgccaagcucaaccucuccccccacggcaccuuccucggcuucgucaagcucuga

SEQ ID NO: 50980 - RNA, 801 nt, Artificial Sequence
  derived and/or modified sequence opt2 from TNFSF13B__Homo_sapiens__NP_001139117
auggacgacuccaccgagcgcgagcagucccgccucaccuccugccucaagaagcgcgaggagaugaagcucaaggagugcgucuccauccucccccgcaaggagucccccuccguccgcuccuccaaggacggcaagcuccucgccgccacccuccuccucgcccuccucuccugcugccucaccgucgucuccuucuaccaggucgccgcccuccagggcgaccucgccucccuccgcgccgagcuccagggccaccacgccgagaagcuccccgccggcgccggcgcccccaaggccggccucgaggaggcccccgccgucaccgccggccucaagaucuucgagccccccgcccccggcgagggcaacuccucccagaacucccgcaacaagcgcgccguccagggccccgaggagaccggcuccuacaccuucguccccuggcuccucuccuucaagcgcggcuccgcccucgaggagaaggagaacaagauccucgucaaggagaccggcuacuucuucaucuacggccagguccucuacaccgacaagaccuacgccaugggccaccucauccagcgcaagaagguccacgucuucggcgacgagcucucccucgucacccucuuccgcugcauccagaacaugcccgagacccuccccaacaacuccugcuacuccgccggcaucgccaagcucgaggagggcgacgagcuccagcucgccaucccccgcgagaacgcccagaucucccucgacggcgacgucaccuucuucggcgcccucaagcuccucuga

SEQ ID NO: 50981 - RNA, 669 nt, Artificial Sequence
  derived and/or modified sequence opt2 from TNFSF13__Homo_sapiens__NP_001185552
augcccgccuccucccccuuccuccucgcccccaagggcccccccggcaacaugggcggccccguccgcgagcccgcccucuccgucgcccucuggcucuccuggggcgccgcccucggcgccgucgccugcgccauggcccuccucacccagcagaccgagcuccagucccuccgccgcgaggucucccgccuccagggcaccggcggccccucccagaacggcgagggcuaccccuggcagucccuccccgagcagcacuccguccuccaccucguccccaucaacgccaccuccaaggacgacuccgacgucaccgaggucauguggcagcccgcccuccgccgcggccgcggccuccaggcccagggcuacggcguccgcauccaggacgccggcgucuaccuccucuacucccagguccucuuccaggacgucaccuucaccaugggccaggucgucucccgcgagggccagggccgccaggagacccucuuccgcugcauccgcuccaugcccucccaccccgaccgcgccuacaacuccugcuacuccgccggcgucuuccaccuccaccagggcgacauccucuccgucaucaucccccgcgcccgcgccaagcucaaccucuccccccacggcaccuuccucggcuucgucaagcucuga

SEQ ID NO: 50982 - RNA, 723 nt, Artificial Sequence
  derived and/or modified sequence opt2 from TNFSF14__Homo_sapiens__NP_003798
auggaggaguccgucguccgccccuccgucuucgucgucgacggccagaccgacauccccuucacccgccucggccgcucccaccgccgccaguccugcuccgucgcccgcgucggccucggccuccuccuccuccucaugggcgccggccucgccguccagggcugguuccuccuccagcuccacuggcgccucggcgagauggucacccgccuccccgacggccccgccggcuccugggagcagcucauccaggagcgccgcucccacgaggucaaccccgccgcccaccucaccggcgccaacuccucccucaccggcuccggcggcccccuccucugggagacccagcucggccucgccuuccuccgcggccucuccuaccacgacggcgcccucgucgucaccaaggccggcuacuacuacaucuacuccaagguccagcucggcggcgucggcugcccccucggccucgccuccaccaucacccacggccucuacaagcgcaccccccgcuaccccgaggagcucgagcuccucgucucccagcagucccccugcggccgcgccaccuccuccucccgcgucuggugggacuccuccuuccucggcggcgucguccaccucgaggccggcgagaaggucgucguccgcguccucgacgagcgccucguccgccuccgcgacggcacccgcuccuacuucggcgccuucauggucuga

SEQ ID NO: 50983 - RNA, 579 nt, Artificial Sequence
  derived and/or modified sequence opt2 from TNFSF15__Homo_sapiens__NP_001191273
augcagcucaccaagggccgccuccacuucucccacccccucucccacaccaagcacaucucccccuucgucaccgacgccccccuccgcgccgacggcgacaagccccgcgcccaccucaccgucguccgccagacccccacccagcacuucaagaaccaguuccccgcccuccacugggagcacgagcucggccucgccuucaccaagaaccgcaugaacuacaccaacaaguuccuccucauccccgaguccggcgacuacuucaucuacucccaggucaccuuccgcggcaugaccuccgagugcuccgagauccgccaggccggccgccccaacaagcccgacuccaucaccgucgucaucaccaaggucaccgacuccuaccccgagcccacccagcuccucaugggcaccaaguccgucugcgaggucggcuccaacugguuccagcccaucuaccucggcgccauguucucccuccaggagggcgacaagcucauggucaacgucuccgacaucucccucgucgacuacaccaaggaggacaagaccuucuucggcgccuuccuccucuga

SEQ ID NO: 50984 - RNA, 600 nt, Artificial Sequence
  derived and/or modified sequence opt2 from TNFSF18__Homo_sapiens__NP_005083
augacccuccaccccucccccaucaccugcgaguuccucuucuccaccgcccucaucucccccaagaugugccucucccaccucgagaacaugccccucucccacucccgcacccagggcgcccagcgcuccuccuggaagcucuggcucuucugcuccaucgucaugcuccucuuccucugcuccuucuccuggcucaucuucaucuuccuccagcucgagaccgccaaggagcccugcauggccaaguucggcccccuccccuccaaguggcagauggccuccuccgagccccccugcgucaacaaggucuccgacuggaagcucgagauccuccagaacggccucuaccucaucuacggccaggucgcccccaacgccaacuacaacgacgucgcccccuucgagguccgccucuacaagaacaaggacaugauccagacccucaccaacaaguccaagauccagaacgucggcggcaccuacgagcuccacgucggcgacaccaucgaccucaucuucaacuccgagcaccagguccucaagaacaacaccuacuggggcaucauccuccucgccaacccccaguucaucuccuga

SEQ ID NO: 50985 - RNA, 402 nt, Artificial Sequence
  derived and/or modified sequence opt2 from TNFSF4__Homo_sapiens__NP_001284491
auggucucccaccgcuacccccgcauccaguccaucaagguccaguucaccgaguacaagaaggagaagggcuucauccucaccucccagaaggaggacgagaucaugaagguccagaacaacuccgucaucaucaacugcgacggcuucuaccucaucucccucaagggcuacuucucccaggaggucaacaucucccuccacuaccagaaggacgaggagccccucuuccagcucaagaagguccgcuccgucaacucccucauggucgccucccucaccuacaaggacaaggucuaccucaacgucaccaccgacaacaccucccucgacgacuuccacgucaacggcggcgagcucauccucauccaccagaaccccggcgaguucugcguccucuga

SEQ ID NO: 50986 - RNA, 705 nt, Artificial Sequence
  derived and/or modified sequence opt2 from TNFSF8__Homo_sapiens__NP_001235
auggaccccggccuccagcaggcccucaacggcauggccccccccggcgacaccgccaugcacguccccgccggcuccgucgccucccaccucggcaccaccucccgcuccuacuucuaccucaccaccgccacccucgcccucugccucgucuucaccgucgccaccaucaugguccucgucguccagcgcaccgacuccauccccaacucccccgacaacgucccccucaagggcggcaacugcuccgaggaccuccucugcauccucaagcgcgcccccuucaagaaguccugggccuaccuccaggucgccaagcaccucaacaagaccaagcucuccuggaacaaggacggcauccuccacggcguccgcuaccaggacggcaaccucgucauccaguuccccggccucuacuucaucaucugccagcuccaguuccucguccagugccccaacaacuccgucgaccucaagcucgagcuccucaucaacaagcacaucaagaagcaggcccucgucaccgucugcgaguccggcaugcagaccaagcacgucuaccagaaccucucccaguuccuccucgacuaccuccaggucaacaccaccaucuccgucaacgucgacaccuuccaguacaucgacaccuccaccuucccccucgagaacguccucuccaucuuccucuacuccaacuccgacuga

SEQ ID NO: 50987 - RNA, 765 nt, Artificial Sequence
  derived and/or modified sequence opt2 from TNFSF9__Homo_sapiens__NP_003802
auggaguacgccuccgacgccucccucgaccccgaggcccccuggccccccgccccccgcgcccgcgccugccgcguccuccccugggcccucgucgccggccuccuccuccuccuccuccucgccgccgccugcgccgucuuccucgccugccccugggccgucuccggcgcccgcgccucccccggcuccgccgccuccccccgccuccgcgagggccccgagcucucccccgacgaccccgccggccuccucgaccuccgccagggcauguucgcccagcucgucgcccagaacguccuccucaucgacggcccccucuccugguacuccgaccccggccucgccggcgucucccucaccggcggccucuccuacaaggaggacaccaaggagcucgucgucgccaaggccggcgucuacuacgucuucuuccagcucgagcuccgccgcgucgucgccggcgagggcuccggcuccgucucccucgcccuccaccuccagccccuccgcuccgccgccggcgccgccgcccucgcccucaccgucgaccucccccccgccuccuccgaggcccgcaacuccgccuucggcuuccagggccgccuccuccaccucuccgccggccagcgccucggcguccaccuccacaccgaggcccgcgcccgccacgccuggcagcucacccagggcgccaccguccucggccucuuccgcgucacccccgagauccccgccggccuccccuccccccgcuccgaguga

SEQ ID NO: 50988 - RNA, 4059 nt, Artificial Sequence
  derived and/or modified sequence opt2 from TNIK__Homo_sapiens__NP_001155032
auggccuccgacucccccgcccgcucccucgacgagaucgaccucuccgcccuccgcgaccccgccggcaucuucgagcucgucgagcucgucggcaacggcaccuacggccaggucuacaagggccgccacgucaagaccggccagcucgccgccaucaaggucauggacgucaccggcgacgaggaggaggagaucaagcaggagaucaacaugcucaagaaguacucccaccaccgcaacaucgccaccuacuacggcgccuucaucaagaagaacccccccggcauggacgaccagcucuggcucgucauggaguucugcggcgccggcuccgucaccgaccucaucaagaacaccaagggcaacacccucaaggaggaguggaucgccuacaucugccgcgagauccuccgcggccucucccaccuccaccagcacaaggucauccaccgcgacaucaagggccagaacguccuccucaccgagaacgccgaggucaagcucgucgacuucggcgucuccgcccagcucgaccgcaccgucggccgccgcaacaccuucaucggcacccccuacuggauggcccccgaggucaucgccugcgacgagaaccccgacgccaccuacgacuucaaguccgaccucuggucccucggcaucaccgccaucgagauggccgagggcgcccccccccucugcgacaugcaccccaugcgcgcccucuuccucaucccccgcaaccccgccccccgccucaaguccaagaagugguccaagaaguuccaguccuucaucgaguccugccucgucaagaaccacucccagcgccccgccaccgagcagcucaugaagcaccccuucauccgcgaccagcccaacgagcgccagguccgcauccagcucaaggaccacaucgaccgcaccaagaagaagcgcggcgagaaggacgagaccgaguacgaguacuccggcuccgaggaggaggaggaggagaacgacuccggcgagcccuccuccauccucaaccuccccggcgaguccacccuccgccgcgacuuccuccgccuccagcucgccaacaaggagcgcuccgaggcccuccgccgccagcagcucgagcagcagcagcgcgagaacgaggagcacaagcgccagcuccucgccgagcgccagaagcgcaucgaggagcagaaggagcagcgccgccgccucgaggagcagcagcgccgcgagaaggagcuccgcaagcagcaggagcgcgagcagcgccgccacuacgaggagcagaugcgccgcgaggaggagcgccgccgcgccgagcacgagcaggaguacauccgccgccagcucgaggaggagcagcgccagcucgagauccuccagcagcagcuccuccacgagcaggcccuccuccucgaguacaagcgcaagcagcucgaggagcagcgccaggccgagcgccuccagcgccagcucaagcaggagcgcgacuaccucgucucccuccagcaccagcgccaggagcagcgccccgucgagaagaagccccucuaccacuacaaggagggcaugucccccuccgagaagcccgccugggccaaggaggucgaggagcgcucccgccucaaccgccaguccucccccgccaugccccacaaggucgccaaccgcaucuccgaccccaaccuccccccccgcuccgaguccuucuccaucuccggcguccagcccgcccgcaccccccccaugcuccgccccgucgacccccagaucccccaccucgucgccgucaagucccagggccccgcccucaccgccucccaguccguccacgagcagcccaccaagggccucuccggcuuccaggaggcccucaacgucaccucccaccgcgucgagaugccccgccagaacuccgaccccaccuccgagaaccccccccuccccacccgcaucgagaaguucgaccgcuccuccuggcuccgccaggaggaggacaucccccccaaggucccccagcgcaccaccuccaucucccccgcccucgcccgcaagaacucccccggcaacggcuccgcccucggcccccgccucggcucccagcccauccgcgccuccaaccccgaccuccgccgcaccgagcccauccucgaguccccccuccagcgcaccuccuccggcuccuccuccuccuccuccacccccuccucccagcccuccucccagggcggcucccagcccggcucccaggccggcuccuccgagcgcacccgcguccgcgccaacuccaaguccgagggcucccccguccucccccacgagcccgccaaggucaagcccgaggagucccgcgacaucacccgccccucccgccccgccgaccucaccgcccucgccaaggagcuccgcgagcuccgcaucgaggagaccaaccgccccaugaagaaggucaccgacuacuccuccuccuccgaggaguccgaguccuccgaggaggaggaggaggacggcgaguccgagacccacgacggcaccgucgccgucuccgacaucccccgccucauccccaccggcgcccccggcuccaacgagcaguacaacgucggcauggucggcacccacggccucgagaccucccacgccgacuccuucuccggcuccaucucccgcgagggcacccucaugauccgcgagaccuccggcgagaagaagcgcuccggccacuccgacuccaacggcuucgccggccacaucaaccuccccgaccucguccagcagucccacucccccgccggcacccccaccgagggccucggccgcgucuccacccacucccaggagauggacuccggcaccgaguacggcaugggcuccuccaccaaggccuccuucacccccuucgucgacccccgcgucuaccagaccucccccaccgacgaggacgaggaggacgaggaguccuccgccgccgcccucuucaccuccgagcuccuccgccaggagcaggccaagcucaacgaggcccgcaagaucuccgucgucaacgucaaccccaccaacauccgcccccacuccgacacccccgagauccgcaaguacaagaagcgcuucaacuccgagauccucugcgccgcccucuggggcgucaaccuccucgucggcaccgagaacggccucaugcuccucgaccgcuccggccagggcaaggucuacaaccucaucaaccgccgccgcuuccagcagauggacguccucgagggccucaacguccucgucaccaucuccggcaagaagaacaagcuccgcgucuacuaccucuccuggcuccgcaaccgcauccuccacaacgaccccgaggucgagaagaagcagggcuggaucaccgucggcgaccucgagggcugcauccacuacaaggucgucaaguacgagcgcaucaaguuccucgucaucgcccucaagaacgccgucgagaucuacgccugggcccccaagcccuaccacaaguucauggccuucaaguccuucgccgaccuccagcacaagccccuccucgucgaccucaccgucgaggagggccagcgccucaaggucaucuucggcucccacaccggcuuccacgucaucgacgucgacuccggcaacuccuacgacaucuacauccccucccacauccagggcaacaucaccccccacgccaucgucauccuccccaagaccgacggcauggagaugcucgucugcuacgaggacgagggcgucuacgucaacaccuacggccgcaucaccaaggacgucguccuccaguggggcgagaugcccaccuccgucgccuacauccacuccaaccagaucaugggcuggggcgagaaggccaucgagauccgcuccgucgagaccggccaccucgacggcgucuucaugcacaagcgcgcccagcgccucaaguuccucugcgagcgcaacgacaaggucuucuucgccuccguccgcuccggcggcuccucccaggucuucuucaugacccucaaccgcaacuccaugaugaacugguga

SEQ ID NO: 50989 - RNA, 1752 nt, Artificial Sequence
  derived and/or modified sequence opt2 from TNIP1__Homo_sapiens__NP_001239315
auggaggccacccgccuccgccagaaggccgaggagcucgucaaggacaacgagcuccuccccccccccucccccucccucggcuccuucgacccccucgccgagcucaccggcaaggacuccaacgucaccgccucccccaccgcccccgccugccccuccgacaagcccgcccccguccagaagccccccuccuccggcaccuccuccgaguucgaggucgucacccccgaggagcagaacucccccgaguccuccucccacgccaacgccauggcccucggcccccucccccgcgaggacggcaaccucaugcuccaccuccagcgccucgagaccacccucuccgucugcgccgaggagcccgaccacggccagcucuucacccaccucggccgcauggcccucgaguucaaccgccucgccuccaagguccacaagaacgagcagcgcaccuccauccuccagacccucugcgagcagcuccgcaaggagaacgaggcccucaaggccaagcucgacaagggccucgagcagcgcgaccaggccgccgagcgccuccgcgaggagaaccucgagcucaagaagcuccucauguccaacggcaacaaggagggcgccuccggccgccccggcucccccaagauggagggcaccggcaagaaggccgucgccggccagcagcaggccuccgucaccgccggcaagguccccgaggucgucgcccucggcgccgccgagaagaaggucaagaugcucgagcagcagcgcuccgagcuccucgaggucaacaagcagugggaccagcacuuccgcuccaugaagcagcaguacgagcagaagaucaccgagcuccgccagaagcucgccgaccuccagaagcaggucaccgaccucgaggccgagcgcgagcagaagcagcgcgacuucgaccgcaagcuccuccucgccaaguccaagaucgagauggaggagaccgacaaggagcagcucaccgccgaggccaaggagcuccgccagaaggucaaguaccuccaggaccagcucuccccccucacccgccagcgcgaguaccaggagaaggagauccagcgccucaacaaggcccucgaggaggcccucuccauccagaccccccccuccuccccccccaccgccuucggcucccccgagggcgccggcgcccuccuccgcaagcaggagcucgucacccagaacgagcuccucaagcagcaggucaagaucuucgaggaggacuuccagcgcgagcgcuccgaccgcgagcgcaugaacgaggagaaggaggagcucaagaagcaggucgagaagcuccaggcccaggucacccucuccaacgcccagcucaaggccuucaaggacgaggagaaggcccgcgaggcccuccgccagcagaagcgcaaggccaaggccuccggcgagcgcuaccacgucgagccccaccccgagcaccucugcggcgccuaccccuacgccuacccccccaugcccgccauggucccccaccacggcuucgaggacuggucccagauccgcuacccccccccccccauggccauggagcacccccccccccuccccaacucccgccucuuccaccuccccgaguacaccuggcgccuccccugcggcggcguccgcaaccccaaccaguccucccaggucauggacccccccaccgcccgccccaccgagcccgagucccccaagaacgaccgcgagggcccccaguga

SEQ ID NO: 50990 - RNA, 969 nt, Artificial Sequence
  derived and/or modified sequence opt2 from TNIP2__Homo_sapiens__NP_001154999
augcagcagcuccucucccagccccagcacgagcgcgagaaggaggucguccuccuccgccgcuccauggccgagggcgagcgcgcccgcgccgccuccgacguccucugccgcucccucgccaacgagacccaccagcuccgccgcacccucaccgccaccgcccacaugugccagcaccucgccaagugccucgacgagcgccagcacgcccagcgcaacgucggcgagcgcucccccgaccaguccgagcacaccgacggccacaccuccguccaguccgucaucgagaagcuccaggaggagaaccgccuccucaagcagaaggucacccacgucgaggaccucaacgccaaguggcagcgcuacaacgccucccgcgacgaguacguccgcggccuccacgcccagcuccgcggccuccagaucccccacgagcccgagcucaugcgcaaggagaucucccgccucaaccgccagcucgaggagaagaucaacgacugcgccgaggucaagcaggagcucgccgccucccgcaccgcccgcgacgccgcccucgagcgcguccagaugcucgagcagcagauccucgccuacaaggacgacuucauguccgagcgcgccgaccgcgagcgcgcccagucccgcauccaggagcucgaggagaaggucgccucccuccuccaccaggucuccuggcgccaggacucccgcgagcccgacgccggccgcauccacgccggcuccaagaccgccaaguaccucgccgccgacgcccucgagcucaugguccccggcggcuggcgccccggcaccggcucccagcagcccgagccccccgccgagggcggccaccccggcgccgcccagcgcggccagggcgaccuccagugcccccacugccuccagugcuucuccgacgagcagggcgaggagcuccuccgccacgucgccgagugcugccaguga

SEQ ID NO: 50991 - RNA, 1110 nt, Artificial Sequence
  derived and/or modified sequence opt2 from TNIP3__Homo_sapiens__NP_001122315
augaacaagaacgagaagcacgacgacaagcucgucauguucaccaaccaguccgaggacuccgagcgcugcgaguccauggagcucgacaagaagauccaggaccucaucgagcgcaacgccuccccccaccccaagcgcuucacccccgaggccaugcccacccaccgcaaccucugcucccucaagacccccggcaagaccgccuccauggcccacuucguccagggcaccucccgcaugaucgccgccgaguccuccaccgagcacaaggagugcgccgagcccuccacccgcaagaaccucaugaacucccucgagcagaagauccgcugccucgagaagcagcgcaaggagcuccucgaggucaaccagcagugggaccagcaguuccgcuccaugaaggagcucuacgagcgcaaggucgccgagcucaagaccaagcucgacgccgccgagcgcuuccucuccacccgcgagaaggacccccaccagcgccagcgcaaggacgaccgccagcgcgaggacgaccgccagcgcgaccucacccgcgaccgccuccagcgcgaggagaaggagaaggagcgccucaacgaggagcuccacgagcucaaggaggagaacaagcuccucaagggcaagaacacccucgccaacaaggagaaggagcacuacgagugcgagaucaagcgccucaacaaggcccuccaggacgcccucaacaucaagugcuccuucuccgaggacugccuccgcaagucccgcgucgaguucugccacgaggagaugcgcaccgagauggagguccucaagcagcagguccagaucuacgaggaggacuucaagaaggagcgcuccgaccgcgagcgccucaaccaggagaaggaggagcuccagcagaucaacgagaccucccagucccagcucaaccgccucaacucccagaucaaggccugccagauggagaaggagaagcucgagaagcagcucaagcagauguacugcccccccugcaacugcggccucgucuuccaccuccaggaccccuggguccccaccggccccggcgccguccagaagcagcgcgagcaccccgucuacccccaguga

SEQ ID NO: 50992 - RNA, 1986 nt, Artificial Sequence
  derived and/or modified sequence opt2 from TNK1__Homo_sapiens__XP_011522347
augcuccccgaggccggcucccucuggcuccucaagcuccuccgcgacauccagcucgcccaguucuacuggcccauccucgaggagcucaacgucacccgccccgagcacuucgacuucgucaagcccgaggaccucgacggcaucggcaugggccgccccgcccagcgccgccucuccgaggcccucaagcgccuccgcuccggccccaaguccaagaacugggucuacaagauccucggcggcuucgcccccgagcacaaggagcccacccuccccuccgacuccccccgccaccuccccgagcccgagggcggccucaagugccucauccccgagggcgccgucugccgcggcgagcuccucggcuccggcugcuucggcgucguccaccgcggccucuggacccuccccuccggcaaguccguccccgucgccgucaagucccuccgcgucggccccgagggccccaugggcaccgagcucggcgacuuccuccgcgaggucuccgucaugaugaaccucgagcacccccacguccuccgccuccacggccucguccucggccagccccuccagauggucauggagcucgccccccucggcucccuccacgcccgccucaccgcccccgcccccacccccccccuccucgucgcccuccucugccucuuccuccgccagcucgccggcgccauggccuaccucggcgcccgcggccucguccaccgcgaccucgccacccgcaaccuccuccucgccuccccccgcaccaucaaggucgccgacuucggccucguccgcccccucggcggcgcccgcggccgcuacgucaugggcggcccccgccccauccccuacgccuggugcgcccccgagucccuccgccacggcgccuucuccuccgccuccgacgucuggauguucggcgucacccucugggagauguucuccggcggcgaggagcccugggccggcgucccccccuaccucauccuccagcgccucgaggaccgcgcccgccucccccgccccccccucugcucccgcgcccucuacucccucgcccuccgcugcugggccccccaccccgccgaccgccccuccuucucccaccucgagggccuccuccaggaggccggccccuccgaggccugcugcguccgcgacgucaccgagcccggcgcccuccgcauggagaccggcgaccccaucaccgucaucgagggcucccccgacuccaccaucuggaagggccagaacggccgcaccuucaaggucggcuccuuccccgccuccgccgucacccucgccgacgccggcggccuccccgccacccgccccguccaccgcggcacccccgcccgcggcgaccagcaccccggcuccaucgacggcgaccgcaagaaggccaaccucugggacgccccccccgcccgcggccagcgccgcaacaugccccucgagcgcaugaagggcaucucccgcucccucgaguccguccucucccucggcccccgccccaccggcggcggcuccuccccccccgagauccgccaggcccgcgccgucccccagggcccccccggccuccccccccgccccccccucuccuccuccuccccccagcccucccagcccucccgcgagcgccuccccuggcccaagcgcaagcccccccacaaccaccccaugggcaugcccggcgcccgcaaggccgccgcccucuccggcggccuccucuccgaccccgagcuccagcgcaagaucauggaggucgagcucuccguccacggcgucacccaccaggagugccagaccgcccucggcgccaccggcggcgacgucgucuccgccauccgcaaccucaaggucgaccagcucuuccaccucuccucccgcucccgcgccgacugcuggcgcauccucgagcacuaccagugggaccucuccgccgccucccgcuacguccucgcccgccccuga

SEQ ID NO: 50993 - RNA, 3261 nt, Artificial Sequence
  derived and/or modified sequence opt2 from TNK2__Homo_sapiens__NP_001010938
augcucgaggcccgccccccccgcacccagggcuccgacgccgccggcgccgccgccggccgcggccuccgcgcccuccuccucucccucaccgccgccgccggcaucuggggcuccaugggcgagcgcuccgccuaccagcgccucgccggcggcgaggagggcccccagcgccucggcggcggccgcaugcagcccgaggagggcaccggcuggcuccucgagcuccucuccgagguccagcuccagcaguacuuccuccgccuccgcgacgaccucaacgucacccgccucucccacuucgaguacgucaagaacgaggaccucgagaagaucggcaugggccgccccggccagcgccgccucugggaggccgucaagcgccgcaaggcccucugcaagcgcaaguccuggauguccaaggucuucuccggcaagcgccucgaggccgaguuccccccccaccacucccaguccaccuuccgcaagaccucccccgcccccggcggccccgccggcgagggcccccuccagucccucaccugccucaucggcgagaaggaccuccgccuccucgagaagcucggcgacggcuccuucggcgucguccgccgcggcgagugggacgcccccuccggcaagaccgucuccgucgccgucaagugccucaagcccgacguccucucccagcccgaggccauggacgacuucauccgcgaggucaacgccaugcacucccucgaccaccgcaaccucauccgccucuacggcgucguccucaccccccccaugaagauggucaccgagcucgccccccucggcucccuccucgaccgccuccgcaagcaccagggccacuuccuccucggcacccucucccgcuacgccguccaggucgccgagggcaugggcuaccucgaguccaagcgcuucauccaccgcgaccucgccgcccgcaaccuccuccucgccacccgcgaccucgucaagaucggcgacuucggccucaugcgcgcccucccccagaacgacgaccacuacgucaugcaggagcaccgcaagguccccuucgccuggugcgcccccgagucccucaagacccgcaccuucucccacgccuccgacaccuggauguucggcgucacccucugggagauguucaccuacggccaggagcccuggaucggccucaacggcucccagauccuccacaagaucgacaaggagggcgagcgccucccccgccccgaggacugcccccaggacaucuacaacgucaugguccagugcugggcccacaagcccgaggaccgccccaccuucgucgcccuccgcgacuuccuccucgaggcccagcccaccgacaugcgcgcccuccaggacuucgaggagcccgacaagcuccacauccagaugaacgacgucaucaccgucaucgagggccgcgccgagaacuacugguggcgcggccagaacacccgcacccucugcgucggccccuucccccgcaacgucgucaccuccgucgccggccucuccgcccaggacaucucccagccccuccagaacuccuucauccacaccggccacggcgacuccgacccccgccacugcuggggcuuccccgaccgcaucgacgagcucuaccucggcaaccccauggacccccccgaccuccucuccgucgagcucuccaccucccgccccccccagcaccucggcggcgucaagcgcgagccccccccccgccccccccagcccgccuucuucacccagaagcccaccuacgaccccgucuccgaggaccaggacccccucuccuccgacuucaagcgccucggccuccgcaagcccggccucccccgcggccucuggcucgccaagcccuccgcccgcguccccggcaccaaggccucccgcggcuccggcgccgaggucacccucaucgacuucggcgaggagcccgucguccccgcccuccgccccugcgcccccucccucgcccagcucgccauggacgccugcucccuccucgacgagacccccccccagucccccacccgcgcccucccccgcccccuccaccccacccccgucgucgacugggacgcccgcccccucccccccccccccgccuacgacgacgucgcccaggacgaggacgacuucgagaucugcuccaucaacuccacccucgucggcgccggcguccccgccggccccucccagggccagaccaacuacgccuucguccccgagcaggcccgccccccccccccccucgaggacaaccucuuccuccccccccagggcggcggcaagccccccuccuccgcccagaccgccgagaucuuccaggcccuccagcaggagugcaugcgccagcuccaggcccccgccggcucccccgcccccucccccucccccggcggcgacgacaagccccagguccccccccgcguccccauccccccccgccccacccgcccccacguccagcucucccccgccccccccggcgaggaggagaccucccaguggcccggccccgccucccccccccgcguccccccccgcgagccccucuccccccagggcucccgcacccccuccccccucgucccccccggcuccuccccccuccccccccgccucuccuccucccccggcaagaccaugcccaccacccaguccuucgccuccgaccccaaguacgccaccccccaggucauccaggcccccggcccccgcgccggccccugcauccuccccaucguccgcgacggcaagaaggucuccuccacccacuacuaccuccuccccgagcgccccuccuaccucgagcgcuaccagcgcuuccuccgcgaggcccagucccccgaggagcccaccccccuccccgucccccuccuccuccccccccccuccacccccgcccccgccgcccccaccgccaccguccgccccaugccccaggccgcccucgaccccaaggccaacuucuccaccaacaacuccaaccccggcgcccgccccccccccccccgcgccaccgcccgccucccccagcgcggcugccccggcgacggccccgaggccggccgccccgccgacaagauccagauggucgagcagcucuucggccucggccuccgcccccgcggcgagugccacaagguccucgagauguucgacuggaaccucgagcaggccggcugccaccuccucggcuccuggggccccgcccaccacaagcgcuga

SEQ ID NO: 50994 - RNA, 3501 nt, Artificial Sequence
  derived and/or modified sequence opt2 from TNKS2__Homo_sapiens__NP_079511
auguccggccgccgcugcgccggcggcggcgccgccugcgccuccgccgccgccgaggccgucgagcccgccgcccgcgagcucuucgaggccugccgcaacggcgacgucgagcgcgucaagcgccucgucacccccgagaaggucaacucccgcgacaccgccggccgcaaguccaccccccuccacuucgccgccggcuucggccgcaaggacgucgucgaguaccuccuccagaacggcgccaacguccaggcccgcgacgacggcggccucaucccccuccacaacgccugcuccuucggccacgccgaggucgucaaccuccuccuccgccacggcgccgaccccaacgcccgcgacaacuggaacuacaccccccuccacgaggccgccaucaagggcaagaucgacgucugcaucguccuccuccagcacggcgccgagcccaccauccgcaacaccgacggccgcaccgcccucgaccucgccgaccccuccgccaaggccguccucaccggcgaguacaagaaggacgagcuccucgaguccgcccgcuccggcaacgaggagaagaugauggcccuccucaccccccucaacgucaacugccacgccuccgacggccgcaaguccaccccccuccaccucgccgccggcuacaaccgcgucaagaucguccagcuccuccuccagcacggcgccgacguccacgccaaggacaagggcgaccucgucccccuccacaacgccugcuccuacggccacuacgaggucaccgagcuccucgucaagcacggcgccugcgucaacgccauggaccucuggcaguucaccccccuccacgaggccgccuccaagaaccgcgucgaggucugcucccuccuccucuccuacggcgccgaccccacccuccucaacugccacaacaaguccgccaucgaccucgcccccaccccccagcucaaggagcgccucgccuacgaguucaagggccacucccuccuccaggccgcccgcgaggccgacgucacccgcaucaagaagcaccucucccucgagauggucaacuucaagcacccccagacccacgagaccgcccuccacugcgccgccgccucccccuaccccaagcgcaagcagaucugcgagcuccuccuccgcaagggcgccaacaucaacgagaagaccaaggaguuccucaccccccuccacgucgccuccgagaaggcccacaacgacgucgucgaggucgucgucaagcacgaggccaaggucaacgcccucgacaaccucggccagaccucccuccaccgcgccgccuacugcggccaccuccagaccugccgccuccuccucuccuacggcugcgaccccaacaucaucucccuccagggcuucaccgcccuccagaugggcaacgagaacguccagcagcuccuccaggagggcaucucccucggcaacuccgaggccgaccgccagcuccucgaggccgccaaggccggcgacgucgagaccgucaagaagcucugcaccguccaguccgucaacugccgcgacaucgagggccgccaguccaccccccuccacuucgccgccggcuacaaccgcgucuccgucgucgaguaccuccuccagcacggcgccgacguccacgccaaggacaagggcggccucgucccccuccacaacgccugcuccuacggccacuacgaggucgccgagcuccucgucaagcacggcgccgucgucaacgucgccgaccucuggaaguucaccccccuccacgaggccgccgccaagggcaaguacgagaucugcaagcuccuccuccagcacggcgccgaccccaccaagaagaaccgcgacggcaacaccccccucgaccucgucaaggacggcgacaccgacauccaggaccuccuccgcggcgacgccgcccuccucgacgccgccaagaagggcugccucgcccgcgucaagaagcucuccucccccgacaacgucaacugccgcgacacccagggccgccacuccaccccccuccaccucgccgccggcuacaacaaccucgaggucgccgaguaccuccuccagcacggcgccgacgucaacgcccaggacaagggcggccucaucccccuccacaacgccgccuccuacggccacgucgacgucgccgcccuccucaucaaguacaacgccugcgucaacgccaccgacaagugggccuucaccccccuccacgaggccgcccagaagggccgcacccagcucugcgcccuccuccucgcccacggcgccgaccccacccucaagaaccaggagggccagaccccccucgaccucgucuccgccgacgacgucuccgcccuccucaccgccgccaugccccccuccgcccuccccuccugcuacaagccccagguccucaacggcguccgcucccccggcgccaccgccgacgcccucuccuccggccccuccucccccuccucccucuccgccgccuccucccucgacaaccucuccggcuccuucuccgagcucuccuccgucgucuccuccuccggcaccgagggcgccuccucccucgagaagaaggagguccccggcgucgacuucuccaucacccaguucguccgcaaccucggccucgagcaccucauggacaucuucgagcgcgagcagaucacccucgacguccucgucgagaugggccacaaggagcucaaggagaucggcaucaacgccuacggccaccgccacaagcucaucaagggcgucgagcgccucaucuccggccagcagggccucaaccccuaccucacccucaacaccuccggcuccggcaccauccucaucgaccucucccccgacgacaaggaguuccaguccgucgaggaggagaugcaguccaccguccgcgagcaccgcgacggcggccacgccggcggcaucuucaaccgcuacaacauccucaagauccagaaggucugcaacaagaagcucugggagcgcuacacccaccgccgcaaggaggucuccgaggagaaccacaaccacgccaacgagcgcaugcucuuccacggcucccccuucgucaacgccaucauccacaagggcuucgacgagcgccacgccuacaucggcggcauguucggcgccggcaucuacuucgccgagaacuccuccaaguccaaccaguacgucuacggcaucggcggcggcaccggcugccccguccacaaggaccgcuccugcuacaucugccaccgccagcuccucuucugccgcgucacccucggcaaguccuuccuccaguucuccgccaugaagauggcccacuccccccccggccaccacuccgucaccggccgccccuccgucaacggccucgcccucgccgaguacgucaucuaccgcggcgagcaggccuaccccgaguaccucaucaccuaccagaucaugcgccccgagggcauggucgacggcuga

SEQ ID NO: 50995 - RNA, 3984 nt, Artificial Sequence
  derived and/or modified sequence opt2 from TNKS__Homo_sapiens__NP_003738
auggccgccucccgccgcucccagcaccaccaccaccaccaccagcagcagcuccagcccgcccccggcgccuccgcccccccccccccccccccccccccccucucccccggccucgcccccggcaccacccccgccucccccaccgccuccggccucgcccccuucgccuccccccgccacggccucgcccuccccgagggcgacggcucccgcgacccccccgaccgcccccgcucccccgaccccgucgacggcaccuccugcugcuccaccaccuccaccaucugcaccgucgccgccgcccccgucguccccgccgucuccaccuccuccgccgccggcgucgcccccaaccccgccggcuccggcuccaacaacucccccuccuccuccuccucccccaccuccuccuccuccuccucccccuccucccccggcuccucccucgccgagucccccgaggccgccggcgucuccuccaccgccccccucggccccggcgccgccggccccggcaccggcguccccgccgucuccggcgcccuccgcgagcuccucgaggccugccgcaacggcgacgucucccgcgucaagcgccucgucgacgccgccaacgucaacgccaaggacauggccggccgcaaguccuccccccuccacuucgccgccggcuucggccgcaaggacgucgucgagcaccuccuccagaugggcgccaacguccacgcccgcgacgacggcggccucaucccccuccacaacgccugcuccuucggccacgccgaggucgucucccuccuccucugccagggcgccgaccccaacgcccgcgacaacuggaacuacaccccccuccacgaggccgccaucaagggcaagaucgacgucugcaucguccuccuccagcacggcgccgaccccaacauccgcaacaccgacggcaaguccgcccucgaccucgccgaccccuccgccaaggccguccucaccggcgaguacaagaaggacgagcuccucgaggccgcccgcuccggcaacgaggagaagcucauggcccuccucaccccccucaacgucaacugccacgccuccgacggccgcaaguccaccccccuccaccucgccgccggcuacaaccgcguccgcaucguccagcuccuccuccagcacggcgccgacguccacgccaaggacaagggcggccucgucccccuccacaacgccugcuccuacggccacuacgaggucaccgagcuccuccucaagcacggcgccugcgucaacgccauggaccucuggcaguucaccccccuccacgaggccgccuccaagaaccgcgucgaggucugcucccuccuccucucccacggcgccgaccccacccucgucaacugccacggcaaguccgccgucgacauggcccccacccccgagcuccgcgagcgccucaccuacgaguucaagggccacucccuccuccaggccgcccgcgaggccgaccucgccaaggucaagaagacccucgcccucgagaucaucaacuucaagcagccccagucccacgagaccgcccuccacugcgccgucgccucccuccaccccaagcgcaagcaggucaccgagcuccuccuccgcaagggcgccaacgucaacgagaagaacaaggacuucaugaccccccuccacgucgccgccgagcgcgcccacaacgacgucauggagguccuccacaagcacggcgccaagaugaacgcccucgacacccucggccagaccgcccuccaccgcgccgcccucgccggccaccuccagaccugccgccuccuccucuccuacggcuccgaccccuccaucaucucccuccagggcuucaccgccgcccagaugggcaacgaggccguccagcagauccucuccgaguccacccccauccgcaccuccgacgucgacuaccgccuccucgaggccuccaaggccggcgaccucgagaccgucaagcagcucugcuccucccagaacgucaacugccgcgaccucgagggccgccacuccaccccccuccacuucgccgccggcuacaaccgcgucuccgucgucgaguaccuccuccaccacggcgccgacguccacgccaaggacaagggcggccucgucccccuccacaacgccugcuccuacggccacuacgaggucgccgagcuccucguccgccacggcgccuccgucaacgucgccgaccucuggaaguucaccccccuccacgaggccgccgccaagggcaaguacgagaucugcaagcuccuccucaagcacggcgccgaccccaccaagaagaaccgcgacggcaacaccccccucgaccucgucaaggagggcgacaccgacauccaggaccuccuccgcggcgacgccgcccuccucgacgccgccaagaagggcugccucgcccgcguccagaagcucugcacccccgagaacaucaacugccgcgacacccagggccgcaacuccaccccccuccaccucgccgccggcuacaacaaccucgaggucgccgaguaccuccucgagcacggcgccgacgucaacgcccaggacaagggcggccucaucccccuccacaacgccgccuccuacggccacgucgacaucgccgcccuccucaucaaguacaacaccugcgucaacgccaccgacaagugggccuucaccccccuccacgaggccgcccagaagggccgcacccagcucugcgcccuccuccucgcccacggcgccgaccccaccaugaagaaccaggagggccagaccccccucgaccucgccaccgccgacgacauccgcgcccuccucaucgacgccaugccccccgaggcccuccccaccugcuucaagccccaggccaccgucgucuccgccucccucaucucccccgccuccacccccuccugccucuccgccgccuccuccaucgacaaccucaccggcccccucgccgagcucgccgucggcggcgccuccaacgccggcgacggcgccgccggcaccgagcgcaaggagggcgaggucgccggccucgacaugaacaucucccaguuccucaagucccucggccucgagcaccuccgcgacaucuucgagaccgagcagaucacccucgacguccucgccgacaugggccacgaggagcucaaggagaucggcaucaacgccuacggccaccgccacaagcucaucaagggcgucgagcgccuccucggcggccagcagggcaccaaccccuaccucaccuuccacugcgucaaccagggcaccauccuccucgaccucgcccccgaggacaaggaguaccaguccgucgaggaggagaugcaguccaccauccgcgagcaccgcgacggcggcaacgccggcggcaucuucaaccgcuacaacgucauccgcauccagaaggucgucaacaagaagcuccgcgagcgcuucugccaccgccagaaggaggucuccgaggagaaccacaaccaccacaacgagcgcaugcucuuccacggcucccccuucaucaacgccaucauccacaagggcuucgacgagcgccacgccuacaucggcggcauguucggcgccggcaucuacuucgccgagaacuccuccaaguccaaccaguacgucuacggcaucggcggcggcaccggcugccccacccacaaggaccgcuccugcuacaucugccaccgccagaugcucuucugccgcgucacccucggcaaguccuuccuccaguucuccaccaugaagauggcccacgccccccccggccaccacuccgucaucggccgccccuccgucaacggccucgccuacgccgaguacgucaucuaccgcggcgagcaggccuaccccgaguaccucaucaccuaccagaucaugaagcccgaggcccccucccagaccgccaccgccgccgagcagaagaccuga

SEQ ID NO: 50996 - RNA, 954 nt, Artificial Sequence
  derived and/or modified sequence opt2 from TNMD__Homo_sapiens__NP_071427
auggccaagaacccccccgagaacugcgaggacugccacauccucaacgccgaggccuucaaguccaagaagaucugcaagucccucaagaucugcggccucgucuucggcauccucgcccucacccucaucguccucuucuggggcuccaagcacuucuggcccgagguccccaagaaggccuacgacauggagcacaccuucuacuccaacggcgagaagaagaagaucuacauggagaucgaccccgucacccgcaccgagaucuuccgcuccggcaacggcaccgacgagacccucgagguccacgacuucaagaacggcuacaccggcaucuacuucgucggccuccagaagugcuucaucaagacccagaucaaggucauccccgaguucuccgagcccgaggaggagaucgacgagaacgaggagaucaccaccaccuucuucgagcaguccgucaucuggguccccgccgagaagcccaucgagaaccgcgacuuccucaagaacuccaagauccucgagaucugcgacaacgucaccauguacuggaucaaccccacccucaucuccgucuccgagcuccaggacuucgaggaggagggcgaggaccuccacuuccccgccaacgagaagaagggcaucgagcagaacgagcagugggucgucccccaggucaaggucgagaagacccgccacgcccgccaggccuccgaggaggagcuccccaucaacgacuacaccgagaacggcaucgaguucgaccccaugcucgacgagcgcggcuacugcugcaucuacugccgccgcggcaaccgcuacugccgccgcgucugcgagccccuccucggcuacuaccccuaccccuacugcuaccagggcggccgcgucaucugccgcgucaucaugcccugcaacuggugggucgcccgcaugcucggccgcgucuga

SEQ ID NO: 50997 - RNA, 486 nt, Artificial Sequence
  derived and/or modified sequence opt2 from TNNC1__Homo_sapiens__NP_003271
auggacgacaucuacaaggccgccgucgagcagcucaccgaggagcagaagaacgaguucaaggccgccuucgacaucuucguccucggcgccgaggacggcugcaucuccaccaaggagcucggcaaggucaugcgcaugcucggccagaaccccacccccgaggagcuccaggagaugaucgacgaggucgacgaggacggcuccggcaccgucgacuucgacgaguuccucgucaugaugguccgcugcaugaaggacgacuccaagggcaaguccgaggaggagcucuccgaccucuuccgcauguucgacaagaacgccgacggcuacaucgaccucgacgagcucaagaucaugcuccaggccaccggcgagaccaucaccgaggacgacaucgaggagcucaugaaggacggcgacaagaacaacgacggccgcaucgacuacgacgaguuccucgaguucaugaagggcgucgaguga

SEQ ID NO: 50998 - RNA, 3900 nt, Artificial Sequence
  derived and/or modified sequence opt2 from TNN__Homo_sapiens__NP_071376
augucccuccaggagauguuccgcuuccccaugggccuccuccucggcuccguccuccucgucgccuccgcccccgccacccucgagccccccggcugcuccaacaaggagcagcaggucaccgucucccacaccuacaagaucgacguccccaaguccgcccucguccaggucgacgccgacccccagccccucuccgacgacggcgccucccuccucgcccucggcgaggcccgcgaggagcagaacaucaucuuccgccacaacauccgccuccagaccccccagaaggacugcgagcucgccggcuccguccaggaccuccucgcccgcgucaagaagcucgaggaggagauggucgagaugaaggagcagugcuccgcccagcgcugcugccagggcgucaccgaccucucccgccacugcuccggccacggcaccuucucccucgagaccugcuccugccacugcgaggagggccgcgagggccccgccugcgagcgccucgccugccccggcgccugcuccggccacggccgcugcgucgacggccgcugccucugccacgagcccuacgucggcgccgacugcggcuaccccgccugccccgagaacugcuccggccacggcgagugcguccgcggcgucugccagugccacgaggacuucauguccgaggacugcuccgagaagcgcugccccggcgacugcuccggccacggcuucugcgacaccggcgagugcuacugcgaggagggcuucaccggccucgacugcgcccaggucgucaccccccagggccuccagcuccucaagaacaccgaggacucccuccucgucuccugggagcccuccucccaggucgaccacuaccuccucuccuacuacccccucggcaaggagcucuccggcaagcagauccagguccccaaggagcagcacuccuacgagauccucggccuccuccccggcaccaaguacaucgucacccuccgcaacgucaagaacgaggucuccuccuccccccagcaccuccucgccaccaccgaccucgccguccucggcaccgccugggucaccgacgagaccgagaacucccucgacgucgagugggagaaccccuccaccgaggucgacuacuacaagcuccgcuacggccccaugaccggccaggaggucgccgaggucaccguccccaaguccuccgaccccaagucccgcuacgacaucaccggccuccaccccggcaccgaguacaagaucaccgucguccccaugcgcggcgagcucgagggcaagcccauccuccucaacggccgcaccgagaucgacucccccaccaacgucgucaccgaccgcgucaccgaggacaccgccaccgucuccugggaccccguccaggccgucaucgacaaguacgucguccgcuacaccuccgccgacggcgacaccaaggagauggccguccacaaggacgaguccuccaccguccucaccggccucaagcccggcgaggccuacaaggucuacgucugggccgagcgcggcaaccagggcuccaagaaggccgacaccaacgcccucaccgagaucgacucccccgccaaccucgucaccgaccgcgucaccgagaacaccgccaccaucuccugggaccccguccaggccaccaucgacaaguacgucguccgcuacaccuccgccgacgaccaggagacccgcgagguccucgucggcaaggagcaguccuccaccguccucaccggccuccgccccggcgucgaguacaccguccacgucugggcccagaagggcgaccgcgaguccaagaaggccgacaccaacgcccccaccgacaucgacucccccaagaaccucgucaccgaccgcgucaccgagaacauggccaccgucuccugggaccccguccaggccgccaucgacaaguacgucguccgcuacaccuccgccggcggcgagacccgcgagguccccgucggcaaggagcaguccuccaccguccucaccggccuccgccccggcauggaguacaugguccacgucugggcccagaagggcgaccaggaguccaagaaggccgacaccaaggcccagaccgacaucgacuccccccagaaccucgucaccgaccgcgucaccgagaacauggccaccgucuccugggaccccguccgcgccaccaucgaccgcuacgucguccgcuacaccuccgccaaggacggcgagacccgcgagguccccgucggcaaggagcaguccuccaccguccucaccggccuccgccccggcgucgaguacaccguccacgucugggcccagaagggcgcccaggaguccaagaaggccgacaccaaggcccagaccgacaucgacuccccccagaaccucgucaccgacugggucaccgagaacaccgccaccgucuccugggaccccguccaggccaccaucgaccgcuacgucguccacuacaccuccgccaacggcgagacccgcgagguccccgucggcaaggagcaguccuccaccguccucaccggccuccgccccggcauggaguacaccguccacgucugggcccagaagggcaaccaggaguccaagaaggccgacaccaaggcccagaccgagaucgacggccccaagaaccucgucaccgacugggucaccgagaacauggccaccgucuccugggaccccguccaggccaccaucgacaaguacaugguccgcuacaccuccgccgacggcgagacccgcgagguccccgucggcaaggagcacuccuccaccguccucaccggccuccgccccggcauggaguacaugguccacgucugggcccagaagggcgcccaggaguccaagaaggccgacaccaaggcccagaccgagcucgaccccccccgcaaccuccgccccuccgccgucacccaguccggcggcauccucaccuggaccccccccuccgcccagauccacggcuacauccucaccuaccaguuccccgacggcaccgucaaggagaugcagcucggccgcgaggaccagcgcuucgcccuccagggccucgagcagggcgccaccuaccccgucucccucgucgccuucaagggcggccgccgcucccgcaacgucuccaccacccucuccaccgucggcgcccgcuucccccaccccuccgacugcucccagguccagcagaacuccaacgccgccuccggccucuacaccaucuaccuccacggcgacgccucccgcccccuccaggucuacugcgacauggagaccgacggcggcggcuggaucgucuuccagcgccgcaacaccggccagcucgacuucuucaagcgcuggcgcuccuacgucgagggcuucggcgaccccaugaaggaguucuggcucggccucgacaagcuccacaaccucaccaccggcacccccgcccgcuacgagguccgcgucgaccuccagaccgccaacgaguccgccuacgccaucuacgacuucuuccaggucgccuccuccaaggagcgcuacaagcucaccgucggcaaguaccgcggcaccgccggcgacgcccucaccuaccacaacggcuggaaguucaccaccuucgaccgcgacaacgacaucgcccucuccaacugcgcccucacccaccacggcggcuggugguacaagaacugccaccucgccaaccccaacggccgcuacggcgagaccaagcacuccgagggcgucaacugggagcccuggaagggccacgaguucuccauccccuacgucgagcucaagauccgcccccacggcuacucccgcgagcccguccucggccgcaagaagcgcacccuccgcggccgccuccgcaccuucuga

SEQ ID NO: 50999 - RNA, 564 nt, Artificial Sequence
  derived and/or modified sequence opt2 from TNNI1__Homo_sapiens__NP_003272
augcccgaggucgagcgcaagcccaagaucaccgccucccgcaagcuccuccucaagucccucaugcucgccaaggccaaggagugcugggagcaggagcacgaggagcgcgaggccgagaagguccgcuaccucgccgagcgcauccccacccuccagacccgcggccucucccucuccgcccuccaggaccucugccgcgagcuccacgccaaggucgaggucgucgacgaggagcgcuacgacaucgaggccaagugccuccacaacacccgcgagaucaaggaccucaagcucaaggucauggaccuccgcggcaaguucaagcgccccccccuccgccgcguccgcgucuccgccgacgccaugcuccgcgcccuccucggcuccaagcacaaggucuccauggaccuccgcgccaaccucaaguccgucaagaaggaggacaccgagaaggagcgccccgucgaggucggcgacuggcgcaagaacgucgaggccauguccggcauggagggccgcaagaagauguucgacgccgccaagucccccaccucccaguga

SEQ ID NO: 51000 - RNA, 549 nt, Artificial Sequence
  derived and/or modified sequence opt2 from TNNI2__Homo_sapiens__NP_001139313
augucccagugcaagaagcgcaaccgcgccaucaccgcccgccgccagcaccucaaguccgucaugcuccagaucgccgccaccgagcucgagaaggaggagucccgccgcgaggccgagaagcagaacuaccucgccgagcacugccccccccuccacauccccggcuccauguccgagguccaggagcucugcaagcagcuccacgccaagaucgacgccgccgaggaggagaaguacgacauggagguccgcguccagaagaccuccaaggagcucgaggacaugaaccagaagcucuucgaccuccgcggcaaguucaagcgccccccccuccgccgcguccgcauguccgccgacgccaugcucaaggcccuccucggcuccaagcacaaggucugcauggaccuccgcgccaaccucaagcaggucaagaaggaggacaccgagaaggagcgcgaccuccgcgacgucggcgacuggcgcaagaacaucgaggagaaguccggcauggagggccgcaagaagauguucgaguccgaguccuga

SEQ ID NO: 51001 - RNA, 633 nt, Artificial Sequence
  derived and/or modified sequence opt2 from TNNI3__Homo_sapiens__NP_000354
auggccgacggcuccuccgacgccgcccgcgagccccgccccgcccccgcccccauccgccgccgcuccuccaacuaccgcgccuacgccaccgagccccacgccaagaagaaguccaagaucuccgccucccgcaagcuccagcucaagacccuccuccuccagaucgccaagcaggagcucgagcgcgaggccgaggagcgccgcggcgagaagggccgcgcccucuccacccgcugccagccccucgagcucgccggccucggcuucgccgagcuccaggaccucugccgccagcuccacgcccgcgucgacaaggucgacgaggagcgcuacgacaucgaggccaaggucaccaagaacaucaccgagaucgccgaccucacccagaagaucuucgaccuccgcggcaaguucaagcgccccacccuccgccgcguccgcaucuccgccgacgccaugaugcaggcccuccucggcgcccgcgccaaggagucccucgaccuccgcgcccaccucaagcaggucaagaaggaggacaccgagaaggagaaccgcgaggucggcgacuggcgcaagaacaucgacgcccucuccggcauggagggccgcaagaagaaguucgaguccuga

SEQ ID NO: 51002 - RNA, 756 nt, Artificial Sequence
  derived and/or modified sequence opt2 from TNNT1__Homo_sapiens__NP_001278703
auguccgacaccgaggagcaggaguacgaggaggagcagcccgaggaggaggccgccgaggaggaggaggaggaggaggagcgccccaagcccucccgccccgucguccccccccucaucccccccaagauccccgagggcgagcgcgucgacuucgacgacauccaccgcaagcgcauggagaaggaccuccucgagcuccagacccucaucgacguccacuucgagcagcgcaagaaggaggaggaggagcucgucgcccucaaggagcgcaucgagcgccgccgcuccgagcgcgccgagcagcagcgcuuccgcaccgagaaggagcgcgagcgccaggccaagcucgccgaggagaagaugcgcaaggaggaggaggaggccaagaagcgcgccgaggacgacgccaagaagaagaagguccucuccaacaugggcgcccacuucggcggcuaccucgucaaggccgagcagaagcgcggcaagcgccagaccggccgcgagaugaagguccgcauccucuccgagcgcaagaagccccucgacaucgacuacaugggcgaggagcagcuccgcgagaaggcccaggagcucuccgacuggauccaccagcucgaguccgagaaguucgaccucauggccaagcucaagcagcagaaguacgagaucaacguccucuacaaccgcaucucccacgcccagaaguuccgcaagggcgccggcaagggccgcgucggcggccgcuggaaguga

SEQ ID NO: 51003 - RNA, 867 nt, Artificial Sequence
  derived and/or modified sequence opt2 from TNNT2__Homo_sapiens__NP_001001430
auguccgacaucgaggaggucgucgaggaguacgaggaggaggagcaggaggaggccgccgucgaggagcaggaggaggccgccgaggaggacgccgaggccgaggccgagaccgaggagacccgcgccgaggaggacgaggaggaggaggaggccaaggaggccgaggacggccccauggaggaguccaagcccaagccccgcuccuucaugcccaaccucgucccccccaagauccccgacggcgagcgcgucgacuucgacgacauccaccgcaagcgcauggagaaggaccucaacgagcuccaggcccucaucgaggcccacuucgagaaccgcaagaaggaggaggaggagcucgucucccucaaggaccgcaucgagcgccgccgcgccgagcgcgccgagcagcagcgcauccgcaacgagcgcgagaaggagcgccagaaccgccucgccgaggagcgcgcccgccgcgaggaggaggagaaccgccgcaaggccgaggacgaggcccgcaagaagaaggcccucuccaacaugaugcacuucggcggcuacauccagaagcaggcccagaccgagcgcaaguccggcaagcgccagaccgagcgcgagaagaagaagaagauccucgccgagcgccgcaagguccucgccaucgaccaccucaacgaggaccagcuccgcgagaaggccaaggagcucuggcaguccaucuacaaccucgaggccgagaaguucgaccuccaggagaaguucaagcagcagaaguacgagaucaacguccuccgcaaccgcaucaacgacaaccagaaggucuccaagacccgcggcaaggccaaggucaccggccgcuggaaguga

SEQ ID NO: 51004 - RNA, 753 nt, Artificial Sequence
  derived and/or modified sequence opt2 from TNNT3__Homo_sapiens__NP_001036245
auguccgacgaggaggucgagcaggucgaggagcaguacgaggaggaggaggaggcccaggaggaggaggagguccaggaggaggagaagccccgccccaagcucaccgcccccaagauccccgagggcgagaaggucgacuucgacgacauccagaagaagcgccagaacaaggaccucauggagcuccaggcccucaucgacucccacuucgaggcccgcaagaaggaggaggaggagcucgucgcccucaaggagcgcaucgagaagcgccgcgccgagcgcgccgagcagcagcgcauccgcgccgagaaggagcgcgagcgccagaaccgccucgccgaggagaaggcccgccgcgaggaggaggacgccaagcgccgcgccgaggacgaccucaagaagaagaaggcccucuccuccaugggcgccaacuacuccuccuaccucgccaaggccgaccagaagcgcggcaagaagcagaccgcccgcgagaugaagaagaagauccucgccgagcgccgcaagccccucaacaucgaccaccucggcgaggacaagcuccgcgacaaggccaaggagcucugggagacccuccaccagcucgagaucgacaaguucgaguucggcgagaagcucaagcgccagaaguacgacaucaugaacguccgcgcccgcguccagaugcucgccaaguucuccaagaaggccggcacccccgccaagggcaaggucggcggccgcuggaaguga

SEQ ID NO: 51005 - RNA, 168 nt, Artificial Sequence
  derived and/or modified sequence opt2 from TNP1__Homo_sapiens__NP_003275
auguccaccucccgcaagcucaagucccacggcaugcgccgcuccaagucccgcuccccccacaagggcgucaagcgcggcggcuccaagcgcaaguaccgcaagggcaaccucaagucccgcaagcgcggcgacgacgccaaccgcaacuaccgcucccaccucuga

SEQ ID NO: 51006 - RNA, 417 nt, Artificial Sequence
  derived and/or modified sequence opt2 from TNP2__Homo_sapiens__NP_005416
auggacacccagacccacucccuccccaucacccacacccagcuccacuccaacucccagccccagucccgcaccugcacccgccacugccagaccuucucccaguccugccgccagucccaccgcggcucccgcucccaguccuccucccagucccccgccucccaccgcaaccccaccggcgcccacuccuccuccggccaccagucccagucccccaacaccucccccccccccaagcgccacaagaagaccaugaacucccaccacucccccaugcgccccaccauccuccacugccgcugccccaagaaccgcaagaaccucgagggcaagcucaagaagaagaagauggccaagcgcauccagcaggucuacaagaccaagacccgcuccuccggcuggaaguccaacuga

SEQ ID NO: 51007 - RNA, 2697 nt, Artificial Sequence
  derived and/or modified sequence opt2 from TNPO1__Homo_sapiens__NP_002261
auggucugggaccgccagaccaagauggaguacgaguggaagcccgacgagcagggccuccagcagauccuccagcuccucaaggagucccagucccccgacaccaccauccagcgcaccguccagcagaagcucgagcagcucaaccaguaccccgacuucaacaacuaccucaucuucguccucaccaagcucaaguccgaggacgagcccacccgcucccucuccggccucauccucaagaacaacgucaaggcccacuuccagaacuuccccaacggcgucaccgacuucaucaaguccgagugccucaacaacaucggcgacuccuccccccucauccgcgccaccgucggcauccucaucaccaccaucgccuccaagggcgagcuccagaacuggcccgaccuccuccccaagcucugcucccuccucgacuccgaggacuacaacaccugcgagggcgccuucggcgcccuccagaagaucugcgaggacuccgccgagauccucgacuccgacguccucgaccgcccccucaacaucaugauccccaaguuccuccaguucuucaagcacuccucccccaagauccgcucccacgccgucgccugcgucaaccaguucaucaucucccgcacccaggcccucaugcuccacaucgacuccuucaucgagaaccucuucgcccucgccggcgacgaggagcccgagguccgcaagaacgucugccgcgcccucgucaugcuccucgagguccgcauggaccgccuccucccccacaugcacaacaucgucgaguacaugcuccagcgcacccaggaccaggacgagaacgucgcccucgaggccugcgaguucuggcucacccucgccgagcagcccaucugcaaggacguccucguccgccaccuccccaagcucauccccguccucgucaacggcaugaaguacuccgacaucgacaucauccuccucaagggcgacgucgaggaggacgagaccauccccgacuccgagcaggacauccgcccccgcuuccaccgcucccgcaccgucgcccagcagcacgacgaggacggcaucgaggaggaggacgacgacgacgacgagaucgacgacgacgacaccaucuccgacuggaaccuccgcaagugcuccgccgccgcccucgacguccucgccaacgucuaccgcgacgagcuccucccccacauccucccccuccucaaggagcuccucuuccaccacgagugggucgucaaggaguccggcauccucguccucggcgccaucgccgagggcugcaugcagggcaugauccccuaccuccccgagcucaucccccaccucauccagugccucuccgacaagaaggcccucguccgcuccaucaccugcuggacccucucccgcuacgcccacugggucgucucccagccccccgacaccuaccucaagccccucaugaccgagcuccucaagcgcauccucgacuccaacaagcgcguccaggaggccgccugcuccgccuucgccacccucgaggaggaggccugcaccgagcucguccccuaccucgccuacauccucgacacccucgucuucgccuucuccaaguaccagcacaagaaccuccucauccucuacgacgccaucggcacccucgccgacuccgucggccaccaccucaacaagcccgaguacauccagaugcucaugcccccccucauccagaaguggaacaugcucaaggacgaggacaaggaccucuucccccuccucgagugccucuccuccgucgccaccgcccuccaguccggcuuccuccccuacugcgagcccgucuaccagcgcugcgucaaccucguccagaagacccucgcccaggccaugcucaacaacgcccagcccgaccaguacgaggcccccgacaaggacuucaugaucgucgcccucgaccuccucuccggccucgccgagggccucggcggcaacaucgagcagcucgucgcccgcuccaacauccucacccucauguaccagugcaugcaggacaagaugcccgagguccgccaguccuccuucgcccuccucggcgaccucaccaaggccugcuuccagcacgucaagcccugcaucgccgacuucaugcccauccucggcaccaaccucaaccccgaguucaucuccgucugcaacaacgccaccugggccaucggcgagaucuccauccagaugggcaucgagaugcagcccuacauccccaugguccuccaccagcucgucgagaucaucaaccgccccaacacccccaagacccuccucgagaacaccgccaucaccaucggccgccucggcuacgucugcccccaggaggucgcccccaugcuccagcaguucauccgccccuggugcaccucccuccgcaacauccgcgacaacgaggagaaggacuccgccuuccgcggcaucugcaccaugaucuccgucaaccccuccggcgucauccaggacuucaucuucuucugcgacgccgucgccuccuggaucaaccccaaggacgaccuccgcgacauguucugcaagauccuccacggcuucaagaaccaggucggcgacgagaacuggcgccgcuucuccgaccaguucccccucccccucaaggagcgccucgccgccuucuacggcgucuga

SEQ ID NO: 51008 - RNA, 2664 nt, Artificial Sequence
  derived and/or modified sequence opt2 from TNPO2__Homo_sapiens__NP_001129667
auggacuggcagcccgacgagcagggccuccagcagguccuccagcuccucaaggacucccagucccccaacaccgccacccagcgcaucguccaggacaagcucaagcagcucaaccaguuccccgacuucaacaacuaccucaucuucguccucacccgccucaaguccgaggacgagcccacccgcucccucuccggccucauccucaagaacaacgucaaggcccacuaccaguccuuccccccccccgucgccgacuucaucaagcaggagugccucaacaacaucggcgacgccuccucccucauccgcgccaccaucggcauccucaucaccaccaucgccuccaagggcgagcuccagauguggcccgagcuccucccccagcucugcaaccuccucaacuccgaggacuacaacaccugcgagggcgccuucggcgcccuccagaagaucugcgaggacuccuccgagcuccucgacuccgacgcccucaaccgcccccucaacaucaugauccccaaguuccuccaguucuucaagcacugcucccccaagauccgcucccacgccaucgccugcgucaaccaguucaucauggaccgcgcccaggcccucauggacaacaucgacaccuucaucgagcaccucuucgcccucgccgucgacgacgaccccgagguccgcaagaacgucugccgcgcccucgucaugcuccucgagguccgcaucgaccgccucaucccccacaugcacuccaucauccaguacaugcuccagcgcacccaggaccacgacgagaacgucgcccucgaggccugcgaguucuggcucacccucgccgagcagcccaucugcaaggagguccucgccucccaccucguccagcucauccccauccucgucaacggcaugaaguacuccgagaucgacaucauccuccucaagggcgacgucgaggaggacgaggccguccccgacuccgagcaggacaucaagccccgcuuccacaagucccgcaccgucacccucccccacgaggccgagcgccccgacggcuccgaggacgccgaggacgacgacgacgacgacgcccucuccgacuggaaccuccgcaagugcuccgccgccgcccucgacguccucgccaacgucuuccgcgaggagcuccucccccaccuccucccccuccucaagggccuccucuuccaccccgagugggucgucaaggaguccggcauccucguccucggcgccaucgccgagggcugcaugcagggcaugguccccuaccuccccgagcucaucccccaccucauccagugccucuccgacaagaaggcccucguccgcuccaucgccugcuggacccucucccgcuacgcccacugggucgucucccagccccccgacaugcaccucaagccccucaugaccgagcuccucaagcgcauccucgacggcaacaagcgcguccaggaggccgccugcuccgccuucgccacccucgaggaggaggccugcaccgagcucguccccuaccucuccuacauccucgacacccucgucuucgccuucggcaaguaccagcacaagaaccuccucauccucuacgacgccaucggcacccucgccgacuccgucggccaccaccucaaccagcccgaguacauccagaagcucaugcccccccucauccagaaguggaacgagcucaaggacgaggacaaggaccucuucccccuccucgagugccucuccuccgucgccaccgcccuccaguccggcuuccuccccuacugcgagcccgucuaccagcgcugcgucacccucguccagaagacccucgcccaggccaugauguacacccagcaccccgagcaguacgaggcccccgacaaggacuucaugaucgucgcccucgaccuccucuccggccucgccgagggccucggcggccacgucgagcagcucgucgcccgcuccaacaucaugacccuccucuuccagugcaugcaggacuccaugcccgagguccgccaguccuccuucgcccuccucggcgaccucaccaaggccugcuucauccacgucaagcccugcaucgccgaguucaugcccauccucggcaccaaccucaaccccgaguucaucuccgucugcaacaacgccaccugggccaucggcgagaucugcaugcagaugggcgccgagaugcagcccuacguccagaugguccucaacaaccucgucgagaucaucaaccgccccaacacccccaagacccuccucgagaacaccgccaucaccaucggccgccucggcuacgucugcccccaggaggucgcccccaugcuccagcaguucauccgccccuggugcaccucccuccgcaacauccgcgacaacgaggagaaggacuccgccuuccgcggcaucugcaugaugaucggcgucaaccccggcggcgucguccaggacuucaucuucuucugcgacgccgucgccuccugggucucccccaaggacgaccuccgcgacauguucuacaagauccuccacggcuucaaggaccaggucggcgaggacaacuggcagcaguucuccgagcaguuccccccccuccucaaggagcgccucgccgccuucuacggcgucuga

SEQ ID NO: 51009 - RNA, 2580 nt, Artificial Sequence
  derived and/or modified sequence opt2 from TNPO3__Homo_sapiens__NP_001177957
auggagggcgccaagcccacccuccagcucgucuaccaggccguccaggcccucuaccacgaccccgaccccuccggcaaggagcgcgccuccuucuggcucggcgagcuccagcgcuccguccacgccugggagaucuccgaccagcuccuccagauccgccaggacgucgaguccugcuacuucgccgcccagaccaugaagaugaagauccagaccuccuucuacgagcuccccaccgacucccacgccucccuccgcgacucccuccucacccacauccagaaccucaaggaccucucccccgucaucgucacccagcucgcccucgccaucgccgaccucgcccuccagaugcccuccuggaagggcugcguccagacccucgucgagaaguacuccaacgacgucaccucccuccccuuccuccucgagauccucaccguccuccccgaggagguccacucccgcucccuccgcaucggcgccaaccgccgcaccgagaucaucgaggaccucgccuucuacuccuccaccgucgucucccuccucaugaccugcgucgagaaggccggcaccgacgagaagaugcucaugaaggucuuccgcugccucggcuccugguucaaccucggcguccucgacuccaacuucauggccaacaacaagcuccucgcccuccucuucgagguccuccagcaggacaagaccuccuccaaccuccacgaggccgccuccgacugcgucugcuccgcccucuacgccaucgagaacgucgagaccaaccucccccucgccaugcagcucuuccagggcguccucacccucgagaccgccuaccacauggccgucgcccgcgaggaccucgacaagguccucaacuacugccgcaucuucaccgagcucugcgagaccuuccucgagaagaucgucugcacccccggccagggccucggcgaccuccgcacccucgagcuccuccucaucugcgccggccacccccaguacgaggucgucgagaucuccuucaacuucugguaccgccucggcgagcaccucuacaagaccaacgacgaggucauccacggcaucuucaaggccuacauccagcgccuccuccacgcccucgcccgccacugccagcucgagcccgaccacgagggcguccccgaggagaccgacgacuucggcgaguuccgcaugcgcgucuccgaccucgucaaggaccucaucuuccucaucggcuccauggagugcuucgcccagcucuacuccacccucaaggagggcaacccccccugggaggucaccgaggccguccucuucaucauggccgccaucgccaaguccgucgaccccgagaacaaccccacccucgucgagguccucgagggcgucguccgccuccccgagaccguccacaccgccguccgcuacaccuccaucgagcucgucggcgagauguccgaggucgucgaccgcaacccccaguuccucggcaccgcccucguccucgcccgccucccccucgacaagaucaccgagugccucuccgagcucugcuccguccaggucauggcccucaagaagcuccucucccaggagcccuccaacggcaucuccuccgaccccaccgucuuccucgaccgccucgccgucaucuuccgccacaccaaccccaucgucgagaacggccagacccaccccugccagaaggucauccaggagaucuggcccguccucuccgagacccucaacaagcaccgcgccgacaaccgcaucgucgagcgcugcugccgcugccuccgcuucgccguccgcugcgucggcaagggcuccgccgcccuccuccagccccucgucacccagauggucaacgucuaccacguccaccagcacuccugcuuccucuaccucggcuccauccucgucgacgaguacggcauggaggagggcugccgccagggccuccucgacaugcuccaggcccucugcauccccaccuuccagcuccucgagcagcagaacggccuccagaaccaccccgacaccgucgacgaccucuuccgccucgccacccgcuucauccagcgcucccccgucacccuccuccgcucccaggucgucauccccauccuccagugggccaucgccuccaccacccucgaccaccgcgacgccaacugcuccgucaugcgcuuccuccgcgaccucauccacaccggcgucgccaacgaccacgaggaggacuucgagcuccgcaaggagcucaucggccaggucaugaaccagcucggccagcagcucgucucccagcuccuccacaccugcugcuucugccucccccccuacacccuccccgacgucgccgagguccucugggagaucaugcaggucgaccgccccaccuucugccgcuggcucgagaacucccucaagggccuccccaaggagaccaccgucggcgccgucaccgucacccacaagcagcucaccgacuuccacaagcaggucaccuccgccgaggagugcaagcaggucugcugggcccuccgcgacuucacccgccucuuccgcuga

SEQ ID NO: 51010 - RNA, 8907 nt, Artificial Sequence
  derived and/or modified sequence opt2 from TNRC18__Homo_sapiens__NP_001073964
auggacggccgcgacuucggcccccagcgcuccguccacggccccccccccccccuccucuccggccucgccauggacucccaccgcgucggcgccgccaccgccggccgccuccccgccuccggccuccccggcccccucccccccggcaaguacauggccggccucaaccuccacccccaccccggcgaggccuuccucggcuccuucgucgccuccggcaugggccccuccgccuccucccacggcucccccgucccccuccccuccgaccucuccuuccgcucccccacccccuccaaccuccccaugguccagcucugggccgcccacgcccacgagggcuucucccaccuccccuccggccucuaccccuccuaccuccaccucaaccaccucgagccccccuccuccggcuccccccuccucucccagcucggccagcccuccaucuucgacacccagaagggccagggccccggcggcgacggcuucuaccuccccaccgccggcgcccccggcucccuccacucccacgcccccuccgcccgcacccccggcggcggccacuccuccggcgcccccgccaagggcuccuccucccgcgacggccccgccaaggagcgcgccggccgcggcggcgagccccccccccucuucggcaagaaggacccccgcgcccgcggcgaggaggccuccggcccccgcggcgucgucgaccucacccaggaggcccgcgccgagggccgccaggaccgcggccccccccgccucgccgagcgccucucccccuuccucgccgaguccaagaccaagaacgccgcccuccagcccuccguccucaccaugugcaacggcggcgccggcgacgucggccuccccgcccucgucgccgaggccggccgcggcggcgccaaggaggccgcccgccaggacgagggcgcccgccuccuccgccgcaccgagacccuccuccccggcccccgccccugccccuccccccucccccccccccccgccccccccaagggcccccccgccccccccgccgccacccccgccggcgucuacaccgucuuccgcgagcagggccgcgagcaccgcgucgucgcccccaccuucguccccuccgucgaggccuucgacgagcgccccggccccauccagaucgccucccaggcccgcgacgcccgcgcccgcgagcgcgaggccggccgccccggcguccuccaggccccccccggcuccccccgcccccucgaccgccccgagggccuccgcgagaagaacuccgucauccgcucccucaagcgccccccccccgccgacgcccccaccguccgcgccacccgcgccucccccgacccccgcgccuacguccccgccaaggagcuccucaagcccgaggccgacccccgccccugcgagcgcgccccccgcggccccgccggccccgccgcccagcaggccgccaagcucuucggccucgagcccggccgccccccccccaccggccccgagcacaaguggaagcccuucgagcucggcaacuucgccgccacccagauggccguccucgccgcccagcaccaccacucccgcgccgaggaggaggccgccgucgucgccgccuccuccuccaagaaggccuaccucgaccccggcgccguccucccccgcuccgccgccaccugcggccgccccgucgccgacaugcacuccgccgcccacggcuccggcgaggccuccgccaugcagucccucaucaaguacuccggcuccuucgcccgcgacgccgucgccguccgccccggcggcugcggcaagaagucccccuucggcggccucggcaccaugaagcccgagcccgcccccaccuccgccggcgccucccgcgcccaggcccgccucccccacuccggcggccccgccgccggcggcggccgccagcucaagcgcgaccccgagcgccccgaguccgccaaggccuucggccgcgagggcuccggcgcccagggcgaggccgagguccgccacccccccgucggcaucgccgucgccgucgcccgccagaaggacuccggcggcuccggccgccucggccccggccucgucgaccaggagcgcucccucucccucuccaacgucaagggccacggccgcgccgacgaggacugcgucgacgaccgcgcccgccaccgcgaggagcgccuccucggcgcccgccucgaccgcgaccaggagaagcuccuccgcgaguccaaggagcucgccgaccucgcccgccuccaccccaccuccugcgcccccaacggccucaaccccaaccucauggucaccggcggccccgcccucgccggcuccggccgcugguccgccgaccccgccgcccaccucgccacccaccccuggcucccccgcuccggcaacgccuccauguggcucgccggccaccccuacggccucggcccccccucccuccaccagggcauggcccccgccuucccccccggccucggcggcucccuccccuccgccuaccaguucguccgcgacccccaguccggccagcucgucgucauccccuccgaccaccucccccacuucgccgagcucauggagcgcgccaccguccccccccucuggcccgcccucuacccccccggccgcuccccccuccaccacgcccagcagcuccagcucuucucccagcagcacuuccuccgccagcaggaguuccucuaccuccagcagcaggccgcccaggcccucgagcuccagcgcuccgcccagcucguccaggagcgccucaaggcccaggagcaccgcgccgagauggaggagaagggcuccaagcgcggccucgaggccgccggcaaggccggccucgccaccgccggccccggccuccucccccgcaagccccccggccucgccgccggccccgccggcaccuacggcaaggccgucucccccccccccuccccccgcgccucccccgucgccgcccucaaggccaaggucauccagaagcucgaggacgucuccaagccccccgccuacgccuaccccgccacccccuccucccaccccaccucccccccccccgccucccccccccccacccccggcaucacccgcaaggaggaggcccccgagaacgucgucgagaagaaggaccucgagcucgagaaggaggcccccucccccuuccaggcccucuucuccgacauccccccccgcuaccccuuccaggcccuccccccccacuacggccgccccuaccccuuccuccuccagcccaccgccgccgccgacgccgacggccucgcccccgacgucccccuccccgccgacggccccgagcgccucgcccucucccccgaggacaagcccauccgccucucccccuccaagaucaccgagccccuccgcgagggccccgaggaggagccccucgccgagcgcgaggucaaggccgaggucgaggacauggacgagggccccaccgagcuccccccccucgaguccccccucccccuccccgccgccgaggccauggccacccccucccccgccggcggcugcggcggcggccuccucgaggcccaggcccucuccgccaccggccaguccugcgccgagcccuccgagugccccgacuucgucgagggccccgagccccgcgucgacucccccggccgcaccgagcccugcaccgccgcccucgaccucggcguccagcucacccccgagacccucgucgaggccaaggaggagcccgucgagguccccgucgccguccccgucgucgaggccguccccgaggagggccucgcccaggucgcccccuccgagucccagcccacccucgagauguccgacugcgacguccccgccggcgagggccagugccccucccucgagccccaggaggccguccccguccucggcuccaccugcuuccucgaggaggccuccuccgaccaguuccuccccucccucgaggacccccucgccggcaugaacgcccucgccgccgccgccgagcucccccaggcccgcccccuccccucccccggcgccgccggcgcccaggcccucgagaagcucgaggccgccgagucccucguccucgagcaguccuuccuccacggcaucacccuccucuccgagaucgccgagcucgagcucgagcgccgcucccaggagaugggcggcgccgagcgcgcccucgucgcccgccccucccucgagucccuccucgccgccggcucccacaugcuccgcgagguccucgacggccccgucgucgacccccucaagaaccuccgccucccccgcgagcucaagcccaacaagaaguacuccuggaugcgcaagaaggaggagcgcauguacgccaugaaguccucccucgaggacauggacgcccucgagcucgacuuccgcaugcgccucgccgagguccagcgccaguacaaggagaagcagcgcgagcucgucaagcuccagcgccgccgcgacuccgaggaccgccgcgaggagccccaccgcucccucgcccgccgcggccccggccgcccccgcaagcgcacccacgcccccuccgcccucucccccccccgcaagcgcggcaaguccggccacuccuccggcaagcucuccuccaagucccuccucaccuccgacgacuacgagcucggcgccggcauccgcaagcgccacaagggcuccgaggaggagcacgacgcccucaucggcaugggcaaggcccgcggccgcaaccagaccugggacgagcacgaggccuccuccgacuucaucucccagcucaagaucaagaagaagaagauggccuccgaccaggagcagcucgccuccaagcucgacaaggcccucucccucaccaagcaggacaagcucaagucccccuucaaguucuccgacuccgccggcggcaaguccaagaccuccggcggcugcggccgcuaccucacccccuacgacucccuccucggcaagaaccgcaaggcccucgccaagggccucggccucucccucaaguccucccgcgagggcaagcacaagcgcgccgccaagacccgcaagauggaggucggcuucaaggcccgcggccagcccaaguccgcccacucccccuucgccuccgaggucuccuccuacuccuacaacaccgacuccgaggaggacgaggaguuccucaaggacgaguggcccgcccagggccccuccuccuccaagcucacccccucccuccucugcuccauggucgccaagaacuccaaggccgccggcggccccaagcucaccaagcgcggccucgccgccccccgcacccucaagcccaagcccgccaccucccgcaagcagcccuucugccuccuccuccgcgaggccgaggcccgcuccuccuucuccgacuccuccgaggaguccuucgaccaggacgaguccuccgaggaggaggacgaggaggaggagcucgaggaggaggacgaggccuccggcggcggcuaccgccucggcgcccgcgagcgcgcccucucccccggccucgaggaguccggccucggccuccucgcccgcuucgccgccuccgcccuccccucccccaccgucggccccucccucuccgucguccagcucgaggccaagcagaaggcccgcaagaaggaggagcgccagucccuccucggcaccgaguucgaguacaccgacuccgaguccgaggucaagguccgcaagcgcucccccgccggccuccuccgccccaagaagggccucggcgagcccggccccucccucgccgcccccacccccggcgcccgcggccccgaccccuccucccccgacaaggccaagcucgccgucgagaagggccgcaaggcccgcaagcuccgcggccccaaggagcccggcuucgaggccggccccgaggccuccgacgacgaccucuggacccgccgccgcuccgagcgcaucuuccuccacgacgccuccgccgccgcccccgcccccgucuccaccgcccccgccaccaagaccucccgcugcgccaagggcggcccccucuccccccgcaaggacgccggccgcgccaaggaccgcaaggacccccgcaagaagaagaagggcaaggaggccggccccggcgccggccucccccccccccgcgcccccgcccuccccuccgaggcccgcgccccccacgccuccucccucaccgccgccaagcgcuccaaggccaaggccaagggcaaggaggucaagaaggagaaccgcggcaagggcggcgccgucuccaagcucauggaguccauggccgccgaggaggacuucgagcccaaccaggacuccuccuucuccgaggacgagcaccucccccgcggcggcgccgucgagcgcccccucacccccgccccccgcuccugcaucaucgacaaggacgagcucaaggacggccuccgcguccucauccccauggacgacaagcuccucuacgccggccacguccagaccguccacucccccgacaucuaccgcgucgucgucgagggcgagcgcggcaaccgcccccacaucuacugccucgagcagcuccuccaggaggccaucaucgacguccgccccgccuccacccgcuuccucccccagggcacccgcaucgccgccuacuggucccagcaguaccgcugccucuaccccggcaccgucguccgcggccuccucgaccucgaggacgacggcgaccucaucaccgucgaguucgacgacggcgacaccggccgcaucccccucucccacauccgccuccucccccccgacuacaagauccagugcgccgagcccucccccgcccuccucguccccuccgccaagcgccgcucccgcaagaccuccaaggacaccggcgagggcaaggacggcggcaccgccggcuccgaggagcccggcgccaaggcccgcggccgcggccgcaagcccuccgccaaggccaagggcgaccgcgccgccacccucgaggagggcaaccccaccgacgagguccccuccaccccccucgcccucgagcccuccuccacccccggcuccaagaaguccccccccgagcccgucgacaagcgcgccaaggcccccaaggcccgccccgcccccccccagcccucccccgccccccccgccuucaccuccugccccgcccccgagcccuucgccgagcuccccgcccccgccaccucccucgcccccgccccccucaucaccaugcccgccacccgccccaagcccaagaaggcccgcgccgccgaggaguccggcgccaagggcccccgccgccccggcgaggaggccgagcuccucgucaagcucgaccacgagggcgucaccucccccaaguccaagaaggccaaggaggcccuccuccuccgcgaggaccccggcgccggcggcuggcaggagcccaagucccuccucucccucggcuccuacccccccgccgccggcuccuccgagcccaaggcccccuggcccaaggccaccgacggcgaccucgcccaggagcccggccccggccucaccuucgaggacuccggcaaccccaagucccccgacaaggcccaggccgagcaggacggcgccgaggaguccgaguccuccuccuccuccuccuccggcuccuccuccuccuccuccuccuccuccuccuccggcuccgagaccgagggcgaggaggagggcgacaagaacggcgacggcggcugcggcaccggcggccgcaacugcuccgccgccuccucccgcgccgccucccccgccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccaccaccgacgaggacuccuccugcuccuccgacgacgaggccgcccccgcccccaccgccggccccuccgcccaggccgcccuccccaccaaggccaccaagcaggccggcaaggcccgccccuccgcccacucccccggcaagaagacccccgccccccagccccaggccccccccccccagcccacccagccccuccagcccaaggcccaggccggcgccaagucccgccccaagaagcgcgagggcguccaccuccccaccaccaaggagcucgccaagcgccagcgccuccccuccgucgagaaccgccccaagaucgccgccuuccuccccgcccgccagcucuggaagugguucggcaagcccacccagcgccgcggcaugaagggcaaggcccgcaagcucuucuacaaggccaucguccgcggcaaggagaugauccgcaucggcgacugcgccgucuuccucuccgccggccgccccaaccuccccuacaucggccgcauccaguccaugugggaguccuggggcaacaacauggucguccgcgucaagugguucuaccaccccgaggagaccucccccggcaagcaguuccaccagggccagcacugggaccagaaguccucccgcucccuccccgccgcccuccgcgucuccucccagcgcaaggacuucauggagcgcgcccucuaccaguccucccacgucgacgagaacgacguccagaccgucucccacaagugccucgucgucggccucgagcaguacgagcagaugcucaagaccaagaaguaccaggacuccgagggccucuacuaccucgccggcaccuacgagcccaccaccggcaugaucuucuccaccgacggcguccccguccucugcuga

SEQ ID NO: 51011 - RNA, 5889 nt, Artificial Sequence
  derived and/or modified sequence opt2 from TNRC6A__Homo_sapiens__NP_055309
augcgcgagcucgaggccaaggccaccaaggacgucgagcgcaaccucucccgcgaccucguccaggaggaggagcagcucauggaggagaagaagaagaagaaggacgacaagaagaagaaggaggccgcccagaagaaggccaccgagcagaagaucaagguccccgagcagaucaagcccuccgucucccagccccagcccgccaacuccaacaacggcaccuccaccgccaccuccaccaacaacaacgccaagcgcgccaccgccaacaaccagcagccccagcagcagcagcagcagcagcagccccagcagcagcagccccagcagcagccccagccccagccccagcagcagcagccccagcagcagccccaggcccucccccgcuacccccgcgagguccccccccgcuuccgccaccaggagcacaagcagcuccucaagcgcggccagcacuuccccgucaucgccgccaaccucggcuccgccgucaagguccucaacucccaguccgaguccuccgcccucaccaaccagcagccccagaacaacggcgagguccagaacuccaagaaccaguccgacaucaaccacuccaccuccggcucccacuacgagaacucccagcgcggccccgucuccuccaccuccgacuccuccaccaacugcaagaacgccgucgucuccgaccucuccgagaaggaggccuggcccuccgcccccggcuccgaccccgagcucgccuccgagugcauggacgccgacuccgccuccuccuccgaguccgagcgcaacaucaccaucauggccuccggcaacaccggcggcgagaaggacggccuccgcaacuccaccggccucggcucccagaacaaguucgucgucggcuccuccuccaacaacgucggccacggcuccuccaccggccccuggggcuucucccacggcgccaucaucuccaccugccaggucuccgucgacgcccccgaguccaaguccgaguccuccaacaaccgcaugaacgccuggggcaccgucuccuccuccuccaacggcggccucaaccccuccacccucaacuccgccuccaaccacggcgccuggcccguccucgagaacaacggccucgcccucaagggccccgucggcuccggcuccuccggcaucaacauccagugcuccaccaucggccagaugcccaacaaccaguccaucaacuccaaggucuccggcggcuccacccacggcaccuggggcucccuccaggagaccugcgaguccgaggucuccggcacccagaaggucuccuucuccggccagccccagaacaucaccaccgagaugaccggccccaacaacaccaccaacuucaugaccuccucccuccccaacuccggcuccguccagaacaacgagcuccccuccuccaacaccggcgccuggcgcgucuccaccaugaaccacccccagaugcaggcccccuccggcaugaacggcaccucccucucccaccucuccaacggcgaguccaaguccggcggcuccuacggcaccaccuggggcgccuacggcuccaacuacuccggcgacaagugcuccggccccaacggccaggccaacggcgacaccgucaacgccacccucaugcagcccggcgucaacggccccaugggcaccaacuuccaggucaacaccaacaagggcggcggcgucugggaguccggcgccgccaacucccaguccaccuccuggggcuccggcaacggcgccaacuccggcggcucccgccgcggcuggggcacccccgcccagaacaccggcaccaaccuccccuccgucgaguggaacaagcuccccuccaaccagcacuccaacgacuccgccaacggcaacggcaagaccuucaccaacggcuggaaguccaccgaggaggaggaccagggcuccgccaccucccagaccaacgagcaguccuccgucugggccaagaccggcggcaccgucgaguccgacggcuccaccgaguccaccggccgccucgaggagaagggcaccggcgagucccagucccgcgaccgccgcaagaucgaccagcacacccuccuccaguccaucgucaaccgcaccgaccucgacccccgcguccucuccaacuccggcuggggccagacccccaucaagcagaacaccgccugggacaccgagaccuccccccgcggcgagcgcaagaccgacaacggcaccgaggccuggggcuccuccgccacccagaccuucaacuccggcgccugcaucgacaagaccucccccaacggcaacgacaccuccuccgucuccggcuggggcgaccccaagcccgcccuccgcuggggcgacuccaagggcuccaacugccagggcggcugggaggacgacuccgccgccaccggcauggucaaguccaaccaguggggcaacugcaaggaggagaaggccgccuggaacgacucccagaagaacaagcagggcuggggcgacggccagaaguccucccagggcugguccgucuccgccuccgacaacuggggcgagaccucccgcaacaaccacuggggcgaggccaacaagaaguccuccuccggcggcuccgacuccgaccgcuccgucuccggcuggaacgagcucggcaagaccuccuccuucaccuggggcaacaacaucaaccccaacaacuccuccggcugggacgaguccuccaagcccacccccucccagggcuggggcgacccccccaaguccaaccagucccucggcuggggcgacuccuccaagcccgucuccucccccgacuggaacaagcagcaggacaucgucggcuccuggggcaucccccccgccaccggcaagccccccggcaccggcuggcucggcggccccauccccgcccccgccaaggaggaggagcccaccggcugggaggagcccucccccgaguccauccgccgcaagauggagaucgacgacggcaccuccgccuggggcgaccccuccaaguacaacuacaagaacgucaacauguggaacaagaacguccccaacggcaacucccgcuccgaccagcaggcccagguccaccagcuccucacccccgccuccgccaucuccaacaaggaggccuccuccggcuccggcuggggcgagcccuggggcgagcccuccacccccgccaccaccgucgacaacggcaccuccgccuggggcaagcccaucgacuccggccccuccuggggcgagcccaucgccgccgccuccuccaccuccaccuggggcuccuccuccgucggcccccaggcccucuccaaguccggccccaaguccaugcaggacggcuggugcggcgacgacaugccccuccccggcaaccgccccaccggcugggaggaggaggaggacgucgagaucggcauguggaacuccaacuccucccaggagcucaacuccucccucaacuggccccccuacaccaagaagauguccuccaagggccucuccggcaagaagcgccgccgcgagcgcggcaugaugaagggcggcaacaagcaggaggaggccuggaucaaccccuucgucaagcaguucuccaacaucuccuucucccgcgacucccccgaggagaacguccaguccaacaagauggaccucuccggcggcaugcuccaggacaagcgcauggagaucgacaagcacucccucaacaucggcgacuacaaccgcaccgucggcaagggccccggcucccgcccccagaucuccaaggaguccuccauggagcgcaaccccuacuucgacaaggacggcaucgucgccgacgagucccagaacaugcaguucauguccucccaguccaugaagcucccccccuccaacuccgcccuccccaaccaggcccucggcuccaucgccggccucggcaugcagaaccucaacuccguccgccagaacggcaaccccuccauguucggcgucggcaacaccgccgcccagccccgcggcaugcagcagccccccgcccagccccucuccuccucccagcccaaccuccgcgcccaggucccccccccccuccucuccccccagguccccgucucccuccucaaguacgcccccaacaacggcggccucaacccccucuucggcccccagcaggucgccaugcucaaccagcucucccagcucaaccagcucucccagaucucccagcuccagcgccuccucgcccagcagcagcgcgcccagucccagcgcuccguccccuccggcaaccgcccccagcaggaccagcagggccgcccccucuccguccagcagcagaugaugcagcagucccgccagcucgaccccaaccuccucgucaagcagcagaccccccccucccagcagcagccccuccaccagcccgccaugaaguccuuccucgacaacgucaugccccacaccacccccgagcuccagaagggccccucccccaucaacgccuucuccaacuuccccaucggccucaacuccaaccucaacgucaacauggacaugaacuccaucaaggagccccagucccgccuccgcaaguggaccaccgucgacuccaucuccgucaacaccucccucgaccagaacuccuccaagcacggcgccaucuccuccggcuuccgccucgaggagucccccuucguccccuacgacuucaugaacuccuccaccucccccgccuccccccccggcuccaucggcgacggcuggccccgcgccaagucccccaacggcuccuccuccgucaacuggccccccgaguuccgccccggcgagcccuggaagggcuaccccaacaucgaccccgagaccgaccccuacgucacccccggcuccgucaucaacaaccucuccaucaacaccguccgcgaggucgaccaccuccgcgaccgcaacuccggcuccuccuccucccucaacaccacccuccccuccaccuccgccugguccuccauccgcgccuccaacuacaacgucccccucuccuccaccgcccaguccaccuccgcccgcaacuccgacuccaagcucaccuggucccccggcuccgucaccaacaccucccucgcccacgagcucuggaaggucccccucccccccaagaacaucaccgcccccucccgccccccccccggccucaccggccagaagcccccccucuccaccugggacaacuccccccuccgcaucggcggcggcuggggcaacuccgacgcccgcuacacccccggcuccuccuggggcgaguccuccuccggccgcaucaccaacuggcucguccucaagaaccucaccccccagaucgacggcuccacccuccgcacccucugcaugcagcacggcccccucaucaccuuccaccucaaccucccccacggcaacgcccucguccgcuacuccuccaaggaggaggucgucaaggcccagaagucccuccacaugugcguccucggcaacaccaccauccucgccgaguucgccuccgaggaggagaucucccgcuucuucgcccagucccagucccucacccccucccccggcuggcagucccucggcuccucccagucccgccucggcucccucgacugcucccacuccuucuccucccgcaccgaccucaaccacuggaacggcgccggccucuccggcaccaacugcggcgaccuccacggcaccucccucuggggcaccccccacuacuccaccucccucuggggcccccccuccuccuccgacccccgcggcaucuccucccccucccccaucaacgccuuccucuccgucgaccaccucggcggcggcggcgaguccauguga

SEQ ID NO: 51012 - RNA, 3090 nt, Artificial Sequence
  derived and/or modified sequence opt2 from TNRC6B__Homo_sapiens__NP_001020014
augcagaccaacgagggcgaggucuccgaggaguccuccuccaaggucgagcaggaggacuucgucauggagggccacggcaagacccccccccccggcgaggaguccaagcaggagaaggagcaggagcgcgaggagcagcucauggaggacaagaagcgcaagaaggaggacaagaagaagaaggaggccacccagaaggucaccgagcagaagaccaagguccccgaggucaccaagcccucccucucccagcccaccgccgccucccccaucggcuccucccccuccccccccgucaacggcggcaacaacgccaagcgcgucgccguccccaacggccagccccccuccgccgcccgcuacaugccccgcgagguccccccccgcuuccgcugccagcaggaccacaagguccuccucaagcgcggccagccccccccccccuccugcaugcuccucggcggcggcgccggccccccccccugcaccgcccccggcgccaaccccaacaacgcccaggucaccggcgcccuccuccaguccgaguccggcaccgcccccgucugguccaaguccaccccccccgcccccgacaacggcaccuccgccuggggcgagcccaacgaguccucccccggcuggggcgagauggacgacaccggcgccuccaccaccggcuggggcaacacccccgccaacgcccccaacgccaugaagcccaacuccaaguccaugcaggacggcuggggcgaguccgacggccccgucaccggcgcccgccaccccuccugggaggaggaggaggacggcggcgucuggaacaccaccggcucccagggcuccgccuccucccacaacuccgccuccuggggccagggcggcaagaagcagaugaagugcucccucaagggcggcaacaacgacuccuggaugaacccccucgccaagcaguucuccaacaugggccuccucucccagaccgaggacaaccccuccuccaagauggaccucuccgucggcucccucuccgacaagaaguucgacgucgacaagcgcgccaugaaccucggcgacuucaacgacaucaugcgcaaggaccgcuccggcuuccgcccccccaacuccaaggacaugggcaccaccgacuccggccccuacuucgagaagggcggcucccacggccucuucggcaacuccaccgcccagucccgcggccuccacacccccguccagccccucaacuccucccccucccuccgcgcccagguccccccccaguucaucuccccccaggucuccgccuccaugcucaagcaguuccccaacuccggccucucccccggccucuucaacgucggcccccagcucuccccccagcagaucgccaugcucucccagcucccccagaucccccaguuccagcucgccugccagcuccuccuccagcagcagcagcagcagcagcuccuccagaaccagcgcaagaucucccaggccguccgccagcagcaggagcagcagcucgcccgcauggucuccgcccuccagcagcagcagcagcagcagcagcgccagcccggcaugaagcacucccccucccaccccgucggccccaagccccaccucgacaacaugguccccaacgcccucaacgucggccuccccgaccuccagaccaagggccccauccccggcuacggcuccggcuucuccuccggcggcauggacuacggcauggucggcggcaaggaggccggcaccgagucccgcuucaagcaguggaccuccaugauggagggccuccccuccgucgccacccaggaggccaacaugcacaagaacggcgccaucgucgcccccggcaagacccgcggcggcucccccuacaaccaguucgacaucauccccggcgacacccucggcggccacaccggccccgccggcgacuccuggcuccccgccaaguccccccccaccaacaagaucggcuccaaguccuccaacgccuccuggccccccgaguuccagcccggcguccccuggaagggcauccagaacaucgaccccgaguccgaccccuacgucacccccggcuccguccucggcggcaccgccaccucccccaucgucgacaccgaccaccagcuccuccgcgacaacaccaccggcuccaacuccucccucaacaccucccuccccucccccggcgccuggcccuacuccgccuccgacaacuccuucaccaacguccacuccaccuccgccaaguuccccgacuacaaguccaccuggucccccgaccccaucggccacaaccccacccaccucuccaacaagauguggaagaaccacaucuccucccgcaacaccaccccccucccccgccccccccccggccucaccaaccccaagcccuccucccccugguccuccaccgccccccgcuccguccgcggcuggggcacccaggacucccgccucgccuccgccuccaccugguccgacggcggcuccguccgccccuccuacuggcucguccuccacaaccucaccccccagaucgacggcuccacccuccgcaccaucugcaugcagcacggcccccuccucaccuuccaccucaaccucacccagggcaccgcccucauccgcuacuccaccaagcaggaggccgccaaggcccagaccgcccuccacaugugcguccucggcaacaccaccauccucgccgaguucgccaccgacgacgaggucucccgcuuccucgcccaggcccagccccccacccccgccgccacccccuccgcccccgccgccggcuggcagucccucgagaccggccagaaccaguccgaccccgucggccccgcccucaaccucuucggcggcuccaccggccucggccagugguccuccuccgccggcggcuccuccggcgccgaccucgccggcgccucccucuggggcccccccaacuacuccuccucccucuggggcguccccaccgucgaggacccccaccgcaugggcucccccgccccccuccuccccggcgaccuccucggcggcggcuccgacuccaucuga

SEQ ID NO: 51013 - RNA, 4077 nt, Artificial Sequence
  derived and/or modified sequence opt2 from TNR__Homo_sapiens__XP_011508249
augggcgccgacggcgagaccgucguccucaagaacaugcucaucggcaucaaccucauccuccucggcuccaugaucaagcccuccgagugccagcucgaggucaccaccgagcgcguccagcgccaguccgucgaggaggagggcggcaucgccaacuacaacaccuccuccaaggagcagcccgucgucuucaaccacgucuacaacaucaacgucccccucgacaaccucugcuccuccggccucgaggccuccgccgagcaggaggucuccgccgaggacgagacccucgccgaguacaugggccagaccuccgaccacgagucccaggucaccuucacccaccgcaucaacuuccccaagaaggccugccccugcgccuccuccgcccagguccuccaggagcuccucucccgcaucgagaugcucgagcgcgaggucuccguccuccgcgaccagugcaacgccaacugcugccaggaguccgccgccaccggccagcucgacuacaucccccacugcuccggccacggcaacuucuccuucgaguccugcggcugcaucugcaacgagggcugguucggcaagaacugcuccgagcccuacugcccccucggcugcuccucccgcggcgucugcgucgacggccagugcaucugcgacuccgaguacuccggcgacgacugcuccgagcuccgcugccccaccgacugcuccucccgcggccucugcgucgacggcgagugcgucugcgaggagcccuacaccggcgaggacugccgcgagcuccgcugccccggcgacugcuccggcaagggccgcugcgccaacggcaccugccucugcgaggagggcuacgucggcgaggacugcggccagcgccagugccucaacgccugcuccggccgcggccagugcgaggagggccucugcgucugcgaggagggcuaccagggccccgacugcuccgccgucgccccccccgaggaccuccgcgucgccggcaucuccgaccgcuccaucgagcucgagugggacggccccauggccgucaccgaguacgucaucuccuaccagcccaccgcccucggcggccuccagcuccagcagcgcguccccggcgacugguccggcgucaccaucaccgagcucgagcccggccucaccuacaacaucuccgucuacgccgucaucuccaacauccucucccuccccaucaccgccaaggucgccacccaccucuccaccccccagggccuccaguucaagaccaucaccgagaccaccgucgagguccagugggagcccuucuccuucuccuucgacggcugggagaucuccuucauccccaagaacaacgagggcggcgucaucgcccagguccccuccgacgucaccuccuucaaccagaccggccucaagcccggcgaggaguacaucgucaacgucgucgcccucaaggagcaggcccgcuccccccccaccuccgccuccgucuccaccgucaucgacggccccacccagauccucguccgcgacgucuccgacaccgucgccuucgucgaguggauccccccccgcgccaaggucgacuucauccuccucaaguacggccucgucggcggcgagggcggccgcaccaccuuccgccuccagcccccccucucccaguacuccguccaggcccuccgccccggcucccgcuacgaggucuccgucuccgccguccgcggcaccaacgaguccgacuccgccaccacccaguucaccaccgagaucgacgcccccaagaaccuccgcgucggcucccgcaccgccaccucccucgaccucgagugggacaacuccgaggccgagguccaggaguacaaggucgucuacuccacccucgccggcgagcaguaccacgagguccucgucccccgcggcaucggccccaccacccgcgccacccucaccgaccucguccccggcaccgaguacggcgucggcaucuccgccgucaugaacucccagcaguccguccccgccaccaugaacgcccgcaccgagcucgacuccccccgcgaccucauggucaccgccuccuccgagaccuccaucucccucaucuggaccaaggccuccggccccaucgaccacuaccgcaucaccuucacccccuccuccggcaucgccuccgaggucaccguccccaaggaccgcaccuccuacacccucaccgaccucgagcccggcgccgaguacaucaucuccgucaccgccgagcgcggccgccagcagucccucgaguccaccgucgacgccuucaccggcuuccgccccaucucccaccuccacuucucccacgucaccuccuccuccgucaacaucaccugguccgaccccuccccccccgccgaccgccucauccucaacuacuccccccgcgacgaggaggaggagaugauggaggucucccucgacgccaccaagcgccacgccguccucaugggccuccagcccgccaccgaguacaucgucaaccucgucgccguccacggcaccgucaccuccgagcccaucgucggcuccaucaccaccggcaucgacccccccaaggacaucaccaucuccaacgucaccaaggacuccgucauggucuccugguccccccccgucgccuccuucgacuacuaccgcgucuccuaccgccccacccaggucggccgccucgacuccuccgucguccccaacaccgucaccgaguucaccaucacccgccucaaccccgccaccgaguacgagaucucccucaacuccguccgcggccgcgaggaguccgagcgcaucugcacccucguccacaccgccauggacaaccccgucgaccucaucgccaccaacaucacccccaccgaggcccuccuccaguggaaggcccccgucggcgaggucgagaacuacgucaucguccucacccacuucgccgucgccggcgagaccauccucgucgacggcgucuccgaggaguuccgccucgucgaccuccuccccuccacccacuacaccgccaccauguacgccaccaacggcccccucaccuccggcaccaucuccaccaacuucuccacccuccucgacccccccgccaaccucaccgccuccgaggucacccgccaguccgcccucaucuccuggcagcccccccgcgccgagaucgagaacuacguccucaccuacaaguccaccgacggcucccgcaaggagcucaucgucgacgccgaggacaccuggauccgccucgagggccuccucgagaacaccgacuacaccguccuccuccaggccgcccaggacaccaccugguccuccaucaccuccaccgccuucaccaccggcggccgcgucuucccccacccccaggacugcgcccagcaccucaugaacggcgacacccucuccggcgucuaccccaucuuccucaacggcgagcucucccagaagcuccaggucuacugcgacaugaccaccgacggcggcggcuggaucgucuuccagcgccgccagaacggccagaccgacuucuuccgcaagugggccgacuaccgcgucggcuucggcaacgucgaggacgaguucuggcucggccucgacaacauccaccgcaucaccucccagggccgcuacgagcuccgcgucgacaugcgcgacggccaggaggccgccuucgccuccuacgaccgcuucuccgucgaggacucccgcaaccucuacaagcuccgcaucggcuccuacaacggcaccgccggcgacucccucuccuaccaccagggccgccccuucuccaccgaggaccgcgacaacgacgucgccgucaccaacugcgccauguccuacaagggcgccuggugguacaagaacugccaccgcaccaaccucaacggcaaguacggcgagucccgccacucccagggcaucaacugguaccacuggaagggccacgaguucuccauccccuucgucgagaugaagaugcgccccuacaaccaccgccucauggccggccgcaagcgccagucccuccaguucuga

SEQ ID NO: 51014 - RNA, 5208 nt, Artificial Sequence
  derived and/or modified sequence opt2 from TNS1__Homo_sapiens__NP_072174
auguccgucucccgcaccauggaggacuccugcgagcucgaccucgucuacgucaccgagcgcaucaucgccgucuccuuccccuccaccgccaacgaggagaacuuccgcuccaaccuccgcgaggucgcccagaugcucaaguccaagcacggcggcaacuaccuccucuucaaccucuccgagcgccgccccgacaucaccaagcuccacgccaagguccucgaguucggcuggcccgaccuccacacccccgcccucgagaagaucugcuccaucugcaaggccauggacaccuggcucaacgccgacccccacaacgucgucguccuccacaacaagggcaaccgcggccgcaucggcgucgucaucgccgccuacaugcacuacuccaacaucuccgccuccgccgaccaggcccucgaccgcuucgccaugaagcgcuucuacgaggacaagaucguccccaucggccagcccucccagcgccgcuacguccacuacuucuccggccuccucuccggcuccaucaagaugaacaacaagccccucuuccuccaccacgucaucaugcacggcauccccaacuucgaguccaagggcggcugccgccccuuccuccgcaucuaccaggccaugcagcccgucuacaccuccggcaucuacaacauccccggcgacucccagaccuccgucugcaucaccaucgagcccggccuccuccucaagggcgacauccuccucaagugcuaccacaagaaguuccgcucccccgcccgcgacgucaucuuccgcguccaguuccacaccugcgccauccacgaccucggcgucgucuucggcaaggaggaccucgacgacgccuucaaggacgaccgcuuccccgaguacggcaaggucgaguucgucuucuccuacggccccgagaagauccagggcauggagcaccucgagaacggccccuccgucuccgucgacuacaacaccuccgacccccucauccgcugggacuccuacgacaacuucuccggccaccgcgacgacggcauggaggaggucgucggccacacccagggcccccucgacggcucccucuacgccaaggucaagaagaaggacucccuccacggcuccaccggcgccgucaacgccacccgccccacccucuccgccacccccaaccacgucgagcacacccucuccgucuccuccgacuccggcaacuccaccgccuccaccaagaccgacaagaccgacgagcccguccccggcgccuccuccgccaccgccgcccucuccccccaggagaagcgcgagcucgaccgccuccucuccggcuucggccucgagcgcgagaagcagggcgccauguaccacacccagcaccuccgcucccgccccgccggcggcuccgccguccccuccuccggccgccacgucguccccgcccagguccacgucaacggcggcgcccucgccuccgagcgcgagaccgacauccucgacgacgagcuccccaaccaggacggccacuccgccggcuccaugggcacccucuccucccucgacggcgucaccaacaccuccgagggcggcuaccccgaggcccucuccccccucaccaacggccucgacaaguccuaccccauggagcccauggucaacggcggcggcuaccccuacgaguccgccucccgcgccggccccgcccacgccggccacaccgcccccaugcgccccuccuacuccgcccaggagggccucgccggcuaccagcgcgagggcccccaccccgccuggccccagcccgucaccaccucccacuacgcccacgaccccuccggcauguuccgcucccaguccuucuccgaggccgagccccagcucccccccgcccccguccgcggcggcuccucccgcgaggccguccagcgcggccucaacuccuggcagcagcagcagcagcagcagcagcagccccgcccccccccccgccagcaggagcgcgcccaccucgagucccucgucgccucccgccccuccccccagccccucgccgagacccccauccccucccuccccgaguucccccgcgccgccucccagcaggagaucgagcaguccaucgagacccucaacaugcucaugcucgaccucgagcccgccuccgccgccgccccccuccacaagucccaguccguccccggcgccuggcccggcgccuccccccucuccucccagccccucuccggcuccucccgccagucccacccccucacccagucccgcuccggcuacauccccuccggccacucccucggcacccccgagcccgccccccgcgccucccucgaguccgucccccccggccgcuccuacucccccuacgacuaccagcccugccucgccggccccaaccaggacuuccacuccaagucccccgccuccuccucccuccccgccuuccuccccaccacccacuccccccccggcccccagcagccccccgccucccuccccggccucaccgcccagccccuccucucccccaaggaggccaccuccgaccccucccgcacccccgaggaggagccccucaaccucgagggccucgucgcccaccgcgucgccggcguccaggcccgcgagaagcagcccgccgagccccccgccccccuccgccgccgcgccgccuccgacggccaguacgagaaccagucccccgaggccaccuccccccgcucccccggcguccgcucccccguccagugcgucucccccgagcucgcccucaccaucgcccucaaccccggcggccgccccaaggagccccaccuccacuccuacaaggaggccuucgaggagauggagggcaccucccccuccucccccccccccuccggcguccgcuccccccccggccucgccaagaccccccucuccgcccucggccucaagccccacaaccccgccgacauccuccuccaccccaccggcgucacccgccgccgcauccagcccgaggaggacgagggcaaggucgucguccgccucuccgaggagccccgcuccuacgucgaguccgucgcccgcaccgccgucgccggcccccgcgcccaggacuccgagcccaaguccuucuccgcccccgccacccaggccuacggccacgagaucccccuccgcaacggcacccucggcggcuccuucgucucccccuccccccucuccaccuccucccccauccucuccgccgacuccaccuccgucggcuccuuccccuccggcgaguccuccgaccagggcccccgcacccccacccagccccuccucgaguccggcuuccgcuccggcucccucggccagcccucccccuccgcccagcgcaacuaccaguccuccuccccccuccccaccgucggcuccuccuacuccucccccgacuacucccuccagcacuucuccuccucccccgagucccaggcccgcgcccaguucuccgucgccggcguccacaccguccccggcuccccccaggcccgccaccgcaccgucggcaccaacaccccccccucccccggcuucggcuggcgcgccaucaaccccuccauggccgcccccuccucccccucccucucccaccaccagaugaugggcccccccggcaccggcuuccacggcuccaccgucuccuccccccaguccuccgccgccaccacccccggcucccccucccucugccgccaccccgccggcgucuaccaggucuccggccuccacaacaaggucgccaccacccccggcucccccucccucggccgccaccccggcgcccaccagggcaaccucgccuccggccuccacuccaacgccaucgccucccccggcucccccucccucggccgccaccucggcggcuccggcuccgucguccccggcucccccugccucgaccgccacgucgccuacggcggcuacuccacccccgaggaccgccgccccacccucucccgccaguccuccgccuccggcuaccaggcccccuccacccccuccuuccccgucucccccgccuacuaccccggccucuccucccccgccaccucccccucccccgacuccgccgccuuccgccagggcucccccacccccgcccuccccgagaagcgccgcauguccgucggcgaccgcgccggcucccuccccaacuacgccaccaucaacggcaaggucuccucccccgucgccuccggcauguccucccccuccggcggcuccaccgucuccuucucccacacccuccccgacuucuccaaguacuccaugcccgacaacucccccgagacccgcgccaaggucaaguucguccaggacaccuccaaguacugguacaagcccgagaucucccgcgagcaggccaucgcccuccucaaggaccaggagcccggcgccuucaucauccgcgacucccacuccuuccgcggcgccuacggccucgccaugaaggucuccucccccccccccaccaucaugcagcagaacaagaagggcgacaugacccacgagcucguccgccacuuccucaucgagaccggcccccgcggcgucaagcucaagggcugccccaacgagcccaacuucggcucccucuccgcccucgucuaccagcacuccaucaucccccucgcccuccccugcaagcucgucauccccaaccgcgaccccaccgacgaguccaaggacuccuccggccccgccaacuccaccgccgaccuccucaagcagggcgccgccugcaacguccucuucgucaacuccgucgacauggagucccucaccggcccccaggccaucuccaaggccaccuccgagacccucgccgccgaccccacccccgccgccaccaucguccacuucaaggucuccgcccagggcaucacccucaccgacaaccagcgcaagcucuucuuccgccgccacuacccccucaacaccgucaccuucugcgaccucgacccccaggagcgcaaguggaugaagaccgagggcggcgcccccgccaagcucuucggcuucgucgcccgcaagcagggcuccaccaccgacaacgccugccaccucuucgccgagcucgaccccaaccagcccgccuccgccaucgucaacuucgucuccaaggucaugcucaacgccggccagaagcgcuga

SEQ ID NO: 51015 - RNA, 4260 nt, Artificial Sequence
  derived and/or modified sequence opt2 from TNS2__Homo_sapiens__NP_056134
auggacggcggcggcgucugcgucggccgcggcgaccuccucuccuccccccaggcccucggccagcuccuccgcaaggagucccgcccccgccgcgccaugaagccccgcaaggccgagccccacuccuuccgcgagaaggucuuccgcaagaagccccccgucugcgccgucugcaaggucaccaucgacggcaccggcgucuccugccgcgucugcaaggucgccacccaccgcaagugcgaggccaaggucaccuccgccugccaggcccucccccccgucgagcuccgccgcaacaccgcccccguccgccgcaucgagcaccucggcuccaccaagucccucaaccacuccaagcagcgcuccacccucccccgcuccuucucccucgacccccucauggagcgccgcugggaccucgaccucaccuacgucaccgagcgcauccucgccgccgccuuccccgcccgccccgacgagcagcgccaccgcggccaccuccgcgagcucgcccacguccuccaguccaagcaccgcgacaaguaccuccucuucaaccucuccgagaagcgccacgaccucacccgccucaaccccaagguccaggacuucggcuggcccgagcuccacgcccccccccucgacaagcucugcuccaucugcaaggccauggagaccuggcucuccgccgacccccagcacgucgucguccucuacugcaagggcaacaagggcaagcucggcgucaucgucuccgccuacaugcacuacuccaagaucuccgccggcgccgaccaggcccucgccacccucaccaugcgcaaguucugcgaggacaaggucgccaccgagcuccagcccucccagcgccgcuacaucuccuacuucuccggccuccucuccggcuccauccgcaugaacuccuccccccucuuccuccacuacguccucauccccaugcuccccgccuucgagcccggcaccggcuuccagcccuuccucaagaucuaccaguccaugcagcucgucuacaccuccggcgucuaccacaucgccggccccggcccccagcagcucugcaucucccucgagcccgcccuccuccucaagggcgacgucauggucaccugcuaccacaagggcggccgcggcaccgaccgcacccucgucuuccgcguccaguuccacaccugcaccauccacggcccccagcucaccuuccccaaggaccagcucgacgaggccuggaccgacgagcgcuuccccuuccaggccuccgucgaguucgucuucuccuccucccccgagaagaucaagggcuccaccccccgcaacgaccccuccgucuccgucgacuacaacaccaccgagcccgccguccgcugggacuccuacgagaacuucaaccagcaccacgaggacuccgucgacggcucccucacccacacccgcggcccccucgacggcucccccuacgcccagguccagcgccccccccgccagaccccccccgcccccucccccgagcccccccccccccccaugcucuccgucuccuccgacuccggccacuccuccacccucaccaccgagcccgccgccgagucccccggccgccccccccccaccgccgccgagcgccaggagcucgaccgccuccucggcggcugcggcgucgccuccggcggccgcggcgccggccgcgagaccgccauccucgacgacgaggagcagcccaccgucggcggcggcccccaccucggcgucuaccccggccaccgccccggccucucccgccacugcuccugccgccagggcuaccgcgagcccugcggcguccccaacggcggcuacuaccgccccgagggcacccucgagcgccgccgccucgccuacggcggcuacgagggcuccccccagggcuacgccgaggccuccauggagaagcgccgccucugccgcucccucuccgagggccucuaccccuacccccccgagaugggcaagcccgccaccggcgacuucggcuaccgcgcccccggcuaccgcgaggucgucauccucgaggaccccggccuccccgcccucuaccccugccccgccugcgaggagaagcucgcccuccccaccgccgcccucuacggccuccgccucgagcgcgaggccggcgagggcugggccuccgaggccggcaagccccuccuccaccccguccgccccggccacccccucccccuccuccuccccgccugcggccaccaccacgcccccaugcccgacuacuccugccucaagccccccaaggccggcgaggagggccacgagggcugcuccuacaccaugugccccgagggccgcuacggccaccccggcuaccccgcccucgucaccuacuccuacggcggcgccguccccuccuacugccccgccuacggccgcgucccccacuccugcggcucccccggcgagggccgcggcuaccccucccccggcgcccacuccccccgcgccggcuccaucucccccggcuccccccccuacccccagucccgcaagcucuccuacgagauccccaccgaggagggcggcgaccgcuacccccuccccggccaccucgccuccgccggcccccucgccuccgccgagucccucgagcccgucuccuggcgcgagggccccuccggccacuccacccucccccgcuccccccgcgacgcccccugcuccgccuccuccgagcucuccggccccuccaccccccuccacaccuccucccccguccagggcaaggaguccacccgccgccaggacacccgcucccccaccuccgcccccacccagcgccucucccccggcgaggcccucccccccgucucccaggccggcaccggcaaggcccccgagcuccccuccggcuccggccccgagccccucgcccccucccccgucucccccaccuucccccccuccucccccuccgacuggccccaggagcgcucccccggcggccacuccgacggcgccuccccccgcucccccguccccaccacccuccccggccuccgccacgcccccuggcagggcccccgcggcccccccgacucccccgacggcuccccccucacccccguccccucccagaugcccuggcucgucgccucccccgagcccccccaguccucccccacccccgccuucccccucgccgccuccuacgacaccaacggccucucccagcccccccuccccgagaagcgccaccuccccggccccggccagcagcccggccccuggggccccgagcaggccuccucccccgcccgcggcaucucccaccacgucaccuucgccccccuccucuccgacaacgucccccagacccccgagccccccacccaggagucccaguccaacgucaaguucguccaggacaccuccaaguucugguacaagccccaccucucccgcgaccaggccaucgcccuccucaaggacaaggaccccggcgccuuccucauccgcgacucccacuccuuccagggcgccuacggccucgcccucaaggucgccacccccccccccuccgcccagcccuggaagggcgaccccgucgagcagcucguccgccacuuccucaucgagaccggccccaagggcgucaagaucaagggcugccccuccgagcccuacuucggcucccucuccgcccucgucucccagcacuccaucucccccaucucccuccccugcugccuccgcauccccuccaaggacccccucgaggagacccccgaggcccccguccccaccaacauguccaccgccgccgaccuccuccgccagggcgccgccugcuccguccucuaccucaccuccgucgagaccgagucccucaccggcccccaggccgucgcccgcgccuccuccgccgcccucuccugcuccccccgccccacccccgccgucguccacuucaaggucuccgcccagggcaucacccucaccgacaaccagcgcaagcucuucuuccgccgccacuaccccgucaacuccaucaccuucuccuccaccgacccccaggaccgccgcuggaccaaccccgacggcaccaccuccaagaucuucggcuucgucgccaagaagcccggcucccccugggagaacgucugccaccucuucgccgagcucgaccccgaccagcccgccggcgccaucgucaccuucaucaccaagguccuccucggccagcgcaaguga

SEQ ID NO: 51016 - RNA, 4686 nt, Artificial Sequence
  derived and/or modified sequence opt2 from TNS3__Homo_sapiens__XP_011513778
augugcucccgccagcgcuccggcuucggcugcaucaccaacugguggaagaugggcacccgccaccccgcccaccccgcccagcccgaggagcucaccuccucccuccacgccuucaagaacaaggccuucaagaaguccaaggucugcggcgucugcaagcagaucaucgacggccagggcaucuccugccgcgccugcaaguacuccugccacaagaagugcgaggccaaggucgucauccccugcggcguccagguccgccucgagcaggcccccggcuccuccacccucuccuccucccucugccgcgacaagccccuccgccccgucauccucucccccaccauggaggagggccacggccucgaccucaccuacaucaccgagcgcaucaucgccgucuccuuccccgccggcugcuccgaggaguccuaccuccacaaccuccaggaggucacccgcaugcucaaguccaagcacggcgacaacuaccucguccucaaccucuccgagaagcgcuacgaccucaccaagcucaaccccaagaucauggacgucggcuggcccgagcuccacgcccccccccucgacaagaugugcaccaucugcaaggcccaggaguccuggcucaacuccaaccuccagcacgucgucgucauccacugccgcggcggcaagggccgcaucggcgucgucaucuccuccuacaugcacuucaccaacgucuccgccuccgccgaccaggcccucgaccgcuucgccaugaagaaguucuacgacgacaaggucuccgcccucaugcagcccucccagaagcgcuacguccaguuccucuccggccuccucuccggcuccgucaagaugaacgccuccccccucuuccuccacuucgucauccuccacggcacccccaacuucgacaccggcggcgucugccgccccuuccucaagcucuaccaggccaugcagcccgucuacaccuccggcaucuacaacgucggccccgagaaccccucccgcaucugcaucgucaucgagcccgcccagcuccucaagggcgacgucauggucaagugcuaccacaagaaguaccgcuccgccacccgcgacgucaucuuccgccuccaguuccacaccggcgccguccagggcuacggccucgucuucggcaaggaggaccucgacaacgccuccaaggacgaccgcuuccccgacuacggcaaggucgagcucgucuucuccgccacccccgagaagauccagggcuccgagcaccucuacaacgaccacggcgucaucgucgacuacaacaccaccgacccccucauccgcugggacuccuacgagaaccucuccgccgacggcgagguccuccacacccagggccccgucgacggcucccucuacgccaagguccgcaagaaguccuccuccgaccccggcauccccggcggcccccaggccauccccgccaccaacucccccgaccacuccgaccacacccucuccgucuccuccgacuccggccacuccaccgccuccgcccgcaccgacaagaccgaggagcgccucgcccccggcacccgccgcggccucuccgcccaggagaaggccgagcucgaccagcuccucuccggcuucggccucgaggaccccggcuccucccucaaggagaugaccgacgcccgcuccaaguacuccggcacccgccacgucguccccgcccagguccacgucaacggcgacgccgcccucaaggaccgcgagaccgacauccucgacgacgagaugccccaccacgaccuccacuccgucgacucccucggcacccucuccuccuccgagggcccccaguccgcccaccucggccccuucaccugccacaaguccucccagaacucccuccucuccgacggcuucggcuccaacgucggcgaggacccccagggcacccucguccccgaccucggccucggcauggacggccccuacgagcgcgagcgcaccuucggcucccgcgagcccaagcagccccagccccuccuccgcaagcccuccgucuccgcccagaugcaggccuacggccaguccuccuacuccacccagaccuggguccgccagcagcagauggucgucgcccaccaguacuccuucgcccccgacggcgaggcccgccucgucucccgcugccccgccgacaaccccggccucguccaggcccagccccgcgucccccucacccccacccgcggcaccuccucccgcgucgccguccagcgcggcgucggcuccggcccccacccccccgacacccagcagcccucccccuccaaggccuucaagccccgcuuccccggcgaccaggucgucaacggcgccggccccgagcucuccaccggccccucccccggcucccccacccucgacaucgaccaguccaucgagcagcucaaccgccucauccucgagcucgaccccaccuucgagcccauccccacccacaugaacgcccucggcucccaggccaacggcuccgucucccccgacuccgucggcggcggccuccgcgccuccucccgccuccccgacaccggcgagggccccucccgcgccaccggccgccagggcuccuccgccgagcagccccucggcggccgccuccgcaagcucucccucggccaguacgacaacgacgccggcggccagcuccccuucuccaagugcgccuggggcaaggccggcgucgacuacgcccccaaccucccccccuuccccucccccgccgacgucaaggagaccaugacccccggcuacccccaggaccucgacaucaucgacggccgcauccucuccuccaaggaguccaugugcuccacccccgccuuccccgucucccccgagacccccuacgucaagaccgcccuccgccacccccccuucuccccccccgagcccccccucuccucccccgccucccagcacaagggcggccgcgagccccgcuccugccccgagacccucacccacgccgucggcauguccgagucccccaucggccccaaguccaccaugcuccgcgccgacgccuccuccacccccuccuuccagcaggccuucgccuccuccugcaccaucuccuccaacggccccggccagcgccgcgaguccuccuccuccgccgagcgccagugggucgaguccucccccaagcccauggucucccuccucggcuccggccgccccaccggcuccccccucuccgccgaguucuccggcacccgcaaggacucccccguccucuccugcuucccccccuccgagcuccaggcccccuuccacucccacgagcucucccucgccgagccccccgacucccucgccccccccuccucccaggccuuccucggcuucggcaccgcccccgucggcuccggccucccccccgaggaggaccucggcgcccuccucgccaacucccacggcgccucccccacccccuccaucccccucaccgccaccggcgccgccgacaacggcuuccucucccacaacuuccucaccgucgcccccggccacuccucccaccacucccccggccuccagggccagggcgucacccuccccggccagcccccccuccccgagaagaagcgcgccuccgagggcgaccgcucccucggcuccgucucccccuccuccuccggcuucuccuccccccacuccggcuccaccaucuccauccccuuccccaacguccuccccgacuucuccaaggccuccgaggccgccuccccccuccccgacucccccggcgacaagcucgucaucgucaaguucguccaggacaccuccaaguucugguacaaggccgacaucucccgcgagcaggccaucgccaugcucaaggacaaggagcccggcuccuucaucguccgcgacucccacuccuuccgcggcgccuacggccucgccaugaaggucgccacccccccccccuccguccuccagcucaacaagaaggccggcgaccucgccaacgagcucguccgccacuuccucaucgagugcacccccaagggcguccgccucaagggcugcuccaacgagcccuacuucggcucccucaccgcccucgucugccagcacuccaucaccccccucgcccuccccugcaagcuccucauccccgagcgcgacccccucgaggagaucgccgaguccuccccccagaccgccgccaacuccgccgccgagcuccucaagcagggcgccgccugcaacgucugguaccucaacuccgucgagauggagucccucaccggccaccaggccauccagaaggcccucuccaucacccucguccaggagcccccccccgucuccaccgucguccacuucaaggucuccgcccagggcaucacccucaccgacaaccagcgcaagcucuucuuccgccgccacuaccccgucaacuccgucaucuucugcgcccucgacccccaggaccgcaaguggaucaaggacggccccuccuccaaggucuucggcuucgucgcccgcaagcagggcuccgccaccgacaacgucugccaccucuucgccgagcacgaccccgagcagcccgccuccgccaucgucaacuucgucuccaaggucaugaucggcucccccaagaaggucuga

SEQ ID NO: 51017 - RNA, 2148 nt, Artificial Sequence
  derived and/or modified sequence opt2 from TNS4__Homo_sapiens__NP_116254
augucccaggucauguccuccccccuccucgccggcggccacgccgucucccucgcccccugcgacgagccccgccgcacccuccaccccgcccccucccccucccuccccccccagugcuccuacuacaccaccgagggcuggggcgcccaggcccucauggcccccguccccugcaugggcccccccggccgccuccagcaggccccccaggucgaggccaaggccaccugcuuccuccccucccccggcgagaaggcccucggcacccccgaggaccucgacuccuacaucgacuucucccucgagucccucaaccagaugauccucgagcucgaccccaccuuccagcuccucccccccggcaccggcggcucccaggccgagcucgcccaguccaccauguccaugcgcaagaaggaggaguccgaggcccucgacaucaaguacaucgaggucaccuccgcccgcucccgcugccacgacggcccccagcacugcuccucccccuccgucaccccccccuucggcucccuccgcuccggcggccuccuccucucccgcgacgucccccgcgagacccgcuccuccuccgagucccucaucuucuccggcaaccagggccgcggccaccagcgcccccucccccccuccgagggccucuccccccgcccccccaacucccccuccaucuccauccccugcaugggcuccaaggccuccuccccccacggccucggcuccccccucgucgccuccccccgccucgagaagcgccucggcggccucgccccccagcgcggcucccgcaucuccguccucuccgccucccccgucuccgacgucuccuacauguucggcuccucccagucccuccuccacuccuccaacuccucccaccaguccuccucccgcucccucgagucccccgccaacuccuccuccucccuccacucccucggcuccgucucccucugcacccgccccuccgacuuccaggccccccgcaaccccacccucaccaugggccagccccgcaccccccacucccccccccucgccaaggagcacgccuccuccugcccccccuccaucaccaacuccauggucgacauccccaucguccucaucaacggcugccccgagcccggcuccucccccccccagcgcacccccggccaccagaacuccguccagcccggcgccgccucccccuccaaccccugccccgccacccgcuccaacucccagacccucuccgacgcccccuucaccaccugccccgagggccccgcccgcgacaugcagcccaccaugaaguucgucauggacaccuccaaguacugguucaagcccaacaucacccgcgagcaggccaucgagcuccuccgcaaggaggagcccggcgccuucgucauccgcgacuccuccuccuaccgcggcuccuucggccucgcccucaagguccaggagguccccgccuccgcccagucccgccccggcgaggacuccaacgaccucauccgccacuuccucaucgaguccuccgccaagggcguccaccucaagggcgccgacgaggagcccuacuucggcucccucuccgccuucgucugccagcacuccaucauggcccucgcccuccccugcaagcucaccaucccccagcgcgagcucggcggcgccgacggcgccuccgacuccaccgacucccccgccuccugccagaagaaguccgccggcugccacacccucuaccucuccuccgucuccgucgagacccucaccggcgcccucgccguccagaaggccaucuccaccaccuucgagcgcgacauccuccccacccccaccgucguccacuucaaggucaccgagcagggcaucacccucaccgacguccagcgcaaggucuucuuccgccgccacuacccccucaccacccuccgcuucugcggcauggaccccgagcagcgcaaguggcagaaguacugcaagcccuccuggaucuucggcuucgucgccaagucccagaccgagccccaggagaacgucugccaccucuucgccgaguacgacaugguccagcccgccucccaggucaucggccucgucaccgcccuccuccaggacgccgagcgcauguga

SEQ ID NO: 51018 - RNA, 12729 nt, Artificial Sequence
  derived and/or modified sequence opt2 from TNXB__Homo_sapiens__NP_061978
augaugcccgcccaguacgcccucaccuccucccucguccuccucguccuccucuccaccgcccgcgccggccccuucuccucccgcuccaacgucacccuccccgccccccgcccccccccccagcccggcggccacaccgucggcgccggcgucggcucccccuccucccagcucuacgagcacaccgucgagggcggcgagaagcaggucgucuucacccaccgcaucaaccucccccccuccaccggcugcggcugcccccccggcaccgagccccccguccucgccuccgagguccaggcccuccgcguccgccucgagauccucgaggagcucgucaagggccucaaggagcagugcaccggcggcugcugccccgccuccgcccaggccggcaccggccagaccgacguccgcacccucugcucccuccacggcgucuucgaccucucccgcugcaccugcuccugcgagcccggcuggggcggccccaccugcuccgaccccaccgacgccgagaucccccccuccuccccccccuccgccuccggcuccugccccgacgacugcaacgaccagggccgcugcguccgcggccgcugcgucugcuuccccggcuacaccggccccuccugcggcuggcccuccugccccggcgacugccagggccgcggccgcugcguccagggcgucugcgucugccgcgccggcuucuccggccccgacugcucccagcgcuccugcccccgcggcugcucccagcgcggccgcugcgagggcggccgcugcgucugcgaccccggcuacaccggcgacgacugcggcaugcgcuccugcccccgcggcugcucccagcgcggccgcugcgagaacggccgcugcgucugcaaccccggcuacaccggcgaggacugcggcguccgcuccugcccccgcggcugcucccagcgcggccgcugcaaggacggccgcugcgucugcgaccccggcuacaccggcgaggacugcggcacccgcuccugccccugggacugcggcgagggcggccgcugcgucgacggccgcugcgucugcuggcccggcuacaccggcgaggacugcuccacccgcaccugcccccgcgacugccgcggccgcggccgcugcgaggacggcgagugcaucugcgacaccggcuacuccggcgacgacugcggcguccgcuccugccccggcgacugcaaccagcgcggccgcugcgaggacggccgcugcgucugcuggcccggcuacaccggcaccgacugcggcucccgcgccugcccccgcgacugccgcggccgcggccgcugcgagaacggcgucugcgucugcaacgccggcuacuccggcgaggacugcggcguccgcuccugccccggcgacugccgcggccgcggccgcugcgaguccggccgcugcaugugcuggcccggcuacaccggccgcgacugcggcacccgcgccugccccggcgacugccgcggccgcggccgcugcgucgacggccgcugcgucugcaaccccggcuucaccggcgaggacugcggcucccgccgcugccccggcgacugccgcggccacggccucugcgaggacggcgucugcgucugcgacgccggcuacuccggcgaggacugcuccacccgcuccugccccggcggcugccgcggccgcggccagugccucgacggccgcugcgucugcgaggacggcuacuccggcgaggacugcggcguccgccagugccccaacgacugcucccagcacggcgucugccaggacggcgucugcaucugcugggagggcuacgucuccgaggacugcuccauccgcaccugccccuccaacugccacggccgcggccgcugcgaggagggccgcugccucugcgaccccggcuacaccggccccaccugcgccacccgcaugugccccgccgacugccgcggccgcggccgcugcguccagggcgucugccucugccacgucggcuacggcggcgaggacugcggccaggaggagccccccgccuccgccugccccggcggcugcggcccccgcgagcucugccgcgccggccagugcgucugcgucgagggcuuccgcggccccgacugcgccauccagaccugccccggcgacugccgcggccgcggcgagugccacgacggcuccugcgucugcaaggacggcuacgccggcgaggacugcggcgaggagguccccaccaucgagggcaugcgcaugcaccuccucgaggagaccaccguccgcaccgaguggacccccgcccccggccccgucgacgccuacgagauccaguucauccccaccaccgagggcgccuccccccccuucaccgcccgcguccccuccuccgccuccgccuacgaccagcgcggccucgcccccggccaggaguaccaggucaccguccgcgcccuccgcggcaccuccuggggccuccccgccuccaagaccaucaccaccaugaucgacggcccccaggaccuccgcgucgucgccgucacccccaccacccucgagcucggcuggcuccgcccccaggccgaggucgaccgcuucgucgucuccuacgucuccgccggcaaccagcgcguccgccucgaggucccccccgaggccgacggcacccuccucaccgaccucaugcccggcgucgaguacgucgucaccgucaccgccgagcgcggccgcgccgucuccuaccccgccuccguccgcgccaacaccggcuccuccccccucggccuccucggcaccaccgacgagcccccccccuccggccccuccaccacccagggcgcccaggccccccuccuccagcagcgcccccaggagcucggcgagcuccgcguccucggccgcgacgagaccggccgccuccgcgucgucuggaccgcccagcccgacaccuucgccuacuuccagcuccgcaugcgcguccccgagggccccggcgcccacgaggagguccuccccggcgacguccgccaggcccucguccccccccccccccccggcacccccuacgagcucucccuccacggcgucccccccggcggcaagcccuccgaccccaucaucuaccagggcaucauggacaaggacgaggagaagcccggcaaguccuccggccccccccgccucggcgagcucaccgucaccgaccgcaccuccgacucccuccuccuccgcuggaccguccccgagggcgaguucgacuccuucgucauccaguacaaggaccgcgacggccagccccaggucguccccgucgagggcccccagcgcuccgccgucaucaccucccucgaccccggccgcaaguacaaguucguccucuacggcuucgucggcaagaagcgccacggcccccucgucgccgaggccaagauccucccccaguccgaccccucccccggcacccccccccaccucggcaaccucugggucaccgaccccacccccgacucccuccaccucuccuggaccguccccgagggccaguucgacaccuucaugguccaguaccgcgaccgcgacggccgcccccaggucguccccgucgagggccccgagcgcuccuucgucgucuccucccucgaccccgaccacaaguaccgcuucacccucuucggcaucgccaacaagaagcgcuacggcccccucaccgccgacggcaccaccgcccccgagcgcaaggaggagcccccccgccccgaguuccucgagcagccccuccucggcgagcucaccgucaccggcgucacccccgacucccuccgccucuccuggaccgucgcccagggccccuucgacuccuucaugguccaguacaaggacgcccagggccagccccaggccguccccgucgccggcgacgagaacgaggucaccguccccggccucgaccccgaccgcaaguacaagaugaaccucuacggccuccgcggccgccagcgcgucggccccgaguccgucgucgccaagaccgccccccaggaggacgucgacgagacccccucccccaccgagcucggcaccgaggcccccgagucccccgaggagccccuccucggcgagcucaccgucaccggcuccucccccgacucccucucccucuucuggaccgucccccagggcuccuucgacuccuucaccguccaguacaaggaccgcgacggccgcccccgcgccguccgcgucggcggcaaggaguccgaggucaccgucggcggccucgagcccggccacaaguacaagaugcaccucuacggccuccacgagggccagcgcgucggccccgucuccgccgucggcgucaccgccccccagcaggaggagaccccccccgccaccgaguccccccucgagccccgccucggcgagcucaccgucaccgacgucacccccaacuccgucggccucuccuggaccguccccgagggccaguucgacuccuucaucguccaguacaaggacaaggacggccagccccaggucguccccgucgccgccgaccagcgcgaggucaccgucuacaaccucgagcccgagcgcaaguacaagaugaacauguacggccuccacgacggccagcgcaugggcccccucuccgucgucaucgucaccgccccccucccccccgcccccgccaccgaggccuccaagcccccccucgagccccgccucggcgagcucaccgucaccgacaucacccccgacuccgucggccucuccuggaccguccccgagggcgaguucgacuccuucgucguccaguacaaggaccgcgacggccagccccaggucguccccgucgccgccgaccagcgcgaggucaccauccccgaccucgagcccucccgcaaguacaaguuccuccucuucggcauccaggacggcaagcgccgcucccccgucuccgucgaggccaagaccgucgcccgcggcgacgccucccccggcgcccccccccgccucggcgagcucugggucaccgaccccacccccgacucccuccgccucuccuggaccguccccgagggccaguucgacuccuucgucguccaguucaaggacaaggacggcccccaggucguccccgucgagggccacgagcgcuccgucaccgucaccccccucgacgccggccgcaaguaccgcuuccuccucuacggccuccucggcaagaagcgccacggcccccucaccgccgacggcaccaccgaggcccgcuccgccauggacgacaccggcaccaagcgcccccccaagccccgccucggcgaggagcuccaggucaccaccgucacccagaacuccgucggccucuccuggaccguccccgagggccaguucgacuccuucgucguccaguacaaggaccgcgacggccagccccaggucguccccgucgagggcucccuccgcgaggucuccguccccggccucgaccccgcccaccgcuacaagcuccuccucuacggccuccaccacggcaagcgcgucggccccaucuccgccgucgccaucaccgccggccgcgaggagaccgagaccgagaccaccgcccccaccccccccgcccccgagccccaccucggcgagcucaccgucgaggaggccaccucccacacccuccaccucuccuggauggucaccgagggcgaguucgacuccuucgagauccaguacaccgaccgcgacggccagcuccagaugguccgcaucggcggcgaccgcaacgacaucacccucuccggccucgaguccgaccaccgcuaccucgucacccucuacggcuucuccgacggcaagcacgucggccccguccacgucgaggcccucaccguccccgaggaggagaagcccuccgagccccccaccgccacccccgagccccccaucaagccccgccucggcgagcucaccgucaccgacgccacccccgacucccucucccucuccuggaccguccccgagggccaguucgaccacuuccucguccaguaccgcaacggcgacggccagcccaaggccguccgcguccccggccacgaggagggcgucaccaucuccggccucgagcccgaccacaaguacaagaugaaccucuacggcuuccacggcggccagcgcaugggccccgucuccgucgucggcgucaccgccgccgaggaggagacccccucccccaccgagcccuccauggaggcccccgagcccgccgaggagccccuccucggcgagcucaccgucaccggcuccucccccgacucccucucccucuccuggaccgucccccagggccgcuucgacuccuucaccguccaguacaaggaccgcgacggccgcccccaggucguccgcgucggcggcgaggaguccgaggucaccgucggcggccucgagcccggccgcaaguacaagaugcaccucuacggccuccacgagggccgccgcgucggccccgucuccgccgucggcgucaccgcccccgaggaggagucccccgacgccccccucgccaagcuccgccucggccagaugaccguccgcgacaucaccuccgacucccucucccucuccuggaccguccccgagggccaguucgaccacuuccucguccaguucaagaacggcgacggccagcccaaggccguccgcguccccggccacgaggacggcgucaccaucuccggccucgagcccgaccacaaguacaagaugaaccucuacggcuuccacggcggccagcgcgucggccccgucuccgccgucggccucaccgcccccggcaaggacgaggagauggcccccgccuccaccgagccccccacccccgagccccccaucaagccccgccucgaggagcucaccgucaccgacgccacccccgacucccucucccucuccuggaccguccccgagggccaguucgaccacuuccucguccaguacaagaacggcgacggccagcccaaggccacccgcguccccggccacgaggaccgcgucaccaucuccggccucgagcccgacaacaaguacaagaugaaccucuacggcuuccacggcggccagcgcgucggccccgucuccgccaucggcgucaccgccgccgaggaggagacccccucccccaccgagcccuccauggaggcccccgagccccccgaggagccccuccucggcgagcucaccgucaccggcuccucccccgacucccucucccucuccuggaccgucccccagggccgcuucgacuccuucaccguccaguacaaggaccgcgacggccgcccccaggucguccgcgucggcggcgaggaguccgaggucaccgucggcggccucgagcccggccgcaaguacaagaugcaccucuacggccuccacgagggccgccgcgucggccccgucuccaccgucggcgucaccgccccccaggaggacgucgacgagacccccucccccaccgagcccggcaccgaggcccccggcccccccgaggagccccuccucggcgagcucaccgucaccggcuccucccccgacucccucucccucuccuggaccgucccccagggccgcuucgacuccuucaccguccaguacaaggaccgcgacggccgcccccaggccguccgcgucggcggccaggaguccaaggucaccguccgcggccucgagcccggccgcaaguacaagaugcaccucuacggccuccacgagggccgccgccucggccccgucuccgccgucggcgucaccgaggacgaggccgagaccacccaggccguccccaccaugacccccgagccccccaucaagccccgccucggcgagcucaccaugaccgacgccacccccgacucccucucccucuccuggaccguccccgagggccaguucgaccacuuccucguccaguaccgcaacggcgacggccagcccaaggccguccgcguccccggccacgaggacggcgucaccaucuccggccucgagcccgaccacaaguacaagaugaaccucuacggcuuccacggcggccagcgcgucggccccaucuccgucaucggcgucaccgccgccgaggaggagacccccucccccaccgagcucuccaccgaggcccccgagccccccgaggagccccuccucggcgagcucaccgucaccggcuccucccccgacucccucucccucuccuggaccaucccccagggccacuucgacuccuucaccguccaguacaaggaccgcgacggccgcccccaggucaugcgcguccgcggcgaggaguccgaggucaccgucggcggccucgagcccggccgcaaguacaagaugcaccucuacggccuccacgagggccgccgcgucggccccgucuccaccgucggcgucaccgaggacgaggccgagaccacccaggccguccccaccaccacccccgagccccccaacaagccccgccucggcgagcucaccgucaccgacgccacccccgacucccucucccucuccuggaugguccccgagggccaguucgaccacuuccucguccaguaccgcaacggcgacggccagcccaaggucguccgcguccccggccacgaggacggcgucaccaucuccggccucgagcccgaccacaaguacaagaugaaccucuacggcuuccacggcggccagcgcgucggccccaucuccgucaucggcgucaccgccgccgaggaggagacccccgcccccaccgagcccuccaccgaggcccccgagccccccgaggagccccuccucggcgagcucaccgucaccggcuccucccccgacucccucucccucuccuggaccaucccccagggccgcuucgacuccuucaccguccaguacaaggaccgcgacggccgcccccaggucguccgcguccgcggcgaggaguccgaggucaccgucggcggccucgagcccggcugcaaguacaagaugcaccucuacggccuccacgagggccagcgcgucggccccgucuccgccgucggcgucaccgcccccaaggacgaggccgagaccacccaggccguccccaccaugacccccgagccccccaucaagccccgccucggcgagcucaccgucaccgacgccacccccgacucccucucccucuccuggaugguccccgagggccaguucgaccacuuccucguccaguaccgcaacggcgacggccagcccaaggccguccgcguccccggccacgaggacggcgucaccaucuccggccucgagcccgaccacaaguacaagaugaaccucuacggcuuccacggcggccagcgcgucggccccgucuccgccaucggcgucaccgaggaggagacccccucccccaccgagcccuccaccgaggcccccgaggcccccgaggagccccuccucggcgagcucaccgucaccggcuccucccccgacucccucucccucuccuggaccgucccccagggccgcuucgacuccuucaccguccaguacaaggaccgcgacggccagccccaggucguccgcguccgcggcgaggaguccgaggucaccgucggcggccucgagcccggccgcaaguacaagaugcaccucuacggccuccacgagggccagcgcgucggccccgucuccaccgucggcaucaccgccccccuccccaccccccuccccgucgagccccgccucggcgagcucgccgucgccgccgucaccuccgacuccgucggccucuccuggaccgucgcccagggccccuucgacuccuuccucguccaguaccgcgacgcccagggccagccccaggccguccccgucuccggcgaccuccgcgccgucgccgucuccggccucgaccccgcccgcaaguacaaguuccuccucuucggccuccagaacggcaagcgccacggccccguccccgucgaggcccgcaccgcccccgacaccaagcccuccccccgccucggcgagcucaccgucaccgacgccacccccgacuccgucggccucuccuggaccguccccgagggcgaguucgacuccuucgucguccaguacaaggacaaggacggccgccuccaggucguccccgucgccgccaaccagcgcgaggucaccguccagggccucgagcccucccgcaaguaccgcuuccuccucuacggccucuccggccgcaagcgccucggccccaucuccgccgacuccaccaccgccccccucgagaaggagcuccccccccaccucggcgagcucaccgucgccgaggagaccuccuccucccuccgccucuccuggaccgucgcccagggccccuucgacuccuucgucguccaguaccgcgacaccgacggccagccccgcgccguccccgucgccgccgaccagcgcaccgucaccgucgaggaccucgagcccggcaagaaguacaaguuccuccucuacggccuccucggcggcaagcgccucggccccgucuccgcccucggcaugaccgcccccgaggaggacacccccgcccccgagcucgcccccgaggcccccgagccccccgaggagccccgccucggcguccucaccgucaccgacaccacccccgacuccaugcgccucuccugguccgucgcccagggccccuucgacuccuucgucguccaguacgaggacaccaacggccagccccaggcccuccucgucgacggcgaccaguccaagauccucaucuccggccucgagcccuccacccccuaccgcuuccuccucuacggccuccacgagggcaagcgccucggcccccucuccgccgagggcaccaccggccucgcccccgccggccagaccuccgaggagucccgcccccgccucucccagcucuccgucaccgacgucaccaccuccucccuccgccucaacugggaggccccccccggcgccuucgacuccuuccuccuccgcuucggcguccccucccccuccacccucgagccccacccccgcccccuccuccagcgcgagcucaugguccccggcacccgccacuccgccguccuccgcgaccuccgcuccggcacccucuacucccucacccucuacggccuccgcggcccccacaaggccgacuccauccagggcaccgcccgcacccucucccccguccucgaguccccccgcgaccuccaguucuccgagauccgcgagaccuccgccaaggucaacuggaugcccccccccucccgcgccgacuccuucaaggucuccuaccagcucgccgacggcggcgagccccaguccguccaggucgacggccaggcccgcacccagaagcuccagggccucauccccggcgcccgcuacgaggucaccgucgucuccguccgcggcuucgaggaguccgagccccucaccggcuuccucaccaccguccccgacggccccacccagcuccgcgcccucaaccucaccgagggcuucgccguccuccacuggaagcccccccagaaccccgucgacaccuacgacguccaggucaccgcccccggcgcccccccccuccaggccgagacccccggcuccgccgucgacuacccccuccacgaccucguccuccacaccaacuacaccgccaccguccgcggccuccgcggccccaaccucaccucccccgccuccaucaccuucaccaccggccucgaggccccccgcgaccucgaggccaaggaggucaccccccgcaccgcccuccucaccuggaccgagccccccguccgccccgccggcuaccuccucuccuuccacacccccggcggccagaaccaggagauccuccuccccggcggcaucaccucccaccagcuccucggccucuuccccuccaccuccuacaacgcccgccuccaggccauguggggccagucccuccucccccccgucuccaccuccuucaccaccggcggccuccgcauccccuucccccgcgacugcggcgaggagaugcagaacggcgccggcgccucccgcaccuccaccaucuuccucaacggcaaccgcgagcgcccccucaacgucuucugcgacauggagaccgacggcggcggcuggcucgucuuccagcgccgcauggacggccagaccgacuucuggcgcgacugggaggacuacgcccacggcuucggcaacaucuccggcgaguucuggcucggcaacgaggcccuccacucccucacccaggccggcgacuacuccaugcgcgucgaccuccgcgccggcgacgaggccgucuucgcccaguacgacuccuuccacgucgacuccgccgccgaguacuaccgccuccaccucgagggcuaccacggcaccgccggcgacuccauguccuaccacuccggcuccgucuucuccgcccgcgaccgcgaccccaacucccuccucaucuccugcgccgucuccuaccgcggcgccuggugguaccgcaacugccacuacgccaaccucaacggccucuacggcuccaccgucgaccaccagggcgucuccugguaccacuggaagggcuucgaguucuccguccccuucaccgagaugaagcuccgcccccgcaacuuccgcucccccgccggcggcggcuga

SEQ ID NO: 51019 - RNA, 1038 nt, Artificial Sequence
  derived and/or modified sequence opt2 from TOB1__Homo_sapiens__NP_001230806
augcagcucgagauccaggucgcccucaacuucaucaucuccuaccucuacaacaagcucccccgccgccgcgucaacaucuucggcgaggagcucgagcgccuccucaagaagaaguacgagggccacugguaccccgagaagcccuacaagggcuccggcuuccgcugcauccacaucggcgagaaggucgaccccgucaucgagcaggccuccaaggaguccggccucgacaucgacgacguccgcggcaaccucccccaggaccucuccgucuggaucgaccccuucgaggucuccuaccagaucggcgagaagggccccgucaagguccucuacgucgacgacaacaacgagaacggcugcgagcucgacaaggagaucaagaacuccuucaaccccgaggcccaggucuucaugcccaucuccgaccccgccuccuccgucuccuccucccccuccccccccuucggccacuccgccgccgucucccccaccuucaugccccgcuccacccagccccucaccuucaccaccgccaccuucgccgccaccaaguucggcuccaccaagaugaagaacuccggccgcuccaacaaggucgcccgcaccucccccaucaaccucggccucaacgucaacgaccuccucaagcagaaggccaucuccuccuccaugcacucccucuacggccucggccucggcucccagcagcagccccagcagcagcagcagcccgcccagcccccccccccccccccccccccccagcagcagcagcagcagaagaccuccgcccucucccccaacgccaaggaguucaucuuccccaacaugcagggccagggcuccuccaccaacggcauguuccccggcgacuccccccucaaccucuccccccuccaguacuccaacgccuucgacgucuucgccgccuacggcggccucaacgagaaguccuucgucgacggccucaacuucucccucaacaacaugcaguacuccaaccagcaguuccagcccgucauggccaacuga

SEQ ID NO: 51020 - RNA, 1035 nt, Artificial Sequence
  derived and/or modified sequence opt2 from TOB2__Homo_sapiens__NP_057356
augcagcucgagaucaaggucgcccucaacuucaucaucuccuaccucuacaacaagcucccccgccgccgcgccgaccucuucggcgaggagcucgagcgccuccucaagaagaaguacgagggccacugguaccccgagaagccccucaagggcuccggcuuccgcugcguccacaucggcgagauggucgaccccgucgucgagcucgccgccaagcgcuccggccucgccgucgaggacguccgcgccaacguccccgaggagcucuccgucuggaucgaccccuucgaggucuccuaccagaucggcgagaagggcgccgucaagguccucuaccucgacgacuccgagggcugcggcgcccccgagcucgacaaggagaucaaguccuccuucaaccccgacgcccaggucuucguccccaucggcucccaggacuccucccucuccaacucccccucccccuccuucggccagucccccucccccaccuucaucccccgcuccgcccagcccaucaccuucaccaccgccuccuucgccgccaccaaguucggcuccaccaagaugaagaagggcggcggcgccgccuccggcggcggcgucgccuccuccggcgccggcggccagcagcccccccagcagccccgcauggcccgcucccccaccaacucccuccucaagcacaagucccucucccucuccaugcacucccucaacuucaucaccgccaaccccgccccccagucccagcucucccccaacgccaaggaguucgucuacaacggcggcggcucccccucccucuucuucgacgccgccgacggccagggcuccggcacccccggccccuucggcggcuccggcgccggcaccugcaacuccuccuccuucgacauggcccaggucuucggcggcggcgccaacucccucuuccucgagaagacccccuucgucgagggccucuccuacaaccucaacaccaugcaguaccccucccagcaguuccagcccgucguccucgccaacuga

SEQ ID NO: 51021 - RNA, 825 nt, Artificial Sequence
  derived and/or modified sequence opt2 from TOLLIP__Homo_sapiens__NP_061882
auggccaccaccgucuccacccagcgcggccccgucuacaucggcgagcucccccaggacuuccuccgcaucacccccacccagcagcagcgccagguccagcucgacgcccaggccgcccagcagcuccaguacggcggcgccgucggcaccgucggccgccucaacaucaccgucguccaggccaagcucgccaagaacuacggcaugacccgcauggaccccuacugccgccuccgccucggcuacgccgucuacgagacccccaccgcccacaacggcgccaagaacccccgcuggaacaaggucauccacugcaccgucccccccggcgucgacuccuucuaccucgagaucuucgacgagcgcgccuucuccauggacgaccgcaucgccuggacccacaucaccauccccgagucccuccgccagggcaaggucgaggacaagugguacucccucuccggccgccagggcgacgacaaggagggcaugaucaaccucgucauguccuacgcccuccuccccgccgccauggucaugcccccccagcccgucguccucaugcccaccgucuaccagcagggcgucggcuacguccccaucaccggcaugcccgccgucugcucccccggcaugguccccgucgcccucccccccgccgccgucaacgcccagccccgcugcuccgaggaggaccucaaggccauccaggacauguuccccaacauggaccaggaggucauccgcuccguccucgaggcccagcgcggcaacaaggacgccgccaucaacucccuccuccagaugggcgaggagcccuga

SEQ ID NO: 51022 - RNA, 1383 nt, Artificial Sequence
  derived and/or modified sequence opt2 from TOM1__Homo_sapiens__NP_001129201
auggagaucugcgacaucaucaacgagaccgaggagggccccaaggacgcccuccgcgccgucaagaagcgcaucgucggcaacaagaacuuccacgaggucaugcucgcccucaccguccucgagaccugcgucaagaacugcggccaccgcuuccacguccucgucgccucccaggacuucgucgaguccguccucguccgcaccauccuccccaagaacaacccccccaccaucguccacgacaagguccucaaccucauccaguccugggccgacgccuuccgcuccucccccgaccucaccggcgucgucaccaucuacgaggaccuccgccgcaagggccucgaguuccccaugaccgaccucgacaugcucucccccauccacaccccccagcgcaccgucuucaacuccgagacccaguccggccaggacuccgucggcaccgacuccucccagcaggaggacuccggccagcacgccgccccccuccccgccccccccauccucuccggcgacacccccaucgcccccacccccgagcagaucggcaagcuccgcuccgagcucgagauggucuccggcaacguccgcgucauguccgagaugcucaccgagcucguccccacccaggccgagcccgccgaccucgagcuccuccaggagcucaaccgcaccugccgcgccaugcagcagcgcguccucgagcucaucccccagaucgccaacgagcagcucaccgaggagcuccucaucgucaacgacaaccucaacaacgucuuccuccgccacgagcgcuucgagcgcuuccgcaccggccagaccaccaaggcccccuccgaggccgagcccgccgccgaccucaucgacaugggccccgaccccgccgccaccggcaaccucuccucccagcucgccggcaugaaccucggcuccuccuccguccgcgccggccuccagucccucgaggccuccggccgccucgaggacgaguucgacauguucgcccucacccgcggcuccucccucgccgaccagcgcaaggaggucaaguacgaggccccccaggccaccgacggccucgccggcgcccucgacgcccgccagcaguccaccggcgccauccccgucacccaggccugccucauggaggacaucgagcaguggcucuccaccgacgucggcaacgacgccgaggagcccaagggcgucaccuccgagggcaaguucgacaaguuccucgaggagcgcgccaaggccgccgaccgccuccccaaccucuccucccccuccgccgagggcccccccggcccccccuccggccccgccccccgcaagaagacccaggagaaggacgacgacaugcucuucgcccucuga

SEQ ID NO: 51023 - RNA, 1431 nt, Artificial Sequence
  derived and/or modified sequence opt2 from TOM1L1__Homo_sapiens__NP_005477
auggccuucggcaagucccaccgcgaccccuacgccaccuccgucggccaccucaucgagaaggccaccuucgccggcguccagaccgaggacuggggccaguucaugcacaucugcgacaucaucaacaccacccaggacggccccaaggacgccgucaaggcccucaagaagcgcaucuccaagaacuacaaccacaaggagauccagcucacccucucccucaucgacaugugcguccagaacugcggccccuccuuccagucccucaucgucaagaaggaguucgucaaggagaaccucgucaagcuccucaacccccgcuacaaccucccccucgacauccagaaccgcauccucaacuucaucaagaccuggucccagggcuuccccggcggcgucgacgucuccgaggucaaggaggucuaccucgaccucgucaagaagggcguccaguucccccccuccgaggccgaggccgagaccgcccgccaggagaccgcccagaucuccuccaacccccccaccuccguccccaccgcccccgcccucuccuccgucaucgcccccaagaacuccaccgucacccucguccccgagcagaucggcaagcuccacuccgagcucgacauggucaagaugaacguccgcgucauguccgccauccucauggagaacacccccggcuccgagaaccacgaggacaucgagcuccuccagaagcucuacaagaccggccgcgagaugcaggagcgcaucauggaccuccucgucgucgucgagaacgaggacgucaccgucgagcucauccaggucaacgaggaccucaacaacgccauccucggcuacgagcgcuucacccgcaaccagcagcgcauccucgagcagaacaagaaccagaaggaggccaccaacaccaccuccgagcccuccgcccccucccaggaccuccucgaccucucccccuccccccgcaugccccgcgccacccucggcgagcucaacaccaugaacaaccagcucuccggccucaacuucucccuccccuccuccgacgucaccaacaaccucaagcccucccuccacccccagaugaaccuccucgcccucgagaacaccgagaucccccccuucgcccagcgcaccucccagaaccucaccuccucccacgccuacgacaacuuccucgagcacuccaacuccgucuuccuccagcccgucucccuccagaccaucgccgccgcccccuccaaccagucccuccccccccuccccuccaaccaccccgccaugaccaaguccgaccuccagccccccaacuacuacgaggucauggaguucgacccccucgcccccgccgucaccaccgaggccaucuacgaggagaucgacgcccaccagcacaagggcgcccagaacgacggcgacuga

SEQ ID NO: 51024 - RNA, 438 nt, Artificial Sequence
  derived and/or modified sequence opt2 from TOMM20__Homo_sapiens__NP_055580
auggucggccgcaacuccgccaucgccgccggcgucugcggcgcccucuucaucggcuacugcaucuacuucgaccgcaagcgccgcuccgaccccaacuucaagaaccgccuccgcgagcgccgcaagaagcagaagcucgccaaggagcgcgccggccucuccaagcuccccgaccucaaggacgccgaggccguccagaaguucuuccucgaggagauccagcucggcgaggagcuccucgcccagggcgaguacgagaagggcgucgaccaccucaccaacgccaucgccgucugcggccagccccagcagcuccuccagguccuccagcagacccuccccccccccgucuuccagaugcuccucaccaagcuccccaccaucucccagcgcaucgucuccgcccagucccucgccgaggacgacgucgaguga

SEQ ID NO: 51025 - RNA, 930 nt, Artificial Sequence
  derived and/or modified sequence opt2 from TOMM34__Homo_sapiens__NP_006800
auggcccccaaguuccccgacuccgucgaggagcuccgcgccgccggcaacgaguccuuccgcaacggccaguacgccgaggccuccgcccucuacggccgcgcccuccgcguccuccaggcccagggcuccuccgaccccgaggaggaguccguccucuacuccaaccgcgccgccugccaccucaaggacggcaacugccgcgacugcaucaaggacugcaccuccgcccucgcccucguccccuucuccaucaagccccuccuccgccgcgccuccgccuacgaggcccucgagaaguaccccauggccuacgucgacuacaagaccguccuccagaucgacgacaacgucaccuccgccgucgagggcaucaaccgcaugacccgcgcccucauggacucccucggccccgaguggcgccucaagcuccccuccaucccccucguccccgucuccgcccagaagcgcuggaacucccuccccuccgagaaccacaaggagauggccaaguccaaguccaaggagaccaccgccaccaagaaccgcguccccuccgccggcgacgucgagaaggcccgcguccucaaggaggagggcaacgagcucgucaagaagggcaaccacaagaaggccaucgagaaguacuccgagucccuccucugcuccaaccucgaguccgccaccuacuccaaccgcgcccucugcuaccucguccucaagcaguacaccgaggccgucaaggacugcaccgaggcccucaagcucgacggcaagaacgucaaggccuucuaccgccgcgcccaggcccacaaggcccucaaggacuacaaguccuccuucgccgacaucuccaaccuccuccagaucgagccccgcaacggccccgcccagaagcuccgccaggaggucaagcagaaccuccacuga

SEQ ID NO: 51026 - RNA, 1086 nt, Artificial Sequence
  derived and/or modified sequence opt2 from TOMM40__Homo_sapiens__NP_001122389
augggcaacguccucgccgccuccuccccccccgccggccccccccccccccccgcccccgcccucgucggccuccccccccccccccccuccccccccggcuucacccuccccccccucggcggcucccucggcgccggcaccuccaccucccgcuccuccgagcgcacccccggcgccgccaccgccuccgccuccggcgccgccgaggacggcgccugcggcugccuccccaaccccggcaccuucgaggagugccaccgcaagugcaaggagcucuuccccauccagauggagggcgucaagcucaccgucaacaagggccucuccaaccacuuccaggucaaccacaccgucgcccucuccaccaucggcgaguccaacuaccacuucggcgucaccuacgucggcaccaagcagcucucccccaccgaggccuuccccguccucgucggcgacauggacaacuccggcucccucaacgcccaggucauccaccagcucggccccggccuccgcuccaagauggccauccagacccagcaguccaaguucgucaacuggcaggucgacggcgaguaccgcggcuccgacuucaccgccgccgucacccucggcaaccccgacguccucgucggcuccggcauccucgucgcccacuaccuccaguccaucacccccugccucgcccucggcggcgagcucgucuaccaccgccgccccggcgaggagggcaccgucaugucccucgccggcaaguacacccucaacaacuggcucgccaccgucacccucggccaggccggcaugcacgccaccuacuaccacaaggccuccgaccagcuccaggucggcgucgaguucgaggccuccacccgcaugcaggacaccuccgucuccuucggcuaccagcucgaccuccccaaggccaaccuccucuucaagggcuccgucgacuccaacuggaucgucggcgccacccucgagaagaagcuccccccccucccccucacccucgcccucggcgccuuccucaaccaccgcaagaacaaguuccagugcggcuucggccucaccaucggcuga

SEQ ID NO: 51027 - RNA, 1827 nt, Artificial Sequence
  derived and/or modified sequence opt2 from TOMM70A__Homo_sapiens__NP_055635
auggccgccuccaagcccgucgaggccgccgucgucgccgccgccguccccuccuccggcuccggcgucggcggcggcggcaccgccggccccggcaccggcggccucccccgcuggcagcucgcccucgccgucggcgccccccuccuccucggcgccggcgccaucuaccucuggucccgccagcagcgccgccgcgaggcccgcggccgcggcgacgccuccggccucaagcgcaacuccgagcgcaagacccccgagggccgcgccucccccgcccccggcuccggccaccccgagggccccggcgcccaccucgacaugaacucccucgaccgcgcccaggccgccaagaacaagggcaacaaguacuucaaggccggcaaguacgagcaggccauccagugcuacaccgaggccaucucccucugccccaccgagaagaacgucgaccucuccaccuucuaccagaaccgcgccgccgccuucgagcagcuccagaaguggaaggaggucgcccaggacugcaccaaggccgucgagcucaaccccaaguacgucaaggcccucuuccgccgcgccaaggcccacgagaagcucgacaacaagaaggagugccucgaggacgucaccgccgucugcauccucgagggcuuccagaaccagcaguccaugcuccucgccgacaagguccucaagcuccucggcaaggagaaggccaaggagaaguacaagaaccgcgagccccucaugcccuccccccaguucaucaaguccuacuucuccuccuucaccgacgacaucaucucccagcccaugcucaagggcgagaaguccgacgaggacaaggacaaggagggcgaggcccucgaggucaaggagaacuccggcuaccucaaggccaagcaguacauggaggaggagaacuacgacaagaucaucuccgagugcuccaaggagaucgacgccgagggcaaguacauggccgaggcccuccuccuccgcgccaccuucuaccuccucaucggcaacgccaacgccgccaagcccgaccucgacaaggucaucucccucaaggaggccaacgucaagcuccgcgccaacgcccucaucaagcgcggcuccauguacaugcagcagcagcagccccuccucuccacccaggacuucaacauggccgccgacaucgacccccagaacgccgacgucuaccaccaccgcggccagcucaagauccuccucgaccaggucgaggaggccgucgccgacuucgacgagugcauccgccuccgccccgaguccgcccucgcccaggcccagaagugcuucgcccucuaccgccaggccuacaccggcaacaacuccucccagauccaggccgccaugaagggcuucgaggaggucaucaagaaguucccccgcugcgccgagggcuacgcccucuacgcccaggcccucaccgaccagcagcaguucggcaaggccgacgagauguacgacaagugcaucgaccucgagcccgacaacgccaccaccuacguccacaagggccuccuccagcuccaguggaagcaggaccucgaccgcggccucgagcucaucuccaaggccaucgagaucgacaacaagugcgacuucgccuacgagaccaugggcaccaucgagguccagcgcggcaacauggagaaggccaucgacauguucaacaaggccaucaaccucgccaaguccgagauggagauggcccaccucuacucccucugcgacgccgcccacgcccagaccgaggucgccaagaaguacggccucaagccccccacccucuga

SEQ ID NO: 51028 - RNA, 4137 nt, Artificial Sequence
  derived and/or modified sequence opt2 from TONSL__Homo_sapiens__NP_038460
augucccucgagcgcgagcuccgccagcucuccaaggccaaggccaaggcccagcgcgccggccagcgccgcgaggaggccgcccucugccaccagcucggcgagcuccucgccggccacggccgcuacgccgaggcccucgagcagcacuggcaggagcuccagcuccgcgagcgcgccgacgacccccucggcugcgccgucgcccaccgcaagaucggcgagcgccucgccgagauggaggacuaccccgccgcccuccagcaccagcaccaguaccucgagcucgcccacucccuccgcaaccacaccgagcuccagcgcgccugggccaccaucggccgcacccaccucgacaucuacgaccacugccagucccgcgacgcccuccuccaggcccaggccgccuucgagaagucccucgccaucgucgacgaggagcucgagggcacccucgcccagggcgagcucaacgagaugcgcacccgccucuaccucaaccucggccucaccuucgagucccuccagcagaccgcccucugcaacgacuacuuccgcaaguccaucuuccucgccgagcagaaccaccucuacgaggaccucuuccgcgcccgcuacaaccucggcaccauccacuggcgcgccggccagcacucccaggccaugcgcugccucgagggcgcccgcgagugcgcccacaccaugcgcaagcgcuucauggaguccgagugcugcgucgucaucgcccagguccuccaggaccucggcgacuuccucgccgccaagcgcgcccucaagaaggccuaccgccucggcucccagaagcccguccagcgcgccgccaucugccagaaccuccagcacguccucgccgucguccgccuccagcagcagcucgaggaggccgagggccgcgacccccagggcgccauggucaucugcgagcagcucggcgaccucuucuccaaggccggcgacuucccccgcgccgccgaggccuaccagaagcagcuccgcuucgccgagcuccucgaccgccccggcgccgagcgcgccaucauccacgucucccucgccaccacccucggcgacaugaaggaccaccacggcgccguccgccacuacgaggaggagcuccgccuccgcuccggcaacguccucgaggaggccaagaccuggcucaacaucgcccucucccgcgaggaggccggcgacgccuacgagcuccucgcccccugcuuccagaaggcccucuccugcgcccagcaggcccagcgcccccagcuccagcgccagguccuccagcaccuccacaccguccagcuccgccuccagccccaggaggcccccgagaccgagacccgccuccgcgagcucuccgucgccgaggacgaggacgaggaggaggaggccgaggaggccgccgccaccgccgaguccgaggcccucgaggccggcgaggucgagcucuccgagggcgaggacgacaccgacggccucaccccccagcucgaggaggacgaggagcuccagggccaccucggccgccgcaagggcuccaaguggaaccgccgcaacgacaugggcgagacccuccuccaccgcgccugcaucgagggccagcuccgccgcguccaggaccucguccgccagggccacccccucaacccccgcgacuacugcggcuggaccccccuccacgaggccugcaacuacggccaccucgagaucguccgcuuccuccucgaccacggcgccgccgucgacgaccccggcggccagggcugcgagggcaucaccccccuccacgacgcccucaacugcggccacuucgaggucgccgagcuccuccucgagcgcggcgccuccgucacccuccgcacccgcaagggccucuccccccucgagacccuccagcagugggucaagcucuaccgccgcgaccucgaccucgagacccgccagaaggcccgcgccauggagaugcuccuccaggccgccgccuccggccaggacccccacuccucccaggccuuccacacccccuccucccuccucuucgaccccgagaccucccccccccucucccccugccccgagccccccuccaacuccacccgccuccccgaggccucccaggcccacguccgcgucucccccggccaggccgcccccgccauggcccgcccccgccgcucccgccacggccccgccuccuccuccuccuccuccgagggcgaggacuccgccggccccgcccgccccucccagaagcgcccccgcugcuccgccaccgcccagcgcgucgccgccuggacccccggccccgccuccaaccgcgaggccgccaccgccuccaccucccgcgccgccuaccaggccgccauccgcggcgucggcuccgcccagucccgccucggccccggccccccccgcggccacuccaaggcccucgccccccaggccgcccucauccccgaggaggagugccucgccggcgacuggcucgagcucgacaugccccucacccgcucccgccgcccccgcccccgcggcaccggcgacaaccgccgccccuccuccaccuccggcuccgacuccgaggagucccgcccccgcgcccgcgccaagcagguccgccucaccugcaugcaguccugcuccgcccccgucaacgccggccccuccucccucgccuccgagccccccggcucccccuccaccccccgcgucuccgagcccuccggcgacuccuccgccgccggccagccccucggccccgccccccccccccccauccgcguccgcguccagguccaggaccaccucuuccucauccccgucccccacuccuccgacacccacuccgucgccuggcucgccgagcaggccgcccagcgcuacuaccagaccugcggccuccucccccgccucacccuccgcaaggagggcgcccuccucgccccccaggaccucauccccgacguccuccaguccaacgacgagguccucgccgaggucaccuccugggaccuccccccccucaccgaccgcuaccgccgcgccugccagucccucggccagggcgagcaccagcagguccuccaggccgucgagcuccagggccucggccucuccuucuccgccugcucccucgcccucgaccaggcccagcucaccccccuccuccgcgcccucaagcuccacaccgcccuccgcgagcuccgccucgccggcaaccgccucggcgacaagugcgucgccgagcucgucgccgcccucggcaccaugcccucccucgcccuccucgaccucuccuccaaccaccucggccccgagggccuccgccagcucgccaugggccuccccggccaggccacccuccagucccucgaggagcucgaccucuccaugaacccccucggcgacggcugcggccagucccucgccucccuccuccacgccugcccccuccucuccacccuccgccuccaggccugcggcuucggccccuccuucuuccucucccaccagaccgcccucggcuccgccuuccaggacgccgagcaccucaagacccucucccucuccuacaacgcccucggcgcccccgcccucgcccgcacccuccagucccuccccgccggcacccuccuccaccucgagcucuccuccgucgccgccggcaagggcgacuccgaccucauggagcccgucuuccgcuaccucgccaaggagggcugcgcccucgcccaccucacccucuccgccaaccaccucggcgacaaggccguccgcgaccucugccgcugccucucccucugccccucccucaucucccucgaccucuccgccaaccccgagaucuccugcgccucccucgaggagcuccucuccacccuccagaagcgcccccagggccucuccuuccucggccucuccggcugcgccguccagggcccccucggccucggccucugggacaagaucgccgcccagcuccgcgagcuccagcucugcucccgccgccucugcgccgaggaccgcgacgcccuccgccagcuccagcccucccgccccggccccggcgagugcacccucgaccacggcuccaagcucuucuuccgccgccucuga

SEQ ID NO: 51029 - RNA, 2298 nt, Artificial Sequence
  derived and/or modified sequence opt2 from TOP1__Homo_sapiens__NP_003277
auguccggcgaccaccuccacaacgacucccagaucgaggccgacuuccgccucaacgacucccacaagcacaaggacaagcacaaggaccgcgagcaccgccacaaggagcacaagaaggagaaggaccgcgagaaguccaagcacuccaacuccgagcacaaggacuccgagaagaagcacaaggagaaggagaagaccaagcacaaggacggcuccuccgagaagcacaaggacaagcacaaggaccgcgacaaggagaagcgcaaggaggagaagguccgcgccuccggcgacgccaagaucaagaaggagaaggagaacggcuucuccucccccccccagaucaaggacgagcccgaggacgacggcuacuucgucccccccaaggaggacaucaagccccucaagcgcccccgcgacgaggacgacgccgacuacaagcccaagaagaucaagaccgaggacaccaagaaggagaagaagcgcaagcucgaggaggaggaggacggcaagcucaagaagcccaagaacaaggacaaggacaagaagguccccgagcccgacaacaagaagaagaagcccaagaaggaggaggagcagaaguggaaguggugggaggaggagcgcuaccccgagggcaucaaguggaaguuccucgagcacaagggccccgucuucgccccccccuacgagccccuccccgagaacgucaaguucuacuacgacggcaaggucaugaagcucucccccaaggccgaggaggucgccaccuucuucgccaagaugcucgaccacgaguacaccaccaaggagaucuuccgcaagaacuucuucaaggacuggcgcaaggagaugaccaacgaggagaagaacaucaucaccaaccucuccaagugcgacuucacccagaugucccaguacuucaaggcccagaccgaggcccgcaagcagauguccaaggaggagaagcucaagaucaaggaggagaacgagaagcuccucaaggaguacggcuucugcaucauggacaaccacaaggagcgcaucgccaacuucaagaucgagccccccggccucuuccgcggccgcggcaaccaccccaagaugggcaugcucaagcgccgcaucaugcccgaggacaucaucaucaacugcuccaaggacgccaagguccccucccccccccccggccacaaguggaaggagguccgccacgacaacaaggucaccuggcucgucuccuggaccgagaacauccagggcuccaucaaguacaucaugcucaaccccuccucccgcaucaagggcgagaaggacuggcagaaguacgagaccgcccgccgccucaagaagugcgucgacaagauccgcaaccaguaccgcgaggacuggaaguccaaggagaugaagguccgccagcgcgccgucgcccucuacuucaucgacaagcucgcccuccgcgccggcaacgagaaggaggagggcgagaccgccgacaccgucggcugcugcucccuccgcgucgagcacaucaaccuccaccccgagcucgacggccaggaguacgucgucgaguucgacuuccucggcaaggacuccauccgcuacuacaacaagguccccgucgagaagcgcgucuucaagaaccuccagcucuucauggagaacaagcagcccgaggacgaccucuucgaccgccucaacaccggcauccucaacaagcaccuccaggaccucauggagggccucaccgccaaggucuuccgcaccuacaacgccuccaucacccuccagcagcagcucaaggagcucaccgcccccgacgagaacauccccgccaagauccucuccuacaaccgcgccaaccgcgccgucgccauccucugcaaccaccagcgcgccccccccaagaccuucgagaaguccaugaugaaccuccagaccaagaucgacgccaagaaggagcagcucgccgacgcccgccgcgaccucaaguccgccaaggccgacgccaaggucaugaaggacgccaagaccaagaaggucgucgaguccaagaagaaggccguccagcgccucgaggagcagcucaugaagcucgagguccaggccaccgaccgcgaggagaacaagcagaucgcccucggcaccuccaagcucaacuaccucgacccccgcaucaccgucgccuggugcaagaaguggggcguccccaucgagaagaucuacaacaagacccagcgcgagaaguucgccugggccaucgacauggccgacgaggacuacgaguucuga

SEQ ID NO: 51030 - RNA, 4596 nt, Artificial Sequence
  derived and/or modified sequence opt2 from TOP2A__Homo_sapiens__NP_001058
auggaggucuccccccuccagcccgucaacgagaacaugcaggucaacaagaucaagaagaacgaggacgccaagaagcgccucuccgucgagcgcaucuaccagaagaagacccagcucgagcacauccuccuccgccccgacaccuacaucggcuccgucgagcucgucacccagcagaugugggucuacgacgaggacgucggcaucaacuaccgcgaggucaccuucguccccggccucuacaagaucuucgacgagauccucgucaacgccgccgacaacaagcagcgcgaccccaagauguccugcauccgcgucaccaucgaccccgagaacaaccucaucuccaucuggaacaacggcaagggcauccccgucgucgagcacaaggucgagaagauguacguccccgcccucaucuucggccagcuccucaccuccuccaacuacgacgacgacgagaagaaggucaccggcggccgcaacggcuacggcgccaagcucugcaacaucuucuccaccaaguucaccgucgagaccgccucccgcgaguacaagaagauguucaagcagaccuggauggacaacaugggccgcgccggcgagauggagcucaagcccuucaacggcgaggacuacaccugcaucaccuuccagcccgaccucuccaaguucaagaugcagucccucgacaaggacaucgucgcccucaugguccgccgcgccuacgacaucgccggcuccaccaaggacgucaaggucuuccucaacggcaacaagcuccccgucaagggcuuccgcuccuacgucgacauguaccucaaggacaagcucgacgagaccggcaacucccucaaggucauccacgagcaggucaaccaccgcugggaggucugccucaccauguccgagaagggcuuccagcagaucuccuucgucaacuccaucgccaccuccaagggcggccgccacgucgacuacgucgccgaccagaucgucaccaagcucgucgacgucgucaagaagaagaacaagggcggcgucgccgucaaggcccaccaggucaagaaccacauguggaucuucgucaacgcccucaucgagaaccccaccuucgacucccagaccaaggagaacaugacccuccagcccaaguccuucggcuccaccugccagcucuccgagaaguucaucaaggccgccaucggcugcggcaucgucgaguccauccucaacugggucaaguucaaggcccagguccagcucaacaagaagugcuccgccgucaagcacaaccgcaucaagggcauccccaagcucgacgacgccaacgacgccggcggccgcaacuccaccgagugcacccucauccucaccgagggcgacuccgccaagacccucgccgucuccggccucggcgucgucggccgcgacaaguacggcgucuucccccuccgcggcaagauccucaacguccgcgaggccucccacaagcagaucauggagaacgccgagaucaacaacaucaucaagaucgucggccuccaguacaagaagaacuacgaggacgaggacucccucaagacccuccgcuacggcaagaucaugaucaugaccgaccaggaccaggacggcucccacaucaagggccuccucaucaacuucauccaccacaacuggcccucccuccuccgccaccgcuuccucgaggaguucaucacccccaucgucaaggucuccaagaacaagcaggagauggccuucuacucccuccccgaguucgaggaguggaaguccuccacccccaaccacaagaaguggaaggucaaguacuacaagggccucggcaccuccaccuccaaggaggccaaggaguacuucgccgacaugaagcgccaccgcauccaguucaaguacuccggccccgaggacgacgccgccaucucccucgccuucuccaagaagcagaucgacgaccgcaaggaguggcucaccaacuucauggaggaccgccgccagcgcaagcuccucggccuccccgaggacuaccucuacggccagaccaccaccuaccucaccuacaacgacuucaucaacaaggagcucauccucuucuccaacuccgacaacgagcgcuccauccccuccauggucgacggccucaagcccggccagcgcaagguccucuucaccugcuucaagcgcaacgacaagcgcgaggucaaggucgcccagcucgccggcuccgucgccgagauguccuccuaccaccacggcgagaugucccucaugaugaccaucaucaaccucgcccagaacuucgucggcuccaacaaccucaaccuccuccagcccaucggccaguucggcacccgccuccacggcggcaaggacuccgccuccccccgcuacaucuucaccaugcucuccucccucgcccgccuccucuucccccccaaggacgaccacacccucaaguuccucuacgacgacaaccagcgcgucgagcccgagugguacauccccaucauccccaugguccucaucaacggcgccgagggcaucggcaccggcugguccugcaagauccccaacuucgacguccgcgagaucgucaacaacauccgccgccucauggacggcgaggagccccuccccaugcuccccuccuacaagaacuucaagggcaccaucgaggagcucgcccccaaccaguacgucaucuccggcgaggucgccauccucaacuccaccaccaucgagaucuccgagcuccccguccgcaccuggacccagaccuacaaggagcagguccucgagcccaugcucaacggcaccgagaagacccccccccucaucaccgacuaccgcgaguaccacaccgacaccaccgucaaguucgucgucaagaugaccgaggagaagcucgccgaggccgagcgcgucggccuccacaaggucuucaagcuccagaccucccucaccugcaacuccaugguccucuucgaccacgucggcugccucaagaaguacgacaccguccucgacauccuccgcgacuucuucgagcuccgccucaaguacuacggccuccgcaaggaguggcuccucggcaugcucggcgccgaguccgccaagcucaacaaccaggcccgcuucauccucgagaagaucgacggcaagaucaucaucgagaacaagcccaagaaggagcucaucaagguccucauccagcgcggcuacgacuccgaccccgucaaggccuggaaggaggcccagcagaagguccccgacgaggaggagaacgaggaguccgacaacgagaaggagaccgagaaguccgacuccgucaccgacuccggccccaccuucaacuaccuccucgacaugccccucugguaccucaccaaggagaagaaggacgagcucugccgccuccgcaacgagaaggagcaggagcucgacacccucaagcgcaagucccccuccgaccucuggaaggaggaccucgccaccuucaucgaggagcucgaggccgucgaggccaaggagaagcaggacgagcaggucggccuccccggcaagggcggcaaggccaagggcaagaagacccagauggccgagguccuccccuccccccgcggccagcgcgucaucccccgcaucaccaucgagaugaaggccgaggccgagaagaagaacaagaagaagaucaagaacgagaacaccgagggcuccccccaggaggacggcgucgagcucgagggccucaagcagcgccucgagaagaagcagaagcgcgagcccggcaccaagaccaagaagcagaccacccucgccuucaagcccaucaagaagggcaagaagcgcaaccccugguccgacuccgaguccgaccgcuccuccgacgaguccaacuucgacguccccccccgcgagaccgagccccgccgcgccgccaccaagaccaaguucaccauggaccucgacuccgacgaggacuucuccgacuucgacgagaagaccgacgacgaggacuucguccccuccgacgccuccccccccaagaccaagaccucccccaagcucuccaacaaggagcucaagccccagaaguccgucgucuccgaccucgaggccgacgacgucaagggcuccgucccccucuccuccuccccccccgccacccacuuccccgacgagaccgagaucaccaaccccguccccaagaagaacgucaccgucaagaagaccgccgccaagucccaguccuccaccuccaccaccggcgccaagaagcgcgccgcccccaagggcaccaagcgcgaccccgcccucaacuccggcgucucccagaagcccgaccccgccaagaccaagaaccgccgcaagcgcaagcccuccaccuccgacgacuccgacuccaacuucgagaagaucgucuccaaggccgucaccuccaagaaguccaagggcgaguccgacgacuuccacauggacuucgacuccgccgucgccccccgcgccaaguccguccgcgccaagaagcccaucaaguaccucgaggaguccgacgaggacgaccucuucuga

SEQ ID NO: 51031 - RNA, 4866 nt, Artificial Sequence
  derived and/or modified sequence opt2 from TOP2B__Homo_sapiens__NP_001059
auggccaaguccggcggcugcggcgccggcgccggcgucggcggcggcaacggcgcccucaccugggucaacaacgccgccaagaaggaggaguccgagaccgccaacaagaacgacuccuccaagaagcucuccgucgagcgcgucuaccagaagaagacccagcucgagcacauccuccuccgccccgacaccuacaucggcuccgucgagccccucacccaguucaugugggucuacgacgaggacgucggcaugaacugccgcgaggucaccuucguccccggccucuacaagaucuucgacgagauccucgucaacgccgccgacaacaagcagcgcgacaagaacaugaccugcaucaaggucuccaucgaccccgaguccaacaucaucuccaucuggaacaacggcaagggcauccccgucgucgagcacaaggucgagaaggucuacguccccgcccucaucuucggccagcuccucaccuccuccaacuacgacgacgacgagaagaaggucaccggcggccgcaacggcuacggcgccaagcucugcaacaucuucuccaccaaguucaccgucgagaccgccugcaaggaguacaagcacuccuucaagcagaccuggaugaacaacaugaugaagaccuccgaggccaagaucaagcacuucgacggcgaggacuacaccugcaucaccuuccagcccgaccucuccaaguucaagauggagaagcucgacaaggacaucgucgcccucaugacccgccgcgccuacgaccucgccggcuccugccgcggcgucaaggucauguucaacggcaagaagcuccccgucaacggcuuccgcuccuacgucgaccucuacgucaaggacaagcucgacgagaccggcgucgcccucaaggucauccacgagcucgccaacgagcgcugggacgucugccucacccucuccgagaagggcuuccagcagaucuccuucgucaacuccaucgccaccaccaagggcggccgccacgucgacuacgucgucgaccaggucgucggcaagcucaucgaggucgucaagaagaagaacaaggccggcgucuccgucaagcccuuccaggucaagaaccacaucugggucuucaucaacugccucaucgagaaccccaccuucgacucccagaccaaggagaacaugacccuccagcccaaguccuucggcuccaagugccagcucuccgagaaguucuucaaggccgccuccaacugcggcaucgucgaguccauccucaacugggucaaguucaaggcccagacccagcucaacaagaagugcuccuccgucaaguacuccaagaucaagggcauccccaagcucgacgacgccaacgacgccggcggcaagcacucccucgagugcacccucauccucaccgagggcgacuccgccaagucccucgccgucuccggccucggcgucaucggccgcgaccgcuacggcgucuucccccuccgcggcaagauccucaacguccgcgaggccucccacaagcagaucauggagaacgccgagaucaacaacaucaucaagaucgucggccuccaguacaagaaguccuacgacgacgccgagucccucaagacccuccgcuacggcaagaucaugaucaugaccgaccaggaccaggacggcucccacaucaagggccuccucaucaacuucauccaccacaacuggcccucccuccucaagcacggcuuccucgaggaguucaucacccccaucgucaaggccuccaagaacaagcaggagcucuccuucuacuccauccccgaguucgacgaguggaagaagcacaucgagaaccagaaggccuggaagaucaaguacuacaagggccucggcaccuccaccgccaaggaggccaaggaguacuucgccgacauggagcgccaccgcauccucuuccgcuacgccggccccgaggacgacgccgccaucacccucgccuucuccaagaagaagaucgacgaccgcaaggaguggcucaccaacuucauggaggaccgccgccagcgccgccuccacggccuccccgagcaguuccucuacggcaccgccaccaagcaccucaccuacaacgacuucaucaacaaggagcucauccucuucuccaacuccgacaacgagcgcuccauccccucccucgucgacggcuucaagcccggccagcgcaagguccucuucaccugcuucaagcgcaacgacaagcgcgaggucaaggucgcccagcucgccggcuccgucgccgagauguccgccuaccaccacggcgagcaggcccucaugaugaccaucgucaaccucgcccagaacuucgucggcuccaacaacaucaaccuccuccagcccaucggccaguucggcacccgccuccacggcggcaaggacgccgccuccccccgcuacaucuucaccaugcucuccacccucgcccgccuccucuuccccgccgucgacgacaaccuccucaaguuccucuacgacgacaaccagcgcgucgagcccgagugguacauccccaucauccccaugguccucaucaacggcgccgagggcaucggcaccggcugggccugcaagcuccccaacuacgacgcccgcgagaucgucaacaacguccgccgcaugcucgacggccucgacccccaccccaugcuccccaacuacaagaacuucaagggcaccauccaggagcucggccagaaccaguacgccgucuccggcgagaucuucgucgucgaccgcaacaccgucgagaucaccgagcuccccguccgcaccuggacccaggucuacaaggagcagguccucgagcccaugcucaacggcaccgacaagacccccgcccucaucuccgacuacaaggaguaccacaccgacaccaccgucaaguucgucgucaagaugaccgaggagaagcucgcccaggccgaggccgccggccuccacaaggucuucaagcuccagaccacccucaccugcaacuccaugguccucuucgaccacaugggcugccucaagaaguacgagaccguccaggacauccucaaggaguucuucgaccuccgccucuccuacuacggccuccgcaaggaguggcucgucggcaugcucggcgccgaguccaccaagcucaacaaccaggcccgcuucauccucgagaagauccagggcaagaucaccaucgagaaccgcuccaagaaggaccucauccagaugcucguccagcgcggcuacgaguccgaccccgucaaggccuggaaggaggcccaggagaaggccgccgaggaggacgagacccagaaccagcacgacgacuccuccuccgacuccggcacccccuccggccccgacuucaacuacauccucaacaugucccucuggucccucaccaaggagaaggucgaggagcucaucaagcagcgcgacgccaagggccgcgaggucaacgaccucaagcgcaagucccccuccgaccucuggaaggaggaccucgccgccuucgucgaggagcucgacaaggucgagucccaggagcgcgaggacguccucgccggcauguccggcaaggccaucaagggcaaggucggcaagcccaaggucaagaagcuccagcucgaggagaccaugcccucccccuacggccgccgcaucauccccgagaucaccgccaugaaggccgacgccuccaagaagcuccucaagaagaagaagggcgaccucgacaccgccgccgucaaggucgaguucgacgaggaguucuccggcgcccccgucgagggcgccggcgaggaggcccucacccccuccguccccaucaacaagggccccaagcccaagcgcgagaagaaggagcccggcacccgcguccgcaagacccccaccuccuccggcaagcccuccgccaagaaggucaagaagcgcaaccccugguccgacgacgaguccaaguccgaguccgaccucgaggagaccgagcccgucgucaucccccgcgacucccuccuccgccgcgccgccgccgagcgccccaaguacaccuucgacuucuccgaggaggaggacgacgacgccgacgacgacgacgacgacaacaacgaccucgaggagcucaaggucaaggccucccccaucaccaacgacggcgaggacgaguucguccccuccgacggccucgacaaggacgaguacaccuucucccccggcaaguccaaggccacccccgagaagucccuccacgacaagaagucccaggacuucggcaaccucuucuccuuccccuccuacucccagaaguccgaggacgacuccgccaaguucgacuccaacgaggaggacuccgccuccgucuucucccccuccuucggccucaagcagaccgacaagguccccuccaagaccgucgccgccaagaagggcaagcccuccuccgacaccguccccaagcccaagcgcgcccccaagcagaagaaggucgucgaggccgucaacuccgacuccgacuccgaguucggcauccccaagaagaccaccacccccaagggcaagggccgcggcgccaagaagcgcaaggccuccggcuccgagaacgagggcgacuacaaccccggccgcaagaccuccaagaccaccuccaagaagcccaagaagaccuccuucgaccaggacuccgacgucgacaucuuccccuccgacuuccccaccgagccccccucccucccccgcaccggccgcgcccgcaaggaggucaaguacuucgccgaguccgacgaggaggaggacgacgucgacuucgccauguucaacuga

SEQ ID NO: 51032 - RNA, 3006 nt, Artificial Sequence
  derived and/or modified sequence opt2 from TOP3A__Homo_sapiens__NP_004609
augaucuuccccgucgcccgcuacgcccuccgcuggcuccgccgccccgaggaccgcgccuucucccgcgccgccauggagauggcccuccgcggcguccgcaagguccucugcgucgccgagaagaacgacgccgccaagggcaucgccgaccuccucuccaacggccgcaugcgccgccgcgagggccucuccaaguucaacaagaucuacgaguucgacuaccaccucuacggccagaacgucaccauggucaugaccuccgucuccggccaccuccucgcccacgacuuccagaugcaguuccgcaaguggcaguccugcaacccccucguccucuucgaggccgagaucgagaaguacugccccgagaacuucgucgacaucaagaagacccucgagcgcgagacccgccagugccaggcccucgucaucuggaccgacugcgaccgcgagggcgagaacaucggcuucgagaucauccacgucugcaaggccgucaagcccaaccuccagguccuccgcgcccgcuucuccgagaucaccccccacgccguccgcaccgccugcgagaaccucaccgagcccgaccagcgcgucuccgacgccgucgacguccgccaggagcucgaccuccgcaucggcgccgccuucacccgcuuccagacccuccgccuccagcgcaucuuccccgagguccucgccgagcagcucaucuccuacggcuccugccaguuccccacccucggcuucgucgucgagcgcuucaaggccauccaggccuucguccccgagaucuuccaccgcaucaaggucacccacgaccacaaggacggcaucgucgaguucaacuggaagcgccaccgccucuucaaccacaccgccugccucguccucuaccagcucugcgucgaggaccccauggccaccgucgucgagguccgcuccaagcccaaguccaaguggcgcccccaggcccucgacaccgucgagcucgagaagcucgccucccgcaagcuccgcaucaacgccaaggagaccaugcgcaucgccgagaagcucuacacccagggcuacaucuccuacccccgcaccgagaccaacaucuucccccgcgaccucaaccucaccguccucgucgagcagcagacccccgacccccgcuggggcgccuucgcccaguccauccucgagcgcggcggccccaccccccgcaacggcaacaaguccgaccaggcccacccccccauccaccccaccaaguacaccaacaaccuccagggcgacgagcagcgccucuacgaguucaucguccgccacuuccucgccugcugcucccaggacgcccagggccaggagaccaccgucgagaucgacaucgcccaggagcgcuucgucgcccacggccucaugauccucgcccgcaacuaccucgacgucuaccccuacgaccacugguccgacaagauccuccccgucuacgagcagggcucccacuuccagcccuccaccgucgagauggucgacggcgagaccuccccccccaagcuccucaccgaggccgaccucaucgcccucauggagaagcacggcaucggcaccgacgccacccacgccgagcacaucgagaccaucaaggcccgcauguacgucggccucacccccgacaagcgcuuccuccccggccaccucggcaugggccucgucgagggcuacgacuccaugggcuacgagauguccaagcccgaccuccgcgccgagcucgaggccgaccucaagcucaucugcgacggcaagaaggacaaguucgucguccuccgccagcagguccagaaguacaagcaggucuucaucgaggccgucgccaaggccaagaagcucgacgaggcccucgcccaguacuucggcaacggcaccgagcucgcccagcaggaggacaucuaccccgccaugcccgagcccauccgcaagugcccccagugcaacaaggacaugguccucaagaccaagaagaacggcggcuucuaccucuccugcaugggcuuccccgagugccgcuccgccgucuggcuccccgacuccguccucgaggccucccgcgacuccuccgucugccccgucugccagccccaccccgucuaccgccucaagcucaaguucaagcgcggcucccucccccccaccaugccccucgaguucgucugcugcaucggcggcugcgacgacacccuccgcgagauccucgaccuccgcuucuccggcggccccccccgcgccucccagcccuccggccgccuccaggccaaccagucccucaaccgcauggacaacucccagcacccccagcccgccgacucccgccagaccggcuccuccaaggcccucgcccagacccuccccccccccaccgccgccggcgaguccaacuccgucaccugcaacugcggccaggaggccguccuccucaccguccgcaaggagggccccaaccgcggccgccaguucuucaagugcaacggcggcuccugcaacuucuuccucugggccgacucccccaaccccggcgccggcggcccccccgcccucgccuaccgcccccucggcgccucccucggcugcccccccggccccggcauccaccucggcggcuucggcaaccccggcgacggcuccggcuccggcaccuccugccucugcucccagcccuccgucacccgcaccguccagaaggacggccccaacaagggccgccaguuccacaccugcgccaagccccgcgagcagcagugcggcuucuuccagugggucgacgagaacaccgcccccggcaccuccggcgcccccuccuggaccggcgaccgcggccgcacccucgaguccgaggcccgcuccaagcgcccccgcgccuccuccuccgacaugggcuccaccgccaagaagccccgcaagugcucccucugccaccagcccggccacacccgccccuucugcccccagaaccgcuga

SEQ ID NO: 51033 - RNA, 2589 nt, Artificial Sequence
  derived and/or modified sequence opt2 from TOP3B__Homo_sapiens__NP_001269042
augaagaccguccucauggucgccgagaagcccucccucgcccaguccaucgccaagauccucucccgcggcucccucuccucccacaagggccucaacggcgccugcuccguccacgaguacaccggcaccuucgccggccagcccguccgcuucaagaugaccuccgucugcggccacgucaugacccucgacuuccucggcaaguacaacaagugggacaaggucgaccccgccgagcucuucucccaggcccccaccgagaagaaggaggccaaccccaagcucaacauggucaaguuccuccaggucgagggccgcggcugcgacuacaucguccucuggcucgacugcgacaaggagggcgagaacaucugcuucgagguccucgacgccguccuccccgucaugaacaaggcccacggcggcgagaagaccgucuuccgcgcccgcuucuccuccaucaccgacaccgacaucugcaacgccauggccugccucggcgagcccgaccacaacgaggcccucuccgucgacgcccgccaggagcucgaccuccgcaucggcugcgccuucacccgcuuccagaccaaguacuuccagggcaaguacggcgaccucgacuccucccucaucuccuucggccccugccagacccccacccucggcuucugcgucgagcgccacgacaagauccaguccuucaagcccgagaccuacuggguccuccaggccaaggucaacaccgacaaggaccgcucccuccuccucgacugggaccgcguccgcgucuucgaccgcgagaucgcccagauguuccucaacaugaccaagcucgagaaggaggcccaggucgaggccaccucccgcaaggagaaggccaagcagcgcccccucgcccucaacaccgucgagaugcuccgcgucgccuccuccucccucggcaugggcccccagcacgccaugcagaccgccgagcgccucuacacccagggcuacaucuccuacccccgcaccgagaccacccacuaccccgagaacuucgaccucaagggcucccuccgccagcaggccaaccaccccuacugggccgacaccgucaagcgccuccucgccgagggcaucaaccgcccccgcaagggccacgacgccggcgaccacccccccaucacccccaugaaguccgccaccgaggccgagcucggcggcgacgccuggcgccucuacgaguacaucacccgccacuucaucgccaccgucucccacgacugcaaguaccuccaguccaccaucuccuuccgcaucggccccgagcucuucaccugcuccggcaagaccguccucucccccggcuucaccgaggucaugcccuggcaguccgucccccucgaggagucccuccccaccugccagcgcggcgacgccuuccccgucggcgaggucaagaugcucgagaagcagaccaacccccccgacuaccucaccgaggccgagcucaucacccucauggagaagcacggcaucggcaccgacgccuccauccccguccacaucaacaacaucugccagcgcaacuacgucaccgucgaguccggccgccgccucaagcccaccaaccucggcaucguccucguccacggcuacuacaagaucgacgccgagcucguccuccccaccauccgcuccgccgucgagaagcagcucaaccucaucgcccagggcaaggccgacuaccgccagguccucggccacacccucgacgucuucaagcgcaaguuccacuacuucgucgacuccaucgccggcauggacgagcucauggaggucuccuucuccccccucgccgccaccggcaagccccucucccgcugcggcaagugccaccgcuucaugaaguacauccaggccaagcccucccgccuccacugcucccacugcgacgagaccuacacccucccccagaacggcaccaucaagcucuacaaggagcuccgcugcccccucgacgacuucgagcucguccucugguccuccggcucccgcggcaaguccuacccccucugccccuacugcuacaaccacccccccuuccgcgacaugaagaagggcaugggcugcaacgagugcacccaccccuccugccagcacucccucuccaugcucggcaucggccagugcgucgagugcgaguccggcguccucguccucgaccccaccuccggccccaaguggaaggucgccugcaacaagugcaacgucgucgcccacugcuucgagaacgcccaccgcguccgcgucuccgccgacaccugcuccgucugcgaggccgcccuccucgacgucgacuucaacaaggccaaguccccccuccccggcgacgagacccagcacaugggcugcgucuucugcgaccccgucuuccaggagcucgucgagcucaagcacgccgccuccugccaccccaugcaccgcggcggccccggccgccgccagggccgcggccgcggccgcgcccgccgcccccccggcaagcccaacccccgccgccccaaggacaagauguccgcccucgccgccuacuucgucuga

SEQ ID NO: 51034 - RNA, 4569 nt, Artificial Sequence
  derived and/or modified sequence opt2 from TOPBP1__Homo_sapiens__NP_008958
augucccgcaacgacaaggagcccuucuucgucaaguuccucaaguccuccgacaacuccaagugcuucuucaaggcccucgaguccaucaaggaguuccaguccgaggaguaccuccagaucaucaccgaggaggaggcccucaagaucaaggagaacgaccgcucccucuacaucugcgaccccuucuccggcgucgucuucgaccaccucaagaagcucggcugccgcaucgucggcccccaggucgucaucuucugcaugcaccaccagcgcugcgucccccgcgccgagcaccccgucuacaacauggucauguccgacgucaccaucuccugcaccucccucgagaaggagaagcgcgaggagguccacaaguacguccagaugaugggcggccgcgucuaccgcgaccucaacgucuccgucacccaccucaucgccggcgaggucggcuccaagaaguaccucgucgccgccaaccucaagaagcccauccuccuccccuccuggaucaagacccucugggagaagucccaggagaagaagaucacccgcuacaccgacaucaacauggaggacuucaagugccccaucuuccucggcugcaucaucugcgucaccggccucugcggccucgaccgcaaggagguccagcagcucaccgucaagcacggcggccaguacaugggccagcucaagaugaacgagugcacccaccucaucguccaggagcccaagggccagaaguacgagugcgccaagcgcuggaacguccacugcgucaccacccagugguucuucgacuccaucgagaagggcuucugccaggacgaguccaucuacaagaccgagccccgccccgaggccaagaccaugcccaacuccuccacccccaccucccagaucaacaccaucgacucccgcacccucuccgacgucuccaacaucuccaacaucaacgccuccugcgucuccgaguccaucugcaacucccucaacuccaagcucgagcccacccucgagaaccucgagaaccucgacgucuccgccuuccaggcccccgaggaccuccucgacggcugccgcaucuaccucugcggcuucuccggccgcaagcucgacaagcuccgccgccucaucaacuccggcggcggcguccgcuucaaccagcucaacgaggacgucacccacgucaucgucggcgacuacgacgacgagcucaagcaguucuggaacaaguccgcccaccgcccccacgucgucggcgccaaguggcuccucgagugcuucuccaagggcuacaugcucuccgaggagcccuacauccacgccaacuaccagcccgucgagauccccgucucccacaagcccgaguccaaggccgcccuccucaagaagaagaacuccuccuucuccaagaaggacuucgcccccuccgagaagcacgagcaggccgacgaggaccuccucucccaguacgagaacggcuccuccaccgucgucgaggccaagaccuccgaggcccgccccuucaacgacuccacccacgccgagccccucaacgacuccacccacaucucccuccaggaggagaaccaguccuccgucucccacugcguccccgacgucuccaccaucaccgaggagggccucuucucccagaaguccuuccucguccucggcuucuccaacgagaacgaguccaacaucgccaacaucaucaaggagaacgccggcaagaucaugucccuccucucccgcaccgucgccgacuacgccgucgucccccuccucggcugcgaggucgaggccaccgucggcgaggucgucaccaacaccuggcucgucaccugcaucgacuaccagacccucuucgaccccaaguccaacccccucuucacccccguccccgucaugaccggcaugaccccccucgaggacugcgucaucuccuucucccagugcgccggcgccgagaaggagucccucaccuuccucgccaaccuccucggcgccuccguccaggaguacuucguccgcaaguccaacgccaagaagggcauguucgccuccacccaccucauccucaaggagcgcggcggcuccaaguacgaggccgccaagaaguggaaccuccccgccgucaccaucgccuggcuccucgagaccgcccgcaccggcaagcgcgccgacgagucccacuuccucaucgagaacuccaccaaggaggagcgcucccucgagaccgagaucaccaacggcaucaaccucaacuccgacaccgccgagcaccccggcacccgccuccagacccaccgcaagaccgucgucaccccccucgacaugaaccgcuuccaguccaaggccuuccgcgccgucgucucccagcacgcccgccaggucgccgccucccccgccgucggccagccccuccagaaggagcccucccuccaccucgacacccccuccaaguuccucuccaaggacaagcucuucaagcccuccuucgacgucaaggacgcccucgccgcccucgagacccccggccgccccucccagcagaagcgcaagcccuccaccccccucuccgaggucaucgucaagaaccuccagcucgcccucgccaacuccucccgcaacgccgucgcccucuccgccuccccccagcucaaggaggcccaguccgagaaggaggaggcccccaagccccuccacaaggucgucgucugcgucuccaagaagcucuccaagaagcaguccgagcucaacggcaucgccgccucccucggcgccgacuaccgcugguccuucgacgagaccgucacccacuucaucuaccagggccgccccaacgacaccaaccgcgaguacaaguccgucaaggagcgcggcguccacaucgucuccgagcacuggcuccucgacugcgcccaggagugcaagcaccuccccgagucccucuacccccacaccuacaaccccaagaugucccucgacaucuccgccguccaggacggccgccucugcaacucccgccuccucuccgccgucuccuccaccaaggacgacgagcccgacccccucauccucgaggagaacgacgucgacaacauggccaccaacaacaaggaguccgcccccuccaacggcuccggcaagaacgacuccaagggcguccucacccagacccucgagaugcgcgagaacuuccagaagcagcuccaggagaucauguccgccaccuccaucgucaagccccagggccagcgcaccucccucucccgcuccggcugcaacuccgccuccuccacccccgacuccacccgcuccgcccgcuccggccgcucccgcguccucgaggcccuccgccagucccgccagaccguccccgacgucaacaccgagcccucccagaacgagcagaucaucugggacgaccccaccgcccgcgaggagcgcgcccgccucgccuccaaccuccaguggcccuccugccccacccaguacuccgagcuccaggucgacauccagaaccucgaggacucccccuuccagaagccccuccacgacuccgagaucgccaagcaggccgucugcgaccccggcaacauccgcgucaccgaggcccccaagcaccccaucuccgaggagcucgagacccccaucaaggacucccaccucauccccaccccccaggcccccuccaucgccuucccccucgccaacccccccgucgccccccacccccgcgagaagaucaucaccaucgaggagacccacgaggagcucaagaagcaguacaucuuccagcucuccucccucaacccccaggagcgcaucgacuacugccaccucaucgagaagcucggcggccucgucaucgagaagcagugcuucgaccccaccugcacccacaucgucgucggccacccccuccgcaacgagaaguaccucgccuccgucgccgccggcaaguggguccuccaccgcuccuaccucgaggccugccgcaccgccggccacuucguccaggaggaggacuacgaguggggcuccuccuccauccucgacguccucaccggcaucaacguccagcagcgccgccucgcccucgccgccaugcgcuggcgcaagaagauccagcagcgccaggaguccggcaucgucgagggcgccuucuccggcuggaaggucauccuccacgucgaccagucccgcgaggccggcuucaagcgccuccuccaguccggcggcgccaagguccuccccggccacuccgucccccucuucaaggaggccacccaccucuucuccgaccucaacaagcucaagcccgacgacuccggcgucaacaucgccgaggccgccgcccagaacgucuacugccuccgcaccgaguacaucgccgacuaccucaugcaggagucccccccccacgucgagaacuacugccuccccgaggccaucuccuucauccagaacaacaaggagcucggcaccggccucucccagaagcgcaaggcccccaccgagaagaacaagaucaagcgcccccgcguccacuga

SEQ ID NO: 51035 - RNA, 2943 nt, Artificial Sequence
  derived and/or modified sequence opt2 from TOPORS__Homo_sapiens__NP_001182551
augaucauggccuccgccgccaaggaguucaagauggacaacuucucccccaaggccggcaccuccaagcuccagcagaccguccccgccgacgccucccccgacuccaagugccccaucugccucgaccgcuucgacaacgucuccuaccucgaccgcugccuccacaaguucugcuuccgcugcguccaggagugguccaagaacaaggccgagugcccccucugcaagcagcccuucgacuccaucuuccacuccguccgcgccgaggacgacuucaaggaguacguccuccgccccuccuacaacggcuccuucgucacccccgaccgccgcuuccgcuaccgcaccacccucacccgcgagcgcaacgccuccgucuacucccccuccggccccgucaaccgccgcaccaccaccccccccgacuccggcguccucuucgagggccucggcaucuccacccgcccccgcgacgucgagaucccccaguucaugcgccagaucgccguccgccgccccaccaccgccgacgagcgcucccuccgcaagauccaggagcaggacaucaucaacuuccgccgcacccucuaccgcgccggcgcccgcguccgcaacaucgaggacggcggccgcuaccgcgacaucuccgccgaguucuuccgccgcaaccccgccugccuccaccgccucguccccuggcucaagcgcgagcucaccguccucuucggcgcccacggcucccucgucaacaucguccagcacaucaucauguccaacgucacccgcuacgaccucgagucccaggccuucgucuccgaccuccgccccuuccuccucaaccgcaccgagcacuucauccacgaguucaucuccuucgcccgcucccccuucaacauggccgccuucgaccagcacgccaacuacgacugccccgcccccuccuacgaggagggcucccacuccgacuccuccgucaucaccaucucccccgacgaggccgagacccaggagcucgacaucaacgucgccaccgucucccaggcccccugggacgacgagacccccggccccuccuacuccuccuccgagcagguccacgucaccauguccucccuccucaacaccuccgacuccuccgacgaggagcucgucaccggcggcgccaccucccagauccagggcguccagaccaacgacgaccucaacaacgacuccgacgacuccuccgacaacugcgucaucgucggcuucgucaagccccucgccgagcgcacccccgagcucgucgagcucuccuccgacuccgaggaccucggcuccuacgagaagauggagaccgucaagacccaggagcaggagcaguccuacuccuccggcgacuccgacgucucccgcugcuccuccccccacuccguccucggcaaggacgagcagaucaacaagggccacugcgacuccuccacccgcaucaaguccaagaaggaggagaagcgcuccaccucccucuccuccccccgcaaccucaacuccuccguccgcggcgaccgcgucuacucccccuacaaccaccgccaccgcaagcgcggccgcucccgcuccuccgacucccgcucccagucccgcuccggccacgaccagaagaaccaccgcaagcaccacggcaagaagcgcaugaaguccaagcgcucccgcucccgcgaguccucccgcccccgcggccgccgcgacaagaagcgcucccgcacccgcgacuccuccuggucccgccgcucccagacccucucccucuccuccgaguccaccucccgcucccgcucccgcuccuccgaccacggcaagcgccgcucccgcucccgcaaccgcgaccgcuacuaccuccgcaacaacuacggcucccgcuacaagugggaguacaccuacuacucccgcaacaaggaccgcgacggcuacgaguccuccuaccgccgccgcacccucucccgcgcccacuacucccgccaguccuccucccccgaguuccgcguccaguccuucuccgagcgcaccaacgcccgcaagaagaacaaccacuccgagcgcaaguacuacuacuacgagcgccaccgcucccgcucccucuccuccaaccgcucccgcaccgccuccaccggcaccgaccgcguccgcaacgagaagcccggcggcaagcgcaaguacaagacccgccaccucgagggcaccaacgaggucgcccagcccucccgcgaguucgccuccaaggccaaggacucccacuaccagaaguccuccuccaagcucgacggcaacuacaagaacgaguccgacaccuucuccgacucccgcuccuccgaccgcgagaccaagcacaagcgccgcaagcgcaagacccgcucccucuccgucgagaucgucuacgagggcaaggccaccgacaccaccaagcaccacaagaagaagaagaagaagcacaagaagaagcacaagaagcaccacggcgacaacgccucccgcucccccgucgucaucaccaucgacuccgacuccgacaaggacuccgaggucaaggaggacaccgagugcgacaacuccggcccccaggacccccuccagaacgaguuccucgcccccucccucgagcccuucgagaccaaggacgucgucaccaucgaggccgaguucggcguccucgacaaggagugcgacaucgccacccucuccaacaaccucaacaacgccaacaagaccgucgacaacauccccccccucgccgccuccgucgagcagacccucgacguccgcgaggaguccaccuucgucuccgaccucgagaaccagcccuccaacaucgucucccuccagaccgagcccucccgccagcuccccuccccccgcaccucccucauguccgucugccucggccgcgacugcgacauguccuga

SEQ ID NO: 51036 - RNA, 999 nt, Artificial Sequence
  derived and/or modified sequence opt2 from TOR1A__Homo_sapiens__NP_000104
augaagcucggccgcgccguccucggccuccuccuccucgcccccuccgucguccaggccgucgagcccaucucccucggccucgcccucgccggcguccucaccggcuacaucuacccccgccucuacugccucuucgccgagugcugcggccagaagcgcucccucucccgcgaggcccuccagaaggaccucgacgacaaccucuucggccagcaccucgccaagaagaucauccucaacgccgucuucggcuucaucaacaaccccaagcccaagaagccccucacccucucccuccacggcuggaccggcaccggcaagaacuucgucuccaagaucaucgccgagaacaucuacgagggcggccucaacuccgacuacguccaccucuucgucgccacccuccacuucccccacgccuccaacaucacccucuacaaggaccagcuccagcucuggauccgcggcaacgucuccgccugcgcccgcuccaucuucaucuucgacgagauggacaagaugcacgccggccucaucgacgccaucaagcccuuccucgacuacuacgaccucgucgacggcgucuccuaccagaaggccauguucaucuuccucuccaacgccggcgccgagcgcaucaccgacgucgcccucgacuucuggcgcuccggcaagcagcgcgaggacaucaagcucaaggacaucgagcacgcccucuccgucuccgucuucaacaacaagaacuccggcuucuggcacuccucccucaucgaccgcaaccucaucgacuacuucguccccuuccucccccucgaguacaagcaccucaagaugugcauccgcgucgagaugcagucccgcggcuacgagaucgacgaggacaucgucucccgcgucgccgaggagaugaccuucuuccccaaggaggagcgcgucuucuccgacaagggcugcaagaccgucuucaccaagcucgacuacuacuacgacgacuga

SEQ ID NO: 51037 - RNA, 1752 nt, Artificial Sequence
  derived and/or modified sequence opt2 from TOR1AIP1__Homo_sapiens__NP_056417
auggccggcgacggccgccgcgccgaggccguccgcgagggcuggggcgucuacgucaccccccgcgcccccauccgcgagggccgcggccgccucgccccccagaacggcggcuccuccgacgcccccgccuaccgcaccccccccucccgccagggccgccgcgagguccgcuucuccgacgagccccccgaggucuacggcgacuucgagccccucgucgccaaggagcgcucccccgucggcaagcgcacccgccucgaggaguuccgcuccgacuccgccaaggaggagguccgcgaguccgccuacuaccuccgcucccgccagcgccgccagccccgcccccaggagaccgaggagaugaagacccgccgcaccacccgccuccagcagcagcacuccgagcagcccccccuccagcccucccccgucaugacccgccgcggccuccgcgacucccacuccuccgaggaggacgaggccuccucccagaccgaccucucccagaccaucuccaagaagaccguccgcuccauccaggaggcccccgucuccgaggaccucgucauccgccuccgccgccccccccuccgcuacccccgcuacgaggccaccuccguccagcagaaggucaacuucuccgaggagggcgagaccgaggaggacgaccaggacuccucccacuccuccgucaccaccgucaaggcccgcucccgcgacuccgacgaguccggcgacaagaccacccgcuccuccucccaguacaucgaguccuucuggcaguccucccagucccagaacuucaccgcccacgacaagcagcccuccguccucuccuccggcuaccagaagaccccccaggagugggccccccagaccgcccgcauccgcacccgcaugcagaacgacuccauccucaaguccgagcucggcaaccagucccccuccaccuccucccgccaggucaccggccagccccagaacgccuccuucgucaagcgcaaccgcugguggcuccucccccucaucgccgcccucgccuccggcuccuucugguucuucuccacccccgaggucgagaccaccgccguccaggaguuccagaaccagaugaaccagcucaagaacaaguaccagggccaggacgagaagcucuggaagcgcucccagaccuuccucgagaagcaccucaacuccucccacccccgcucccagcccgccauccuccuccucaccgccgcccgcgacgccgaggaggcccuccgcugccucuccgagcagaucgccgacgccuacuccuccuuccgcuccguccgcgccauccgcaucgacggcaccgacaaggccacccaggacuccgacaccgucaagcucgaggucgaccaggagcucuccaacggcuucaagaacggccagaacgccgccgucguccaccgcuucgaguccuuccccgccggcuccacccucaucuucuacaaguacugcgaccacgagaacgccgccuucaaggacgucgcccucguccucaccguccuccucgaggaggagacccucggcaccucccucggccucaaggaggucgaggagaagguccgcgacuuccucaaggucaaguucaccaacuccaacacccccaacuccuacaaccacauggaccccgacaagcucaacggccucuggucccgcaucucccaccucguccuccccguccagcccgagaacgcccucaagcgcggcaucugccucuga

SEQ ID NO: 51038 - RNA, 396 nt, Artificial Sequence
  derived and/or modified sequence opt2 from TOR1AIP2__Homo_sapiens__NP_071742
auguucuccgacaacucccacugccccgacugcggccagcagugguuccccucccucgagcucggccacuggcucuaccagaccgagcucgucgagaacgagugcuaccaggucuuccucgaccgcaucaaccgcgccgacuacugccccgagugcuaccccgacaaccccgccaaccgcucccucguccuccccugguccuucccccucgagugggccccccagaaccucacccgcuggaccuucgagaaggccugccaccccuuccuccucggccccccccucguccgcaagcgcauccacgacucccgcgucgccggcuucaaccccgcccuccagcucauccucacccgcaccgacaagacccucaacaagaagcucggccagaacaaguga

SEQ ID NO: 51039 - RNA, 1011 nt, Artificial Sequence
  derived and/or modified sequence opt2 from TOR1B__Homo_sapiens__NP_055321
augcuccgcgccggcuggcuccgcggcgccgccgcccucgcccuccuccucgccgcccgcgucgucgccgccuucgagcccaucaccgucggccucgccaucggcgccgccuccgccaucaccggcuaccucuccuacaacgacaucuacugccgcuucgccgagugcugccgcgaggagcgcccccucaacgccuccgcccucaagcucgaccucgaggagaagcucuucggccagcaccucgccaccgaggucaucuucaaggcccucaccggcuuccgcaacaacaagaaccccaagaagccccucacccucucccuccacggcugggccggcaccggcaagaacuucgucucccagaucgucgccgagaaccuccaccccaagggccucaaguccaacuucguccaccucuucgucuccacccuccacuucccccacgagcagaagaucaagcucuaccaggaccagcuccagaaguggauccgcggcaacgucuccgccugcgccaacuccgucuucaucuucgacgagauggacaagcuccaccccggcaucaucgacgccaucaagcccuuccucgacuacuacgagcaggucgacggcgucuccuaccgcaaggccaucuucaucuuccucuccaacgccggcggcgaccucaucaccaagaccgcccucgacuucuggcgcgccggccgcaagcgcgaggacauccagcucaaggaccucgagcccguccucuccgucggcgucuucaacaacaagcacuccggccucuggcacuccggccucaucgacaagaaccucaucgacuacuucauccccuuccucccccucgaguaccgccacgucaagaugugcguccgcgccgagaugcgcgcccgcggcuccgccaucgacgaggacaucgucacccgcgucgccgaggagaugaccuucuucccccgcgacgagaagaucuacuccgacaagggcugcaagaccguccagucccgccucgacuuccacuga

SEQ ID NO: 51040 - RNA, 966 nt, Artificial Sequence
  derived and/or modified sequence opt2 from TOR2A__Homo_sapiens__NP_001078816
auggccgccgccacccgcggcugccgccccuggggcucccuccucggccuccucggccucgucuccgccgccgccgccgccugggaccucgccucccuccgcugcacccucggcgccuucugcgagugcgacuuccgccccgaccuccccggccucgagugcgaccucgcccagcaccucgccggccagcaccucgccaaggcccucgucgucaaggcccucaaggccuucguccgcgaccccgcccccaccaagccccucguccucucccuccacggcuggaccggcaccggcaaguccuacgucuccucccuccucgcccacuaccucuuccagggcggccuccgcuccccccgcguccaccacuucucccccguccuccacuucccccaccccucccacaucgagcgcuacaagaaggaccucaaguccuggguccagggcaaccucaccgccugcggccgcucccucuuccucuucgacgagauggacaagaugccccccggccucauggagguccuccgccccuuccucggcuccuccugggucgucuacggcaccaacuaccgcaaggccaucuucaucuucaucuccaacaccggcggcgagcagaucaaccaggucgcccucgaggccuggcgcucccgccgcgaccgcgaggagauccuccuccaggagcucgagcccgucaucucccgcgccguccucgacaacccccaccacggcuucuccaacuccggcaucauggaggagcgccuccucgacgccgucguccccuuccucccccuccagcgccaccacguccgccacugcguccucaacgagcucgcccagcucggccucgagccccgcgacgaggucguccaggccguccucgacuccaccaccuucuuccccgaggacgagcagcucuucuccuccaacggcugcaagaccgucgccucccgcaucgccuucuuccucuga

SEQ ID NO: 51041 - RNA, 1395 nt, Artificial Sequence
  derived and/or modified sequence opt2 from TOX2__Homo_sapiens__NP_001092266
auguccgacggcaaccccgagcuccucuccaccucccagaccuacaacggccaguccgagaacaacgaggacuacgagaucccccccaucaccccccccaaccuccccgagcccucccuccuccaccucggcgaccacgaggccuccuaccacucccucugccacggccucacccccaacggccuccuccccgccuacuccuaccaggccauggaccuccccgccaucauggucuccaacaugcucgcccaggacucccaccuccucuccggccagcuccccaccauccaggagaugguccacuccgaggucgccgccuacgacuccggccgccccggcccccuccucggccgccccgccaugcucgccucccacauguccgcccucucccagucccagcucaucucccagaugggcauccgcuccuccaucgcccacuccucccccuccccccccggcuccaaguccgccacccccucccccuccuccuccacccaggaggaggaguccgagguccacuucaagaucuccggcgagaagcgccccuccgccgaccccggcaagaaggccaagaaccccaagaagaagaagaagaaggaccccaacgagccccagaagcccgucuccgccuacgcccucuucuuccgcgacacccaggccgccaucaagggccagaaccccuccgccaccuucggcgacgucuccaagaucgucgccuccaugugggacucccucggcgaggagcagaagcaggccuacaagcgcaagaccgaggccgccaagaaggaguaccucaaggcccucgccgccuaccgcgccucccucgucuccaaguccucccccgaccagggcgagaccaaguccacccaggccaacccccccgccaagaugcucccccccaagcagcccauguacgccaugcccggccucgccuccuuccucacccccuccgaccuccaggccuuccgcuccggcgccucccccgccucccucgcccgcacccucggcuccaagucccuccuccccggccucuccgccucccccccccccccccccuccuucccccucucccccacccuccaccagcagcucucccuccccccccacgcccagggcgcccuccucuccccccccgucuccaugucccccgccccccagccccccguccuccccacccccauggcccuccagguccagcucgccaugucccccuccccccccggcccccaggacuucccccacaucuccgaguuccccuccuccuccggcuccugcucccccggccccuccaaccccaccuccuccggcgacugggacuccuccuaccccuccggcgagugcggcaucuccaccugcucccuccucccccgcgacaagucccucuaccucaccuga

SEQ ID NO: 51042 - RNA, 1731 nt, Artificial Sequence
  derived and/or modified sequence opt2 from TOX3__Homo_sapiens__NP_001073899
auggacguccgcuucuaccccgccgccgccggcgaccccgccucccucgacuucgcccagugccucggcuacuacggcuacuccaaguucggcaacaacaacaacuacaugaacauggccgaggccaacaacgccuucuucgccgccuccgagcagaccuuccacacccccucccucggcgacgaggaguucgagaucccccccaucacccccccccccgaguccgaccccgcccucggcaugcccgacguccuccuccccuuccaggcccucuccgacccccuccccucccagggcuccgaguucaccccccaguuccccccccagucccucgaccuccccuccaucaccaucucccgcaaccucgucgagcaggacggcguccuccacuccuccggccuccacauggaccagucccacacccaggucucccaguaccgccaggaccccucccucaucaugcgcuccaucguccacaugaccgacgccgcccgcuccggcgucaugccccccgcccagcucaccaccaucaaccagucccagcucuccgcccagcucggccucaaccucggcggcgccuccaugccccacaccucccccuccccccccgccuccaaguccgccacccccucccccuccuccuccaucaacgaggaggacgccgacgaggccaaccgcgccaucggcgagaagcgcgccgcccccgacuccggcaagaagcccaagacccccaagaagaagaagaagaaggaccccaacgagccccagaagcccgucuccgccuacgcccucuucuuccgcgacacccaggccgccaucaagggccagaaccccaacgccaccuucggcgaggucuccaagaucgucgccuccaugugggacucccucggcgaggagcagaagcaggucuacaagcgcaagaccgaggccgccaagaaggaguaccucaaggcccucgccgccuaccgcgccucccucgucuccaaggccgccgccgaguccgccgaggcccagaccauccgcuccguccagcagacccucgccuccaccaaccucaccuccucccuccuccucaacaccccccucucccagcacggcaccgucuccgccuccccccagacccuccagcagucccucccccgcuccaucgcccccaagccccucaccaugcgccuccccaugaaccagaucgucaccuccgucaccaucgccgccaacaugcccuccaacaucggcgccccccucaucuccuccaugggcaccaccauggucggcuccgcccccuccacccaggucucccccuccguccagacccagcagcaccagaugcagcuccagcagcagcagcagcagcagcagcagcagaugcagcagaugcagcagcagcagcuccagcagcaccagaugcaccagcagauccagcagcagaugcagcagcagcacuuccagcaccacaugcagcagcaccuccagcagcagcagcagcaccuccagcagcagaucaaccagcagcagcuccagcagcagcuccagcagcgccuccagcuccagcagcuccagcacaugcagcaccagucccagcccuccccccgccagcacucccccgucgccucccagaucaccucccccauccccgccaucggcuccccccagcccgccucccagcagcaccagucccagauccagucccagacccagacccagguccucucccaggucuccaucuucuga

SEQ ID NO: 51043 - RNA, 1797 nt, Artificial Sequence
  derived and/or modified sequence opt2 from TOX4__Homo_sapiens__NP_001290452
auggagaccuuccacacccccucccucggcgacgaggaguucgagaucccccccaucucccucgacuccgaccccucccucgccgucuccgacgucgucggccacuucgacgaccucgccgaccccuccuccucccaggacggcuccuucuccgcccaguacggcguccagacccucgacaugcccgucggcaugacccacggccucauggagcagggcggcggccuccucuccggcggccucaccauggaccucgaccacuccaucggcacccaguacuccgccaacccccccgucaccaucgacguccccaugaccgacaugaccuccggccucaugggccacucccagcucaccaccaucgaccaguccgagcucuccucccagcucggccucucccucggcggcggcaccauccucccccccgcccagucccccgaggaccgccucuccaccacccccucccccaccuccucccuccacgaggacggcgucgaggacuuccgccgccagcuccccucccagaagaccgucgucgucgaggccggcaagaagcagaaggcccccaagaagcgcaagaagaaggaccccaacgagccccagaagcccgucuccgccuacgcccucuucuuccgcgacacccaggccgccaucaagggccagaaccccaacgccaccuucggcgaggucuccaagaucgucgccuccaugugggacucccucggcgaggagcagaagcaggucuacaagcgcaagaccgaggccgccaagaaggaguaccucaaggcccucgccgccuacaaggacaaccaggagugccaggccaccgucgagaccgucgagcucgaccccgccccccccucccagacccccucccccccccccauggccaccgucgaccccgccucccccgcccccgccuccaucgagccccccgcccucucccccuccaucgucgucaacuccacccucuccuccuacgucgccaaccaggccuccuccggcgccggcggccagcccaacaucaccaagcucaucaucaccaagcagaugcuccccuccuccaucaccaugucccagggcggcauggucaccgucauccccgccaccgucgucaccucccgcggccuccagcucggccagaccuccaccgccaccauccagcccucccagcaggcccagaucgucacccgcuccguccuccaggccgccgccgccgccgccgccgccgccuccaugcagcucccccccccccgccuccagccccccccccuccagcagaugccccagccccccacccagcagcaggucaccauccuccagcagccccccccccuccaggccaugcagcagccccccccccagaagguccgcaucaaccuccagcagcagccccccccccuccagaucaaguccgucccccuccccacccucaagaugcagaccacccucgucccccccaccgucgaguccucccccgagcgccccaugaacaacucccccgaggcccacaccgucgaggcccccucccccgagaccaucugcgagaugaucaccgacgucguccccgaggucgagucccccucccagauggacgucgagcucgucuccggcucccccgucgcccucuccccccagccccgcugcguccgcuccggcugcgagaacccccccaucgucuccaaggacugggacaacgaguacugcuccaacgagugcgucgucaagcacugccgcgacgucuuccucgccugggucgccucccgcaacuccaacaccgucgucuucgucaaguga

SEQ ID NO: 51044 - RNA, 1581 nt, Artificial Sequence
  derived and/or modified sequence opt2 from TOX__Homo_sapiens__NP_055544
auggacguccgcuucuaccccccccccgcccagcccgccgccgcccccgacgcccccugccucggccccucccccugccucgaccccuacuacugcaacaaguucgacggcgagaacauguacauguccaugaccgagcccucccaggacuacguccccgccucccaguccuaccccggccccucccucgaguccgaggacuucaacaucccccccaucaccccccccucccuccccgaccacucccucguccaccucaacgaggucgaguccggcuaccacucccucugccaccccaugaaccacaacggccuccuccccuuccacccccagaacauggaccuccccgagaucaccgucuccaacaugcucggccaggacggcacccuccucuccaacuccaucuccgucaugcccgacauccgcaaccccgagggcacccaguacuccucccacccccagauggccgccaugcgcccccgcggccagcccgccgacauccgccagcagcccggcaugaugccccacggccagcucaccaccaucaaccagucccagcucuccgcccagcucggccucaacaugggcggcuccaacgucccccacaacucccccuccccccccggcuccaaguccgccacccccucccccuccuccuccguccacgaggacgagggcgacgacaccuccaagaucaacggcggcgagaagcgccccgccuccgacaugggcaagaagcccaagacccccaagaagaagaagaagaaggaccccaacgagccccagaagcccgucuccgccuacgcccucuucuuccgcgacacccaggccgccaucaagggccagaaccccaacgccaccuucggcgaggucuccaagaucgucgccuccaugugggacggccucggcgaggagcagaagcaggucuacaagaagaagaccgaggccgccaagaaggaguaccucaagcagcucgccgccuaccgcgccucccucgucuccaaguccuacuccgagcccgucgacgucaagaccucccagcccccccagcucaucaacuccaagcccuccgucuuccacggccccucccaggcccacuccgcccucuaccucuccucccacuaccaccagcagcccggcaugaacccccaccucaccgccaugcaccccucccucccccgcaacaucgcccccaagcccaacaaccagaugcccgucaccgucuccaucgccaacauggccgucucccccccccccccccuccagaucucccccccccuccaccagcaccucaacaugcagcagcaccagccccucaccaugcagcagccccucggcaaccagcuccccaugcagguccaguccgcccuccacucccccaccaugcagcagggcuucacccuccagcccgacuaccagaccaucaucaaccccaccuccaccgccgcccaggucgucacccaggccauggaguacguccgcuccggcugccgcaacccccccccccagcccgucgacuggaacaacgacuacugcuccuccggcggcaugcagcgcgacaaggcccucuaccucaccuga

SEQ ID NO: 51045 - RNA, 363 nt, Artificial Sequence
  derived and/or modified sequence opt2 from TP53AIP1__Homo_sapiens__NP_001182123
augggcuccuccuccgaggccuccuuccgcuccgcccaggccuccugcuccggcgcccgccgccagggccucggccgcggcgaccagaaccucuccgucaugccccccaacggccgcgcccagacccacacccccggcugggucuccgacccccucguccucggcgcccagguccacggcggcugccgcggcaucgaggcccucuccgucuccuccggcuccugguccuccgccaccgucuggauccucaccggccucucccgccccuuccuccccggcgccaccguccuccgcgaccgcccccucggcuccgccuucgagcucuccuacgaccagaagaaggccccccuccgccuccaguga

SEQ ID NO: 51046 - RNA, 5928 nt, Artificial Sequence
  derived and/or modified sequence opt2 from TP53BP1__Homo_sapiens__NP_001135451
augcccggcgagcagauggaccccaccggcucccagcucgacuccgacuucucccagcaggacacccccugccucaucaucgaggacucccagcccgagucccagguccucgaggacgacuccggcucccacuucuccaugcucucccgccaccuccccaaccuccagacccacaaggagaaccccguccucgacgucgucuccaaccccgagcagaccgccggcgaggagcgcggcgacggcaacuccggcuucaacgagcaccucaaggagaacaaggucgccgaccccgucgacuccuccaaccucgacaccugcggcuccaucucccaggucaucgagcagcucccccagcccaaccgcaccuccuccguccucggcauguccgucgaguccgcccccgccgucgaggaggagaagggcgaggagcucgagcagaaggagaaggagaaggaggaggacaccuccggcaacaccacccacucccucggcgccgaggacaccgccuccucccagcucggcuucggcguccucgagcucucccagucccaggacgucgaggagaacaccguccccuacgaggucgacaaggagcagcuccaguccgucaccaccaacuccggcuacacccgccucuccgacgucgacgccaacaccgccaucaagcacgaggagcaguccaacgaggacauccccaucgccgagcaguccuccaaggacauccccgucaccgcccagcccuccaaggacguccacgucgucaaggagcagaaccccccccccgcccgcuccgaggacaugcccuucucccccaaggccuccgucgccgccauggaggccaaggagcagcucuccgcccaggagcucauggaguccggccuccagauccagaagucccccgagcccgagguccucuccacccaggaggaccucuucgaccaguccaacaagaccgucuccuccgacggcugcuccacccccucccgcgaggagggcggcugcucccucgccuccacccccgccaccacccuccaccuccuccagcucuccggccagcgcucccucguccaggacucccucuccaccaacuccuccgaccucgucgcccccucccccgacgccuuccgcuccacccccuucaucguccccuccucccccaccgagcaggagggccgccaggacaagcccauggacaccuccguccucuccgaggagggcggcgagcccuuccagaagaagcuccaguccggcgagcccgucgagcucgagaaccccccccuccuccccgaguccaccgucuccccccaggccuccacccccaucucccaguccacccccgucuucccccccggcucccuccccauccccucccagccccaguucucccacgacaucuucauccccucccccucccucgaggagcaguccaacgacggcaagaaggacggcgacaugcacuccuccucccucaccgucgagugcuccaagaccuccgagaucgagcccaagaacucccccgaggaccucggccucucccucaccggcgacuccugcaagcucaugcucuccaccuccgaguacucccagucccccaagauggagucccucuccucccaccgcaucgacgaggacggcgagaacacccagaucgaggacaccgagcccaugucccccguccucaacuccaaguucguccccgccgagaacgacuccauccucaugaaccccgcccaggacggcgagguccagcucucccagaacgacgacaagaccaagggcgacgacaccgacacccgcgacgacaucuccauccucgccaccggcugcaagggccgcgaggagaccgucgccgaggacgucugcaucgaccucaccugcgacuccggcucccaggccguccccucccccgccacccgcuccgaggcccucuccuccguccucgaccaggaggaggccauggagaucaaggagcaccaccccgaggagggcuccuccggcuccgaggucgaggagauccccgagacccccugcgagucccagggcgaggagcucaaggaggagaacauggaguccgucccccuccaccucucccucaccgagacccagucccagggccucugccuccagaaggagaugcccaagaaggagugcuccgaggccauggaggucgagaccuccgucaucuccaucgacuccccccagaagcucgccauccucgaccaggagcucgagcacaaggagcaggaggccugggaggaggccaccuccgaggacuccuccgucgucaucgucgacgucaaggagcccuccccccgcgucgacgucuccugcgagccccucgagggcgucgagaagugcuccgacucccaguccugggaggacaucgcccccgagaucgagcccugcgccgagaaccgccucgacaccaaggaggagaaguccgucgaguacgagggcgaccucaaguccggcaccgccgagaccgagcccgucgagcaggacuccucccagcccucccucccccucguccgcgccgacgacccccuccgccucgaccaggagcuccagcagccccagacccaggagaagaccuccaacucccucaccgaggacuccaagauggccaacgccaagcagcucuccuccgacgccgaggcccagaagcucggcaagcccuccgcccacgccucccaguccuucugcgaguccuccuccgagacccccuuccacuucacccuccccaaggagggcgacaucauccccccccucaccggcgccacccccccccucaucggccaccucaagcucgagcccaagcgccacuccacccccaucggcaucuccaacuaccccgaguccaccaucgccaccuccgacgucauguccgaguccauggucgagacccacgaccccauccucggcuccggcaagggcgacuccggcgccgcccccgacgucgacgacaagcucugccuccgcaugaagcucgucucccccgagaccgaggccuccgaggagucccuccaguucaaccucgagaagcccgccaccggcgagcgcaagaacggcuccaccgccgucgccgaguccgucgccuccccccagaagaccauguccguccucuccugcaucugcgaggcccgccaggagaacgaggcccgcuccgaggacccccccaccacccccauccgcggcaaccuccuccacuuccccuccucccagggcgaggaggagaaggagaagcucgagggcgaccacaccauccgccagucccagcagcccaugaagcccaucucccccgucaaggaccccgucucccccgccucccagaagauggucauccagggccccuccuccccccagggcgaggccauggucaccgacguccucgaggaccagaaggagggccgcuccaccaacaaggagaaccccuccaaggcccucaucgagcgccccucccagaacaacaucggcauccagaccauggagugcucccuccgcguccccgagaccgucuccgccgccacccagaccaucaagaacgucugcgagcagggcaccuccaccgucgaccagaacuucggcaagcaggacgccaccguccagaccgagcgcggcuccggcgagaagcccgucuccgcccccggcgacgacaccgagucccuccacucccagggcgaggaggaguucgacaugccccagcccccccacggccacguccuccaccgccacaugcgcaccauccgcgagguccgcacccucgucacccgcgucaucaccgacgucuacuacgucgacggcaccgaggucgagcgcaaggucaccgaggagaccgaggagcccaucgucgagugccaggagugcgagaccgaggucucccccucccagaccggcggcuccuccggcgaccucggcgacaucuccuccuucuccuccaaggccuccucccuccaccgcaccuccuccggcaccucccucuccgccaugcacuccuccggcuccuccggcaagggcgccggcccccuccgcggcaagaccuccggcaccgagcccgccgacuucgcccuccccuccucccgcggcggccccggcaagcucuccccccgcaagggcgucucccagaccggcacccccgucugcgaggaggacggcgacgccggccucggcauccgccagggcggcaaggcccccgucaccccccgcggccgcggccgccgcggccgcccccccucccgcaccaccggcacccgcgagaccgccguccccggcccccucggcaucgaggacaucucccccaaccucucccccgacgacaaguccuucucccgcgucgucccccgcguccccgacuccacccgccgcaccgacgucggcgccggcgcccuccgccgcuccgacucccccgagauccccuuccaggccgccgccggccccuccgacggccucgacgccuccucccccggcaacuccuucgucggccuccgcgucgucgccaagugguccuccaacggcuacuucuacuccggcaagaucacccgcgacgucggcgccggcaaguacaagcuccucuucgacgacggcuacgagugcgacguccucggcaaggacauccuccucugcgaccccaucccccucgacaccgaggucaccgcccucuccgaggacgaguacuucuccgccggcgucgucaagggccaccgcaaggaguccggcgagcucuacuacuccaucgagaaggagggccagcgcaagugguacaagcgcauggccgucauccucucccucgagcagggcaaccgccuccgcgagcaguacggccucggccccuacgaggccgucaccccccucaccaaggccgccgacaucucccucgacaaccucgucgagggcaagcgcaagcgccgcuccaacgucuccucccccgccacccccaccgccuccuccuccuccuccaccacccccacccgcaagaucaccgaguccccccgcgccuccaugggcguccucuccggcaagcgcaagcucaucaccuccgaggaggagcgcucccccgccaagcgcggccgcaaguccgccaccgucaagcccgucggcgccggcgaguucgucucccccugcgaguccggcgacaacaccggcgagcccuccgcccucgaggagcagcgcggcccccucccccucaacaagacccucuuccucggcuacgccuuccuccucaccauggccaccaccuccgacaagcucgccucccgcuccaagcuccccgacggccccaccggcuccuccgaggaggaggaggaguuccucgagaucccccccuucaacaagcaguacaccgagucccagcuccgcgccggcgccggcuacauccucgaggacuucaacgaggcccagugcaacaccgccuaccagugccuccucaucgccgaccagcacugccgcacccgcaaguacuuccucugccucgccuccggcauccccugcgucucccacgucuggguccacgacuccugccacgccaaccagcuccagaacuaccgcaacuaccuccuccccgccggcuacucccucgaggagcagcgcauccucgacuggcagccccgcgagaaccccuuccagaaccucaagguccuccucgucuccgaccagcagcagaacuuccucgagcucugguccgagauccucaugaccggcggcgccgccuccgucaagcagcaccacuccuccgcccacaacaaggacaucgcccucggcgucuucgacgucgucgucaccgaccccuccugccccgccuccguccucaagugcgccgaggcccuccagcuccccgucgucucccaggagugggucauccagugccucaucgucggcgagcgcaucggcuucaagcagcaccccaaguacaagcacgacuacgucucccacuga

SEQ ID NO: 51047 - RNA, 3405 nt, Artificial Sequence
  derived and/or modified sequence opt2 from TP53BP2__Homo_sapiens__NP_001026855
augcgcuucggcuccaagaugaugcccauguuccucaccgucuaccucuccaacaacgagcagcacuucaccgagguccccgucacccccgagaccaucugccgcgacgucgucgaccucugcaaggagcccggcgaguccgacugccaccucgccgaggucuggugcggcuccgagcgccccgucgccgacaacgagcgcauguucgacguccuccagcgcuucggcucccagcgcaacgagguccgcuucuuccuccgccacgagcgcccccccggccgcgacaucgucuccggcccccgcucccaggaccccucccucaagcgcaacggcgucaagguccccggcgaguaccgccgcaaggagaacggcgucaacuccccccgcauggaccucacccucgccgagcuccaggagauggccucccgccagcagcagcagaucgaggcccagcagcagcuccucgccaccaaggagcagcgccucaaguuccucaagcagcaggaccagcgccagcagcagcaggucgccgagcaggagaagcucaagcgccucaaggagaucgccgagaaccaggaggccaagcucaagaagguccgcgcccucaagggccacgucgagcagaagcgccucuccaacggcaagcucgucgaggagaucgagcagaugaacaaccucuuccagcagaagcagcgcgagcucguccucgccgucuccaaggucgaggagcucacccgccagcucgagaugcucaagaacggccgcaucgacucccaccacgacaaccaguccgccgucgccgagcucgaccgccucuacaaggagcuccagcuccgcaacaagcucaaccaggagcagaacgccaagcuccagcagcagcgcgagugccucaacaagcgcaacuccgaggucgccgucauggacaagcgcgucaacgagcuccgcgaccgccucuggaagaagaaggccgcccuccagcagaaggagaaccuccccgucuccuccgacggcaaccucccccagcaggccgccuccgcccccucccgcgucgccgccgucggccccuacauccaguccuccaccaugccccgcaugcccucccgccccgagcuccucgucaagcccgcccuccccgacggcucccucgucauccaggccuccgagggccccaugaagauccagacccuccccaacaugcgcuccggcgccgccucccagaccaagggcuccaagauccaccccgucggccccgacuggucccccuccaacgccgaccucuuccccucccagggcuccgccuccgucccccaguccaccggcaacgcccucgaccaggucgacgacggcgaggucccccuccgcgagaaggagaagaagguccgccccuucuccauguucgacgccgucgaccaguccaacgccccccccuccuucggcacccuccgcaagaaccaguccuccgaggacauccuccgcgacgcccaggucgccaacaagaacgucgccaagguccccccccccguccccaccaagcccaagcagaucaaccuccccuacuucggccagaccaaccagccccccuccgacaucaagcccgacggcuccucccagcagcucuccaccgucguccccuccaugggcaccaagcccaagcccgccggccagcagccccgcguccuccucucccccuccauccccuccgucggccaggaccagacccucucccccggcuccaagcaggaguccccccccgccgccgccguccgccccuucaccccccagcccuccaaggacacccuccucccccccuuccgcaagccccagaccgucgccgccuccuccaucuacuccauguacacccagcagcaggcccccggcaagaacuuccagcaggccguccaguccgcccucaccaagacccacacccgcggcccccacuucuccuccgucuacggcaagcccgucaucgccgccgcccagaaccagcagcagcaccccgagaacaucuacuccaacucccagggcaagcccggcucccccgagcccgagaccgagcccgucuccuccguccaggagaaccacgagaacgagcgcaucccccgcccccucucccccaccaagcuccuccccuuccucuccaaccccuaccgcaaccaguccgacgccgaccucgaggcccuccgcaagaagcucuccaacgccccccgcccccucaagaagcgcuccuccaucaccgagcccgagggccccaacggccccaacauccagaagcuccucuaccagcgcaccaccaucgccgccauggagaccaucuccguccccuccuaccccuccaaguccgccuccgucaccgccuccuccgagucccccgucgagauccagaaccccuaccuccacgucgagcccgagaaggaggucgucucccucguccccgagucccucucccccgaggacgucggcaacgccuccaccgagaacuccgacaugcccgcccccucccccggccucgacuacgagcccgagggcguccccgacaacucccccaaccuccagaacaaccccgaggagcccaaccccgaggccccccacguccucgacgucuaccucgaggaguacccccccuacccccccccccccuaccccuccggcgagcccgagggccccggcgaggacuccgucuccaugcgcccccccgagaucaccggccaggucucccucccccccggcaagcgcaccaaccuccgcaagaccggcuccgagcgcaucgcccacggcaugcgcgucaaguucaacccccucgcccuccuccucgacuccucccucgagggcgaguucgaccucguccagcgcaucaucuacgaggucgacgaccccucccuccccaacgacgagggcaucaccgcccuccacaacgccgucugcgccggccacaccgagaucgucaaguuccucguccaguucggcgucaacgucaacgccgccgacuccgacggcuggaccccccuccacugcgccgccuccugcaacaacguccaggucugcaaguuccucgucgaguccggcgccgccgucuucgccaugaccuacuccgacaugcagaccgccgccgacaagugcgaggagauggaggagggcuacacccagugcucccaguuccucuacggcguccaggagaagaugggcaucaugaacaagggcgucaucuacgcccucugggacuacgagccccagaacgacgacgagcuccccaugaaggagggcgacugcaugaccaucauccaccgcgaggacgaggacgagaucgagugguggugggcccgccucaacgacaaggagggcuacgucccccgcaaccuccucggccucuacccccgcaucaagccccgccagcgcucccucgccuga

SEQ ID NO: 51048 - RNA, 1182 nt, Artificial Sequence
  derived and/or modified sequence opt2 from TP53__Homo_sapiens__NP_000537
auggaggagccccaguccgaccccuccgucgagcccccccucucccaggagaccuucuccgaccucuggaagcuccuccccgagaacaacguccucuccccccuccccucccaggccauggacgaccucaugcucucccccgacgacaucgagcagugguucaccgaggaccccggccccgacgaggccccccgcaugcccgaggccgccccccccgucgcccccgcccccgccgcccccacccccgccgcccccgcccccgcccccuccuggccccucuccuccuccguccccucccagaagaccuaccagggcuccuacggcuuccgccucggcuuccuccacuccggcaccgccaaguccgucaccugcaccuacucccccgcccucaacaagauguucugccagcucgccaagaccugccccguccagcucugggucgacuccacccccccccccggcacccgcguccgcgccauggccaucuacaagcagucccagcacaugaccgaggucguccgccgcugcccccaccacgagcgcugcuccgacuccgacggccucgcccccccccagcaccucauccgcgucgagggcaaccuccgcgucgaguaccucgacgaccgcaacaccuuccgccacuccgucgucguccccuacgagccccccgaggucggcuccgacugcaccaccauccacuacaacuacaugugcaacuccuccugcaugggcggcaugaaccgccgccccauccucaccaucaucacccucgaggacuccuccggcaaccuccucggccgcaacuccuucgagguccgcgucugcgccugccccggccgcgaccgccgcaccgaggaggagaaccuccgcaagaagggcgagccccaccacgagcucccccccggcuccaccaagcgcgcccuccccaacaacaccuccuccuccccccagcccaagaagaagccccucgacggcgaguacuucacccuccagauccgcggccgcgagcgcuucgagauguuccgcgagcucaacgaggcccucgagcucaaggacgcccaggccggcaaggagcccggcggcucccgcgcccacuccucccaccucaaguccaagaagggccaguccaccucccgccacaagaagcucauguucaagaccgagggccccgacuccgacuga

SEQ ID NO: 51049 - RNA, 570 nt, Artificial Sequence
  derived and/or modified sequence opt2 from TP53I11__Homo_sapiens__NP_001245253
auggccgccaagcagccccccccccucaugaagaagcacucccagaccgaccucgucucccgccucaagacccgcaagauccucggcgucggcggcgaggacgacgacggcgagguccaccgcuccaagaucucccagguccucggcaacgagaucaaguucaccauccgcgagccccucggccuccgcgucuggcaguucgucuccgccguccucuucuccggcaucgccaucauggcccucgccuuccccgaccagcucuacgacgccgucuucgacggcgcccaggucaccuccaagacccccauccgccucuacggcggcgcccuccucuccaucucccucaucauguggaacgcccucuacaccgccgagaaggucaucauccgcuggacccuccucaccgaggccugcuacuucggcguccaguuccucgucgucaccgccacccucgccgagaccggccucaugucccucggcauccuccuccuccucgucucccgccuccucuucgucgucaucuccaucuacuacuacuaccaggucggccgccgccccaagaaggccuga

SEQ ID NO: 51050 - RNA, 1182 nt, Artificial Sequence
  derived and/or modified sequence opt2 from TP53I13__Homo_sapiens__NP_612358
auggccccccccccccccuccccccagcuccuccuccucgccgcccucgcccgccuccucggccccuccgaggucauggccggccccgccgaggaggccggcgcccacugccccgagucccucuggccccuccccccccaggucuccccccgcgucaccuacacccgcgucucccccggccaggccgaggacgucaccuuccucuaccaccccugcgcccaccccuggcucaagcuccagcucgcccuccucgccuacgccugcauggccaaccccucccucacccccgacuucucccucacccaggaccgcccccucguccucaccgccuggggccucgcccucgagauggccugggucgagcccgccugggccgcccacuggcucaugcgccgccgccgccgcaagcagcgcaagaagaaggccuggaucuacugcgagucccucuccggccccgcccccuccgagcccacccccggccgcggccgccucugccgccgcggcugcguccaggcccucgcccucgccuucgcccuccgcuccuggcgcccccccggcaccgaggucaccucccagggcccccgccagcccuccuccuccggcgccaagcgccgccgccuccgcgccgcccucggcccccagcccacccgcuccgcccuccgcuuccccuccgccucccccggcucccucaaggccaagcaguccauggccggcauccccggccgcgaguccaacgcccccuccguccccaccgucucccuccuccccggcgcccccggcggcaacgccuccucccgcaccgaggcccagguccccaacggccagggcucccccggcggcugcgucugcuccucccaggccucccccgccccccgcgccgccgcccccccccgcgccgcccgcggccccaccccccgcaccgaggaggccgccugggccgccauggcccucaccuuccuccucguccuccucacccucgccacccucugcacccgccuccaccgcaacuuccgccgcggcgaguccaucuacuggggccccaccgccgacucccaggacaccgucgccgccguccucaagcgccgccuccuccagcccucccgccgcgucaagcgcucccgccgccgcccccuccucccccccacccccgacuccggccccgagggcgaguccuccgaguga

SEQ ID NO: 51051 - RNA, 747 nt, Artificial Sequence
  derived and/or modified sequence opt2 from TP53I3__Homo_sapiens__NP_001193731
augcucgccguccacuucgacaagcccggcggccccgagaaccucuacgucaaggaggucgccaagcccucccccggcgagggcgagguccuccucaaggucgccgccuccgcccucaaccgcgccgaccucaugcagcgccagggccaguacgaccccccccccggcgccuccaacauccucggccucgaggccuccggccacgucgccgagcucggccccggcugccagggccacuggaagaucggcgacaccgccauggcccuccuccccggcggcggccaggcccaguacgucaccguccccgagggccuccucaugcccauccccgagggccucacccucacccaggccgccgccauccccgaggccuggcucaccgccuuccagcuccuccaccucgucggcaacguccaggccggcgacuacguccucauccacgccggccucuccggcgucggcaccgccgccauccagcucacccgcauggccggcgccaucccccucgucaccgccggcucccagaagaagcuccagauggccgagaagcucggcgccgccgccggcuucaacuacaagaaggaggacuucuccgaggccacccucaaguucaccaagguccaggccaacgccggcgagugcuuccacggcgccaacuccgccucccuccuccacggcggcccccccaccuccgccgccggcuccggccagaaccuccccuccgaccgcaaccccggcggccccuga

SEQ ID NO: 51052 - RNA, 495 nt, Artificial Sequence
  derived and/or modified sequence opt2 from TP53INP1__Homo_sapiens__NP_001129205
auguuccagcgccucaacaagauguucgucggcgaggucuccuccuccuccaaccaggagcccgaguucaacgagaaggaggacgacgaguggauccucgucgacuucaucgacaccugcaccggcuucuccgccgaggaggaggaggaggaggaggacaucuccgaggagucccccaccgagcaccccuccgucuucuccugccuccccgccucccucgagugccucgccgacaccuccgacuccugcuuccuccaguucgaguccugccccauggaggaguccugguucaucacccccccccccugcuucaccgccggcggccucaccaccaucaaggucgagaccucccccauggagaaccuccucaucgagcaccccuccauguccgucuacgccguccacaacuccugccccggccucuccgaggccacccgcggcaccgacgagcuccacucccccuccuccccccgcgcccgcaaguccugccucuga

SEQ ID NO: 51053 - RNA, 663 nt, Artificial Sequence
  derived and/or modified sequence opt2 from TP53INP2__Homo_sapiens__NP_067025
auguuccagcgccucuccucccucuucuucuccacccccuccccccccgaggaccccgacugcccccgcgccuucgucuccgaggaggacgaggucgacggcuggcucaucaucgaccuccccgacuccuacgccgccccccccucccccggcgccgcccccgcccccgccggccgccccccccccgcccccucccucauggacgaguccugguucgucaccccccccgccugcuucaccgccgagggccccggccucggccccgcccgccuccaguccuccccccucgaggaccuccucaucgagcaccccuccauguccgucuacgucaccggcuccaccaucguccucgagcccggcucccccuccccccuccccgacgccgcccuccccgacggcgaccucuccgagggcgagcucacccccgcccgccgcgagccccgcgccgcccgccacgccgccccccuccccgcccgcgccgcccuccucgagaaggccggccagguccgccgccuccagcgcgcccgccagcgcgccgagcgccacgcccucuccgccaaggccguccagcgccagaaccgcgcccgcgagucccgcccccgccgcuccaagaaccaguccuccuucaucuaccagcccugccagcgccaguucaacuacuga

SEQ ID NO: 51054 - RNA, 762 nt, Artificial Sequence
  derived and/or modified sequence opt2 from TP53RK__Homo_sapiens__NP_291028
auggccgccgcccgcgccaccacccccgccgacggcgaggagcccgcccccgaggccgaggcccucgccgccgcccgcgagcgcuccucccgcuuccucuccggccucgagcucgucaagcagggcgccgaggcccgcgucuuccgcggccgcuuccagggccgcgccgccgucaucaagcaccgcuuccccaagggcuaccgccaccccgcccucgaggcccgccucggccgccgccgcaccguccaggaggcccgcgcccuccuccgcugccgccgcgccggcaucuccgcccccgucgucuucuucgucgacuacgccuccaacugccucuacauggaggagaucgagggcuccgucaccguccgcgacuacauccaguccaccauggagaccgagaagaccccccagggccucuccaaccucgccaagaccaucggccagguccucgcccgcaugcacgacgaggaccucauccacggcgaccucaccaccuccaacaugcuccucaagcccccccucgagcagcucaacaucguccucaucgacuucggccucuccuucaucuccgcccuccccgaggacaagggcgucgaccucuacguccucgagaaggccuuccucuccacccaccccaacaccgagaccgucuucgaggccuuccucaaguccuacuccaccuccuccaagaaggcccgccccguccucaagaagcucgacgagguccgccuccgcggccgcaagcgcuccauggucggcuga

SEQ ID NO: 51055 - RNA, 375 nt, Artificial Sequence
  derived and/or modified sequence opt2 from TP53TG3C__Homo_sapiens__NP_001192188
augcgcgccucccccugcaucucccagcccgccgccuccuggcacccccgccccuccgcccuccgccccaccgccggcuccggccccgacacccgcacccccggcaccgucgaggacggcuccgcccccugccccgccuuccgcucccccgccgucucccccugcggcgaggagcccugcugcuuccagaucucccccgccgaggagacccucgagcucggccgccucgucucccccggcaacugcgacacccucuccccccgcgccgccggcuucuacgccugccacguccgcucccucauccccugccgcuccaccaagggccgcuggccccucaccgccuccgccgccggccucuccuccuucuccggcuga

SEQ ID NO: 51056 - RNA, 1668 nt, Artificial Sequence
  derived and/or modified sequence opt2 from TP63__Homo_sapiens__NP_001108450
augaacuucgagaccucccgcugcgccacccuccaguacugccccgaccccuacauccagcgcuucgucgagacccccgcccacuucuccuggaaggaguccuacuaccgcuccaccaugucccaguccacccagaccaacgaguuccucucccccgaggucuuccagcacaucugggacuuccucgagcagcccaucugcuccguccagcccaucgaccucaacuucgucgacgagcccuccgaggacggcgccaccaacaagaucgagaucuccauggacugcauccgcaugcaggacuccgaccucuccgaccccauguggccccaguacaccaaccucggccuccucaacuccauggaccagcagauccagaacggcuccuccuccaccucccccuacaacaccgaccacgcccagaacuccgucaccgcccccucccccuacgcccagcccuccuccaccuucgacgcccucucccccucccccgccauccccuccaacaccgacuaccccggcccccacuccuucgacgucuccuuccagcaguccuccaccgccaaguccgccaccuggaccuacuccaccgagcucaagaagcucuacugccagaucgccaagaccugccccauccagaucaaggucaugaccccccccccccagggcgccgucauccgcgccaugcccgucuacaagaaggccgagcacgucaccgaggucgucaagcgcugccccaaccacgagcucucccgcgaguucaacgagggccagaucgccccccccucccaccucauccgcgucgagggcaacucccacgcccaguacgucgaggaccccaucaccggccgccaguccguccucguccccuacgagcccccccaggucggcaccgaguucaccaccguccucuacaacuucaugugcaacuccuccugcgucggcggcaugaaccgccgccccauccucaucaucgucacccucgagacccgcgacggccagguccucggccgccgcugcuucgaggcccgcaucugcgccugccccggccgcgaccgcaaggccgacgaggacuccauccgcaagcagcaggucuccgacuccaccaagaacggcgacggcaccaagcgccccuuccgccagaacacccacggcauccagaugaccuccaucaagaagcgccgcucccccgacgacgagcuccucuaccuccccguccgcggccgcgagaccuacgagaugcuccucaagaucaaggagucccucgagcucaugcaguaccucccccagcacaccaucgagaccuaccgccagcagcagcagcagcagcaccagcaccuccuccagaagcagaccuccauccagucccccuccuccuacggcaacuccucccccccccucaacaagaugaacuccaugaacaagcuccccuccgucucccagcucaucaacccccagcagcgcaacgcccucacccccaccaccauccccgacggcaugggcgccaacauccccaugaugggcacccacaugcccauggccggcgacaugaacggccucucccccacccaggcccucccccccccccucuccaugcccuccaccucccacugcaccccccccccccccuaccccaccgacugcuccaucguccgcaucuggcaggucuga

SEQ ID NO: 51057 - RNA, 1911 nt, Artificial Sequence
  derived and/or modified sequence opt2 from TP73__Homo_sapiens__XP_011540366
auggcccaguccaccgccaccucccccgacggcggcaccaccuucgagcaccucugguccucccucgagcccgacuccaccuacuucgaccucccccaguccucccgcggcaacaacgaggucgucggcggcaccgacuccuccauggacgucuuccaccucgagggcaugaccaccuccgucauggcccaguucaaccuccucuccuccaccauggaccagauguccucccgcgccgccuccgccucccccuacacccccgagcacgccgccuccguccccacccacucccccuacgcccagcccuccuccaccuucgacaccaugucccccgcccccgucauccccuccaacaccgacuaccccggcccccaccacuucgaggucaccuuccagcaguccuccaccgccaaguccgccaccuggaccuacuccccccuccucaagaagcucuacugccagaucgccaagaccugccccauccagaucaaggucuccaccccccccccccccggcaccgccauccgcgccaugcccgucuacaagaaggccgagcacgucaccgacgucgucaagcgcugccccaaccacgagcucggccgcgacuucaacgagggccaguccgcccccgccucccaccucauccgcgucgagggcaacaaccucucccaguacgucgacgaccccgucaccggccgccaguccgucgucguccccuacgagcccccccaggucggcaccgaguucaccaccauccucuacaacuucaugugcaacuccuccugcgucggcggcaugaaccgccgccccauccucaucaucaucacccucgagaugcgcgacggccagguccucggccgccgcuccuucgagggccgcaucugcgccugccccggccgcgaccgcaaggccgacgaggaccacuaccgcgagcagcaggcccucaacgaguccuccgccaagaacggcgccgccuccaagcgcgccuucaagcaguccccccccgccguccccgcccucggcgccggcgucaagaagcgccgccacggcgacgaggacaccuacuaccuccagguccgcggccgcgagaacuucgagauccucaugaagcucaaggagucccucgagcucauggagcucgucccccagccccucgucgacuccuaccgccagcagcagcagcuccuccagcgccccucccaccuccagccccccuccuacggccccguccucucccccaugaacaagguccacggcggcaugaacaagcuccccuccgucaaccagcucgucggccagccccccccccacuccuccgccgccacccccaaccucggccccgucggccccggcaugcucaacaaccacggccacgccguccccgccaacggcgagauguccuccucccacuccgcccaguccauggucuccggcucccacugcaccccccccccccccuaccacgccgaccccucccucgucuccuuccucaccggccucggcugccccaacugcaucgaguacuucaccucccagggccuccaguccaucuaccaccuccagaaccucaccaucgaggaccucggcgcccucaagauccccgagcaguaccgcaugaccaucuggcgcggccuccaggaccucaagcagggccacgacuacuccaccgcccagcagcuccuccgcuccuccaacgccgccaccaucuccaucggcggcuccggcgagcuccagcgccagcgcgucauggaggccguccacuuccgcguccgccacaccaucaccauccccaaccgcggcggccccggcggcggccccgacgagugggccgacuucggcuucgaccuccccgacugcaaggcccgcaagcagcccaucaaggaggaguucaccgaggccgagauccacuga

SEQ ID NO: 51058 - RNA, 1263 nt, Artificial Sequence
  derived and/or modified sequence opt2 from TPBG__Homo_sapiens__XP_011534399
augcccggcggcugcucccgcggccccgccgccggcgacggccgccuccgccucgcccgccucgcccucguccuccucggcugggucuccuccuccucccccaccuccuccgccuccuccuucuccuccuccgcccccuuccucgccuccgccgucuccgcccagcccccccuccccgaccagugccccgcccucugcgagugcuccgaggccgcccgcaccgucaagugcgucaaccgcaaccucaccgagguccccaccgaccuccccgccuacguccgcaaccucuuccucaccggcaaccagcucgccguccuccccgccggcgccuucgcccgccgccccccccucgccgagcucgccgcccucaaccucuccggcucccgccucgacgagguccgcgccggcgccuucgagcaccuccccucccuccgccagcucgaccucucccacaacccccucgccgaccucucccccuucgccuucuccggcuccaacgccuccgucuccgcccccuccccccucgucgagcucauccucaaccacaucgucccccccgaggacgagcgccagaaccgcuccuucgagggcauggucgucgccgcccuccucgccggccgcgcccuccagggccuccgccgccucgagcucgccuccaaccacuuccucuaccucccccgcgacguccucgcccagcuccccucccuccgccaccucgaccucuccaacaacucccucgucucccucaccuacgucuccuuccgcaaccucacccaccucgagucccuccaccucgaggacaacgcccucaagguccuccacaacggcacccucgccgagcuccagggccucccccacauccgcgucuuccucgacaacaaccccugggucugcgacugccacauggccgacauggucaccuggcucaaggagaccgaggucguccagggcaaggaccgccucaccugcgccuaccccgagaagaugcgcaaccgcguccuccucgagcucaacuccgccgaccucgacugcgaccccauccucccccccucccuccagaccuccuacgucuuccucggcaucguccucgcccucaucggcgccaucuuccuccucguccucuaccucaaccgcaagggcaucaagaaguggaugcacaacauccgcgacgccugccgcgaccacauggagggcuaccacuaccgcuacgagaucaacgccgacccccgccucaccaaccucuccuccaacuccgacgucuga

SEQ ID NO: 51059 - RNA, 2667 nt, Artificial Sequence
  derived and/or modified sequence opt2 from TPCN1__Homo_sapiens__NP_001137291
auggaguccugcuacaucgcccaggccggccucgagcuccucggcuccuccuccucccccacccucaccucccaguccgccgagaucaccgaggacgccuccaacggcggcgucuccgagcagcaccccuggcccuccggcuucgagcgcgagcucaagcccgagaccaucuccucccccggcuaccacauccuccgcgccaccggcgaggagaacauggccgucucccucgacgacgacgucccccucauccucacccucgacgagggcggcuccgccccccucgcccccuccaacggccucggccaggaggagcuccccuccaagaacggcggcuccuacgccauccacgacucccaggcccccucccucuccuccggcggcgaguccucccccuccucccccgcccacaacugggagaugaacuaccaggaggccgccaucuaccuccaggagggcgagaacaacgacaaguucuucacccaccccaaggacgccaaggcccucgccgccuaccucuucgcccacaaccaccucuucuaccucauggagcucgccaccgcccuccuccuccuccuccucucccucugcgaggcccccgccguccccgcccuccgccucggcaucuacguccacgccacccucgagcucuucgcccucauggucgucgucuucgagcucugcaugaagcuccgcuggcucggccuccacaccuucauccgccacaagcgcaccauggucaagaccuccguccucgucguccaguucgucgaggccaucgucguccucguccgccagaugucccacguccgcgucacccgcgcccuccgcugcaucuuccucgucgacugccgcuacugcggcggcguccgccgcaaccuccgccagaucuuccagucccucccccccuucauggacauccuccuccuccuccucuucuucaugaucaucuucgccauccucggcuucuaccucuucucccccaaccccuccgaccccuacuucuccacccucgagaacuccaucgucucccucuucguccuccucaccaccgccaacuuccccgacgucaugaugcccuccuacucccgcaaccccugguccugcgucuucuucaucgucuaccucuccaucgagcucuacuucaucaugaaccuccuccucgccgucgucuucgacaccuucaacgacaucgagaagcgcaaguucaagucccuccuccuccacaagcgcaccgccauccagcacgccuaccgccuccucaucucccagcgccgccccgccggcaucuccuaccgccaguucgagggccucaugcgcuucuacaagccccgcauguccgcccgcgagcgcuaccucaccuucaaggcccucaaccagaacaacaccccccuccucucccucaaggacuucuacgacaucuacgaggucgccgcccucaaguggaaggccaagaagaaccgcgagcacugguucgacgagcucccccgcaccgcccuccucaucuucaagggcaucaacauccucgucaaguccaaggccuuccaguacuucauguaccucgucgucgccgucaacggcgucuggauccucgucgagaccuucaugcucaagggcggcaacuucuucuccaagcacguccccugguccuaccucgucuuccucaccaucuacggcgucgagcucuuccucaaggucgccggccucggccccgucgaguaccucuccuccggcuggaaccucuucgacuucuccgucaccgucuucgccuuccucggccuccucgcccucgcccucaacauggagcccuucuacuucaucgucguccuccgcccccuccagcuccuccgccucuucaagcucaaggagcgcuaccgcaacguccucgacaccauguucgagcuccucccccgcauggccucccucggccucacccuccucaucuucuacuacuccuucgccaucgucggcauggaguucuucugcggcaucgucuuccccaacugcugcaacaccuccaccgucgccgacgccuaccgcuggcgcaaccacaccgucggcaaccgcaccgucgucgaggagggcuacuacuaccucaacaacuucgacaacauccucaacuccuucgucacccucuucgagcucaccgucgucaacaacugguacaucaucauggagggcgucaccucccagaccucccacuggucccgccucuacuucaugaccuucuacaucgucaccauggucgucaugaccaucaucgucgccuucauccucgaggccuucgucuuccgcaugaacuacucccgcaagaaccaggacuccgaggucgacggcggcaucacccucgagaaggagaucuccaaggaggagcucgucgccguccucgagcucuaccgcgaggcccgcggcgccuccuccgacgucacccgccuccucgagacccucucccagauggagcgcuaccagcagcacuccauggucuuccucggccgccgcucccgcaccaaguccgaccucucccucaagauguaccaggaggagauccaggagugguacgaggagcacgcccgcgagcaggagcagcagcgccagcucuccuccuccgccgcccccgccgcccagcagccccccggcucccgccagcgcucccagaccgucaccuga

SEQ ID NO: 51060 - RNA, 2259 nt, Artificial Sequence
  derived and/or modified sequence opt2 from TPCN2__Homo_sapiens__NP_620714
auggccgagccccaggccgaguccgagccccuccucggcggcgcccgcggcggcggcggcgacuggcccgccggccucaccaccuaccgcuccauccaggucggccccggcgccgccgcccgcugggaccucugcaucgaccaggccgucgucuucaucgaggacgccauccaguaccgcuccaucaaccaccgcgucgacgccuccuccauguggcucuaccgccgcuacuacuccaacgucugccagcgcacccucuccuucaccaucuuccucauccucuuccucgccuucaucgagacccccuccucccucaccuccaccgccgacguccgcuaccgcgccgcccccugggagccccccugcggccucaccgaguccgucgagguccucugccuccucgucuucgccgccgaccucuccgucaagggcuaccucuucggcugggcccacuuccagaagaaccucuggcuccucggcuaccucgucguccucgucgucucccucgucgacuggaccgucucccucucccucgucugccacgagccccuccgcauccgccgccuccuccgccccuucuuccuccuccagaacuccuccaugaugaagaagacccucaagugcauccgcuggucccuccccgagauggccuccgucggccuccuccucgccauccaccucugccucuucaccauguucggcaugcuccucuucgccggcggcaagcaggacgacggccaggaccgcgagcgccucaccuacuuccagaaccuccccgagucccucaccucccuccucguccuccucaccaccgccaacaaccccgacgucaugauccccgccuacuccaagaaccgcgccuacgccaucuucuucaucgucuucaccgucaucggcucccucuuccucaugaaccuccucaccgccaucaucuacucccaguuccgcggcuaccucaugaagucccuccagaccucccucuuccgccgccgccucggcacccgcgccgccuucgagguccucuccuccauggucggcgagggcggcgccuucccccaggccgucggcgucaagccccagaaccuccuccagguccuccagaagguccagcucgacuccucccacaagcaggccaugauggagaagguccgcuccuacggcuccguccuccucuccgccgaggaguuccagaagcucuucaacgagcucgaccgcuccgucgucaaggagcaccccccccgccccgaguaccagucccccuuccuccaguccgcccaguuccucuucggccacuacuacuucgacuaccucggcaaccucaucgcccucgccaaccucgucuccaucugcgucuuccucguccucgacgccgacguccuccccgccgagcgcgacgacuucauccucggcauccucaacugcgucuucaucgucuacuaccuccucgagaugcuccucaaggucuucgcccucggccuccgcggcuaccucuccuaccccuccaacgucuucgacggccuccucaccgucguccuccucguccucgagaucuccacccucgccgucuaccgccucccccaccccggcuggcgccccgagauggucggccuccucucccucugggacaugacccgcaugcucaacaugcucaucgucuuccgcuuccuccgcaucauccccuccaugaagcucauggccgucgucgccuccaccguccucggccucguccagaacaugcgcgccuucggcggcauccucgucgucgucuacuacgucuucgccaucaucggcaucaaccucuuccgcggcgucaucgucgcccuccccggcaacuccucccucgcccccgccaacggcuccgcccccugcggcuccuucgagcagcucgaguacugggccaacaacuucgacgacuucgccgccgcccucgucacccucuggaaccucauggucgucaacaacuggcaggucuuccucgacgccuaccgccgcuacuccggccccugguccaagaucuacuucguccucugguggcucgucuccuccgucaucugggucaaccucuuccucgcccucauccucgagaacuuccuccacaagugggacccccgcucccaccuccagccccucgccggcacccccgaggccaccuaccagaugaccgucgagcuccucuuccgcgacauccucgaggagcccggcgaggacgagcucaccgagcgccucucccagcacccccaccucuggcucugccgcuga

SEQ ID NO: 51061 - RNA, 675 nt, Artificial Sequence
  derived and/or modified sequence opt2 from TPD52__Homo_sapiens__NP_001020423
auggacugccgcgagauggaccucuacgaggacuaccagucccccuucgacuucgacgccggcgucaacaaguccuaccucuaccucucccccuccggcaacuccuccccccccggcucccccacccuccagaaguucggccuccuccgcaccgaccccguccccgaggagggcgaggacgucgccgccaccaucuccgccaccgagacccucuccgaggaggagcaggaggagcuccgccgcgagcucgccaaggucgaggaggagauccagacccucucccagguccucgccgccaaggagaagcaccucgccgagaucaagcgcaagcucggcaucaacucccuccaggagcucaagcagaacaucgccaagggcuggcaggacgucaccgccaccuccgccuacaagaagaccuccgagacccucucccaggccggccagaaggccuccgccgccuucuccuccgucggcuccgucaucaccaagaagcucgaggacgucaagaacucccccaccuucaaguccuucgaggagaaggucgagaaccucaaguccaaggucggcggcaccaagcccgccggcggcgacuucggcgagguccucaacuccgccgccaacgccuccgccaccaccaccgagccccuccccgagaagacccaggagucccucuga

SEQ ID NO: 51062 - RNA, 435 nt, Artificial Sequence
  derived and/or modified sequence opt2 from TPD52L1__Homo_sapiens__NP_001003396
auggaggcccaggcccagggccuccucgagaccgagccccuccagggcaccgacgaggacgccgucgccuccgccgacuucuccuccaugcucuccgaggaggagaaggaggagcucaaggccgagcucguccagcucgaggacgagaucaccacccuccgccagguccucuccgccaaggagcgccaccucgucgagaucaagcagaagcucggcaugaaccucaugaacgagcucaagcagaacuucuccaaguccuggcacgacaugcagaccaccaccgccuacaagaagacccacgagacccucucccacgccggccagaaggccaccgccgccuucuccaacgucggcaccgccaucuccaagaaguucggcgacauguccuacuccauccgccacuccaucuccaugcccgccaugcgccgcaaguga

SEQ ID NO: 51063 - RNA, 492 nt, Artificial Sequence
  derived and/or modified sequence opt2 from TPD52L2__Homo_sapiens__NP_001230821
auggacuccgccggccagggcgucgccgcccgcacccccgccgucgagggccucaccgaggccgaggaggaggagcuccgcgccgagcucaccaaggucgaggaggagaucgucacccuccgccagguccucgccgccaaggagcgccacugcggcgagcucaagcgccgccucggccucuccacccucggcgagcucaagcagaaccucucccgcuccuggcacgacguccaggucuccuccgccuacaagaagacccaggagacccucucccaggccggccagaagaccuccgccgcccucuccaccgucggcuccgccaucucccgcaagcucggcgacaugcgcaacuccgccaccuucaaguccuucgaggaccgcgucggcaccaucaaguccaaggucgucggcgaccgcgagaacggcuccgacaaccuccccuccuccgccggcuccggcgacaagccccucuccgaccccgcccccuucuga

SEQ ID NO: 51064 - RNA, 774 nt, Artificial Sequence
  derived and/or modified sequence opt2 from TPGS2__Homo_sapiens__NP_001258879
auggaggaggaggccuccucccccggccucggcugcuccaagccccaccucgagaagcucacccucggcaucacccgcauccucgaguccucccccggcgucaccgaggucaccaucaucgagaagccccccgccgagcgccacaugaucuccuccugggagcagaagaacaacugcgucaugcccgaggacgucaagaacuucuaccucaugaccaacggcuuccacaugaccugguccgucaagcucgacgccuccgacgaccagcccgagaagccccacuucgacucccgcuccgucaucuucgagcucgacuccugcaacggcuccggcaaggucugccucgucuacaaguccggcaagcccgcccucgccgaggacaccgagaucugguuccucgaccgcgcccucuacuggcacuuccucaccgacaccuucaccgccuacuaccgccuccucaucacccaccucggccucccccaguggcaguacgccuucaccuccuacggcaucuccccccaggccaagcagugguucuccauguacaagcccaucaccuacaacaccaaccuccucaccgaggagaccgacuccuucgucaacaagcucgaccccuccaaggucuucaaguccaagaacaagaucgucauccccaagaagaagggccccguccagcccgccggcggccagaagggccccuccggccccuccggccccuccaccuccuccaccuccaaguccuccuccggcuccggcaaccccacccgcaaguga

SEQ ID NO: 51065 - RNA, 1335 nt, Artificial Sequence
  derived and/or modified sequence opt2 from TPH1__Homo_sapiens__NP_004170
augaucgaggacaacaaggagaacaaggaccacucccucgagcgcggccgcgccucccucaucuucucccucaagaacgaggucggcggccucaucaaggcccucaagaucuuccaggagaagcacgucaaccuccuccacaucgagucccgcaaguccaagcgccgcaacuccgaguucgagaucuucgucgacugcgacaucaaccgcgagcagcucaacgacaucuuccaccuccucaagucccacaccaacguccucuccgucaaccuccccgacaacuucacccucaaggaggacggcauggagaccguccccugguuccccaagaagaucuccgaccucgaccacugcgccaaccgcguccucauguacggcuccgagcucgacgccgaccaccccggcuucaaggacaacgucuaccgcaagcgccgcaaguacuucgccgaccucgccaugaacuacaagcacggcgaccccauccccaaggucgaguucaccgaggaggagaucaagaccuggggcaccgucuuccaggagcucaacaagcucuaccccacccacgccugccgcgaguaccucaagaaccucccccuccucuccaaguacugcggcuaccgcgaggacaacaucccccagcucgaggacgucuccaacuuccucaaggagcgcaccggcuucuccauccgccccgucgccggcuaccucuccccccgcgacuuccucuccggccucgccuuccgcgucuuccacugcacccaguacguccgccacuccuccgaccccuucuacacccccgagcccgacaccugccacgagcuccucggccacgucccccuccucgccgagcccuccuucgcccaguucucccaggagaucggccucgccucccucggcgccuccgaggaggccguccagaagcucgccaccugcuacuucuucaccgucgaguucggccucugcaagcaggacggccagcuccgcgucuucggcgccggccuccucuccuccaucuccgagcucaagcacgcccucuccggccacgccaaggucaagcccuucgaccccaagaucaccugcaagcaggagugccucaucaccaccuuccaggacgucuacuucgucuccgaguccuucgaggacgccaaggagaagaugcgcgaguucaccaagaccaucaagcgccccuucggcgucaaguacaaccccuacacccgcuccauccagauccucaaggacaccaaguccaucaccuccgccaugaacgagcuccagcacgaccucgacgucgucuccgacgcccucgccaaggucucccgcaagcccuccaucuga

SEQ ID NO: 51066 - RNA, 1473 nt, Artificial Sequence
  derived and/or modified sequence opt2 from TPH2__Homo_sapiens__NP_775489
augcagcccgccaugaugauguucuccuccaaguacugggcccgccgcggcuucucccucgacuccgccguccccgaggagcaccagcuccucggcuccuccacccucaacaagcccaacuccggcaagaacgacgacaagggcaacaagggcuccuccaagcgcgaggccgccaccgaguccggcaagaccgccgucgucuucucccucaagaacgaggucggcggccucgucaaggcccuccgccucuuccaggagaagcgcgucaacaugguccacaucgagucccgcaagucccgccgccgcuccuccgaggucgagaucuucgucgacugcgagugcggcaagaccgaguucaacgagcucauccagcuccucaaguuccagaccaccaucgucacccucaacccccccgagaacaucuggaccgaggaggaggagcucgaggacguccccugguucccccgcaagaucuccgagcucgacaagugcucccaccgcguccucauguacggcuccgagcucgacgccgaccaccccggcuucaaggacaacgucuaccgccagcgccgcaaguacuucgucgacgucgccaugggcuacaaguacggccagcccaucccccgcgucgaguacaccgaggaggagaccaagaccuggggcgucgucuuccgcgagcucuccaagcucuaccccacccacgccugccgcgaguaccucaagaacuucccccuccucaccaaguacugcggcuaccgcgaggacaacgucccccagcucgaggacgucuccauguuccucaaggagcgcuccggcuucaccguccgccccgucgccggcuaccucuccccccgcgacuuccucgccggccucgccuaccgcgucuuccacugcacccaguacauccgccacggcuccgacccccucuacacccccgagcccgacaccugccacgagcuccucggccacgucccccuccucgccgaccccaaguucgcccaguucucccaggagaucggccucgccucccucggcgccuccgacgaggacguccagaagcucgccaccugcuacuucuucaccaucgaguucggccucugcaagcaggagggccagcuccgcgccuacggcgccggccuccucuccuccaucggcgagcucaagcacgcccucuccgacaaggccugcgucaaggccuucgaccccaagaccaccugccuccaggagugccucaucaccaccuuccaggaggccuacuucgucuccgaguccuucgaggaggccaaggagaagaugcgcgacuucgccaaguccaucacccgccccuucuccgucuacuucaaccccuacacccaguccaucgagauccucaaggacacccgcuccaucgagaacgucguccaggaccuccgcuccgaccucaacaccgucugcgacgcccucaacaagaugaaccaguaccucggcaucuga

SEQ ID NO: 51067 - RNA, 750 nt, Artificial Sequence
  derived and/or modified sequence opt2 from TPI1__Homo_sapiens__NP_000356
auggcccccucccgcaaguucuucgucggcggcaacuggaagaugaacggccgcaagcagucccucggcgagcucaucggcacccucaacgccgccaagguccccgccgacaccgaggucgucugcgccccccccaccgccuacaucgacuucgcccgccagaagcucgaccccaagaucgccgucgccgcccagaacugcuacaaggucaccaacggcgccuucaccggcgagaucucccccggcaugaucaaggacugcggcgccaccugggucguccucggccacuccgagcgccgccacgucuucggcgaguccgacgagcucaucggccagaaggucgcccacgcccucgccgagggccucggcgucaucgccugcaucggcgagaagcucgacgagcgcgaggccggcaucaccgagaaggucgucuucgagcagaccaaggucaucgccgacaacgucaaggacugguccaaggucguccucgccuacgagcccgucugggccaucggcaccggcaagaccgccaccccccagcaggcccaggagguccacgagaagcuccgcggcuggcucaaguccaacgucuccgacgccgucgcccaguccacccgcaucaucuacggcggcuccgucaccggcgccaccugcaaggagcucgccucccagcccgacgucgacggcuuccucgucggcggcgccucccucaagcccgaguucgucgacaucaucaacgccaagcaguga

SEQ ID NO: 51068 - RNA, 585 nt, Artificial Sequence
  derived and/or modified sequence opt2 from TPK1__Homo_sapiens__NP_001035947
auggagcacgccuucaccccccucgagccccuccucuccaccggcaaccucaaguacugccucgucauccucaaccagccccucgacaacuacuuccgccaccucuggaacaaggcccuccuccgcgccugcgccgacggcggcgccaaccgccucuacgacaucaccgagggcgagcgcgaguccuuccuccccgaguucaucaacggcgacuucgacuccauccgccccgagguccgcgaguacuacgccaccaagggcugcgagcucaucuccacccccgaccaggaccacaccgacuucaccaagugccucaagaugcuccagaagaagaucgaggagaaggaccucaagggcaagcaccgccuccacgucgacaccggcauggagggcgacuggugcggccucauccccgucggccagcccugcaugcaggucaccaccaccggccucaaguggaaccucaccaacgacguccucgccuucggcacccucgucuccaccuccaacaccuacgacggcuccggcgucgucaccgucgagaccgaccacccccuccucuggaccauggccaucaaguccuga

SEQ ID NO: 51069 - RNA, 855 nt, Artificial Sequence
  derived and/or modified sequence opt2 from TPM1__Homo_sapiens__NP_000357
auggacgccaucaagaagaagaugcagaugcucaagcucgacaaggagaacgcccucgaccgcgccgagcaggccgaggccgacaagaaggccgccgaggaccgcuccaagcagcucgaggacgagcucgucucccuccagaagaagcucaagggcaccgaggacgagcucgacaaguacuccgaggcccucaaggacgcccaggagaagcucgagcucgccgagaagaaggccaccgacgccgaggccgacgucgccucccucaaccgccgcauccagcucgucgaggaggagcucgaccgcgcccaggagcgccucgccaccgcccuccagaagcucgaggaggccgagaaggccgccgacgaguccgagcgcggcaugaaggucaucgagucccgcgcccagaaggacgaggagaagauggagauccaggagauccagcucaaggaggccaagcacaucgccgaggacgccgaccgcaaguacgaggaggucgcccgcaagcucgucaucaucgaguccgaccucgagcgcgccgaggagcgcgccgagcucuccgagggccagguccgccagcucgaggagcagcuccgcaucauggaccagacccucaaggcccucauggccgccgaggacaaguacucccagaaggaggaccgcuacgaggaggagaucaagguccucuccgacaagcucaaggaggccgagacccgcgccgaguucgccgagcgcuccgucaccaagcucgagaaguccaucgacgaccucgaggacgagcucuacgcccagaagcucaaguacaaggccaucuccgaggagcucgaccacgcccucaacgacaugaccuccauguga

SEQ ID NO: 51070 - RNA, 855 nt, Artificial Sequence
  derived and/or modified sequence opt2 from TPM2__Homo_sapiens__NP_001288155
auggacgccaucaagaagaagaugcagaugcucaagcucgacaaggagaacgccaucgaccgcgccgagcaggccgaggccgacaagaagcaggccgaggaccgcugcaagcagcucgaggaggagcagcaggcccuccagaagaagcucaagggcaccgaggacgaggucgagaaguacuccgaguccgucaaggaggcccaggagaagcucgagcaggccgagaagaaggccaccgacgccgaggccgacgucgccucccucaaccgccgcauccagcucgucgaggaggagcucgaccgcgcccaggagcgccucgccaccgcccuccagaagcucgaggaggccgagaaggccgccgacgaguccgagcgcggcaugaaggucaucgagaaccgcgccaugaaggacgaggagaagauggagcuccaggagaugcagcucaaggaggccaagcacaucgccgaggacuccgaccgcaaguacgaggaggucgcccgcaagcucgucauccucgagggcgagcucgagcgcuccgaggagcgcgccgaggucgccgaguccaagugcggcgaccucgaggaggagcucaagaucgucaccaacaaccucaagucccucgaggcccaggccgacaaguacuccaccaaggaggacaaguacgaggaggagaucaagcuccucgaggagaagcucaaggaggccgagacccgcgccgaguucgccgagcgcuccgucgccaagcucgagaagaccaucgacgaccucgaggagacccucgccuccgccaaggaggagaacgucgagauccaccagacccucgaccagacccuccucgagcucaacaaccucuga

SEQ ID NO: 51071 - RNA, 747 nt, Artificial Sequence
  derived and/or modified sequence opt2 from TPM3__Homo_sapiens__NP_001036816
auggccggcaucaccaccaucgaggccgucaagcgcaagauccagguccuccagcagcaggccgacgacgccgaggagcgcgccgagcgccuccagcgcgaggucgagggcgagcgccgcgcccgcgagcaggccgaggccgaggucgccucccucaaccgccgcauccagcucgucgaggaggagcucgaccgcgcccaggagcgccucgccaccgcccuccagaagcucgaggaggccgagaaggccgccgacgaguccgagcgcggcaugaaggucaucgagaaccgcgcccucaaggacgaggagaagauggagcuccaggagauccagcucaaggaggccaagcacaucgccgaggaggccgaccgcaaguacgaggaggucgcccgcaagcucgucaucaucgagggcgaccucgagcgcaccgaggagcgcgccgagcucgccgaguccaagugcuccgagcucgaggaggagcucaagaacgucaccaacaaccucaagucccucgaggcccaggccgagaaguacucccagaaggaggacaaguacgaggaggagaucaagauccucaccgacaagcucaaggaggccgagacccgcgccgaguucgccgagcgcuccgucgccaagcucgagaagaccaucgacgaccucgaggacaagcucaagugcaccaaggaggagcaccucugcacccagcgcaugcucgaccagacccuccucgaccucaacgagauguga

SEQ ID NO: 51072 - RNA, 855 nt, Artificial Sequence
  derived and/or modified sequence opt2 from TPM4__Homo_sapiens__NP_001138632
auggaggccaucaagaagaagaugcagaugcucaagcucgacaaggagaacgccaucgaccgcgccgagcaggccgaggccgacaagaaggccgccgaggacaagugcaagcaggucgaggaggagcucacccaccuccagaagaagcucaagggcaccgaggacgagcucgacaaguacuccgaggaccucaaggacgcccaggagaagcucgagcucaccgagaagaaggccuccgacgccgagggcgacgucgccgcccucaaccgccgcauccagcucgucgaggaggagcucgaccgcgcccaggagcgccucgccaccgcccuccagaagcucgaggaggccgagaaggccgccgacgaguccgagcgcggcaugaaggucaucgagaaccgcgccaugaaggacgaggagaagauggagauccaggagaugcagcucaaggaggccaagcacaucgccgaggaggccgaccgcaaguacgaggaggucgcccgcaagcucgucauccucgagggcgagcucgagcgcgccgaggagcgcgccgaggucuccgagcucaagugcggcgaccucgaggaggagcucaagaacgucaccaacaaccucaagucccucgaggccgccuccgagaaguacuccgagaaggaggacaaguacgaggaggagaucaagcuccucuccgacaagcucaaggaggccgagacccgcgccgaguucgccgagcgcaccgucgccaagcucgagaagaccaucgacgaccucgaggagaagcucgcccaggccaaggaggagaacgucggccuccaccagacccucgaccagacccucaacgagcucaacugcaucuga

SEQ ID NO: 51073 - RNA, 738 nt, Artificial Sequence
  derived and/or modified sequence opt2 from TPMT__Homo_sapiens__NP_000358
auggacggcacccgcaccucccucgacaucgaggaguacuccgacaccgagguccagaagaaccagguccucacccucgaggaguggcaggacaagugggucaacggcaagaccgccuuccaccaggagcagggccaccagcuccucaagaagcaccucgacaccuuccucaagggcaaguccggccuccgcgucuucuucccccucugcggcaaggccgucgagaugaagugguucgccgaccgcggccacuccgucgucggcgucgagaucuccgagcucggcauccaggaguucuucaccgagcagaaccucuccuacuccgaggagcccaucaccgagauccccggcaccaaggucuucaaguccuccuccggcaacaucucccucuacugcugcuccaucuucgaccucccccgcaccaacaucggcaaguucgacaugaucugggaccgcggcgcccucgucgccaucaaccccggcgaccgcaagugcuacgccgacaccauguucucccuccucggcaagaaguuccaguaccuccucugcguccucuccuacgaccccaccaagcaccccggcccccccuucuacgucccccacgccgagaucgagcgccucuucggcaagaucugcaacauccgcugccucgagaaggucgacgccuucgaggagcgccacaaguccuggggcaucgacugccucuucgagaagcucuaccuccucaccgagaaguga

SEQ ID NO: 51074 - RNA, 2802 nt, Artificial Sequence
  derived and/or modified sequence opt2 from TPO__Homo_sapiens__NP_001193673
augcgcgcccucgccguccucuccgucacccucgucauggccugcaccgaggccuucuuccccuucaucucccgcggcaaggagcuccucuggggcaagcccgaggagucccgcgucuccuccguccucgaggaguccaagcgccucgucgacaccgccauguacgccaccaugcagcgcaaccucaagaagcgcggcauccucucccccgcccagcuccucuccuucuccaagcuccccgagcccaccuccggcgucaucgcccgcgccgccgagaucauggagaccuccauccaggccaugaagcgcaaggucaaccucaagacccagcagucccagcaccccaccgacgcccucuccgaggaccuccucuccaucaucgccaacauguccggcugccuccccuacaugcucccccccaagugccccaacaccugccucgccaacaaguaccgccccaucaccggcgccugcaacaaccgcgaccacccccgcuggggcgccuccaacaccgcccucgcccgcuggcucccccccgucuacgaggacggcuucucccagccccgcggcuggaaccccggcuuccucuacaacggcuucccccucccccccguccgcgaggucacccgccacgucauccaggucuccaacgaggucgucaccgacgacgaccgcuacuccgaccuccucauggccuggggccaguacaucgaccacgacaucgccuucaccccccaguccaccuccaaggccgccuucggcggcggcgccgacugccagaugaccugcgagaaccagaaccccugcuuccccauccagcuccccgaggaggcccgccccgccgccggcaccgccugccuccccuucuaccgcuccuccgccgccugcggcaccggcgaccagggcgcccucuucggcaaccucuccaccgccaacccccgccagcagaugaacggccucaccuccuuccucgacgccuccaccgucuacggcuccucccccgcccucgagcgccagcuccgcaacuggaccuccgccgagggccuccuccgcguccacgcccgccuccgcgacuccggccgcgccuaccuccccuucguccccccccgcgcccccgccgccugcgcccccgagcccggcauccccggcgagacccgcggccccugcuuccucgccggcgacggccgcgccuccgagguccccucccucaccgcccuccacacccucuggcuccgcgagcacaaccgccucgccgccgcccucaaggcccucaacgcccacugguccgccgacgccgucuaccaggaggcccgcaaggucgucggcgcccuccaccagaucaucacccuccgcgacuacaucccccgcauccucggccccgaggccuuccagcaguacgucggccccuacgagggcuacgacuccaccgccaaccccaccgucuccaacgucuucuccaccgccgccuuccgcuucggccacgccaccauccacccccucguccgccgccucgacgccuccuuccaggagcaccccgaccuccccggccucuggcuccaccaggccuucuucucccccuggacccuccuccgcggcggcggccucgacccccucauccgcggccuccucgcccgccccgccaagcuccagguccaggaccagcucaugaacgaggagcucaccgagcgccucuucguccucuccaacuccuccacccucgaccucgccuccaucaaccuccagcgcggccgcgaccacggccuccccggcuacaacgaguggcgcgaguucugcggccucccccgccucgagacccccgccgaccucuccaccgccaucgccucccgcuccgucgccgacaagauccucgaccucuacaagcaccccgacaacaucgacgucuggcucggcggccucgccgagaacuuccucccccgcgcccgcaccggcccccucuucgccugccucaucggcaagcagaugaaggcccuccgcgacggcgacugguucuggugggagaacucccacgucuucaccgacgcccagcgccgcgagcucgagaagcacucccucucccgcgucaucugcgacaacaccggccucacccgcguccccauggacgccuuccaggucggcaaguuccccgaggacuucgaguccugcgacuccaucaccggcaugaaccucgaggccuggcgcgagaccuucccccaggacgacaagugcggcuuccccgaguccgucgagaacggcgacuucguccacugcgaggaguccggccgccgcguccucgucuacuccugccgccacggcuacgagcuccagggccgcgagcagcucaccugcacccaggagggcugggacuuccagcccccccucugcaaggacgucaacgagugcgccgacggcgcccacccccccugccacgccuccgcccgcugccgcaacaccaagggcggcuuccagugccucugcgccgaccccuacgagcucggcgacgacggccgcaccugcgucgacuccggccgccucccccgcgucaccuggaucuccaugucccucgccgcccuccucaucggcggcuucgccggccucaccuccaccgucaucugccgcuggacccgcaccggcaccaaguccacccuccccaucuccgagaccggcggcggcacccccgagcuccgcugcggcaagcaccaggccgucggcaccuccccccagcgcgccgccgcccaggacuccgagcaggaguccgccggcauggagggccgcgacacccaccgccucccccgcgcccucuga

SEQ ID NO: 51075 - RNA, 1692 nt, Artificial Sequence
  derived and/or modified sequence opt2 from TPP1__Homo_sapiens__NP_000382
augggccuccaggccugccuccucggccucuucgcccucauccucuccggcaagugcuccuacucccccgagcccgaccagcgccgcacccucccccccggcugggucucccucggccgcgccgaccccgaggaggagcucucccucaccuucgcccuccgccagcagaacgucgagcgccucuccgagcucguccaggccgucuccgaccccuccuccccccaguacggcaaguaccucacccucgagaacgucgccgaccucguccgccccuccccccucacccuccacaccguccagaaguggcuccucgccgccggcgcccagaagugccacuccgucaucacccaggacuuccucaccugcuggcucuccauccgccaggccgagcuccuccuccccggcgccgaguuccaccacuacgucggcggccccaccgagacccacgucguccgcuccccccaccccuaccagcucccccaggcccucgccccccacgucgacuucgucggcggccuccaccgcuucccccccaccuccucccuccgccagcgccccgagccccaggucaccggcaccgucggccuccaccucggcgucacccccuccgucauccgcaagcgcuacaaccucaccucccaggacgucggcuccggcaccuccaacaacucccaggccugcgcccaguuccucgagcaguacuuccacgacuccgaccucgcccaguucaugcgccucuucggcggcaacuucgcccaccaggccuccgucgcccgcgucgucggccagcagggccgcggccgcgccggcaucgaggccucccucgacguccaguaccucauguccgccggcgccaacaucuccaccugggucuacuccucccccggccgccacgagggccaggagcccuuccuccaguggcucaugcuccucuccaacgaguccgcccucccccacguccacaccgucuccuacggcgacgacgaggacucccucuccuccgccuacauccagcgcgucaacaccgagcucaugaaggccgccgcccgcggccucacccuccucuucgccuccggcgacuccggcgccggcugcugguccgucuccggccgccaccaguuccgccccaccuuccccgccuccucccccuacgucaccaccgucggcggcaccuccuuccaggagcccuuccucaucaccaacgagaucgucgacuacaucuccggcggcggcuucuccaacgucuucccccgccccuccuaccaggaggaggccgucaccaaguuccucuccuccuccccccaccucccccccuccuccuacuucaacgccuccggccgcgccuaccccgacgucgccgcccucuccgacggcuacugggucgucuccaaccgcguccccauccccugggucuccggcaccuccgccuccacccccgucuucggcggcauccucucccucaucaacgagcaccgcauccucuccggccgccccccccucggcuuccucaacccccgccucuaccagcagcacggcgccggccucuucgacgucacccgcggcugccacgaguccugccucgacgaggaggucgagggccagggcuucugcuccggccccggcugggaccccgucaccggcuggggcacccccaacuuccccgcccuccucaagacccuccucaaccccuga

SEQ ID NO: 51076 - RNA, 3750 nt, Artificial Sequence
  derived and/or modified sequence opt2 from TPP2__Homo_sapiens__NP_003282
auggccaccgccgccaccgaggagcccuuccccuuccacggccuccuccccaagaaggagaccggcgccgccuccuuccucugccgcuaccccgaguacgacggccgcggcguccucaucgccguccucgacaccggcgucgaccccggcgcccccggcaugcaggucaccaccgacggcaagcccaagaucgucgacaucaucgacaccaccggcuccggcgacgucaacaccgccaccgaggucgagcccaaggacggcgagaucgucggccucuccggccgcguccucaagauccccgccuccuggaccaaccccuccggcaaguaccacaucggcaucaagaacggcuacgacuucuaccccaaggcccucaaggagcgcauccagaaggagcgcaaggagaagaucugggaccccguccaccgcgucgcccucgccgaggccugccgcaagcaggaggaguucgacgucgccaacaacggcuccucccaggccaacaagcucaucaaggaggagcuccagucccaggucgagcuccucaacuccuucgagaagaaguacuccgaccccggccccgucuacgacugccucgucuggcacgacggcgaggucuggcgcgccugcaucgacuccaacgaggacggcgaccucuccaaguccaccguccuccgcaacuacaaggaggcccaggaguacggcuccuucggcaccgccgagaugcucaacuacuccgucaacaucuacgacgacggcaaccuccucuccaucgucaccuccggcggcgcccacggcacccacgucgccuccaucgccgccggccacuuccccgaggagcccgagcgcaacggcgucgcccccggcgcccagauccucuccaucaagaucggcgacacccgccucuccaccauggagaccggcaccggccucauccgcgccaugaucgaggucaucaaccacaagugcgaccucgucaacuacuccuacggcgaggccacccacuggcccaacuccggccgcaucugcgaggucaucaacgaggccgucuggaagcacaacaucaucuacgucuccuccgccggcaacaacggccccugccucuccaccgucggcugccccggcggcaccaccuccuccgucaucggcgucggcgccuacgucucccccgacaugauggucgccgaguacucccuccgcgagaagcuccccgccaaccaguacaccugguccucccgcggccccuccgccgacggcgcccucggcgucuccaucuccgcccccggcggcgccaucgccuccguccccaacuggacccuccgcggcacccagcucaugaacggcaccuccauguccucccccaacgccugcggcggcaucgcccucauccucuccggccucaaggccaacaacaucgacuacaccguccacuccguccgccgcgcccucgagaacaccgccgucaaggccgacaacaucgaggucuucgcccagggccacggcaucauccaggucgacaaggccuacgacuaccucguccagaacaccuccuucgccaacaagcucggcuucaccgucaccgucggcaacaaccgcggcaucuaccuccgcgaccccguccaggucgccgcccccuccgaccacggcgucggcaucgagcccgucuuccccgagaacaccgagaacuccgagaagaucucccuccagcuccaccucgcccucaccuccaacuccuccuggguccagugccccucccaccucgagcucaugaaccagugccgccacaucaacauccgcgucgacccccgcggccuccgcgagggccuccacuacaccgaggucugcggcuacgacaucgccucccccaacgccggcccccucuuccgcguccccaucaccgccgucaucgccgccaaggucaacgaguccucccacuacgaccucgccuucaccgacguccacuucaagcccggccagauccgccgccacuucaucgagguccccgagggcgccaccugggccgaggucaccgucugcuccugcuccuccgaggucuccgccaaguucguccuccacgccguccagcucgucaagcagcgcgccuaccgcucccacgaguucuacaaguucugcucccuccccgagaagggcacccucaccgaggccuuccccguccucggcggcaaggccaucgaguucugcaucgcccgcuggugggccucccucuccgacgucaacaucgacuacaccaucuccuuccacggcaucgucugcaccgccccccagcucaacauccacgccuccgagggcaucaaccgcuucgacguccaguccucccucaaguacgaggaccucgcccccugcaucacccucaagaacuggguccagacccuccgccccgucuccgccaagaccaagccccucggcucccgcgacguccuccccaacaaccgccagcucuacgagaugguccucaccuacaacuuccaccagcccaaguccggcgaggucacccccuccugcccccuccucugcgagcuccucuacgaguccgaguucgacucccagcucuggaucaucuucgaccagaacaagcgccagaugggcuccggcgacgccuacccccaccaguacucccucaagcucgagaagggcgacuacaccauccgccuccagauccgccacgagcagaucuccgaccucgagcgccucaaggaccuccccuucaucgucucccaccgccucuccaacacccucucccucgacauccacgagaaccacuccuucgcccuccucggcaagaagaaguccuccaaccucacccucccccccaaguacaaccagcccuucuucgucaccucccuccccgacgacaagauccccaagggcgccggccccggcugcuaccucgccggcucccucacccucuccaagaccgagcucggcaagaaggccgacgucauccccguccacuacuaccucauccccccccccaccaagaccaagaacggcuccaaggacaaggagaaggacuccgagaaggagaaggaccucaaggaggaguucaccgaggcccuccgcgaccucaagauccaguggaugaccaagcucgacuccuccgacaucuacaacgagcucaaggagaccuaccccaacuaccucccccucuacgucgcccgccuccaccagcucgacgccgagaaggagcgcaugaagcgccucaacgagaucgucgacgccgccaacgccgucaucucccacaucgaccagaccgcccucgccgucuacaucgccaugaagaccgacccccgccccgacgccgccaccaucaagaacgacauggacaagcagaaguccacccucgucgacgcccucugccgcaagggcugcgcccucgccgaccaccuccuccacacccaggcccaggacggcgccaucuccaccgacgccgagggcaaggaggaggagggcgaguccccccucgacucccucgccgagaccuucugggagaccaccaaguggaccgaccucuucgacaacaagguccucaccuucgccuacaagcacgcccucgucaacaagauguacggccgcggccucaaguucgccaccaagcucgucgaggagaagcccaccaaggagaacuggaagaacugcauccagcucaugaagcuccucggcuggacccacugcgccuccuucaccgagaacuggcuccccaucauguacccccccgacuacugcgucuucuga

SEQ ID NO: 51077 - RNA, 513 nt, Artificial Sequence
  derived and/or modified sequence opt2 from TPPP2__Homo_sapiens__XP_005267381
auggccuccgaggccgagaagaccuuccaccgcuucgccgccuucggcgaguccuccuccuccggcaccgagaugaacaacaagaacuucuccaagcucugcaaggacugcggcaucauggacggcaagaccgucaccuccaccgacgucgacaucgucuucuccaaggucaaggccaagaacgcccgcaccaucaccuuccagcaguucaaggaggccgucaaggagcucggccagaagcgcuucaagggcaagucccccgacgagguccucgagaacaucuacggccucauggagggcaaggaccccgccaccaccggcgccaccaaggccaccaccgucggcgccgucgaccgccucaccgacaccuccaaguacaccggcacccacaaggagcgcuucgacgaguccggcaagggcaagggcaucgccggccgcgaggagaugaccgacaacaccggcuacgucuccggcuacaagggcuccggcaccuacgacaagaagaccaaguga

SEQ ID NO: 51078 - RNA, 531 nt, Artificial Sequence
  derived and/or modified sequence opt2 from TPPP3__Homo_sapiens__NP_057224
auggccgccuccaccgacauggccggccucgaggaguccuuccgcaaguucgccauccacggcgaccccaaggccuccggccaggagaugaacggcaagaacugggccaagcucugcaaggacugcaaggucgccgacggcaaguccgucaccggcaccgacgucgacaucgucuucuccaaggucaagggcaaguccgcccgcgucaucaacuacgaggaguucaagaaggcccucgaggagcucgccaccaagcgcuucaagggcaaguccaaggaggaggccuucgacgccaucugccagcucgucgccggcaaggagcccgccaacgucggcgucaccaaggccaagaccggcggcgccgucgaccgccucaccgacaccucccgcuacaccggcucccacaaggagcgcuucgacgaguccggcaagggcaagggcaucgccggccgccaggacauccucgacgacuccggcuacgucuccgccuacaagaacgccggcaccuacgacgccaaggucaagaaguga

SEQ ID NO: 51079 - RNA, 660 nt, Artificial Sequence
  derived and/or modified sequence opt2 from TPPP__Homo_sapiens__NP_008961
auggccgacaaggccaagcccgccaaggccgccaaccgcaccccccccaagucccccggcgaccccuccaaggaccgcgccgccaagcgccucucccucgaguccgagggcgccggcgagggcgccgccgccucccccgagcucuccgcccucgaggaggccuuccgccgcuucgccguccacggcgacgcccgcgccaccggccgcgagaugcacggcaagaacugguccaagcucugcaaggacugccaggucaucgacggccgcaacgucaccgucaccgacgucgacaucgucuucuccaagaucaagggcaaguccugccgcaccaucaccuucgagcaguuccaggaggcccucgaggagcucgccaagaagcgcuucaaggacaaguccuccgaggaggccguccgcgagguccaccgccucaucgagggcaaggcccccaucaucuccggcgucaccaaggccaucuccucccccaccgucucccgccucaccgacaccaccaaguucaccggcucccacaaggagcgcuucgaccccuccggcaagggcaagggcaaggccggccgcgucgaccucgucgacgaguccggcuacgucuccggcuacaagcacgccggcaccuacgaccagaagguccagggcggcaaguga

SEQ ID NO: 51080 - RNA, 828 nt, Artificial Sequence
  derived and/or modified sequence opt2 from TPRG1__Homo_sapiens__NP_940887
auguccaccaucggcuccuucgagggcuuccaggccgucucccucaagcaggagggcgacgaccagcccuccgagaccgaccaccucuccauggaggaggaggaccccaugccccgccagaucucccgccaguccuccgucaccgaguccacccucuaccccaaccccuaccaccagcccuacaucucccgcaaguacuucgccacccgccccggcgccaucgagaccgccauggaggaccucaagggccacgucgccgagaccuccggcgagaccauccagggcuucuggcuccucaccaagaucgaccacuggaacaacgagaaggagcgcauccuccucgucaccgacaagacccuccucaucugcaaguacgacuucaucaugcucuccugcguccagcuccagcgcaucccccucuccgccgucuaccgcaucugccucggcaaguucaccuuccccggcaugucccucgacaagcgccagggcgagggccuccgcaucuacuggggcucccccgaggagcagucccuccucucccgcuggaaccccugguccaccgagguccccuacgccaccuucaccgagcaccccaugaaguacaccuccgagaaguuccucgagaucugcaagcucuccggcuucauguccaagcucguccccgccauccagaacgcccacaagaacuccaccggcuccggccgcggcaagaagcucaugguccucaccgagcccauccucaucgagaccuacaccggccucauguccuucaucggcaaccgcaacaagcucggcuacucccucgcccgcggcuccaucggcuucuga

SEQ ID NO: 51081 - RNA, 7092 nt, Artificial Sequence
  derived and/or modified sequence opt2 from TPR__Homo_sapiens__NP_003283
auggccgccguccuccagcagguccucgagcgcaccgagcucaacaagcuccccaaguccguccagaacaagcucgagaaguuccucgccgaccagcaguccgagaucgacggccucaagggccgccacgagaaguucaaggucgaguccgagcagcaguacuucgagaucgagaagcgccucucccacucccaggagcgccucgucaacgagacccgcgagugccagucccuccgccucgagcucgagaagcucaacaaccagcucaaggcccucaccgagaagaacaaggagcucgagaucgcccaggaccgcaacaucgccauccagucccaguucacccgcaccaaggaggagcucgaggccgagaagcgcgaccucauccgcaccaacgagcgccucucccaggagcucgaguaccucaccgaggacgucaagcgccucaacgagaagcucaaggaguccaacaccaccaagggcgagcuccagcucaagcucgacgagcuccaggccuccgacgucuccgucaaguaccgcgagaagcgccucgagcaggagaaggagcuccuccacucccagaacaccuggcucaacaccgagcucaagaccaagaccgacgagcuccucgcccucggccgcgagaagggcaacgagauccucgagcucaagugcaaccucgagaacaagaaggaggaggucucccgccucgaggagcagaugaacggccucaagaccuccaacgagcaccuccagaagcacgucgaggaccuccucaccaagcucaaggaggccaaggagcagcaggccuccauggaggagaaguuccacaacgagcucaacgcccacaucaagcucuccaaccucuacaaguccgccgccgacgacuccgaggccaaguccaacgagcucacccgcgccgucgaggagcuccacaagcuccucaaggaggccggcgaggccaacaaggccauccaggaccaccuccucgaggucgagcaguccaaggaccagauggagaaggagaugcucgagaagaucggccgccucgagaaggagcucgagaacgccaacgaccuccucuccgccaccaagcgcaagggcgccauccucuccgaggaggagcucgccgccaugucccccaccgccgccgccgucgccaagaucgucaagcccggcaugaagcucaccgagcucuacaacgccuacgucgagacccaggaccagcuccuccucgagaagcucgagaacaagcgcaucaacaaguaccucgacgagaucgucaaggaggucgaggccaaggcccccauccucaagcgccagcgcgaggaguacgagcgcgcccagaaggccgucgccucccucuccgucaagcucgagcaggccaugaaggagauccagcgccuccaggaggacaccgacaaggccaacaagcaguccuccguccucgagcgcgacaaccgccgcauggagauccaggucaaggaccucucccagcagauccgcguccuccucauggagcucgaggaggcccgcggcaaccacgucauccgcgacgaggaggucuccuccgccgacaucuccuccuccuccgaggucaucucccagcaccucgucuccuaccgcaacaucgaggagcuccagcagcagaaccagcgccuccucgucgcccuccgcgagcucggcgagacccgcgagcgcgaggagcaggagaccaccuccuccaagaucaccgagcuccagcucaagcucgaguccgcccucaccgagcucgagcagcuccgcaagucccgccagcaccagaugcagcucgucgacuccaucguccgccagcgcgacauguaccgcauccuccucucccagaccaccggcgucgccaucccccuccacgccuccucccucgacgacgucucccucgccuccacccccaagcgccccuccaccucccagaccgucuccacccccgcccccguccccgucaucgaguccaccgaggccaucgaggccaaggccgcccucaagcagcuccaggagaucuucgagaacuacaagaaggagaaggccgagaacgagaagauccagaacgagcagcucgagaagcuccaggagcaggucaccgaccuccgcucccagaacaccaagaucuccacccagcucgacuucgccuccaagcgcuacgagaugcuccaggacaacgucgagggcuaccgccgcgagaucaccucccuccacgagcgcaaccagaagcucaccgccaccacccagaagcaggagcagaucaucaacaccaugacccaggaccuccgcggcgccaacgagaagcucgccgucgccgagguccgcgccgagaaccucaagaaggagaaggagaugcucaagcucuccgagguccgccucucccagcagcgcgagucccuccucgccgagcagcgcggccagaaccuccuccucaccaaccuccagaccauccagggcauccucgagcgcuccgagaccgagaccaagcagcgccucuccucccagaucgagaagcucgagcacgagaucucccaccucaagaagaagcucgagaacgaggucgagcagcgccacacccucacccgcaaccucgacguccagcuccucgacaccaagcgccagcucgacaccgagaccaaccuccaccucaacaccaaggagcuccucaagaacgcccagaaggagaucgccacccucaagcagcaccucuccaacauggagguccaggucgccucccaguccucccagcgcaccggcaagggccagcccuccaacaaggaggacgucgacgaccucgucucccagcuccgccagaccgaggagcaggucaacgaccucaaggagcgccucaagaccuccaccuccaacgucgagcaguaccaggccauggucaccucccucgaggagucccucaacaaggagaagcaggucaccgaggagguccgcaagaacaucgagguccgccucaaggaguccgccgaguuccagacccagcucgagaagaagcucauggaggucgagaaggagaagcaggagcuccaggacgacaagcgccgcgccaucgaguccauggagcagcagcucuccgagcucaagaagacccucuccuccguccagaacgagguccaggaggcccuccagcgcgccuccaccgcccucuccaacgagcagcaggcccgccgcgacugccaggagcaggccaagaucgccgucgaggcccagaacaaguacgagcgcgagcucaugcuccacgccgccgacgucgaggcccuccaggccgccaaggagcaggucuccaagauggccuccguccgccagcaccucgaggagaccacccagaaggccgagucccagcuccucgagugcaaggccuccugggaggagcgcgagcgcaugcucaaggacgaggucuccaagugcgucugccgcugcgaggaccucgagaagcagaaccgccuccuccacgaccagaucgagaagcucuccgacaaggucgucgccuccgucaaggagggcguccagggcccccucaacgucucccucuccgaggagggcaagucccaggagcagauccucgagauccuccgcuucauccgccgcgagaaggagaucgccgagacccgcuucgaggucgcccaggucgagucccuccgcuaccgccagcgcgucgagcuccucgagcgcgagcuccaggagcuccaggacucccucaacgccgagcgcgagaagguccaggucaccgccaagaccauggcccagcacgaggagcucaugaagaagaccgagaccaugaacgucgucauggagaccaacaagaugcuccgcgaggagaaggagcgccucgagcaggaccuccagcagaugcaggccaagguccgcaagcucgagcucgacauccucccccuccaggaggccaacgccgagcucuccgagaaguccggcaugcuccaggccgagaagaagcuccucgaggaggacgucaagcgcuggaaggcccgcaaccagcaccucgucucccagcagaaggaccccgacaccgaggaguaccgcaagcuccucuccgagaaggagguccacaccaagcgcauccagcagcucaccgaggagaucggccgccucaaggccgagaucgcccgcuccaacgccucccucaccaacaaccagaaccucauccagucccucaaggaggaccucaacaagguccgcaccgagaaggagaccauccagaaggaccucgacgccaagaucaucgacauccaggagaaggucaagaccaucacccaggucaagaagaucggccgccgcuacaagacccaguacgaggagcucaaggcccagcaggacaaggucauggagaccuccgcccaguccuccggcgaccaccaggagcagcacgucuccguccaggagaugcaggagcucaaggagacccucaaccaggccgagaccaaguccaagucccucgagucccaggucgagaaccuccagaagacccucuccgagaaggagaccgaggcccgcaaccuccaggagcagaccguccagcuccaguccgagcucucccgccuccgccaggaccuccaggaccgcaccacccaggaggagcagcuccgccagcagaucaccgagaaggaggagaagacccgcaaggccaucgucgccgccaaguccaagaucgcccaccucgccggcgucaaggaccagcucaccaaggagaacgaggagcucaagcagcgcaacggcgcccucgaccagcagaaggacgagcucgacguccgcaucaccgcccucaagucccaguacgagggccgcaucucccgccucgagcgcgagcuccgcgagcaccaggagcgccaccucgagcagcgcgacgagccccaggagcccuccaacaagguccccgagcagcagcgccagaucacccucaagaccacccccgccuccggcgagcgcggcaucgccuccaccuccgacccccccaccgccaacaucaagcccacccccgucgucuccacccccuccaaggucaccgccgccgccauggccggcaacaaguccaccccccgcgccuccauccgccccauggucacccccgccaccgucaccaaccccaccaccacccccaccgccaccgucaugcccaccacccaggucgagucccaggaggccaugcaguccgagggccccgucgagcacguccccgucuucggcuccaccuccggcuccguccgcuccaccucccccaacguccagcccuccaucucccagcccauccucaccguccagcagcagacccaggccaccgccuucguccagcccacccagcagucccacccccagaucgagcccgccaaccaggagcucuccuccaacaucgucgaggucguccaguccucccccgucgagcgccccuccaccuccaccgccgucuucggcaccgucuccgccacccccuccuccucccuccccaagcgcacccgcgaggaggaggaggacuccaccaucgaggccuccgaccaggucuccgacgacaccgucgagaugccccuccccaagaagcucaaguccgucacccccgucggcaccgaggaggaggucauggccgaggaguccaccgacggcgaggucgagacccaggucuacaaccaggacucccaggacuccaucggcgagggcgucacccagggcgacuacacccccauggaggacuccgaggagaccucccagucccuccagaucgaccucggcccccuccaguccgaccagcagaccaccaccuccucccaggacggccagggcaagggcgacgacgucaucgucaucgacuccgacgacgaggaggaggacgacgacgagaacgacggcgagcacgaggacuacgaggaggacgaggaggacgacgacgacgacgaggacgacaccggcaugggcgacgagggcgaggacuccaacgagggcaccggcuccgccgacggcaacgacggcuacgaggccgacgacgccgagggcggcgacggcaccgaccccggcaccgagaccgaggaguccaugggcggcggcgagggcaaccaccgcgccgccgacucccagaacuccggcgagggcaacaccggcgccgccgaguccuccuucucccaggaggucucccgcgagcagcagcccuccuccgccuccgagcgccaggccccccgcgccccccaguccccccgccgccccccccacccccuccccccccgccucaccauccacgcccccccccaggagcucggcccccccguccagcgcauccagaugacccgccgccaguccgucggccgcggccuccagcucacccccggcaucggcggcaugcagcagcacuucuucgacgacgaggaccgcaccguccccuccacccccacccucgucgucccccaccgcaccgacggcuucgccgaggccauccacuccccccaggucgccggcgucccccgcuuccgcuucggcccccccgaggacaugccccagaccuccuccucccacuccgaccucggccagcucgccucccagggcggccucggcauguacgagaccccccucuuccucgcccacgaggaggaguccggcggccgcuccguccccaccaccccccuccaggucgccgcccccgucaccgucuucaccgaguccaccaccuccgacgccuccgagcacgccucccaguccguccccauggucaccaccuccaccggcacccucuccaccaccaacgagaccgccaccggcgacgacggcgacgaggucuucgucgaggccgaguccgagggcaucuccuccgaggccggccucgagaucgacucccagcaggaggaggagcccguccaggccuccgacgaguccgaccuccccuccaccucccaggacccccccuccuccuccuccgucgacaccuccuccucccagcccaagcccuuccgccgcguccgccuccagaccacccuccgccagggcguccgcggccgccaguucaaccgccagcgcggcgucucccacgccaugggcggccgcggcggcaucaaccgcggcaacaucaacuga

SEQ ID NO: 51082 - RNA, 2136 nt, Artificial Sequence
  derived and/or modified sequence opt2 from TPRN__Homo_sapiens__NP_001121700
auggccgcccucggccgccccggcuccggcccccgcgccgccguccccgccuggaagcgcgagauccucgagcgcaagcgcgccaagcucgccgcccucggcggcggcgccggccccggcgccgccgagcccgagcagcgcguccucgccgagucccucggcccccuccgcgagaaccccuucaugcuccucgaggccgagcgccgccgcggcggcggcgccgccggcgcccgccuccucgagcgcuaccgccgcguccccggcguccgcgcccuccgcgccgacuccguccucaucaucgagaccguccccggcuucccccccgccccccccgcccccggcgccgcccagauccgcgccgccgagguccucgucuacggcgccccccccggccgcgucucccgccuccucgagcgcuucgacccccccgccgccccccgccgccgcggcucccccgagcgcgcccgcccccccccccccccccccccccccgcccccccccgccccccccccgccgcccccuccccccccgccgcccccggcccccgcggcggcggcgccucccccggcgcccgccgcuccgacuuccuccagaagaccggcuccaacuccuucaccguccacccccgcggccuccaccgcggcgccggcgcccgccuccucuccaacggccacuccgcccccgagccccgcgccggccccgccaaccgccucgccggcuccccccccggcuccggccaguggaagcccaaggucgaguccggcgaccccucccuccaccccccccccucccccggcacccccuccgccacccccgccuccccccccgccuccgccacccccucccagcgccagugcgucuccgccgccaccuccaccaacgacuccuucgagauccgccccgcccccaagcccgucauggagaccaucccccucggcgaccuccaggcccgcgcccucgccucccuccgcgccaacucccgcaacuccuucauggucauccccaaguccaaggccuccggcgcccccccccccgagggccgccaguccgucgagcuccccaagggcgaccucggccccgccucccccucccaggagcucggcucccagcccguccccggcggcgacggcgcccccgcccucggcaaguccccccucgaggucgaggcccagugggccgucgaggagggcgccugcccccgcaccgccaccgcccucgccgaccgcgccauccgcuggcagcgccccuccucccccccccccuuccuccccgccgccuccgaggaggccgagcccgccgagggccuccgcguccccggccucgccaagaacucccgcgaguacguccgccccggccuccccgucaccuucaucgacgaggucgacuccgaggaggccccccaggccgccaagcuccccuaccucccccaccccgcccgcccccuccaccccgcccgccccggcugcgucgccgagcuccagccccgcggcuccaacaccuucaccgucguccccaagcgcaagcccggcacccuccaggaccagcacuucucccaggccaaccgcgagccccgcccccgcgaggccgaggaggaggaggccuccugccuccucggccccacccucaagaagcgcuaccccaccguccacgagaucgaggucaucggcggcuaccucgcccuccagaaguccugccucaccaaggccggcuccucccgcaagaagaugaagaucuccuucaacgacaagucccuccagaccaccuucgaguaccccuccgaguccucccucgagcaggaggaggaggucgaccagcaggaggaggaggaggaggaggaggaggaggaggaggaggaggaggagggcuccggcuccgaggagaagcccuucgcccucuuccucccccgcgccaccuucgucuccuccguccgccccgaguccucccgccuccccgagggcuccuccggccucuccuccuacacccccaagcacuccgucgccuucuccaaguggcaggagcaggcccucgagcaggccccccgcgaggccgagcccccccccgucgaggccaugcucacccccgccucccagaacgaccucuccgacuuccgcuccgagcccgcccucuacuucuga

SEQ ID NO: 51083 - RNA, 828 nt, Artificial Sequence
  derived and/or modified sequence opt2 from TPSAB1__Homo_sapiens__NP_003285
augcucaaccuccuccuccucgcccuccccguccucgccucccgcgccuacgccgcccccgcccccggccaggcccuccagcgcgucggcaucgucggcggccaggaggccccccgcuccaaguggcccuggcaggucucccuccgcguccacggccccuacuggaugcacuucugcggcggcucccucauccacccccaguggguccucaccgccgcccacugcgucggccccgacgucaaggaccucgccgcccuccgcguccagcuccgcgagcagcaccucuacuaccaggaccagcuccuccccgucucccgcaucaucguccacccccaguucuacaccgcccagaucggcgccgacaucgcccuccucgagcucgaggagcccgucaacgucuccucccacguccacaccgucacccucccccccgccuccgagaccuucccccccggcaugcccugcugggucaccggcuggggcgacgucgacaacgacgagcgccuccccccccccuucccccucaagcaggucaagguccccaucauggagaaccacaucugcgacgccaaguaccaccucggcgccuacaccggcgacgacguccgcaucguccgcgacgacaugcucugcgccggcaacacccgccgcgacuccugccagggcgacuccggcggcccccucgucugcaaggucaacggcaccuggcuccaggccggcgucgucuccuggggcgagggcugcgcccagcccaaccgccccggcaucuacacccgcgucaccuacuaccucgacuggauccaccacuacguccccaagaagcccuga

SEQ ID NO: 51084 - RNA, 828 nt, Artificial Sequence
  derived and/or modified sequence opt2 from TPSB2__Homo_sapiens__NP_077078
augcucaaccuccuccuccucgcccuccccguccucgccucccgcgccuacgccgcccccgcccccggccaggcccuccagcgcgucggcaucgucggcggccaggaggccccccgcuccaaguggcccuggcaggucucccuccgcguccgcgaccgcuacuggaugcacuucugcggcggcucccucauccacccccaguggguccucaccgccgcccacugcgucggccccgacgucaaggaccucgccgcccuccgcguccagcuccgcgagcagcaccucuacuaccaggaccagcuccuccccgucucccgcaucaucguccacccccaguucuacaccgcccagaucggcgccgacaucgcccuccucgagcucgaggagcccgucaacgucuccucccacguccacaccgucacccucccccccgccuccgagaccuucccccccggcaugcccugcugggucaccggcuggggcgacgucgacaacgacgagcgccuccccccccccuucccccucaagcaggucaagguccccaucauggagaaccacaucugcgacgccaaguaccaccucggcgccuacaccggcgacgacguccgcaucguccgcgacgacaugcucugcgccggcaacacccgccgcgacuccugccagggcgacuccggcggcccccucgucugcaaggucaacggcaccuggcuccaggccggcgucgucuccuggggcgagggcugcgcccagcccaaccgccccggcaucuacacccgcgucaccuacuaccucgacuggauccaccacuacguccccaagaagcccuga

SEQ ID NO: 51085 - RNA, 729 nt, Artificial Sequence
  derived and/or modified sequence opt2 from TPSD1__Homo_sapiens__NP_036349
augcuccuccucgccccccagaugcucucccuccuccuccucgcccuccccguccucgccucccccgccuacgucgcccccgcccccggccaggcccuccagcagaccggcaucgucggcggccaggaggccccccgcuccaaguggcccuggcaggucucccuccgcguccgcggccccuacuggaugcacuucugcggcggcucccucauccacccccaguggguccucaccgccgcccacugcgucgagcccgacaucaaggaccucgccgcccuccgcguccagcuccgcgagcagcaccucuacuaccaggaccagcuccuccccgucucccgcaucaucguccacccccaguucuacaucauccagaccggcgccgacaucgcccuccucgagcucgaggagcccgucaacaucuccucccacauccacaccgucacccucccccccgccuccgagaccuucccccccggcaugcccugcugggucaccggcuggggcgacgucgacaacaacguccaccuccccccccccuacccccucaaggaggucgagguccccgucgucgagaaccaccucugcaacgccgaguaccacaccggccuccacaccggccacuccuuccagaucguccgcgacgacaugcucugcgccggcuccgagaaccacgacuccugccagggcgacuccggcggcccccucgucugcaaggucaacggcaccuga

SEQ ID NO: 51086 - RNA, 966 nt, Artificial Sequence
  derived and/or modified sequence opt2 from TPSG1__Homo_sapiens__NP_036599
auggcccucggcgccugcggccuccuccuccuccucgccguccccggcgucucccuccgcacccuccagcccggcugcggccgcccccaggucuccgacgccggcggccgcaucgucggcggccacgccgcccccgccggcgccuggcccuggcaggccucccuccgccuccgccgcguccacgucugcggcggcucccuccucuccccccaguggguccucaccgccgcccacugcuucuccggcucccucaacuccuccgacuaccagguccaccucggcgagcucgagaucacccucuccccccacuucuccaccguccgccagaucauccuccacuccucccccuccggccagcccggcaccuccggcgacaucgcccucgucgagcucuccguccccgucacccucuccucccgcauccuccccgucugccuccccgaggccuccgacgacuucugccccggcauccgcugcugggucaccggcuggggcuacacccgcgagggcgagccccuccccccccccuacucccuccgcgaggucaaggucuccgucgucgacaccgagaccugccgccgcgacuaccccggccccggcggcuccauccuccagcccgacaugcucugcgcccgcggccccggcgacgccugccaggacgacuccggcggcccccucgucugccaggucaacggcgccuggguccaggccggcaucgucuccuggggcgagggcugcggccgccccaaccgccccggcgucuacacccgcguccccgccuacgucaacuggauccgccgccacaucaccgccuccggcggcuccgaguccggcuacccccgccucccccuccucgccggcuucuuccuccccggccucuuccuccuccucgucuccugcguccuccucgccaagugccuccuccaccccuccgccgacggcacccccuuccccgcccccgacuga

SEQ ID NO: 51087 - RNA, 417 nt, Artificial Sequence
  derived and/or modified sequence opt2 from TPT1__Homo_sapiens__NP_001273202
auggucucccgcaccgagggcaacaucgacgacucccucaucggcggcaacgccuccgccgagggccccgagggcgagggcaccgaguccaccgucaucaccggcgucgacaucgucaugaaccaccaccuccaggagaccuccuucaccaaggaggccuacaagaaguacaucaaggacuacaugaaguccaucaagggcaagcucgaggagcagcgccccgagcgcgucaagcccuucaugaccggcgccgccgagcagaucaagcacauccucgccaacuucaagaacuaccaguucuucaucggcgagaacaugaaccccgacggcauggucgcccuccucgacuaccgcgaggacggcgucacccccuacaugaucuucuucaaggacggccucgagauggagaagugcuga

SEQ ID NO: 51088 - RNA, 1236 nt, Artificial Sequence
  derived and/or modified sequence opt2 from TPTE2__Homo_sapiens__NP_001135440
augaacgaguccccccagaccaacgaguucaagggcaccaccgaggaggcccccgccaaggaguccccccacaccuccgaguucaagggcgccgcccucgucucccccaucuccaaguccaugcucgagcgccucuccaaguucgaggucgaggacgccgagaacgucgccuccuacgaguggacccaccucguccgccuccuccgccucaucauccucauccgcaucuuccaccuccuccaccagaagcgccagcucgagaagcucaugcgccgccucgucuccgagaacaagcgccgcuacacccgcgacggcuucgaccucgaccucaccuacgucaccgagcgcaucaucgccauguccuuccccuccuccggccgccaguccuucuaccgcaaccccaucgaggaggucguccgcuuccucgacaagaagcaccgcaaccacuaccgcgucuacaaccucugcuccgagcgcgccuacgaccccaagcacuuccacaaccgcgucucccgcaucaugaucgacgaccacaacguccccacccuccacgagauggucgucuucaccaaggaggucaacgaguggauggcccaggaccucgagaacaucgucgccauccacugcaagggcggcaagggccgcaccggcaccauggucugcgcccuccucaucgccuccgagaucuuccucaccgccgaggagucccucuacuacuucggcgagcgccgcaccaacaagacccacuccaacaaguuccagggcgucgagacccccucccagaaccgcuacgucggcuacuucgcccaggucaagcaccucuacaacuggaaccuccccccccgccgcauccucuucaucaagcgcuucaucaucuacuccauccgcggcgacgucugcgaccucaagguccaggucgucauggagaagaaggucgucuucuccuccaccucccucggcaacugcuccauccuccacgacaucgagaccgacaagauccucaucaacgucuacgacggccccccccucuacgacgacgucaagguccaguucuucuccuccaaccuccccaaguacuacgacaacugccccuucuucuucugguucaacaccuccuucauccagaacaaccgccucugccucccccgcaacgagcucgacaacccccacaagcagaaggccuggaagaucuacccccccgaguucgccgucgagauccucuucggcgagaaguga

SEQ ID NO: 51089 - RNA, 1602 nt, Artificial Sequence
  derived and/or modified sequence opt2 from TPTE__Homo_sapiens__NP_954868
augaacgagucccccgaccccaccgaccucgccggcgucaucaucgagcucggccccaacgacuccccccagaccuccgaguucaagggcgccaccgaggaggcccccgccaaggaguccguccucgcccgccucuccaaguucgaggucgaggacgccgagaacgucgccuccuacgacuccaagaucaagaagaucguccacuccaucgucuccuccuucgccuucggccucuucggcgucuuccucguccuccucgacgucacccucauccucgccgaccucaucuucaccgacuccaagcucuacaucccccucgaguaccgcuccaucucccucgccaucgcccucuucuuccucauggacguccuccuccgcgucuucgucgagcgccgccagcaguacuucuccgaccucuucaacauccucgacaccgccaucaucgucauccuccuccucgucgacgucgucuacaucuucuucgacaucaagcuccuccgcaacaucccccgcuggacccaccuccuccgccuccuccgccucaucauccuccuccgcaucuuccaccucuuccaccagaagcgccagcucgagaagcucauccgccgccgcgucuccgagaacaagcgccgcuacacccgcgacggcuucgaccucgaccucaccuacgucaccgagcgcaucaucgccauguccuuccccuccuccggccgccaguccuucuaccgcaaccccaucaaggaggucguccgcuuccucgacaagaagcaccgcaaccacuaccgcgucuacaaccucugcuccgagcgcgccuacgaccccaagcacuuccacaaccgcgucguccgcaucaugaucgacgaccacaacguccccacccuccaccagauggucgucuucaccaaggaggucaacgaguggauggcccaggaccucgagaacaucgucgccauccacugcaagggcggcaccgaccgcaccggcaccauggucugcgccuuccucaucgccuccgagaucugcuccaccgccaaggagucccucuacuacuucggcgagcgccgcaccgacaagacccacuccgagaaguuccagggcgucgagacccccucccagaagcgcuacgucgccuacuucgcccaggucaagcaccucuacaacuggaaccuccccccccgccgcauccucuucaucaagcacuucaucaucuacuccaucccccgcuacguccgcgaccucaagauccagaucgagauggagaagaaggucgucuucuccaccaucucccucggcaagugcuccguccucgacaacaucaccaccgacaagauccucaucgacgucuucgacggccucccccucuacgacgacgucaagguccaguucuucuacuccaaccuccccaccuacuacgacaacugcuccuucuacuucuggcuccacaccuccuucaucgagaacaaccgccucuaccuccccaagaacgagcucgacaaccuccacaagcagaaggcccgccgcaucuaccccuccgacuucgccgucgagauccucuucggcgagaagaugaccuccuccgacgucgucgccggcuccgacuga

SEQ ID NO: 51090 - RNA, 2244 nt, Artificial Sequence
  derived and/or modified sequence opt2 from TPX2__Homo_sapiens__XP_011527001
augucccaggucaaguccuccuacuccuacgacgcccccuccgacuucaucaacuucuccucccucgacgacgagggcgacacccagaacaucgacuccugguucgaggagaaggccaaccucgagaacaagcuccucggcaagaacggcaccggcggccucuuccagggcaagaccccccuccgcaaggccaaccuccagcaggccaucgucaccccccucaagcccgucgacaacaccuacuacaaggaggccgagaaggagaaccucgucgagcaguccauccccuccaacgccugcuccucccucgaggucgaggccgccaucucccgcaagacccccgcccagccccagcgccgcucccuccgccucuccgcccagaaggaccucgagcagaaggagaagcaccacgucaagaugaaggccaagcgcugcgccacccccgucaucaucgacgagauccuccccuccaagaagaugaaggucuccaacaacaagaagaagcccgaggaggagggcuccgcccaccaggacaccgccgagaagaacgccuccucccccgagaaggccaagggccgccacaccguccccugcaugccccccgccaagcagaaguuccucaaguccaccgaggagcaggagcucgagaaguccaugaagaugcagcaggaggucgucgagaugcgcaagaagaacgaggaguucaagaagcucgcccucgccggcaucggccagcccgucaagaaguccgucucccaggucaccaaguccgucgacuuccacuuccgcaccgacgagcgcaucaagcagcaccccaagaaccaggaggaguacaaggaggucaacuucaccuccgagcuccgcaagcaccccuccucccccgcccgcgucaccaagggcugcaccaucgucaagcccuucaaccucucccagggcaagaagcgcaccuucgacgagaccgucuccaccuacgucccccucgcccagcaggucgaggacuuccacaagcgcacccccaaccgcuaccaccuccgcuccaagaaggacgacaucaaccuccuccccuccaaguccuccgucaccaagaucugccgcgacccccagacccccguccuccagaccaagcaccgcgcccgcgccgucaccugcaaguccaccgccgagcucgaggccgaggagcucgagaagcuccagcaguacaaguucaaggcccgcgagcucgacccccgcauccucgagggcggccccauccuccccaagaagccccccgucaagccccccaccgagcccaucggcuucgaccucgagaucgagaagcgcauccaggagcgcgaguccaagaagaagaccgaggacgagcacuucgaguuccacucccgccccugccccaccaagauccucgaggacgucgucggcguccccgagaagaagguccuccccaucaccguccccaagucccccgccuucgcccucaagaaccgcauccgcaugcccaccaaggaggacgaggaggaggacgagcccgucgucaucaaggcccagcccgucccccacuacggcguccccuucaagccccagauccccgaggcccgcaccgucgagaucugccccuucuccuucgacucccgcgacaaggagcgccagcuccagaaggagaagaagaucaaggagcuccagaagggcgagguccccaaguucaaggcccucccccucccccacuucgacaccaucaaccuccccgagaagaaggucaagaacgucacccagaucgagcccuucugccucgagaccgaccgccgcggcgcccucaaggcccagaccuggaagcaccagcucgaggaggagcuccgccagcagaaggaggccgccugcuucaaggcccgccccaacaccgucaucucccaggagcccuucguccccaagaaggagaagaaguccgucgccgagggccucuccggcucccucguccaggagcccuuccagcucgccaccgagaagcgcgccaaggagcgccaggagcucgagaagcgcauggccgaggucgaggcccagaaggcccagcagcucgaggaggcccgccuccaggaggaggagcagaagaaggaggagcucgcccgccuccgccgcgagcucguccacaaggccaaccccauccgcaaguaccagggccucgagaucaaguccuccgaccagccccucaccguccccgucucccccaaguucuccacccgcuuccacugcuga

SEQ ID NO: 51091 - RNA, 543 nt, Artificial Sequence
  derived and/or modified sequence opt2 from TRA2A__Homo_sapiens__NP_001269688
auguccaaccgccgccgccacaccggcucccgcgccaaccccgaccccaacaccugccucggcgucuucggccucucccucuacaccaccgagcgcgaccuccgcgaggucuucucccgcuacggcccccucuccggcgucaacgucgucuacgaccagcgcaccggccgcucccgcggcuucgccuucgucuacuucgagcgcaucgacgacuccaaggaggccauggagcgcgccaacggcauggagcucgacggccgccgcauccgcgucgacuacuccaucaccaagcgcgcccacacccccacccccggcaucuacaugggccgccccacccacuccggcggcggcggcggcggcggcggcggcggcggcggcggcggcggcggccgccgccgcgacuccuacuacgaccgcggcuacgaccgcggcuacgaccgcuacgaggacuacgacuaccgcuaccgccgcucccccucccccuacuacucccgcuaccgcucccgcucccgcucccgcuccuacuccccccgccgcuacuga

SEQ ID NO: 51092 - RNA, 567 nt, Artificial Sequence
  derived and/or modified sequence opt2 from TRA2B__Homo_sapiens__NP_001230808
auguccacccgccgccgccacgucggcaaccgcgccaaccccgaccccaacugcugccucggcgucuucggccucucccucuacaccaccgagcgcgaccuccgcgaggucuucuccaaguacggccccaucgccgacgucuccaucgucuacgaccagcagucccgccgcucccgcggcuucgccuucgucuacuucgagaacgucgacgacgccaaggaggccaaggagcgcgccaacggcauggagcucgacggccgccgcauccgcgucgacuucuccaucaccaagcgcccccacacccccacccccggcaucuacaugggccgccccaccuacggcuccucccgccgccgcgacuacuacgaccgcggcuacgaccgcggcuacgacgaccgcgacuacuacucccgcuccuaccgcggcggcggcggcggcggcggcggcuggcgcgccgcccaggaccgcgaccagaucuaccgccgccgcucccccucccccuacuacucccgcggcggcuaccgcucccgcucccgcucccgcuccuacuccccccgccgcuacuga

SEQ ID NO: 51093 - RNA, 1371 nt, Artificial Sequence
  derived and/or modified sequence opt2 from TRABD2A__Homo_sapiens__NP_001074293
augucccccugguccugguuccuccuccagacccucugccuccuccccaccggcgccgccucccgccgcggcgcccccggcaccgccaacugcgagcucaagccccagcaguccgagcucaacuccuuccucuggaccaucaagcgcgacccccccuccuacuucuucggcaccauccacguccccuacacccgcgucugggacuucauccccgacaacuccaaggaggccuuccuccaguccuccaucgucuacuucgagcucgaccucaccgaccccuacaccaucuccgcccucaccuccugccagaugcucccccagggcgagaaccuccaggacguccucccccgcgacaucuacugccgccucaagcgccaccucgaguacgucaagcucaugaugccccucuggaugacccccgaccagcgcggcaagggccucuacgccgacuaccucuucaacgccaucgccggcaacugggagcgcaagcgccccgucugggucaugcucauggucaacucccucaccgaggucgacaucaagucccgcggcguccccguccucgaccucuuccucgcccaggaggccgagcgccuccgcaagcagaccggcgccgucgagaaggucgaggagcagugccacccccucaacggccucaacuucucccagguccccaacuucaucaacgccacccuccccccccaggagcgcaucaccgcccaggagaucgacuccuaccuccgccgcgagcucaucuacaagcgcaacgagcgcaucggcaagcgcgucaaggcccuccucgaggaguuccccgacaagggcuucuucuucgccuucggcgccggccacuucaugggcaacaacaccguccucgacguccuccgccgcgagggcuacgaggucgagcacgcccccgccggccgccccauccacaagggcaaguccaagaagaccuccacccgccccacccucuccaccaucuucgcccccaagguccccacccucgagguccccgcccccgaggccgucuccuccggccacuccacccuccccccccucgucucccgccccggcuccgccgacacccccuccgaggccgagcagcgcuuccgcaagaagcgccgccgcucccagcgccgcccccgccuccgccaguucuccgaccucuggguccgccucgaggaguccgacaucgucccccagcuccagguccccguccucgaccgccacaucuccaccgagcuccgccucccccgccgcggccacucccaccacucccagauggucgccuccuccgccugccucucccucuggacccccgucuucuggguccucguccucgccuuccagaccgagaccccccuccucuga

SEQ ID NO: 51094 - RNA, 1131 nt, Artificial Sequence
  derived and/or modified sequence opt2 from TRABD__Homo_sapiens__NP_079480
auggacggcgaggagcagcagcccccccacgaggccaacgucgagcccgucguccccuccgaggccuccgagcccgucccccgcguccucuccggcgacccccagaaccucuccgacgucgacgccuucaaccuccuccucgagaugaagcucaagcgccgccgccagcgccccaaccucccccgcaccgucacccagcucgucgccgaggacggcucccgcgucuacgucgucggcaccgcccacuucuccgacgacuccaagcgcgacgucgucaagaccauccgcgagguccagcccgacgucgucgucgucgagcucugccaguaccgcgucuccaugcucaagauggacgaguccacccuccuccgcgaggcccaggagcucucccucgagaagcuccagcaggccguccgccagaacggccucauguccggccucaugcagaugcuccuccucaaggucuccgcccacaucaccgagcagcucggcauggcccccggcggcgaguuccgcgaggccuucaaggaggccuccaagguccccuucugcaaguuccaccucggcgaccgccccauccccgucaccuucaagcgcgccaucgccgcccucuccuucuggcagaagguccgccucgccuggggccucugcuuccucuccgaccccaucuccaaggacgacgucgagcgcugcaagcagaaggaccuccucgagcagaugauggccgagaugaucggcgaguuccccgaccuccaccgcaccaucgucuccgagcgcgacgucuaccucaccuacaugcuccgccaggccgcccgccgccucgagcucccccgcgccuccgacgccgagccccgcaagugcguccccuccgucgucgucggcgucgucggcaugggccacguccccggcaucgagaagaacugguccaccgaccucaacauccaggagaucaugaccguccccccccccuccgucuccggccgcgucucccgccucgccgucaaggccgccuucuucggccuccucggcuacucccucuacuggaugggccgccgcaccgccucccucguccucucccuccccgccgcccaguacugccuccagcgcgucaccgaggcccgccacaaguga

SEQ ID NO: 51095 - RNA, 939 nt, Artificial Sequence
  derived and/or modified sequence opt2 from TRADD__Homo_sapiens__XP_011521722
auggccgccggccagaacggccacgaggagugggucggcuccgccuaccucuucgucgaguccucccucgacaaggucguccucuccgacgccuacgcccacccccagcagaaggucgccgucuaccgcgcccuccaggccgcccucgccgaguccggcggcucccccgacguccuccagaugcucaagauccaccgcuccgacccccagcucaucguccagcuccgcuucugcggccgccagcccugcggccgcuuccuccgcgccuaccgcgagggcgcccuccgcgccgcccuccagcgcucccucgccgccgcccucgcccagcacuccgucccccuccagcucgagcuccgcgccggcgccgagcgccucgacgcccuccucgccgacgaggagcgcugccucuccugcauccucgcccagcagcccgaccgccuccgcgacgaggagcucgccgagcucgaggacgcccuccgcaaccucaagugcggcuccggcgcccgcggcggcgacggcgaggucgccuccgccccccuccagccccccguccccucccucuccgaggucaagcccccccccccccccccccccgcccagaccuuccucuuccagggccagcccgucgucaaccgcccccucucccucaaggaccagcagaccuucgcccgcuccgucggccucaaguggcgcaaggucggccgcucccuccagcgcggcugccgcgcccuccgcgaccccgcccucgacucccucgccuacgaguacgagcgcgagggccucuacgagcaggccuuccagcuccuccgccgcuucguccaggccgagggccgccgcgccacccuccagcgccucgucgaggcccucgaggagaacgagcucaccucccucgccgaggaccuccucggccucaccgaccccaacggcggccucgccuga

SEQ ID NO: 51096 - RNA, 885 nt, Artificial Sequence
  derived and/or modified sequence opt2 from TRAF1__Homo_sapiens__NP_001177876
augaagcaguggaaggcccgccucggcugcggccucgaguccggccccauggcccucgagcagaaccucuccgaccuccagcuccaggccgccgucgaggucgccggcgaccucgaggucgacugcuaccgcgcccccugcuccgagucccaggaggagcucgcccuccagcacuucaugaaggagaagcuccucgccgagcucgagggcaagcuccgcgucuucgagaacaucgucgccguccucaacaaggaggucgaggccucccaccucgcccucgccaccuccauccaccagucccagcucgaccgcgagcgcauccucucccucgagcagcgcgucgucgagcuccagcagacccucgcccagaaggaccaggcccucggcaagcucgagcagucccuccgccucauggaggaggccuccuucgacggcaccuuccucuggaagaucaccaacgucacccgccgcugccacgaguccgccugcggccgcaccgucucccucuucucccccgccuucuacaccgccaaguacggcuacaagcucugccuccgccucuaccucaacggcgacggcaccggcaagcgcacccaccucucccucuucaucgucaucaugcgcggcgaguacgacgcccuccuccccuggcccuuccgcaacaaggucaccuucaugcuccucgaccagaacaaccgcgagcacgccaucgacgccuuccgccccgaccucuccuccgccuccuuccagcgcccccaguccgagaccaacgucgccuccggcugcccccucuucuucccccucuccaagcuccagucccccaagcacgccuacgucaaggacgacaccauguuccucaagugcaucgucgagaccuccaccuga

SEQ ID NO: 51097 - RNA, 1506 nt, Artificial Sequence
  derived and/or modified sequence opt2 from TRAF2__Homo_sapiens__NP_066961
auggccgccgccuccgucaccccccccggcucccucgagcuccuccagcccggcuucuccaagacccuccucggcaccaagcucgaggccaaguaccucugcuccgccugccgcaacguccuccgccgccccuuccaggcccagugcggccaccgcuacugcuccuucugccucgccuccauccucuccuccggcccccagaacugcgccgccugcguccacgagggcaucuacgaggagggcaucuccauccucgaguccuccuccgccuuccccgacaacgccgcccgccgcgaggucgagucccuccccgccgucugccccuccgacggcugcaccuggaagggcacccucaaggaguacgaguccugccacgagggccgcugcccccucaugcucaccgagugccccgccugcaagggccucguccgccucggcgagaaggagcgccaccucgagcacgagugccccgagcgcucccucuccugccgccacugccgcgcccccugcugcggcgccgacgucaaggcccaccacgaggucugccccaaguucccccucaccugcgacggcugcggcaagaagaagaucccccgcgagaaguuccaggaccacgucaagaccugcggcaagugccgcguccccugccgcuuccacgccaucggcugccucgagaccgucgagggcgagaagcagcaggagcacgagguccaguggcuccgcgagcaccucgccaugcuccucuccuccguccucgaggccaagccccuccucggcgaccagucccacgccggcuccgagcuccuccagcgcugcgagucccucgagaagaagaccgccaccuucgagaacaucgucugcguccucaaccgcgaggucgagcgcgucgccaugaccgccgaggccugcucccgccagcaccgccucgaccaggacaagaucgaggcccucuccuccaagguccagcagcucgagcgcuccaucggccucaaggaccucgccauggccgaccucgagcagaagguccucgagauggaggccuccaccuacgacggcgucuucaucuggaagaucuccgacuucgcccgcaagcgccaggaggccgucgccggccgcauccccgccaucuucucccccgccuucuacaccucccgcuacggcuacaagaugugccuccgcaucuaccucaacggcgacggcaccggccgcggcacccaccucucccucuucuucgucgucaugaagggccccaacgacgcccuccuccgcuggcccuucaaccagaaggucacccucaugcuccucgaccagaacaaccgcgagcacgucaucgacgccuuccgccccgacgucaccuccuccuccuuccagcgccccgucaacgacaugaacaucgccuccggcugcccccucuucugccccgucuccaagauggaggccaagaacuccuacguccgcgacgacgccaucuucaucaaggccaucgucgaccucaccggccucuga

SEQ ID NO: 51098 - RNA, 1458 nt, Artificial Sequence
  derived and/or modified sequence opt2 from TRAF3__Homo_sapiens__NP_001186356
auggaguccuccaagaagauggacucccccggcgcccuccagaccaaccccccccucaagcuccacaccgaccgcuccgccggcacccccgucuucguccccgagcagggcggcuacaaggagaaguucgucaagaccgucgaggacaaguacaagugcgagaagugccaccucguccucugcucccccaagcagaccgagugcggccaccgcuucugcgaguccugcauggccgcccuccucuccuccuccucccccaagugcaccgccugccaggaguccaucgucaaggacaaggucuucaaggacaacugcugcaagcgcgagauccucgcccuccagaucuacugccgcaacgagucccgcggcugcgccgagcagcucaugcucggccaccuccucguccaccucaagaacgacugccacuucgaggagcuccccugcguccgccccgacugcaaggagaagguccuccgcaaggaccuccgcgaccacgucgagaaggccugcaaguaccgcgaggccaccugcucccacugcaagucccagguccccaugaucgcccuccaggucucccuccuccagaacgaguccgucgagaagaacaaguccauccagucccuccacaaccagaucugcuccuucgagaucgagaucgagcgccagaaggagaugcuccgcaacaacgaguccaagauccuccaccuccagcgcgucaucgacucccaggccgagaagcucaaggagcucgacaaggagauccgccccuuccgccagaacugggaggaggccgacuccaugaaguccuccgucgagucccuccagaaccgcgucaccgagcucgaguccgucgacaaguccgccggccaggucgcccgcaacaccggccuccucgagucccagcucucccgccacgaccagaugcucuccguccacgacauccgccucgccgacauggaccuccgcuuccagguccucgagaccgccuccuacaacggcguccucaucuggaagauccgcgacuacaagcgccgcaagcaggaggccgucaugggcaagacccucucccucuacucccagcccuucuacaccggcuacuucggcuacaagaugugcgcccgcgucuaccucaacggcgacggcaugggcaagggcacccaccucucccucuucuucgucaucaugcgcggcgaguacgacgcccuccuccccuggcccuucaagcagaaggucacccucaugcucauggaccagggcuccucccgccgccaccucggcgacgccuucaagcccgaccccaacuccuccuccuucaagaagcccaccggcgagaugaacaucgccuccggcugccccgucuucgucgcccagaccguccucgagaacggcaccuacaucaaggacgacaccaucuucaucaaggucaucgucgacaccuccgaccuccccgaccccuga

SEQ ID NO: 51099 - RNA, 1878 nt, Artificial Sequence
  derived and/or modified sequence opt2 from TRAF3IP1__Homo_sapiens__NP_001132962
augaacgccgccgucguccgccgcacccaggaggcccucggcaaggucauccgccgccccccccucaccgagaagcuccucuccaagccccccuuccgcuaccuccacgacaucaucaccgaggucauccgcaugaccggcuucaugaagggccucuacaccgacgccgagaugaaguccgacaacgucaaggacaaggacgccaagaucuccuuccuccagaaggccaucgacgucgucgucauggucuccggcgagccccuccucgccaagcccgcccgcaucgucgccggccacgagcccgagcgcaccaacgagcuccuccagaucaucggcaagugcugccucaacaagcucuccuccgacgacgccguccgccgcguccucgccggcgagaagggcgaggucaagggccgcgccucccucaccucccgcucccaggagcucgacaacaagaacguccgcgaggaggagucccgcguccacaagaacaccgaggaccgcggcgacgccgagaucaaggagcgcuccaccucccgcgaccgcaagcagaaggaggagcucaaggaggaccgcaagccccgcgagaaggacaaggacaaggagaaggccaaggagaacggcggcaaccgccaccgcgagggcgagcgcgagcgcgccaaggcccgcgcccgccccgacaacgagcgccagaaggaccgcggcaaccgcgagcgcgaccgcgacuccgagcgcaagaaggagaccgagcgcaaguccgagggcggcaaggagaaggagcgccuccgcgaccgcgaccgcgagcgcgaccgcgacaagggcaaggaccgcgaccgccgccgcgucaagaacggcgagcacuccugggaccucgaccgcgagaagaaccgcgagcacgacaagcccgagaagaaguccgccuccuccggcgagauguccaagaagcucuccgacggcaccuucaaggacuccaaggccgagaccgagaccgagaucuccacccgcgccuccaagucccucaccaccaagaccuccaagcgccgcuccaagaacuccgucgagggcgacuccaccuccgacgccgagggcgacgccggccccgccggccaggacaaguccgagguccccgagacccccgagauccccaacgagcucuccuccaacauccgccgcaucccccgccccggcuccgcccgccccgcccccccccgcgucaagcgccaggacuccauggaggcccuccagauggaccgcuccggcuccggcaagaccgucuccaacgucaucaccgagucccacaacuccgacaacgaggaggacgaccaguucgucgucgaggccgccccccagcucuccgagauguccgagaucgagauggucaccgccgucgagcucgaggaggaggagaagcacggcggccucgucaagaagauccucgagaccaagaaggacuacgagaagcuccagcagucccccaagcccggcgagaaggagcgcucccucuucgaguccgccuggaagaaggagaaggacaucgucuccaaggagaucgagaagcuccgcaccuccauccagacccucugcaaguccgcccucccccucggcaagaucauggacuacauccaggaggacgucgacgccaugcagaacgagcuccagauguggcacuccgagaaccgccagcacgccgaggcccuccagcaggagcagcgcaucaccgacugcgccgucgagccccucaaggccgagcucgccgagcucgagcagcucaucaaggaccagcaggacaagaucugcgccgucaaggccaacauccucaagaacgaggagaagauccagaagauggucuacuccaucaaccucaccucccgccgcuga

SEQ ID NO: 51100 - RNA, 1695 nt, Artificial Sequence
  derived and/or modified sequence opt2 from TRAF3IP2__Homo_sapiens__NP_001157753
augaaccgcuccauccccgucgaggucgacgaguccgagcccuaccccucccagcuccucaagcccauccccgaguacucccccgaggaggaguccgagccccccgcccccaacauccgcaacauggcccccaacucccucuccgcccccaccaugcuccacaacuccuccggcgacuucucccaggcccacuccacccucaagcucgccaaccaccagcgccccgucucccgccaggucaccugccuccgcacccagguccucgaggacuccgaggacuccuucugccgccgccaccccggccucggcaaggccuuccccuccggcugcuccgccgucuccgagcccgccuccgaguccgucgucggcgcccuccccgccgagcaccaguucuccuucauggagaagcgcaaccaguggcucgucucccagcucuccgccgccucccccgacaccggccacgacuccgacaaguccgaccagucccuccccaacgccuccgccgacucccucggcggcucccaggagaugguccagcgcccccagccccaccgcaaccgcgccggccucgaccuccccaccaucgacaccggcuacgacucccagccccaggacguccucggcauccgccagcucgagcgcccccucccccucaccuccgucugcuacccccaggaccucccccgcccccuccgcucccgcgaguucccccaguucgagccccagcgcuaccccgccugcgcccagaugcucccccccaaccucuccccccacgcccccuggaacuaccacuaccacugccccggcucccccgaccaccagguccccuacggccacgacuacccccgcgccgccuaccagcaggucauccagcccgcccuccccggccagccccuccccggcgccuccguccgcggccuccaccccguccagaaggucauccucaacuaccccucccccugggaccacgaggagcgccccgcccagcgcgacugcuccuuccccggccucccccgccaccaggaccagccccaccaccagccccccaaccgcgccggcgcccccggcgagucccucgagugccccgccgagcuccgcccccaggucccccagccccccucccccgccgccgucccccgcccccccuccaacccccccgcccgcggcacccucaagaccuccaaccuccccgaggagcuccgcaaggucuucaucaccuacuccauggacaccgccauggaggucgucaaguucgucaacuuccuccucgucaacggcuuccagaccgccaucgacaucuucgaggaccgcauccgcggcaucgacaucaucaaguggauggagcgcuaccuccgcgacaccgucaugaucaucgucgccaucucccccaaguacaagcaggacgucgagggcgccgagucccagcucgacgaggacgagcacggccuccacaccaaguacauccaccgcaugaugcagaucgaguucaucaagcagggcuccaugaacuuccgcuucauccccguccucuuccccaacgccaagaaggagcacguccccaccuggcuccagaacacccacgucuacuccuggcccaagaacaagaagaacauccuccuccgccuccuccgcgaggaggaguacgucgcccccccccgcggcccccuccccacccuccaggucgucccccucuga

SEQ ID NO: 51101 - RNA, 1413 nt, Artificial Sequence
  derived and/or modified sequence opt2 from TRAF4__Homo_sapiens__NP_004286
augcccggcuucgacuacaaguuccucgagaagcccaagcgccgccuccucugcccccucugcggcaagcccaugcgcgagcccguccaggucuccaccugcggccaccgcuucugcgacaccugccuccaggaguuccucuccgagggcgucuucaagugccccgaggaccagcucccccucgacuacgccaagaucuaccccgaccccgagcucgagguccagguccucggccuccccauccgcugcauccacuccgaggagggcugccgcugguccggcccccuccgccaccuccagggccaccucaacaccugcuccuucaacgucauccccugccccaaccgcugccccaugaagcucucccgccgcgaccuccccgcccaccuccagcacgacugccccaagcgccgccucaagugcgaguucugcggcugcgacuucuccggcgaggccuacgagucccacgagggcaugugcccccaggaguccgucuacugcgagaacaagugcggcgcccgcaugaugcgccgccuccucgcccagcacgccaccuccgagugccccaagcgcacccagcccugcaccuacugcaccaaggaguucgucuucgacaccauccagucccaccaguaccagugcccccgccuccccgucgccugccccaaccagugcggcgucggcaccgucgcccgcgaggaccuccccggccaccucaaggacuccugcaacaccgcccucguccucugccccuucaaggacuccggcugcaagcaccgcugccccaagcucgccauggcccgccacgucgaggaguccgucaagccccaccucgccaugaugugcgcccucgucucccgccagcgccaggagcuccaggagcuccgccgcgagcucgaggagcucuccgucggcuccgacggcguccucaucuggaagaucggcuccuacggccgccgccuccaggaggccaaggccaagcccaaccucgagugcuucucccccgccuucuacacccacaaguacggcuacaagcuccaggucuccgccuuccucaacggcaacggcuccggcgagggcacccaccucucccucuacauccgcguccuccccggcgccuucgacaaccuccucgaguggcccuucgcccgccgcgucaccuucucccuccucgaccaguccgaccccggccucgccaagccccagcacgucaccgagaccuuccaccccgaccccaacuggaagaacuuccagaagcccggcaccuggcgcggcucccucgacgaguccucccucggcuucggcuaccccaaguucaucucccaccaggacauccgcaagcgcaacuacguccgcgacgacgccgucuucauccgcgccgccgucgagcucccccgcaagauccucuccuga

SEQ ID NO: 51102 - RNA, 1674 nt, Artificial Sequence
  derived and/or modified sequence opt2 from TRAF5__Homo_sapiens__NP_665702
auggccuacuccgaggagcacaagggcaugcccugcggcuucauccgccagaacuccggcaacuccaucucccucgacuucgagcccuccaucgaguaccaguucgucgagcgccucgaggagcgcuacaagugcgccuucugccacuccguccuccacaacccccaccagaccggcugcggccaccgcuucugccagcacugcauccucucccuccgcgagcucaacaccguccccaucugccccgucgacaaggaggucaucaagucccaggaggucuucaaggacaacugcugcaagcgcgagguccucaaccucuacgucuacugcuccaacgcccccggcugcaacgccaaggucauccucggccgcuaccaggaccaccuccagcagugccucuuccagcccguccagugcuccaacgagaagugccgcgagcccguccuccgcaaggaccucaaggagcaccucuccgccuccugccaguuccgcaaggagaagugccucuacugcaagaaggacgucgucgucaucaaccuccagaaccacgaggagaaccucugccccgaguaccccgucuucugccccaacaacugcgccaagaucauccucaagaccgaggucgacgagcaccucgccgucugccccgaggccgagcaggacugccccuucaagcacuacggcugcgccgucaccgacaagcgccgcaaccuccagcagcacgagcacuccgcccuccgcgagcacaugcgccucguccucgagaagaacguccagcucgaggagcagaucuccgaccuccacaagucccucgagcagaaggaguccaagauccagcagcucgccgagaccaucaagaagcucgagaaggaguucaagcaguucgcccagcucuucggcaagaacggcuccuuccuccccaacauccaggucuucgccucccacaucgacaaguccgccuggcucgaggcccagguccaccagcuccuccagauggucaaccagcagcagaacaaguucgaccuccgcccccucauggaggccgucgacaccgucaagcagaagaucacccuccucgagaacaacgaccagcgccucgccguccucgaggaggagaccaacaagcacgacacccacaucaacauccacaaggcccagcucuccaagaacgaggagcgcuucaagcuccucgagggcaccugcuacaacggcaagcucaucuggaaggucaccgacuacaagaugaagaagcgcgaggccgucgacggccacaccgucuccaucuucucccaguccuucuacaccucccgcugcggcuaccgccucugcgcccgcgccuaccucaacggcgacggcuccggccgcggcucccaccucucccucuacuucgucgucaugcgcggcgaguucgacucccuccuccaguggcccuuccgccagcgcgucacccucaugcuccucgaccaguccggcaagaagaacaucauggagaccuucaagcccgaccccaacuccuccuccuucaagcgccccgacggcgagaugaacaucgccuccggcugcccccgcuucgucgcccacuccguccucgagaacgccaagaacgccuacaucaaggacgacacccucuuccucaaggucgccgucgaccucaccgaccucgaggaccucuga

SEQ ID NO: 51103 - RNA, 1569 nt, Artificial Sequence
  derived and/or modified sequence opt2 from TRAF6__Homo_sapiens__NP_665802
augucccuccucaacugcgagaacuccugcggcuccucccaguccgaguccgacugcugcgucgccauggccuccuccugcuccgccgucaccaaggacgacuccgucggcggcaccgccuccaccggcaaccucuccuccuccuucauggaggagauccagggcuacgacgucgaguucgaccccccccucgaguccaaguacgagugccccaucugccucauggcccuccgcgaggccguccagacccccugcggccaccgcuucugcaaggccugcaucaucaaguccauccgcgacgccggccacaagugccccgucgacaacgagauccuccucgagaaccagcucuuccccgacaacuucgccaagcgcgagauccucucccucauggucaagugccccaacgagggcugccuccacaagauggagcuccgccaccucgaggaccaccaggcccacugcgaguucgcccucauggacugcccccagugccagcgccccuuccagaaguuccacaucaacauccacauccucaaggacugcccccgccgccaggucuccugcgacaacugcgccgccuccauggccuucgaggacaaggagauccacgaccagaacugcccccucgccaacgucaucugcgaguacugcaacaccauccucauccgcgagcagaugcccaaccacuacgaccucgacugccccaccgcccccauccccugcaccuucuccaccuucggcugccacgagaagaugcagcgcaaccaccucgcccgccaccuccaggagaacacccagucccacaugcgcaugcucgcccaggccguccacucccucuccgucauccccgacuccggcuacaucuccgagguccgcaacuuccaggagaccauccaccagcucgagggccgccucguccgccaggaccaccagauccgcgagcucaccgccaagauggagacccaguccauguacgucuccgagcucaagcgcaccauccgcacccucgaggacaaggucgccgagaucgaggcccagcagugcaacggcaucuacaucuggaagaucggcaacuucggcaugcaccucaagugccaggaggaggagaagcccgucgucauccacucccccggcuucuacaccggcaagcccggcuacaagcucugcaugcgccuccaccuccagcuccccaccgcccagcgcugcgccaacuacaucucccucuucguccacaccaugcagggcgaguacgacucccaccuccccuggcccuuccagggcaccauccgccucaccauccucgaccaguccgaggcccccguccgccagaaccacgaggagaucauggacgccaagcccgagcuccucgccuuccagcgccccaccaucccccgcaaccccaagggcuucggcuacgucaccuucaugcaccucgaggcccuccgccagcgcaccuucaucaaggacgacacccuccucguccgcugcgaggucuccacccgcuucgacaugggcucccuccgccgcgagggcuuccagccccgcuccaccgacgccggcgucuga

SEQ ID NO: 51104 - RNA, 2013 nt, Artificial Sequence
  derived and/or modified sequence opt2 from TRAF7__Homo_sapiens__NP_115647
auguccuccggcaaguccgcccgcuacaaccgcuucuccggcggccccuccaaccuccccacccccgacgucaccaccggcacccgcauggagaccaccuucggccccgccuucuccgccgucaccaccaucaccaaggccgacggcaccuccaccuacaagcagcacugccgcacccccuccuccuccuccacccucgccuacuccccccgcgacgaggaggacuccaugccccccaucuccaccccccgccgcuccgacuccgccaucuccguccgcucccuccacuccgaguccuccaugucccuccgcuccaccuucucccuccccgaggaggaggaggagcccgagccccucgucuucgccgagcagcccuccgucaagcucugcugccagcucugcugcuccgucuucaaggaccccgucaucaccaccugcggccacaccuucugccgccgcugcgcccucaaguccgagaagugccccgucgacaacgucaagcucaccgucgucgucaacaacaucgccgucgccgagcagaucggcgagcucuucauccacugccgccacggcugccgcgucgccggcuccggcaagccccccaucuucgaggucgacccccgcggcugccccuucaccaucaagcucuccgcccgcaaggaccacgagggcuccugcgacuaccgccccguccgcugccccaacaaccccuccugccccccccuccuccgcaugaaccucgaggcccaccucaaggagugcgagcacaucaagugcccccacuccaaguacggcugcaccuucaucggcaaccaggacaccuacgagacccaccucgagaccugccgcuucgagggccucaaggaguuccuccagcagaccgacgaccgcuuccacgagaugcacgucgcccucgcccagaaggaccaggagaucgccuuccuccgcuccaugcucggcaagcucuccgagaagaucgaccagcucgagaagucccucgagcucaaguucgacguccucgacgagaaccaguccaagcucuccgaggaccucauggaguuccgccgcgacgccuccaugcucaacgacgagcucucccacaucaacgcccgccucaacaugggcauccucggcuccuacgacccccagcagaucuucaagugcaagggcaccuucgucggccaccagggccccgucuggugccucugcgucuacuccaugggcgaccuccucuucuccggcuccuccgacaagaccaucaaggucugggacaccugcaccaccuacaagugccagaagacccucgagggccacgacggcaucguccucgcccucugcauccagggcugcaagcucuacuccggcuccgccgacugcaccaucaucgucugggacauccagaaccuccagaaggucaacaccauccgcgcccacgacaaccccgucugcacccucgucuccucccacaacguccucuucuccggcucccucaaggccaucaaggucugggacaucgucggcaccgagcucaagcucaagaaggagcucaccggccucaaccacuggguccgcgcccucgucgccgcccaguccuaccucuacuccggcuccuaccagaccaucaagaucugggacauccgcacccucgacugcauccacguccuccagaccuccggcggcuccgucuacuccaucgccgucaccaaccaccacaucgucugcggcaccuacgagaaccucauccacgucugggacaucgaguccaaggagcagguccgcacccucaccggccacgucggcaccgucuacgcccucgccgucaucuccacccccgaccagaccaaggucuucuccgccuccuacgaccgcucccuccgcgucugguccauggacaacaugaucugcacccagacccuccuccgccaccagggcuccgucaccgcccucgccgucucccgcggccgccucuucuccggcgccgucgacuccaccgucaaggucuggaccugcuga

SEQ ID NO: 51105 - RNA, 1749 nt, Artificial Sequence
  derived and/or modified sequence opt2 from TRAFD1__Homo_sapiens__NP_006691
auggccgaguuccucgacgaccaggagacccgccucugcgacaacugcaagaaggagauccccgucuucaacuucaccauccacgagauccacugccagcgcaacaucggcaugugccccaccugcaaggagcccuuccccaaguccgacauggagacccacauggccgccgagcacugccaggucaccugcaagugcaacaagaagcucgagaagcgccuccucaagaagcacgaggagaccgagugcccccuccgccucgccgucugccagcacugcgaccucgagcucuccauccucaagcucaaggagcacgaggacuacugcggcgcccgcaccgagcucugcggcaacugcggccgcaacguccucgucaaggaccucaagacccaccccgaggucugcggccgcgagggcgaggagaagcgcaacgaggucgccaucccccccaacgccuacgacgaguccuggggccaggacggcaucuggaucgccucccagcuccuccgccagaucgaggcccucgacccccccaugcgccucccccgccgcccccuccgcgccuucgaguccgacgucuuccacaaccgcaccaccaaccagcgcaacaucaccgcccaggucuccauccagaacaaccucuucgaggagcaggagcgccaggagcgcaaccgcggccagcagccccccaaggagggcggcgaggaguccgccaaccucgacuucaugcucgcccucucccuccagaacgagggccaggccuccuccgucgccgagcaggacuucuggcgcgccgucugcgaggccgaccagucccacggcggcccccgcucccucuccgacaucaagggcgccgccgacgagaucaugcuccccugcgaguucugcgaggagcucuaccccgaggagcuccucaucgaccaccagaccuccugcaaccccucccgcgcccuccccucccucaacaccggcuccuccuccccccgcggcgucgaggagcccgacgucaucuuccagaacuuccuccagcaggccgccuccaaccagcucgacucccucaugggccucuccaacucccaccccgucgaggaguccaucaucauccccugcgaguucugcggcguccagcucgaggaggagguccucuuccaccaccaggaccagugcgaccagcgccccgccaccgccaccaaccacgucaccgagggcaucccccgccucgacucccagccccaggagaccucccccgagcucccccgccgccgcguccgccaccagggcgaccucuccuccggcuaccucgacgacaccaagcaggagaccgccaacggccccaccuccugccucccccccucccgccccaucaacaacaugaccgccaccuacaaccagcucucccgcuccaccuccggcccccgccccggcugccagcccuccucccccugcguccccaagcucuccaacuccgacucccaggacauccagggccgcaaccgcgacucccagaacggcgccaucgcccccggccacgucuccgucauccgccccccccagaaccucuaccccgagaacaucguccccuccuucucccccggccccuccggccgcuacggcgccuccggccgcuccgagggcggccgcaacucccgcgucacccccgccgccgccaacuaccgcucccgcaccgccaaggccaagcccuccaagcagcagggcgccggcgacgccgaggaggaggaggaggaguga

SEQ ID NO: 51106 - RNA, 2862 nt, Artificial Sequence
  derived and/or modified sequence opt2 from TRAK1__Homo_sapiens__NP_001036111
auggcccucgucuuccaguucggccagcccguccgcgcccagccccuccccggccucugccacggcaagcucauccgcaccaacgccugcgacgucugcaacuccaccgaccuccccgaggucgagaucaucucccuccucgaggagcagcucccccacuacaagcuccgcgccgacaccaucuacggcuacgaccacgacgacuggcuccacaccccccucaucucccccgacgccaacaucgaccucaccaccgagcagaucgaggagacccucaaguacuuccuccucugcgccgagcgcgucggccagaugaccaagaccuacaacgacaucgacgccgucacccgccuccucgaggagaaggagcgcgaccucgagcucgccgcccgcaucggccagucccuccucaagaagaacaagacccucaccgagcgcaacgagcuccucgaggagcaggucgagcacauccgcgaggaggucucccagcuccgccacgagcucuccaugaaggacgagcuccuccaguucuacaccuccgccgccgaggaguccgagcccgaguccgucugcuccaccccccucaagcgcaacgaguccuccuccuccguccagaacuacuuccaccucgacucccuccagaagaagcucaaggaccucgaggaggagaacgucguccuccgcuccgaggccucccagcucaagaccgagaccaucaccuacgaggagaaggagcagcagcucgucaacgacugcgucaaggagcuccgcgacgccaacguccagaucgccuccaucuccgaggagcucgccaagaagaccgaggacgccgcccgccagcaggaggagaucacccaccuccucucccagaucgucgaccuccagaagaaggccaaggccugcgccgucgagaacgaggagcucguccagcaccucggcgccgccaaggacgcccagcgccagcucaccgccgagcuccgcgagcucgaggacaaguacgccgagugcauggagaugcuccacgaggcccaggaggagcucaagaaccuccgcaacaagaccaugcccaacaccaccucccgccgcuaccacucccucggccucuuccccauggacucccucgccgccgagaucgagggcaccaugcgcaaggagcuccagcucgaggaggccgagucccccgacaucacccaccagaagcgcgucuucgagaccguccgcaacaucaaccaggucgucaagcagcgcucccucacccccucccccaugaacauccccggcuccaaccaguccuccgccaugaacucccuccucuccuccugcgucuccaccccccgcuccuccuucuacggcuccgacaucggcaacgucguccucgacaacaagaccaacuccaucauccucgagaccgaggccgccgaccucggcaacgacgagcgcuccaagaagcccggcacccccggcacccccggcucccacgaccucgagaccgcccuccgccgccucucccuccgccgcgagaacuaccucuccgagcgccgcuucuucgaggaggagcaggagcgcaagcuccaggagcucgccgagaagggcgagcuccgcuccggcucccucacccccaccgaguccaucaugucccucggcacccacucccgcuucuccgaguucaccggcuucuccggcauguccuucuccucccgcuccuaccuccccgagaagcuccagaucgucaagccccucgagggcuccgccacccuccaccacuggcagcagcucgcccagccccaccucggcggcauccucgacccccgccccggcgucgucaccaagggcuuccgcacccucgacgucgaccucgacgaggucuacugccucaacgacuucgaggaggacgacaccggcgaccacaucucccucccccgccucgccaccuccacccccguccagcaccccgagaccuccgcccaccaccccggcaagugcaugucccagaccaacuccaccuucaccuucaccaccugccgcauccuccaccccuccgacgagcucacccgcgucacccccucccucaacuccgcccccacccccgccugcggcuccaccucccaccucaaguccacccccgucgccacccccugcaccccccgccgccucucccucgccgaguccuucaccaacacccgcgaguccaccaccaccauguccaccucccucggccucgucuggcuccucaaggagcgcggcaucuccgccgccgucuacgacccccaguccugggaccgcgccggccgcggcucccuccuccacuccuacacccccaagauggccgucauccccuccaccccccccaacucccccaugcagacccccaccuccuccccccccuccuucgaguucaagugcaccuccccccccuacgacaacuuccucgccuccaagcccgccuccuccauccuccgcgagguccgcgagaagaacguccgcuccuccgagucccagaccgacgucuccgucuccaaccucaaccucgucgacaagguccgccgcuucggcgucgccaaggucgucaacuccggccgcgcccacguccccacccucaccgaggagcagggcccccuccucugcggcccccccggccccgcccccgcccucgucccccgcggccucguccccgagggccucccccuccgcugccccaccgucaccuccgccaucggcggccuccagcucaacuccggcauccgccgcaaccgcuccuuccccaccauggucggcuccuccaugcagaugaaggcccccgucacccucaccuccggcauccucaugggcgccaagcucuccaagcagaccucccuccgcuga

SEQ ID NO: 51107 - RNA, 2745 nt, Artificial Sequence
  derived and/or modified sequence opt2 from TRAK2__Homo_sapiens__NP_055864
augucccagucccagaacgccaucuucaccucccccaccggcgaggagaaccucaugaacuccaaccaccgcgacuccgaguccaucaccgacgucugcuccaacgaggaccuccccgaggucgagcucgucucccuccucgaggagcagcucccccaguaccgccucaaggucgacacccucuuccucuacgagaaccaggacuggacccaguccccccaccagcgccagcacgccuccgacgcccucucccccguccucgccgaggagaccuuccgcuacaugauccucggcaccgaccgcgucgagcagaugaccaagaccuacaacgacaucgacauggucacccaccuccucgccgagcgcgaccgcgaccucgagcucgccgcccgcaucggccaggcccuccucaagcgcaaccacguccucuccgagcagaacgagucccucgaggagcagcucggccaggccuucgaccaggucaaccagcuccagcacgagcucugcaagaaggacgagcuccuccgcaucgucuccaucgccuccgaggaguccgagaccgacuccuccugcuccaccccccuccgcuucaacgaguccuucucccucucccagggccuccuccagcucgagaugcuccaggagaagcucaaggagcucgaggaggagaacauggcccuccgcuccaaggccugccacaucaagaccgagaccgucaccuacgaggagaaggagcagcagcucgucuccgacugcgucaaggagcuccgcgagaccaacgcccagaugucccgcaugaccgaggagcucuccggcaaguccgacgagcucauccgcuaccaggaggagcucuccucccuccucucccagaucgucgaccuccagcacaagcucaaggagcacgucaucgagaaggaggagcucaagcuccaccuccaggccuccaaggacgcccagcgccagcucaccauggagcuccacgagcuccaggaccgcaacauggagugccucggcaugcuccacgagucccaggaggagaucaaggagcuccgcucccgcuccggccccaccgcccaccucuacuucucccaguccuacggcgccuucaccggcgagucccucgccgccgagaucgagggcaccaugcgcaagaagcucucccucgacgaggaguccucccucuucaagcagaaggcccagcagaagcgcgucuucgacaccguccgcaucgccaacgacacccgcggccgcuccaucuccuuccccgcccuccuccccauccccggcuccaaccgcuccuccgucaucaugaccgccaagcccuucgaguccggccuccagcagaccgaggacaagucccuccucaaccagggcuccuccuccgaggaggucgccggcuccucccagaagaugggccagcccggccccuccggcgacuccgaccucgccaccgcccuccaccgccucucccuccgccgccagaacuaccucuccgagaagcaguucuucgccgaggaguggcagcgcaagauccagguccucgccgaccagaaggagggcgucuccggcugcgucacccccaccgagucccucgccucccucugcaccacccaguccgagaucaccgaccucuccuccgccuccugccuccgcggcuucaugcccgagaagcuccagaucgucaagccccucgagggcucccagacccucuaccacuggcagcagcucgcccagcccaaccucggcaccauccucgacccccgccccggcgucaucaccaagggcuucacccagcuccccggcgacgccaucuaccacaucuccgaccucgaggaggacgaggaggagggcaucaccuuccagguccagcagccccucgaggucgaggagaagcucuccaccuccaagcccgucaccggcaucuuccucccccccaucaccuccgccggcggccccgucaccgucgccaccgccaaccccggcaagugccucuccugcaccaacuccaccuucaccuucaccaccugccgcauccuccaccccuccgacaucacccaggucacccccuccuccggcuuccccucccucuccugcggcuccuccggcuccuccuccuccaacaccgccgucaacucccccgcccucuccuaccgccucuccaucggcgaguccaucaccaaccgccgcgacuccaccaccaccuucuccuccaccaugucccucgccaagcuccuccaggagcgcggcaucuccgccaaggucuaccacucccccaucuccgagaacccccuccagccccuccccaagucccucgccauccccuccaccccccccaacucccccucccacucccccugccccuccccccuccccuucgagccccgcguccaccucuccgagaacuuccucgccucccgccccgccgagaccuuccuccaggagauguacggccuccgccccucccgcaacccccccgacgucggccagcucaagaugaaccucgucgaccgccucaagcgccucggcaucgcccgcgucgucaagaaccccggcgcccaggagaacggccgcugccaggaggccgagaucggcccccagaagcccgacuccgccgucuaccucaacuccggcuccucccuccucggcggccuccgccgcaaccagucccuccccgucaucaugggcuccuucgccgcccccgucugcaccuccucccccaagaugggcguccucaaggaggacuga

SEQ ID NO: 51108 - RNA, 1125 nt, Artificial Sequence
  derived and/or modified sequence opt2 from TRAM1__Homo_sapiens__NP_055109
auggccauccgcaagaaguccaccaaguccccccccguccucucccacgaguucguccuccagaaccacgccgacaucgucuccugcgucgccauggucuuccuccucggccucauguucgagaucaccgccaaggccuccaucaucuucgucacccuccaguacaacgucacccuccccgccaccgaggagcaggccaccgaguccgucucccucuacuacuacggcaucaaggaccucgccaccgucuucuucuacaugcucgucgccaucaucauccacgccgucauccaggaguacaugcucgacaagaucaaccgccgcaugcacuucuccaagaccaagcacuccaaguucaacgaguccggccagcucuccgccuucuaccucuucgccugcgucuggggcaccuucauccucaucuccgagaacuacaucuccgaccccaccauccucuggcgcgccuacccccacaaccucaugaccuuccagaugaaguucuucuacaucucccagcucgccuacuggcuccacgccuuccccgagcucuacuuccagaagaccaagaaggaggacaucccccgccagcucgucuacaucggccucuaccucuuccacaucgccggcgccuaccuccucaaccucaaccaccucggccucguccuccucguccuccacuacuucgucgaguuccucuuccacaucucccgccucuucuacuucuccaacgagaaguaccagaagggcuucucccucugggccguccucuucguccucggccgccuccucacccucauccucuccguccucaccgucggcuucggccucgcccgcgccgagaaccagaagcucgacuucuccaccggcaacuucaacguccucgccguccgcaucgccguccucgccuccaucugcgucacccaggccuucaugauguggaaguucaucaacuuccagcuccgccgcuggcgcgagcacuccgccuuccaggcccccgccgucaagaagaagcccaccgucaccaagggccgcuccuccaagaagggcaccgagaacggcgucaacggcacccucaccuccaacgucgccgacuccccccgcaacaagaaggagaaguccuccuga

SEQ ID NO: 51109 - RNA, 1110 nt, Artificial Sequence
  derived and/or modified sequence opt2 from TRAM1L1__Homo_sapiens__NP_689615
augggccuccgcaagaaguccaccaagaacccccccguccucucccaggaguucauccuccagaaccacgccgacaucgucuccugcgucggcauguucuuccuccucggccucgucuucgagggcaccgccgaggccuccaucgucuuccucacccuccagcacuccgucgccguccccgccgccgaggagcaggccaccggcuccaagucccucuacuacuacggcgucaaggaccucgccaccgucuucuucuacaugcucgucgccaucaucauccacgccaccauccaggaguacguccucgacaagaucaacaagcgcaugcaguucaccaaggccaagcagaacaaguucaacgaguccggccaguucuccgucuucuacuucuucuccugcaucuggggcaccuucauccucaucuccgagaacugccucuccgaccccacccucaucuggaaggcccgcccccacuccaugaugaccuuccagaugaaguucuucuacaucucccagcucgccuacugguuccacgccuuccccgagcucuacuuccagaagaccaagaagcaggacaucccccgccagcucgucuacaucggccuccaccucuuccacaucaccggcgccuaccuccucuaccucaaccaccucggccuccuccuccucguccuccacuacuucgucgagcuccucucccacaugugcggccucuucuacuucuccgacgagaaguaccagaagggcaucucccucugggccaucgucuucauccucggccgccucgucacccucaucgucuccguccucaccgucggcuuccaccucgccggcucccagaaccgcaaccccgacgcccucaccggcaacgucaacguccucgccgccaagaucgccguccucuccuccuccugcaccauccaggccuacgucaccuggaaccucaucacccucuggcuccagcgcugggucgaggacuccaacauccaggccuccugcaugaagaagaagcgcucccgcuccuccaagaagcgcaccgagaacggcgucggcgucgagaccuccaaccgcgucgacugcccccccaagcgcaaggagaaguccuccuga

SEQ ID NO: 51110 - RNA, 1113 nt, Artificial Sequence
  derived and/or modified sequence opt2 from TRAM2__Homo_sapiens__NP_036420
auggccuuccgccgccgcaccaaguccuacccccucuucucccaggaguucgucauccacaaccacgccgacaucggcuucugccucguccucugcguccucaucggccucauguucgaggucaccgccaagaccgccuuccucuucauccucccccaguacaacaucuccguccccaccgccgacuccgagaccguccacuaccacuacggccccaaggaccucgucaccauccucuucuacaucuucaucaccaucauccuccacgccgucguccaggaguacauccucgacaagaucuccaagcgccuccaccucuccaaggucaagcacuccaaguucaacgaguccggccagcucgucgucuuccacuucaccuccgucaucuggugcuucuacgucgucgucaccgagggcuaccucaccaacccccgcucccucugggaggacuacccccacguccaccuccccuuccaggucaaguucuucuaccucugccagcucgccuacuggcuccacgcccuccccgagcucuacuuccagaagguccgcaaggaggagaucccccgccagcuccaguacaucugccucuaccucguccacaucgccggcgccuaccuccucaaccucucccgccucggccucauccuccuccuccuccaguacuccaccgaguuccucuuccacaccgcccgccucuucuacuucgccgacgagaacaacgagaagcucuucuccgccugggccgccgucuucggcgucacccgccucuucauccucacccucgccguccucgccaucggcuucggccucgcccgcauggagaaccaggccuucgaccccgagaagggcaacuucaacacccucuucugccgccucugcguccuccuccucgucugcgccgcccaggccuggcucauguggcgcuucauccacucccagcuccgccacuggcgcgaguacuggaacgagcaguccgccaagcgccgcguccccgccaccccccgccuccccgcccgccucaucaagcgcgaguccggcuaccacgagaacggcgucgucaaggccgagaacggcaccuccccccgcaccaagaagcucaagucccccuga

SEQ ID NO: 51111 - RNA, 1956 nt, Artificial Sequence
  derived and/or modified sequence opt2 from TRAP1__Homo_sapiens__NP_001258978
auggcccgcgagcuccgcgcccuccuccucuggggccgccgccuccgcccccuccuccgcgcccccgcccucgccgccguccccggcggcuccaccuccaagcacgaguuccaggccgagaccaagaagcuccucgacaucgucgcccgcucccucuacuccgagaaggaggucuucauccgcgagcucaucuccaacgccuccgacgcccucgagaagcuccgccacaagcucgucuccgacggccaggcccuccccgagauggagauccaccuccagaccaacgccgagaagggcaccaucaccauccaggacaccggcaucggcaugacccaggaggagcucgucuccaaccucggcaccaucgcccgcuccggcuccaaggccuuccucgacgcccuccagaaccaggccgaggccuccuccaagaucaucggccaguucggcgucggcuucuacuccgccuucauggucgccgaccgcgucgaggucuacucccgcuccgccgcccccggcucccucggcuaccaguggcucuccgacggcuccggcgucuucgagaucgccgaggccuccggcguccgcaccggcaccaagaucaucauccaccucaaguccgacugcaaggaguucuccuccgaggcccgcguccgcgacgucgucaccaaguacuccaacuucgucuccuucccccucuaccucaacggccgccgcaugaacacccuccaggccaucuggaugauggaccccaaggacguccgcgaguggcagcacgaggaguucuaccgcuacgucgcccaggcccacgacaagccccgcuacacccuccacuacaagaccgacgccccccucaacauccgcuccaucuucuacguccccgacaugaagcccuccauguucgacgucucccgcgagcucggcuccuccgucgcccucuacucccgcaagguccucauccagaccaaggccaccgacauccuccccaaguggcuccgcuucauccgcggcgucgucgacuccgaggacaucccccucaaccucucccgcgagcuccuccaggaguccgcccucauccgcaagcuccgcgacguccuccagcagcgccucaucaaguucuucaucgaccaguccaagaaggacgccgagaaguacgccaaguucuucgaggacuacggccucuucaugcgcgagggcaucgucaccgccaccgagcaggaggucaaggaggacaucgccaagcuccuccgcuacgaguccuccgcccuccccuccggccagcucaccucccucuccgaguacgccucccgcaugcgcgccggcacccgcaacaucuacuaccucugcgcccccaaccgccaccucgccgagcacucccccuacuacgaggccaugaagaagaaggacaccgagguccucuucugcuucgagcaguucgacgagcucacccuccuccaccuccgcgaguucgacaagaagaagcucaucuccgucgagaccgacaucgucgucgaccacuacaaggaggagaaguucgaggaccgcucccccgccgccgagugccucuccgagaaggagaccgaggagcucauggccuggaugcgcaacguccucggcucccgcgucaccaacgucaaggucacccuccgccucgacacccaccccgccauggucaccguccucgagaugggcgccgcccgccacuuccuccgcaugcagcagcucgccaagacccaggaggagcgcgcccagcuccuccagcccacccucgagaucaacccccgccacgcccucaucaagaagcucaaccagcuccgcgccuccgagcccggccucgcccagcuccucgucgaccagaucuacgagaacgccaugaucgccgccggccucgucgacgacccccgcgccauggucggccgccucaacgagcuccucgucaaggcccucgagcgccacuga

SEQ ID NO: 51112 - RNA, 3780 nt, Artificial Sequence
  derived and/or modified sequence opt2 from TRAPPC10__Homo_sapiens__NP_003265
auggacgccuccgaggagccccucccccccgucaucuacaccauggagaacaagcccaucgucaccugcgccggcgaccagaaccucuucaccuccgucuaccccacccucucccagcagcucccccgcgagcccauggaguggcgccgcuccuacggccgcgcccccaagaugauccaccucgaguccaacuucguccaguucaaggaggagcuccuccccaaggagggcaacaaggcccuccucaccuuccccuuccuccacaucuacuggaccgagugcugcgacaccgaggucuacaaggccaccgucaaggacgaccucaccaaguggcagaacguccucaaggcccacuccuccgucgacuggcucaucgucaucgucgagaacgacgccaagaagaagaacaagaccaacauccucccccgcaccuccaucgucgacaagauccgcaacgacuucugcaacaagcaguccgaccgcugcgucguccucuccgacccccucaaggacuccucccgcacccaggaguccuggaacgccuuccucaccaagcuccgcacccuccuccucauguccuucaccaagaaccucggcaaguucgaggacgacaugcgcacccuccgcgagaagcgcaccgagcccggcugguccuucugcgaguacuucaugguccaggaggagcucgccuucgucuucgagaugcuccagcaguucgaggacgcccucguccaguacgacgagcucgacgcccucuucucccaguacgucgucaacuucggcgccggcgacggcgccaacuggcucaccuucuucugccagcccgucaaguccuggaacggccucauccuccgcaagcccaucgacauggagaagcgcgaguccauccagcgccgcgaggccacccuccucgaccuccgcuccuaccucuucucccgccagugcacccuccuccucuuccuccagcgccccugggaggucgcccagcgcgcccucgagcuccuccacaacugcguccaggagcucaagcuccucgaggucuccgucccccccggcgcccucgacugcugggucuuccucuccugccucgagguccuccagcgcaucgagggcugcugcgaccgcgcccagaucgacuccaacaucgcccacaccgucggccucugguccuacgccaccgagaagcucaagucccucggcuaccucugcggccucgucuccgagaagggccccaacuccgaggaccucaaccgcaccgucgaccuccucgccggccucggcgccgagcgccccgagaccgccaacaccgcccagucccccuacaagaagcucaaggaggcccucuccuccgucgaggccuucgagaagcacuaccucgaccucucccacgccaccaucgagauguacaccuccaucggccgcauccgcuccgccaaguucgucggcaaggaccucgccgaguucuacaugcgcaagaaggccccccagaaggccgagaucuaccuccagggcgcccucaagaacuaccucgccgagggcugggcccuccccaucacccacacccgcaagcagcucgccgagugccagaagcaccucggccagaucgagaacuaccuccagaccuccucccuccucgccuccgaccaccaccucaccgaggaggagcgcaagcacuucugccaggagauccucgacuucgccucccagcccuccgacucccccggccacaagaucguccuccccaugcacuccuucgcccagcuccgcgaccuccacuucgaccccuccaacgccgucguccacgucggcggcguccucugcgucgagaucaccauguacucccagaugcccguccccguccacgucgagcagaucgucgucaacguccacuucuccaucgagaagaacuccuaccgcaagaccgccgaguggcucaccaagcacaagaccuccaacggcaucaucaacuucccccccgagaccgcccccuuccccgucucccagaacucccuccccgcccucgagcucuacgagauguucgagcgcucccccuccgacaacucccucaacaccaccggcaucaucugccgcaacguccacaugcuccuccgccgccaggaguccuccuccucccucgagaugcccuccggcgucgcccucgaggagggcgcccacguccuccgcugcucccacgucacccucgagcccggcgccaaccagaucaccuuccgcacccaggccaaggagcccggcaccuacacccuccgccagcucugcgccuccgucggcuccgucugguucguccucccccacaucuaccccaucguccaguacgacgucuacucccaggagccccagcuccacgucgagccccucgccgacucccuccucgccggcaucccccagcgcgucaaguucaccgucaccaccggccacuacaccaucaagaacggcgacucccuccagcucuccaacgccgaggccaugcucauccucugccaggccgagucccgcgccgucgucuacuccaacacccgcgagcaguccuccgaggccgcccuccgcauccaguccuccgacaaggucaccuccaucucccuccccgucgcccccgccuaccacgucaucgaguucgagcucgagguccucucccuccccuccgcccccgcccucggcggcgaguccgacaugcucggcauggccgagccccaccgcaagcacaaggacaagcagcgcaccggccgcugcauggucaccaccgaccacaaggucuccaucgacugccccugguccaucuacuccaccgucaucgcccucaccuucuccguccccuuccgcaccacccacucccuccucuccuccggcacccgcaaguacguccaggucugcguccagaaccucuccgagcucgacuuccagcucuccgacuccuaccucgucgacaccggcgacuccaccgaccuccagcucgucccccucaacacccagucccagcagcccaucuacuccaagcaguccgucuucuucgucugggagcucaaguggaccgaggagcccccccccucccuccacugccgcuucuccgucggcuucucccccgccuccgaggagcagcucuccaucucccucaagcccuacaccuacgaguucaaggucgagaacuucuucacccucuacaacgucaaggccgagaucuucccccccuccggcauggaguacugccgcaccggcucccucugcucccucgagguccucaucacccgccucuccgaccuccucgaggucgacaaggacgaggcccucaccgaguccgacgagcacuucuccaccaagcucauguacgaggucgucgacaacuccuccaacugggccgucugcggcaaguccugcggcgucaucuccaugcccgucgccgcccgcgccacccaccgcguccacauggaggucaugccccucuucgccggcuaccucccccuccccgacguccgccucuucaaguaccucccccaccacuccgcccacuccucccagcucgacgccgacuccuggaucgagaacgacucccucuccgucgacaagcacggcgacgaccagcccgacuccuccucccucaagucccgcggcuccguccacuccgccugcuccuccgagcacaagggccuccccaugccccgccuccaggcccuccccgccggccaggucuucaacuccuccuccggcacccagguccucgucauccccucccaggacgaccacguccucgaggucuccgucaccuga

SEQ ID NO: 51113 - RNA, 3402 nt, Artificial Sequence
  derived and/or modified sequence opt2 from TRAPPC11__Homo_sapiens__NP_068761
augucccccacccagugggacuuccccgucgagcucugcugccgccccauggccuucgucacccucaccggccucgacgucgucuacaacgccguccaccgcgccgucugggacgccuucugcgccaaccgccgcgccgaccgcguccccaucuccuucaagguccuccccggcgaccacgaguaccccaagugccgccccaagcgcaccuccuacgagugguacauccccaagggcauccucaagaccggcuggaugaacaagcaccucaaccucguccccgcccucgucgucgucuucuacgagcucgacugggacgagccccaguggaaggagaagcaguccgagugcgccacccgcgucgagaucguccgccagucccuccagggccgcaacaccaaggucgccgucguccucauccagaagaagaccccccucccccccggcgaggacgucaucgccuccgagcgcgccgccgcccucugcaacgccugcgagcucuccggcaagucccucuucguccucccccacaccgaccaccucgucggcuacaucauccgccucgagaacgccuucuacgagcacgcccagaccuacuacuacaccgagauccgccgcgucaagucccacaaggaguuccucaacaagaccacccaccagcuccucuucguccgccaccaguucaagaucgccuucuucuccgagcucaagcaggacacccagaacgcccucaagaacuaccgcaccgccuacaaccucguccacgagcuccgcgcccacgagaccaacauccucgagaucaagaccauggccggcuucaucaacuacaagaucugccgccucugcuuccagcacaacaccccccucgacgccaucgcccaguuccgcaagcacaucgaccucugcaagaagaagaucggcuccgccgagcucuccuucgagcacgacgccuggauguccaagcaguuccaggccuucggcgaccucuucgacgaggccaucaagcucggccucaccgccauccagacccagaaccccggcuucuacuaccagcaggccgccuacuacgcccaggagcgcaagcagcucgccaagacccucugcaaccacgaggccuccgucauguaccccaaccccgacccccucgagacccagaccggcguccucgacuucuacggccagcgcuccuggcgccagggcauccucuccuucgaccucuccgaccccgagaaggagaaggucggcauccucgccauccagcucaaggagcgcaacgucguccacuccgagaucaucaucacccuccucuccaacgccgucgcccaguucaagaaguacaagugcccccgcaugaagucccaccucaugguccagaugggcgaggaguacuacuacgccaaggacuacaccaaggcccucaagcuccucgacuacgucaugugcgacuaccgcuccgagggcugguggacccuccucaccuccguccucaccaccgcccucaagugcuccuaccucauggcccagcucaaggacuacaucaccuacucccucgagcuccucggccgcgccuccacccucaaggacgaccagaagucccgcaucgagaagaaccucaucaacguccucaugaacgagucccccgaccccgagcccgacugcgacauccucgccgucaagaccgcccagaagcucugggccgaccgcaucucccucgccggcuccaacaucuucaccaucggcguccaggacuucguccccuucguccagugcaaggccaaguuccacgcccccuccuuccacgucgacguccccguccaguucgacaucuaccucaaggccgacugcccccaccccauccgcuucuccaagcucugcgucuccuucaacaaccaggaguacaaccaguucugcgucaucgaggaggccuccaaggccaacgagguccucgagaaccucacccagggcaagaugugccucguccccggcaagacccgcaagcuccucuucaaguucgucgccaagaccgaggacgucggcaagaagaucgagaucaccuccgucgaccucgcccucggcaacgagaccggccgcugcgucguccucaacuggcagggcggcggcggcgacgccgccuccucccaggaggcccuccaggccgcccgcuccuucaagcgccgccccaagcuccccgacaacgagguccacugggacuccaucaucauccaggccuccaccaugaucaucucccgcguccccaacaucuccguccaccuccuccacgagccccccgcccucaccaacgagauguacugccucgucgucaccguccagucccacgagaagacccagauccgcgacgucaagcucaccgccggccucaagcccggccaggacgccaaccucacccagaagacccacgucacccuccacggcaccgagcucugcgacgaguccuaccccgcccuccucaccgacauccccgucggcgaccuccaccccggcgagcagcucgagaagaugcucuacguccgcugcggcaccgucggcucccgcauguuccucgucuacgucuccuaccucaucaacaccaccgucgaggagaaggagaucgucugcaagugccacaaggacgagaccgucaccaucgagaccgucuuccccuucgacgucgccgucaaguucgucuccaccaaguucgagcaccucgagcgcgucuacgccgacauccccuuccuccucaugaccgaccuccucuccgccucccccugggcccucaccaucgucuccuccgagcuccagcucgcccccuccaugaccaccgucgaccagcucgagucccaggucgacaacgucauccuccagaccggcgaguccgccuccgagugcuucugccuccagugccccucccucggcaacaucgagggcggcgucgccaccggccacuacaucaucuccuggaagcgcaccuccgccauggagaacauccccaucaucaccaccgucaucacccucccccacgucaucgucgagaacaucccccuccacgucaacgccgaccuccccuccuucggccgcguccgcgagucccuccccgucaaguaccaccuccagaacaagaccgaccucguccaggacgucgagaucuccgucgagcccuccgacgccuucauguucuccggccucaagcagauccgccuccgcauccuccccggcaccgagcaggagaugcucuacaacuucuacccccucauggccggcuaccagcagcuccccucccucaacaucaaccuccuccgcuuccccaacuucaccaaccagcuccuccgccgcuucauccccaccuccaucuucgucaagccccagggccgccucauggacgacaccuccaucgccgccgccuga

SEQ ID NO: 51114 - RNA, 438 nt, Artificial Sequence
  derived and/or modified sequence opt2 from TRAPPC1__Homo_sapiens__NP_067033
augaccguccacaaccucuaccucuucgaccgcaacggcgucugccuccacuacuccgaguggcaccgcaagaagcaggccggcauccccaaggaggaggaguacaagcucauguacggcaugcucuucuccauccgcuccuucgucuccaagauguccccccucgacaugaaggacggcuuccucgccuuccagaccucccgcuacaagcuccacuacuacgagacccccaccggcaucaaggucgucaugaacaccgaccucggcgucggccccauccgcgacguccuccaccacaucuacuccgcccucuacgucgagcucgucgucaagaacccccucugcccccucggccagaccguccaguccgagcucuuccgcucccgccucgacuccuacguccgcucccuccccuucuucuccgcccgcgccggcuga

SEQ ID NO: 51115 - RNA, 525 nt, Artificial Sequence
  derived and/or modified sequence opt2 from TRAPPC2__Homo_sapiens__NP_001122307
auguccuccuggaagcaggaccgcuccggccuccgcuccaccgagcucaacguccucgaguaccagccccucugcgccguccgcucccacauccucaagaccauguccggcuccuucuacuucgucaucgucggccaccacgacaaccccgucuucgagauggaguuccuccccgccggcaaggccgaguccaaggacgaccaccgccaccucaaccaguucaucgcccacgccgcccucgaccucgucgacgagaacauguggcucuccaacaacauguaccucaagaccgucgacaaguucaacgagugguucgucuccgccuucgucaccgccggccacaugcgcuucaucaugcuccacgacauccgccaggaggacggcaucaagaacuucuucaccgacgucuacgaccucuacaucaaguucuccaugaaccccuucuacgagcccaacucccccauccgcuccuccgccuucgaccgcaagguccaguuccucggcaagaagcaccuccucuccuga

SEQ ID NO: 51116 - RNA, 660 nt, Artificial Sequence
  derived and/or modified sequence opt2 from TRAPPC4__Homo_sapiens__NP_057230
auggccaucuucuccgucuacgucgucaacaaggccggcggccucaucuaccagcucgacuccuacgccccccgcgccgaggccgagaagaccuucuccuacccccucgaccuccuccucaagcuccacgacgagcgcguccucgucgccuucggccagcgcgacggcauccgcgucggccacgccguccucgccaucaacggcauggacgucaacggccgcuacaccgccgacggcaaggagguccucgaguaccucggcaaccccgccaacuaccccgucuccauccgcuucggccgcccccgccucaccuccaacgagaagcucaugcucgccuccauguuccacucccucuucgccaucggcucccagcucucccccgagcagggcuccuccggcaucgagaugcucgagaccgacaccuucaagcuccacugcuaccagacccucaccggcaucaaguucgucguccucgccgacccccgccaggccggcaucgacucccuccuccgcaagaucuacgagaucuacuccgacuucgcccucaagaaccccuucuacucccucgagaugcccauccgcugcgagcucuucgaccagaaccucaagcucgcccucgaggucgccgagaaggccggcaccuucggccccggcuccuga

SEQ ID NO: 51117 - RNA, 3447 nt, Artificial Sequence
  derived and/or modified sequence opt2 from TRAPPC9__Homo_sapiens__NP_001153844
auguccguccccgacuacaugcagugcgccgaggaccaccagacccuccucgucgucguccagcccgucggcaucgucuccgaggagaacuucuuccgcaucuacaagcgcaucugcuccgucucccagaucuccguccgcgacucccagcgcguccucuacauccgcuaccgccaccacuacccccccgagaacaacgaguggggcgacuuccagacccaccgcaaggucgucggccucaucaccaucaccgacugcuucuccgccaaggacuggccccagaccuucgagaaguuccacguccagaaggagaucuacggcuccacccucuacgacucccgccucuucgucuucggccuccagggcgagaucgucgagcagccccgcaccgacgucgccuucuaccccaacuacgaggacugccagaccgucgagaagcgcaucgaggacuucaucgagucccucuucaucguccucgaguccaagcgccucgaccgcgccaccgacaaguccggcgacaagaucccccuccucugcguccccuucgagaagaaggacuucgucggccucgacaccgacucccgccacuacaagaagcgcugccagggccgcaugcgcaagcacgucggcgaccucugccuccaggccggcaugcuccaggacucccucguccacuaccacauguccgucgagcuccuccgcuccgucaacgacuuccucuggcucggcgccgcccucgagggccucugcuccgccuccgucaucuaccacuaccccggcggcaccggcggcaaguccggcgcccgccgcuuccagggcuccacccuccccgccgaggccgccaaccgccaccgccccggcgcccaggagguccucaucgaccccggcgcccucaccaccaacggcaucaaccccgacaccuccaccgagaucggccgcgccaagaacugccucucccccgaggacaucaucgacaaguacaaggaggccaucuccuacuacuccaaguacaagaacgccggcgucaucgagcucgaggccugcaucaaggccguccgcguccucgccauccagaagcgcuccauggaggccuccgaguuccuccagaacgccgucuacaucaaccuccgccagcucuccgaggaggagaagauccagcgcuacuccauccucuccgagcucuacgagcucaucggcuuccaccgcaaguccgccuucuucaagcgcgucgccgccaugcagugcgucgcccccuccaucgccgagcccggcuggcgcgccugcuacaagcuccuccucgagacccuccccggcuacucccucucccucgaccccaaggacuucucccgcggcacccaccgcggcugggccgccguccagaugcgccuccuccacgagcucgucuacgccucccgccgcaugggcaaccccgcccucuccguccgccaccucuccuuccuccuccagaccaugcucgacuuccucuccgaccaggagaagaaggacgucgcccagucccucgagaacuacaccuccaagugccccggcaccauggagcccaucgcccuccccggcggccucacccucccccccguccccuucaccaagcuccccaucguccgccacgucaagcuccucaaccuccccgccucccuccgcccccacaagaugaagucccuccucggccagaacgucuccaccaagucccccuucaucuacucccccaucaucgcccacaaccgcggcgaggagcgcaacaagaagaucgacuuccaguggguccagggcgacgucugcgagguccagcucauggucuacaaccccaugcccuucgagcuccgcgucgagaacaugggccuccucaccuccggcgucgaguucgagucccuccccgccgcccucucccuccccgccgaguccggccucuaccccgucacccucgucggcgucccccagaccaccggcaccaucaccgucaacggcuaccacaccaccgucuucggcgucuucuccgacugccuccucgacaaccuccccggcaucaagaccuccggcuccaccgucgaggucauccccgcccucccccgccuccagaucuccaccucccucccccgcuccgcccacucccuccagcccuccuccggcgacgagaucuccaccaacgucuccguccagcucuacaacggcgagucccagcagcucaucaucaagcucgagaacaucggcauggagccccucgagaagcucgaggucaccuccaagguccucaccaccaaggagaagcucuacggcgacuuccucuccuggaagcucgaggagacccucgcccaguucccccuccagcccggcaaggucgccaccuucaccaucaacaucaaggucaagcucgacuucuccugccaggagaaccuccuccaggaccucuccgacgacggcaucuccgucuccggcuucccccucuccucccccuuccgccaggucguccgcccccgcgucgagggcaagcccgucaacccccccgaguccaacaaggccggcgacuacucccacgucaagacccucgaggccguccucaacuucaaguacuccggcggccccggccacaccgagggcuacuaccgcaaccucucccucggccuccacgucgaggucgagcccuccgucuucuucacccgcgucuccacccuccccgccaccuccacccgccagugccaccuccuccucgacgucuucaacuccaccgagcacgagcucaccgucuccacccgcuccuccgaggcccucauccuccacgccggcgagugccagcgcauggccauccaggucgacaaguucaacuucgaguccuuccccgagucccccggcgagaagggccaguucgccaaccccaagcagcucgaggaggagcgccgcgaggcccgcggccucgagauccacuccaagcucggcaucugcuggcgcauccccucccucaagcgcuccggcgaggccuccgucgagggccuccucaaccagcucguccucgagcaccuccagcucgccccccuccagugggacguccucgucgacggccagcccugcgaccgcgaggccgucgccgccugccaggucggcgaccccguccgccucgagguccgccucaccaaccgcuccccccgcuccgucggccccuucgcccucaccgucguccccuuccaggaccaccagaacggcguccacaacuacgaccuccacgacaccgucuccuucgucggcuccuccaccuucuaccucgacgccguccagcccuccggccaguccgccugccucggcgcccuccucuuccucuacaccggcgacuucuuccuccacauccgcuuccacgaggacuccaccuccaaggagcucccccccuccugguucugccuccccuccguccacgucugcgcccucgaggcccaggccuga

SEQ ID NO: 51118 - RNA, 561 nt, Artificial Sequence
  derived and/or modified sequence opt2 from TRAT1__Homo_sapiens__NP_057472
auguccggcaucuccggcugccccuucuuccucuggggccuccucgcccuccucggccucgcccucgucaucucccucaucuucaacaucucccacuacgucgagaagcagcgccaggacaagauguacuccuacuccuccgaccacacccgcgucgacgaguacuacaucgaggacacccccaucuacggcaaccucgacgacaugaucuccgagcccauggacgagaacugcuacgagcagaugaaggcccgccccgagaaguccgucaacaagaugcaggaggccacccccuccgcccaggccaccaacgagacccagaugugcuacgccucccucgaccacuccgucaagggcaagcgccgcaagccccgcaagcagaacacccacuucuccgacaaggacggcgacgagcagcuccacgccaucgacgccuccgucuccaagaccacccucgucgacuccuucucccccgagucccaggccgucgaggagaacauccacgacgaccccauccgccucuucggccucauccgcgccaagcgcgagcccaucaacuga

SEQ ID NO: 51119 - RNA, 1176 nt, Artificial Sequence
  derived and/or modified sequence opt2 from TRDMT1__Homo_sapiens__NP_004403
auggagccccuccgcguccucgagcucuacuccggcgucggcggcaugcaccacgcccuccgcgaguccugcauccccgcccaggucgucgccgccaucgacgucaacaccgucgccaacgaggucuacaaguacaacuucccccacacccagcuccucgccaagaccaucgagggcaucacccucgaggaguucgaccgccucuccuucgacaugauccucauguccccccccugccagcccuucacccgcaucggccgccagggcgacaugaccgacucccgcaccaacuccuuccuccacauccucgacauccucccccgccuccagaagcuccccaaguacauccuccucgagaacgucaagggcuucgaggucuccuccacccgcgaccuccucauccagaccaucgagaacugcggcuuccaguaccaggaguuccuccucucccccaccucccucggcauccccaacucccgccuccgcuacuuccucaucgccaagcuccaguccgagccccuccccuuccaggcccccggccagguccucauggaguuccccaagaucgaguccguccacccccagaaguacgccauggacgucgagaacaagauccaggagaagaacgucgagcccaacaucuccuucgacggcuccauccagugcuccggcaaggacgccauccucuucaagcucgagaccgccgaggagauccaccgcaagaaccagcaggacuccgaccucuccgucaagaugcucaaggacuuccucgaggacgacaccgacgucaaccaguaccuccucccccccaagucccuccuccgcuacgcccuccuccucgacaucguccagcccaccugccgccgcuccgucugcuucaccaagggcuacggcuccuacaucgagggcaccggcuccguccuccagaccgccgaggacguccaggucgagaacaucuacaagucccucaccaaccucucccaggaggagcagaucaccaagcuccucauccucaagcuccgcuacuucacccccaaggagaucgccaaccuccucggcuucccccccgaguucggcuuccccgagaagaucaccgucaagcagcgcuaccgccuccucggcaacucccucaacguccacgucgucgccaagcucaucaagauccucuacgaguga

SEQ ID NO: 51120 - RNA, 1386 nt, Artificial Sequence
  derived and/or modified sequence opt2 from TRDN__Homo_sapiens__NP_001238916
augaccgagaucaccgccgagggcaacgccuccaccaccaccaccgucaucgacuccaagaacggcuccguccccaagucccccggcaagguccucaagcgcaccgucaccgaggacaucgucaccaccuucuccucccccgccgccuggcuccucgucaucgcccucaucaucaccugguccgccgucgccaucgucauguucgaccucgucgacuacaagaacuucuccgccuccuccaucgccaagaucggcuccgacccccucaagcucguccgcgacgccauggaggagaccaccgacuggaucuacggcuucuucucccuccucuccgacaucaucuccuccgaggacgaggaggacgacgacggcgacgaggacaccgacaagggcgagaucgacgagcccccccuccgcaagaaggagauccacaaggacaagaccgagaagcaggagaagcccgagcgcaagauccagaccaaggucacccacaaggagaaggagaagggcaaggagaagguccgcgagaaggagaagcccgagaagaaggccacccacaaggagaagaucgagaagaaggagaagcccgagaccaagacccucgccaaggagcagaagaaggccaagaccgccgagaaguccgaggagaagaccaagaaggaggucaagggcggcaagcaggagaaggucaagcagaccgccgccaaggucaaggagguccagaagacccccuccaagcccaaggagaaggaggacaaggagaaggccgccgucuccaagcacgagcagaaggaccaguacgccuucugccgcuacaugaucgacaucuucguccacggcgaccucaagcccggccagucccccgccaucccccccccccuccccaccgagcaggccucccgccccacccccgccucccccgcccucgaggagaaggagggcgagaagaagaaggccgagaagaaggucaccuccgagaccaagaagaaggccgagaaggaggacaucaagaagaaguccgagaaggagaccgccaucgacgucgagaagaaggagcccggcaaggccuccgagaccaagcagggcaccgucaagaucgccgcccaggccgccgccaagaaggacgagaagaaggaggacuccaagaagaccaagaagcccgccgaggucgagcagcccaagggcaagaagcaggagaagaaggagaagcacgucgagcccgccaagucccccaagaaggagcacuccguccccuccgacaagcaggucaaggccaagaccgagcgcgccaaggaggagaucggcgccgucuccaucaagaaggccguccccggcaagaaggaggagaagaccaccaagaccgucgagcagggcaagaagaaguga

SEQ ID NO: 51121 - RNA, 1659 nt, Artificial Sequence
  derived and/or modified sequence opt2 from TREH__Homo_sapiens__NP_001287994
augcccggccgcaccugggagcucugccuccuccuccuccucggccucggccucggcucccaggaggcccuccccccccccugcgaguccgagaucuacugccacggcgagcuccucaaccagguccagauggccaagcucuaccaggacgacaagcaguucgucgacaugccccucuccaucgcccccgagcagguccuccagaccuucaccgagcucucccgcgaccacaaccacuccaucccccgcgagcagcuccaggccuucguccacgagcacuuccaggccaagggccaggagcuccagcccuggacccccgccgacuggaaggacuccccccaguuccuccagaagaucuccgacgccaagcuccgcgccugggccggccagcuccaccagcucuggaagaagcucggcaagaagaugaagcccgagguccucucccaccccgagcgcuucucccucaucuacuccgagcaccccuucaucguccccggcggccgcuucgucgaguucuacuacugcuacggccacguccccaacggcggccgcgucuacuaccuccagcgcucccagcccccccuccucacccucaugauggacugcuaccucacccacaccaacgacaccgccuuccuccaggagaacaucgagacccucgcccucgagcucgacuucuggaccaagaaccgcaccgucuccgucucccucgagggcaagaacuaccuccucaaccgcuacuacguccccuacggcggcccccgccccgaguccuacuccaaggacgucgagcucgccgacacccuccccgagggcgaccgcgaggcccucugggccgagcucaaggccggcgccgaguccggcugggacuucuccucccgcuggcucaucggcggccccaaccccaacucccucuccggcauccgcaccuccaagcucguccccgucgaccucaacgccuuccucugccaggccgaggagcucauguccaacuucuacucccgccucggcaacgacucccaggccaccaaguaccgcauccuccgcucccagcgccucgccgcccucaacaccguccucugggacgagcagaccggcgccugguucgacuacgaccucgagaagaagaagaagaaccgcgaguucuaccccuccaaccucaccccccucugggccggcugcuucuccgaccccggcgucgccgacaaggcccucaaguaccucgaggacaaccgcauccucaccuaccaguacggcauccccaccucccuccagaagaccggccagcagugggacuuccccaacgccugggccccccuccaggaccucgucauccgcggccucgccaaggccccccuccgccgcgcccaggaggucgccuuccagcucgcccagaacuggauccgcaccaacuucgacgucuacucccagaaguccgccauguacgagaaguacgacgucuccaacggcggccagcccggcggcggcggcgaguacgagguccaggagggcuucggcuggaccaacggcgucguccucaugcuccucgaccgcuacggcgaccgccucaccuccggcgccaagcucgccuuccucgagccccacugccucgccgccacccuccuccccucccuccuccucucccuccuccccugguga

SEQ ID NO: 51122 - RNA, 678 nt, Artificial Sequence
  derived and/or modified sequence opt2 from TREM1__Homo_sapiens__NP_001229518
augcgcaagacccgccucuggggccuccucuggaugcucuucgucuccgagcuccgcgccgccaccaagcucaccgaggagaaguacgagcucaaggagggccagacccucgacgucaagugcgacuacacccucgagaaguucgccuccucccagaaggccuggcagaucauccgcgacggcgagaugcccaagacccucgccugcaccgagcgccccuccaagaacucccaccccguccaggucggccgcaucauccucgaggacuaccacgaccacggccuccuccgcguccgcauggucaaccuccaggucgaggacuccggccucuaccagugcgucaucuaccagccccccaaggagccccacaugcucuucgaccgcauccgccucgucgucaccaagggcuucuccggcacccccggcuccaacgagaacuccacccagaacgucuacaagaucccccccaccaccaccaaggcccucugcccccucuacaccuccccccgcaccgucacccaggccccccccaaguccaccgccgacgucuccacccccgacuccgagaucaaccucaccaacgucaccgacaucauccgcuacuccuuccagguccccggcccccucgucuggacccucuccccccucuuccccucccucugcgccgagcgcauguga

SEQ ID NO: 51123 - RNA, 660 nt, Artificial Sequence
  derived and/or modified sequence opt2 from TREM2__Homo_sapiens__NP_001258750
auggagccccuccgccuccucauccuccucuucgucaccgagcucuccggcgcccacaacaccaccgucuuccagggcgucgccggccagucccuccaggucuccugccccuacgacuccaugaagcacuggggccgccgcaaggccuggugccgccagcucggcgagaagggccccugccagcgcgucgucuccacccacaaccucuggcuccucuccuuccuccgccgcuggaacggcuccaccgccaucaccgacgacacccucggcggcacccucaccaucacccuccgcaaccuccagccccacgacgccggccucuaccagugccagucccuccacggcuccgaggccgacacccuccgcaagguccucgucgagguccucgccgacccccucgaccaccgcgacgccggcgaccucugguuccccggcgaguccgaguccuucgaggacgcccacgucgagcacuccaucucccgcgccgagcgccacgucaaggaggacgacggccgcaagucccccggcgaggucccccccggcaccucccccgccugcauccucgccaccuggccccccggccuccucguccuccucuggcaggagaccacccuccccgagcacugcuucuccuggacccucgaggccggcaccggcuga

SEQ ID NO: 51124 - RNA, 600 nt, Artificial Sequence
  derived and/or modified sequence opt2 from TREML1__Homo_sapiens__NP_001258736
augggccucacccuccuccuccuccuccuccucggccucgagggccagggcaucgucggcucccuccccgagguccuccaggcccccgucggcuccuccauccucguccagugccacuaccgccuccaggacgucaaggcccagaaggucuggugccgcuuccuccccgagggcugccagccccucgucuccuccgccgucgaccgccgcgcccccgccggccgccgcaccuuccucaccgaccucggcggcggccuccuccaggucgagauggucacccuccaggaggaggacgccggcgaguacggcugcauggucgacggcgcccgcggcccccagauccuccaccgcgucucccucaacauccucccccccgaggaggaggaggagacccacaagaucggcucccucgccgagaacgccuucuccgaccccgccggcuccgccaacccccucgagcccucccaggacgagaaguccaucccccucaucuggggcgccguccuccucgucggccuccucgucgccgccgucguccucuucgccgucauggccaagcgcaagcaggagucccuccucuccggccccccccgccaguga

SEQ ID NO: 51125 - RNA, 966 nt, Artificial Sequence
  derived and/or modified sequence opt2 from TREML2__Homo_sapiens__NP_079083
auggcccccgccuuccuccuccuccuccuccucuggccccagggcugcgucuccggccccuccgccgacuccgucuacaccaagguccgccuccucgagggcgagacccucuccguccagugcuccuacaagggcuacaagaaccgcgucgagggcaaggucuggugcaagauccgcaagaagaagugcgagcccggcuucgcccgcgucugggucaagggcccccgcuaccuccuccaggacgacgcccaggccaaggucgucaacaucaccauggucgcccucaagcuccaggacuccggccgcuacuggugcaugcgcaacaccuccggcauccucuacccccucaugggcuuccagcucgacgucucccccgccccccagaccgagcgcaacauccccuucacccaccucgacaacauccucaaguccggcaccgucaccaccggccaggcccccaccuccggccccgacgcccccuucaccaccggcgucauggucuucacccccggccucaucacccucccccgccuccucgccuccacccgccccgccuccaagaccggcuacuccuucaccgccaccuccaccaccucccagggcccccgccgcaccaugggcucccagaccgucaccgccucccccuccaacgcccgcgacuccuccgccggccccgaguccaucuccaccaaguccggcgaccucuccacccgcucccccaccaccggccucugccucaccucccgcucccuccucaaccgccuccccuccaugcccuccauccgccaccaggacgucuacuccaccguccucggcgucguccucacccuccucguccucaugcucaucauggucuacggcuucuggaagaagcgccacauggccuccuacuccaugugcuccgaccccuccacccgcgacccccccggccgccccgagcccuacgucgaggucuaccucaucuga

SEQ ID NO: 51126 - RNA, 3603 nt, Artificial Sequence
  derived and/or modified sequence opt2 from TRERF1__Homo_sapiens__XP_006715208
augggcgaccagcagcucuacaagaccaaccacgucgcccacggcuccgagaaccucuucuaccagcagcccccccucggcguccacuccggccucaaccacaacuacggcaacgccgucaccggcggcggcauggacgccccccaggccucccccaucuccccccacuucccccaggacacccgcgacggccucggccuccccgucggcuccaagaaccucggccagauggacaccucccgccagggcggcuggggcucccacgccggccccggcaaccacguccagcuccgcggcaaccucgccaacuccaacaugauguggggcgcccccgcccaggccgagcccaccgacggcuaccaguacaccuacucccaggccuccgagauccgcacccagaagcucaccuccggcguccuccacaagcucgacuccuucacccaggucuucgccaaccagaaccuccgcauccaggucaacaacauggcccagguccuccacacccaguccgccgucauggacggcgcccccgacuccgcccuccgccagcuccucucccagaagcccauggagccccccgcccccgccauccccucccgcuaccagcaggucccccagcagccccaccccggcuucaccggcggccucuccaagcccgcccuccaggucggccagcaccccacccagggccaccucuacuacgacuaccagcagccccucgcccagguccccguccagggcggccagccccuccaggccccccagaugcucucccagcacaugcagcagaugcagcagcaccaguacuaccccccccagcagcagcagcaggccggccagcagcgcaucuccaugcaggagauccagacccagccccagcagauccgccccucccagccccagccccccccccagcagcagcagccccagcagcuccagcuccagcagcgccagggcuccaugcagaucccccaguacuaccagccccagcccaugaugcagcaccuccaggagcagcagcagcagcagaugcaccuccagccccccuccuaccaccgcgacccccaccaguacacccccgagcaggcccacaccguccagcucaucccccucggcuccaugucccaguacuacuaccaggagccccagcagcccuacucccacccccucuaccagcagucccaccucucccagcaccagcagcgcgaggacucccagcucaagaccuacuccuccgaccgccaggcccaggccaugcucuccucccacggcgaccucggcccccccgacaccggcaugggcgaccccgccuccuccgaccucacccgcgucuccuccacccucccccaccgcccccuccucucccccuccggcauccaccucaacaacaugggcccccagcaccagcagcucucccccuccgccauguggccccagaugcaccuccccgacggccgcgcccagcccggcucccccgaguccuccggccagcccaagggcgccuucggcgagcaguucgacgccaagaacaagcucaccugcuccaucugccucaaggaguucaagaaccuccccgcccucaacggccacaugcgcucccacggcggcaugcgcgccucccccaaccucaagcaggaggagggcgagaagguccuccccccccagccccagcccccccuccccccccccccccccccccccccccccccccagcucccccccgaggccgagucccucacccccauggucaugcccgucuccguccccgucaagcuccucccccccaagcccuccucccagggcuucaccaacuccaccgucgccgcccccuccgcccgcgacaagcccgccuccuccauguccgacgacgagaugcccguccucgagaucccccgcaagcaccagcccuccguccccaaggccgaggagccccucaagaccguccaggagaagaagaaguuccgccaccgccccgagccccucuucaucccccccccccccuccuacaaccccaaccccgccgccuccuacuccggcgccacccucuaccagucccagcuccgcuccccccgcguccucggcgaccaccuccuccucgaccccacccacgagcucccccccuacacccccccccccaugcucucccccguccgccagggcuccggccucuucuccaacguccucaucuccggccacggccccggcgcccacccccagcucccccucaccccccucacccccaccccccgcguccuccucugccgcuccaacuccaucgacggcuccaacgucaccgucacccccggccccggcgagcagaccgucgacgucgagccccgcaucaacaucggccuccgcuuccaggccgagauccccgagcuccaggacaucuccgcccucgcccaggacacccacaaggccacccucgucuggaagcccuggcccgagcucgagaaccacgaccuccagcagcgcgucgagaaccuccucaaccucugcugcuccuccgcccuccccggcggcggcaccaacuccgaguucgcccuccacucccucuucgaggccaagggcgacgucauggucgcccucgagaugcuccuccuccgcaagcccguccgccucaagugccacccccucgccaacuaccacuacgccggcuccgacaaguggaccucccucgagcgcaagcucuucaacaaggcccucgccaccuacuccaaggacuucaucuucguccagaagauggucaaguccaagaccgucgcccagugcgucgaguacuacuacaccuggaagaagaucaugcgccucggccgcaagcaccgcacccgccucgccgagaucaucgacgacugcgucaccuccgaggaggaggaggagcucgaggaggaggaggaggaggaccccgaggaggaccgcaaguccaccaaggaggaggaguccgagguccccaagucccccgagcccccccccguccccguccucgcccccaccgagggccccccccuccaggcccucggccagcccuccggcuccuucaucugcgagaugcccaacugcggcgccgucuucuccucccgccaggcccucaacggccacgcccgcauccacggcggcaccaaccaggucaccaaggcccgcggcgccauccccuccggcaagcagaagcccggcggcacccaguccggcuacugcuccgucaaguccucccccucccacuccaccaccuccggcgagaccgaccccaccaccaucuuccccugcaaggagugcggcaaggucuucuucaagaucaagucccgcaacgcccacaugaagacccaccgccagcaggaggagcagcagcgccagaaggcccagaaggccgccuucgccgccgagauggccgccaccaucgagcgcaccaccggccccgucggcgcccccggccuccucccccucgaccagcucucccucaucaagcccaucaaggacgucgacauccucgacgacgacgucguccagcagcucggcggcgucauggaggaggccgaggucgucgacaccgaccuccuccucgacgaccaggacuccguccuccuccagggcgacgccgagcucuga

SEQ ID NO: 51127 - RNA, 915 nt, Artificial Sequence
  derived and/or modified sequence opt2 from TREX1__Homo_sapiens__NP_009179
augcagacccucaucuucuucgacauggaggccaccggccuccccuucucccagcccaaggucaccgagcucugccuccucgccguccaccgcugcgcccucgaguccccccccaccucccagggccccccccccaccguccccccccccccccgcgucgucgacaagcucucccucugcgucgcccccggcaaggccugcucccccgccgccuccgagaucaccggccucuccaccgccguccucgccgcccacggccgccagugcuucgacgacaaccucgccaaccuccuccucgccuuccuccgccgccagccccagcccuggugccucgucgcccacaacggcgaccgcuacgacuucccccuccuccaggccgagcucgccaugcucggccucaccuccgcccucgacggcgccuucugcgucgacuccaucaccgcccucaaggcccucgagcgcgccuccucccccuccgagcacggcccccgcaaguccuacucccucggcuccaucuacacccgccucuacggccaguccccccccgacucccacaccgccgagggcgacguccucgcccuccucuccaucugccaguggcgcccccaggcccuccuccgcugggucgacgcccacgcccgccccuucggcaccauccgccccauguacggcgucaccgccuccgcccgcaccaagccccgccccuccgccgucaccaccaccgcccaccucgccaccacccgcaacaccucccccucccucggcgagucccgcggcaccaaggaccucccccccgucaaggaccccggcgcccucucccgcgagggccuccucgccccccucggccuccucgccauccucacccucgccgucgccacccucuacggccucucccucgccacccccggcgaguga

SEQ ID NO: 51128 - RNA, 711 nt, Artificial Sequence
  derived and/or modified sequence opt2 from TREX2__Homo_sapiens__NP_542432
auguccgaggccccccgcgccgagaccuucgucuuccucgaccucgaggccaccggccuccccuccgucgagcccgagaucgccgagcucucccucuucgccguccaccgcuccucccucgagaaccccgagcacgacgaguccggcgcccucguccucccccgcguccucgacaagcucacccucugcaugugccccgagcgccccuucaccgccaaggccuccgagaucaccggccucuccuccgagggccucgcccgcugccgcaaggccggcuucgacggcgccgucguccgcacccuccaggccuuccucucccgccaggccggccccaucugccucgucgcccacaacggcuucgacuacgacuucccccuccucugcgccgagcuccgccgccucggcgcccgccucccccgcgacaccgucugccucgacacccuccccgcccuccgcggccucgaccgcgcccacucccacggcacccgcgcccgcggccgccagggcuacucccucggcucccucuuccaccgcuacuuccgcgccgagcccuccgccgcccacuccgccgagggcgacguccacacccuccuccucaucuuccuccaccgcgccgccgagcuccucgccugggccgacgagcaggcccgcggcugggcccacaucgagcccauguaccucccccccgacgaccccucccucgaggccuga

SEQ ID NO: 51129 - RNA, 3075 nt, Artificial Sequence
  derived and/or modified sequence opt2 from TRHDE__Homo_sapiens__NP_037513
augggcgaggacgacgccgcccuccgcgccggcucccgcggccucuccgaccccugggccgacuccgucggcguccgcccccgcaccaccgagcgccacaucgccguccacaagcgccucguccucgccuucgccgucucccucgucgcccuccucgccgucaccaugcucgccguccuccucucccuccgcuucgacgagugcggcgccuccgccacccccggcgccgacggcggccccuccggcuuccccgagcgcggcggcaacggcucccuccccggcuccgcccgccgcaaccaccacgccggcggcgacuccuggcagcccgaggccggcggcgucgccucccccggcaccaccuccgcccagccccccuccgaggaggagcgcgagcccugggagcccuggacccagcuccgccucuccggccaccucaagccccuccacuacaaccucaugcucaccgccuucauggagaacuucaccuucuccggcgaggucaacgucgagaucgccugccgcaacgccacccgcuacgucguccuccacgccucccgcgucgccgucgagaagguccagcucgccgaggaccgcgccuucggcgccguccccgucgccggcuucuuccucuacccccagacccagguccucgucgucguccucaaccgcacccucgacgcccagcgcaacuacaaccucaagaucaucuacaacgcccucaucgagaacgagcuccucggcuucuuccgcuccuccuacguccuccacggcgagcgccgcuuccucggcgucacccaguucucccccacccacgcccgcaaggccuuccccugcuucgacgagcccaucuacaaggccaccuucaagaucuccaucaagcaccaggccaccuaccucucccucuccaacaugcccgucgagaccuccgucuucgaggaggacggcugggucaccgaccacuucucccagaccccccucauguccaccuacuaccucgccugggccaucugcaacuucaccuaccgcgagaccaccaccaaguccggcgucgucguccgccucuacgcccgccccgacgccauccgccgcggcuccggcgacuacgcccuccacaucaccaagcgccucaucgaguucuacgaggacuacuucaagguccccuacucccuccccaagcucgaccuccucgccguccccaagcaccccuacgccgccauggagaacuggggccucuccaucuucgucgagcagcgcauccuccucgaccccuccgucuccuccaucuccuaccuccucgacgucaccauggucaucguccacgagaucugccaccagugguucggcgaccucgucacccccgucuggugggaggacgucuggcucaaggagggcuucgcccacuacuucgaguucgucggcaccgacuaccucuaccccggcuggaacauggagaagcagcgcuuccucaccgacguccuccacgaggucaugcuccucgacggccucgccuccucccaccccgucucccaggagguccuccaggccaccgacaucgaccgcgucuucgacuggaucgccuacaagaagggcgccgcccucauccgcaugcucgccaacuucaugggccacuccgucuuccagcgcggccuccaggacuaccucaccauccacaaguacggcaacgccgcccgcaacgaccucuggaacacccucuccgaggcccucaagcgcaacggcaaguacgucaacauccaggaggucauggaccaguggacccuccagaugggcuaccccgucaucaccauccucggcaacaccaccgccgagaaccgcaucaucaucacccagcagcacuucaucuacgacaucuccgccaagaccaaggcccucaagcuccagaacaacuccuaccucuggcagaucccccucaccaucgucgucggcaaccgcucccacgucuccuccgaggccaucaucugggucuccaacaaguccgagcaccaccgcaucaccuaccucgacaagggcuccuggcuccucggcaacaucaaccagaccggcuacuuccgcgucaacuacgaccuccgcaacuggcgccuccucaucgaccagcucauccgcaaccacgagguccucuccgucuccaaccgcgccggccucaucgacgacgccuucucccucgcccgcgccggcuaccucccccagaacaucccccucgagaucauccgcuaccucuccgaggagaaggacuuccuccccuggcacgccgccucccgcgcccucuacccccucgacaagcuccucgaccgcauggagaacuacaacaucuucaacgaguacauccucaagcaggucgccaccaccuacaucaagcucggcuggcccaagaacaacuucaacggcucccucguccaggccuccuaccagcacgaggagcuccgccgcgaggucaucaugcucgccugcuccuucggcaacaagcacugccaccagcaggccuccacccucaucuccgacuggaucuccuccaaccgcaaccgcaucccccucaacguccgcgacaucgucuacugcaccggcgucucccuccucgacgaggacgucugggaguucaucuggaugaaguuccacuccaccaccgccgucuccgagaagaagauccuccucgaggcccucaccugcuccgacgaccgcaaccuccucaaccgccuccucaaccucucccucaacuccgaggucguccucgaccaggacgccaucgacgucaucauccacgucgcccgcaacccccacggccgcgaccucgccuggaaguucuuccgcgacaaguggaagauccucaacacccgcuacggcgaggcccucuucaugaacuccaagcucaucuccggcgucaccgaguuccucaacaccgagggcgagcucaaggagcucaagaacuucaugaagaacuacgacggcgucgccgccgccuccuucucccgcgccgucgagaccgucgaggccaacguccgcuggaagaugcucuaccaggacgagcucuuccaguggcucggcaaggcccuccgccacuga

SEQ ID NO: 51130 - RNA, 729 nt, Artificial Sequence
  derived and/or modified sequence opt2 from TRH__Homo_sapiens__NP_009048
augcccggccccuggcuccuccucgcccucgcccucacccucaaccucaccggcguccccggcggccgcgcccagcccgaggccgcccagcaggaggccgucaccgccgccgagcaccccggccucgacgacuuccuccgccaggucgagcgccuccucuuccuccgcgagaacauccagcgccuccagggcgaccagggcgagcacuccgccucccagaucuuccaguccgacuggcucuccaagcgccagcaccccggcaagcgcgaggaggaggaggaggagggcgucgaggaggaggaggaggaggagggcggcgccgucggcccccacaagcgccagcaccccggccgccgcgaggacgaggccuccugguccgucgacgucacccagcacaagcgccagcaccccggccgccgcucccccuggcucgccuacgccguccccaagcgccagcaccccggccgccgccucgccgaccccaaggcccagcgcuccugggaggaggaggaggaggaggaggagcgcgaggaggaccucaugcccgagaagcgccagcaccccggcaagcgcgcccucggcggccccugcggcccccagggcgccuacggccaggccggccuccuccucggccuccucgacgaccucucccgcucccagggcgccgaggagaagcgccagcaccccggccgccgcgccgccuggguccgcgagccccucgaggaguga

SEQ ID NO: 51131 - RNA, 1197 nt, Artificial Sequence
  derived and/or modified sequence opt2 from TRHR__Homo_sapiens__XP_011515565
auggagaacgagaccgucuccgagcucaaccagacccagcuccagccccgcgccgucgucgcccucgaguaccaggucgucaccauccuccucguccucaucaucugcggccucggcaucgucggcaacaucauggucguccucgucgucaugcgcaccaagcacaugcgcacccccaccaacugcuaccucgucucccucgccgucgccgaccucaugguccucgucgccgccggccuccccaacaucaccgacuccaucuacggcuccugggucuacggcuacgucggcugccucugcaucaccuaccuccaguaccucggcaucaacgccuccuccugcuccaucaccgccuucaccaucgagcgcuacaucgccaucugccaccccaucaaggcccaguuccucugcaccuucucccgcgccaagaagaucaucaucuucgucugggccuucaccucccucuacugcaugcucugguucuuccuccucgaccucaacaucuccaccuacaaggacgccaucgucaucuccugcggcuacaagaucucccgcaacuacuacucccccaucuaccucauggacuucggcgucuucuacgucguccccaugauccucgccaccguccucuacggcuucaucgcccgcauccucuuccucaaccccauccccuccgaccccaaggagaacuccaagaccuggaagaacgacuccacccaccagaacaccaaccucaacgucaacaccuccaaccgcugcuucaacuccaccgucuccucccgcaagcaggucaccaagaugcucgccgucgucgucauccucuucgcccuccucuggaugcccuaccgcacccucgucgucgucaacuccuuccucuccucccccuuccaggagaacugguuccuccucuucugccgcaucugcaucuaccucaacuccgccaucaaccccgucaucuacaaccucaugucccagaaguuccgcgccgccuuccgcaagcucugcaacugcaagcagaagcccaccgagaagcccgccaacuacuccgucgcccucaacuacuccgucaucaaggaguccgaccacuucuccaccgagcucgacgacaucaccgucaccgacaccuaccucuccgccaccaaggucuccuucgacgacaccugccucgccuccgaggucuccuucucccaguccuga

SEQ ID NO: 51132 - RNA, 231 nt, Artificial Sequence
  derived and/or modified sequence opt2 from TRIAP1__Homo_sapiens__NP_057483
augaacuccgucggcgaggccugcaccgacaugaagcgcgaguacgaccagugcuucaaccgcugguucgccgagaaguuccucaagggcgacuccuccggcgaccccugcaccgaccucuucaagcgcuaccagcagugcguccagaaggccaucaaggagaaggagauccccaucgagggccucgaguucaugggccacggcaaggagaagcccgagaacuccuccuga

SEQ ID NO: 51133 - RNA, 1119 nt, Artificial Sequence
  derived and/or modified sequence opt2 from TRIB1__Homo_sapiens__NP_079471
augcgcgucggccccguccgcuccgccauguccggcgccucccagccccgcggccccgcccuccucuuccccgccacccgcggcguccccgccaagcgccuccucgacgccgacgacgccgccgccgucgccgccaagugcccccgccucuccgagugcuccuccccccccgacuaccucuccccccccggcucccccugcuccccccagcccccccccgccgcccccggcgccggcggcggcuccggcuccgcccccggccccucccgcaucgccgacuaccuccuccucccccucgccgagcgcgagcacgucucccgcgcccucugcauccacaccggccgcgagcuccgcugcaaggucuuccccaucaagcacuaccaggacaagauccgccccuacauccagcuccccucccacuccaacaucaccggcaucgucgaggucauccucggcgagaccaaggccuacgucuucuucgagaaggacuucggcgacaugcacuccuacguccgcucccgcaagcgccuccgcgaggaggaggccgcccgccucuucaagcagaucgucuccgccgucgcccacugccaccaguccgccaucguccucggcgaccucaagcuccgcaaguucgucuucuccaccgaggagcgcacccagcuccgccucgagucccucgaggacacccacaucaugaagggcgaggacgacgcccucuccgacaagcacggcugccccgccuacgucucccccgagauccucaacaccaccggcaccuacuccggcaaggccgccgacgucuggucccucggcgucaugcucuacacccuccucgucggccgcuaccccuuccacgacuccgaccccuccgcccucuucuccaagauccgccgcggccaguucugcauccccgagcacaucucccccaaggcccgcugccucauccgcucccuccuccgccgcgagcccuccgagcgccucaccgcccccgagauccuccuccaccccugguucgaguccguccucgagcccggcuacaucgacuccgagaucggcaccuccgaccagaucguccccgaguaccaggaggacuccgacaucuccuccuucuucugcuga

SEQ ID NO: 51134 - RNA, 1032 nt, Artificial Sequence
  derived and/or modified sequence opt2 from TRIB2__Homo_sapiens__NP_067675
augaacauccaccgcuccacccccaucaccaucgcccgcuacggccgcucccgcaacaagacccaggacuucgaggagcucuccuccauccgcuccgccgagcccucccaguccuucucccccaaccucggcucccccuccccccccgagacccccaaccucucccacugcgucuccugcaucggcaaguaccuccuccucgagccccucgagggcgaccacgucuuccgcgccguccaccuccacuccggcgaggagcucgucugcaaggucuucgacaucuccugcuaccaggagucccucgcccccugcuucugccucuccgcccacuccaacaucaaccagaucaccgagaucauccucggcgagaccaaggccuacgucuucuucgagcgcuccuacggcgacaugcacuccuucguccgcaccugcaagaagcuccgcgaggaggaggccgcccgccucuucuaccagaucgccuccgccgucgcccacugccacgacggcggccucguccuccgcgaccucaagcuccgcaaguucaucuucaaggacgaggagcgcacccgcgucaagcucgagucccucgaggacgccuacauccuccgcggcgacgacgacucccucuccgacaagcacggcugccccgccuacgucucccccgagauccucaacaccuccggcuccuacuccggcaaggccgccgacgucuggucccucggcgucaugcucuacaccaugcucgucggccgcuaccccuuccacgacaucgagcccuccucccucuucuccaagauccgccgcggccaguucaacauccccgagacccucucccccaaggccaagugccucauccgcuccauccuccgccgcgagcccuccgagcgccucaccucccaggagauccucgaccaccccugguucuccaccgacuucuccgucuccaacuccgccuacggcgccaaggaggucuccgaccagcucguccccgacgucaacauggaggagaaccucgaccccuucuucaacuga

SEQ ID NO: 51135 - RNA, 1077 nt, Artificial Sequence
  derived and/or modified sequence opt2 from TRIB3__Homo_sapiens__NP_001288117
augcgcgccaccccccucgccgcccccgccggcucccucucccgcaagaagcgccucgagcucgacgacaaccucgacaccgagcgccccguccagaagcgcgcccgcuccggcccccagccccgccucccccccugccuccucccccucuccccccccaccgcccccgaccgcgccaccgccgucgccaccgccucccgccucggccccuacguccuccucgagcccgaggagggcggccgcgccuaccaggcccuccacugccccaccggcaccgaguacaccugcaaggucuaccccguccaggaggcccucgccguccucgagcccuacgcccgccuccccccccacaagcacgucgcccgccccaccgagguccucgccggcacccagcuccucuacgccuucuucacccgcacccacggcgacaugcacucccucguccgcucccgccaccgcauccccgagcccgaggccgccguccucuuccgccagauggccaccgcccucgcccacugccaccagcacggccucguccuccgcgaccucaagcucugccgcuucgucuucgccgaccgcgagcgcaagaagcucguccucgagaaccucgaggacuccugcguccucaccggccccgacgacucccucugggacaagcacgccugccccgccuacgucggccccgagauccucuccucccgcgccuccuacuccggcaaggccgccgacgucuggucccucggcgucgcccucuucaccaugcucgccggccacuaccccuuccaggacuccgagcccguccuccucuucggcaagauccgccgcggcgccuacgcccuccccgccggccucuccgcccccgcccgcugccucguccgcugccuccuccgccgcgagcccgccgagcgccucaccgccaccggcauccuccuccaccccuggcuccgccaggaccccaugccccucgcccccacccgcucccaccucugggaggccgcccaggucguccccgacggccucggccucgacgaggcccgcgaggaggagggcgaccgcgaggucguccucuacggcuga

SEQ ID NO: 51136 - RNA, 1446 nt, Artificial Sequence
  derived and/or modified sequence opt2 from TRIM10__Homo_sapiens__NP_006769
auggccuccgccgccuccgucaccucccucgccgacgaggucaacugccccaucugccagggcacccuccgcgagcccgucaccaucgacugcggccacaacuucugccgcgccugccucacccgcuacugcgagauccccggccccgaccucgaggagucccccaccugcccccucugcaaggagcccuuccgccccggcuccuuccgccccaacuggcagcucgccaacgucgucgagaacaucgagcgccuccagcucgucuccacccucggccucggcgaggaggacgucugccaggagcacggcgagaagaucuacuucuucugcgaggacgacgagaugcagcucugcgucgucugccgcgaggccggcgagcacgccacccacaccaugcgcuuccucgaggacgccgccgcccccuaccgcgagcagauccacaagugccucaagugccuccgcaaggagcgcgaggagauccaggagauccagucccgcgagaacaagcgcaugcagguccuccucacccaggucuccaccaagcgccagcaggucaucuccgaguucgcccaccuccgcaaguuccucgaggagcagcaguccauccuccucgcccagcucgagucccaggacggcgacauccuccgccagcgcgacgaguucgaccuccucgucgccggcgagaucugccgcuucuccgcccucaucgaggagcucgaggagaagaacgagcgccccgcccgcgagcuccucaccgacauccgcuccacccucauccgcugcgagacccgcaagugccgcaagcccgucgccgucucccccgagcucggccagcgcauccgcgacuucccccagcaggcccucccccuccagcgcgagaugaagauguuccucgagaagcucugcuucgagcucgacuacgagcccgcccacaucucccucgacccccagaccucccaccccaagcuccuccucuccgaggaccaccagcgcgcccaguucuccuacaaguggcagaacucccccgacaacccccagcgcuucgaccgcgccaccugcguccucgcccacaccggcaucaccggcggccgccacaccugggucgucuccaucgaccucgcccacggcggcuccugcaccgucggcgucgucuccgaggacguccagcgcaagggcgagcuccgccuccgccccgaggagggcgucugggccguccgccucgccuggggcuucgucuccgcccucggcuccuuccccacccgccucacccucaaggagcagccccgccagguccgcgucucccucgacuacgaggucggcugggucaccuucaccaacgccgucacccgcgagcccaucuacaccuucaccgccuccuucacccgcaaggucauccccuucuucggccucuggggccgcggcuccuccuucucccucuccuccuga

SEQ ID NO: 51137 - RNA, 1407 nt, Artificial Sequence
  derived and/or modified sequence opt2 from TRIM11__Homo_sapiens__NP_660215
auggccgcccccgaccucuccaccaaccuccaggaggaggccaccugcgccaucugccucgacuacuucaccgaccccgucaugaccgacugcggccacaacuucugccgcgagugcauccgccgcugcuggggccagcccgagggccccuacgccugccccgagugccgcgagcucuccccccagcgcaaccuccgccccaaccgcccccucgccaagauggccgagauggcccgccgccuccacccccccucccccgucccccagggcgucugccccgcccaccgcgagccccucgccgccuucugcggcgacgagcuccgccuccucugcgccgccugcgagcgcuccggcgagcacugggcccaccgcguccgcccccuccaggacgccgccgaggaccucaaggccaagcucgagaagucccucgagcaccuccgcaagcagaugcaggacgcccuccucuuccaggcccaggccgacgagaccugcguccucuggcagaagauggucgagucccagcgccagaacguccucggcgaguucgagcgccuccgccgccuccucgccgaggaggagcagcagcuccuccagcgccucgaggaggaggagcucgagguccucccccgccuccgcgagggcgccgcccaccucggccagcaguccgcccaccucgccgagcucaucgccgagcucgagggccgcugccagcuccccgcccucggccuccuccaggacaucaaggacgcccuccgccgcguccaggacgucaagcuccagccccccgaggucguccccauggagcuccgcaccgucugccgcguccccggccucgucgagacccuccgccgcuuccgcggcgacgucacccucgaccccgacaccgccaaccccgagcucauccucuccgaggaccgccgcuccguccagcgcggcgaccuccgccaggcccuccccgacucccccgagcgcuucgaccccggccccugcguccucggccaggagcgcuucaccuccggccgccacuacugggaggucgaggucggcgaccgcaccuccugggcccucggcgucugccgcgagaacgucaaccgcaaggagaagggcgagcucuccgccggcaacggcuucuggauccucgucuuccucggcuccuacuacaacuccuccgagcgcgcccucgccccccuccgcgaccccccccgccgcgucggcaucuuccucgacuacgaggccggccaccucuccuucuacuccgccaccgacggcucccuccucuucaucuuccccgagauccccuucuccggcacccuccgcccccucuucuccccccucuccuccucccccacccccaugaccaucugccgccccaagggcggcuccggcgacacccucgccccccaguga

SEQ ID NO: 51138 - RNA, 1233 nt, Artificial Sequence
  derived and/or modified sequence opt2 from TRIM13__Homo_sapiens__NP_001007279
auggacgucauggagcuccucgaggaggaccucaccugccccaucugcugcucccucuucgacgacccccgcguccuccccugcucccacaacuucugcaagaagugccucgagggcauccucgagggcuccguccgcaacucccucuggcgccccgcccccuucaagugccccaccugccgcaaggagaccuccgccaccggcaucaacucccuccaggucaacuacucccucaagggcaucgucgagaaguacaacaagaucaagaucucccccaagaugcccgucugcaagggccaccucggccagccccucaacaucuucugccucaccgacaugcagcucaucugcggcaucugcgccacccgcggcgagcacaccaagcacgucuucugcuccaucgaggacgccuacgcccaggagcgcgacgccuucgagucccucuuccaguccuucgagaccuggcgccgcggcgacgcccucucccgccucgacacccucgagaccuccaagcgcaagucccuccagcuccucaccaaggacuccgacaaggucaaggaguucuucgagaagcuccagcacacccucgaccagaagaagaacgagauccucuccgacuucgagaccaugaagcucgccgucaugcaggccuacgaccccgagaucaacaagcucaacaccauccuccaggagcagcgcauggccuucaacaucgccgaggccuucaaggacgucuccgagcccaucgucuuccuccagcagaugcaggaguuccgcgagaagaucaaggucaucaaggagaccccccucccccccuccaaccuccccgccuccccccucaugaagaacuucgacaccucccagugggaggacaucaagcucgucgacgucgacaagcucucccucccccaggacaccggcaccuucaucuccaagauccccugguccuucuacaagcucuuccuccucauccuccuccucggccucgucaucgucuucggccccaccauguuccucgaguggucccucuucgacgaccucgccaccuggaagggcugccucuccaacuucuccuccuaccucaccaagaccgccgacuucaucgagcaguccgucuucuacugggagcaggucaccgacggcuucuucaucuucaacgagcgcuucaagaacuucacccucgucguccucaacaacgucgccgaguucgucugcaaguacaagcuccucuga

SEQ ID NO: 51139 - RNA, 1398 nt, Artificial Sequence
  derived and/or modified sequence opt2 from TRIM15__Homo_sapiens__NP_150232
augcccgccacccccucccucaaggucguccacgagcuccccgccugcacccucugcgccggcccccucgaggacgccgucaccauccccugcggccacaccuucugccgccucugccuccccgcccucucccagaugggcgcccaguccuccggcaagauccuccucugcccccucugccaggaggaggagcaggccgagacccccauggcccccgucccccucggcccccucggcgagaccuacugcgaggagcacggcgagaagaucuacuucuucugcgagaacgacgccgaguuccucugcgucuucugccgcgagggccccacccaccaggcccacaccgucggcuuccucgacgaggccauccagcccuaccgcgaccgccuccgcucccgccucgaggcccucuccaccgagcgcgacgagaucgaggacgucaagugccaggaggaccagaagcuccagguccuccucacccagaucgaguccaagaagcaccaggucgagaccgccuucgagcgccuccagcaggagcucgagcagcagcgcugccuccuccucgcccgccuccgcgagcucgagcagcagaucuggaaggagcgcgacgaguacaucaccaaggucuccgaggaggucacccgccucggcgcccaggucaaggagcucgaggagaagugccagcagcccgccuccgagcuccuccaggacguccgcgucaaccagucccgcugcgagaugaagaccuucgucucccccgaggccaucucccccgaccucgucaagaagauccgcgacuuccaccgcaagauccucacccuccccgagaugaugcgcauguucuccgagaaccucgcccaccaccucgagaucgacuccggcgucaucacccucgacccccagaccgccucccgcucccucguccucuccgaggaccgcaaguccguccgcuacacccgccagaagaagucccuccccgacuccccccuccgcuucgacggccuccccgccguccucggcuuccccggcuucuccuccggccgccaccgcuggcaggucgaccuccagcucggcgacggcggcggcugcaccgucggcgucgccggcgagggcguccgccgcaagggcgagaugggccucuccgccgaggacggcgucugggccgucaucaucucccaccagcagugcugggccuccaccucccccggcaccgaccucccccucuccgagaucccccgcggcguccgcgucgcccucgacuacgaggccggccaggucacccuccacaacgcccagacccaggagcccaucuucaccuucaccgccuccuucuccggcaaggucuuccccuucuucgccgucuggaagaagggcuccugccucacccucaagggcuga

SEQ ID NO: 51140 - RNA, 1695 nt, Artificial Sequence
  derived and/or modified sequence opt2 from TRIM16__Homo_sapiens__NP_006461
auggccgagcucgaccucauggcccccggcccccucccccgcgccaccgcccagccccccgccccccucucccccgacuccggcucccccucccccgacuccggcuccgccucccccgucgaggaggaggacgucggcuccuccgagaagcucggccgcgagaccgaggagcaggacuccgacuccgccgagcagggcgaccccgccggcgagggcaaggagguccucugcgacuucugccucgacgacacccgccgcgucaaggccgucaaguccugccucaccugcauggucaacuacugcgaggagcaccuccagccccaccaggucaacaucaagcuccagucccaccuccucaccgagcccgucaaggaccacaacuggcgcuacugccccgcccaccacuccccccucuccgccuucugcugccccgaccagcagugcaucugccaggacugcugccaggagcacuccggccacaccaucgucucccucgacgccgcccgccgcgacaaggaggccgagcuccagugcacccagcucgaccucgagcgcaagcucaagcucaacgagaacgccaucucccgccuccaggccaaccagaaguccguccucgucuccgucuccgaggucaaggccgucgccgagaugcaguucggcgagcuccucgccgccguccgcaaggcccaggccaacgucaugcucuuccucgaggagaaggagcaggccgcccucucccaggccaacggcaucaaggcccaccucgaguaccgcuccgccgagauggagaaguccaagcaggagcucgagcgcauggccgccaucuccaacaccguccaguuccucgaggaguacugcaaguucaagaacaccgaggacaucaccuuccccuccgucuacgucggccucaaggacaagcucuccggcauccgcaaggucaucaccgaguccaccguccaccucauccagcuccucgagaacuacaagaagaagcuccaggaguucuccaaggaggaggaguacgacauccgcacccaggucuccgccgucguccagcgcaaguacuggaccuccaagcccgagcccuccacccgcgagcaguuccuccaguacgccuacgacaucaccuucgaccccgacaccgcccacaaguaccuccgccuccaggaggagaaccgcaaggucaccaacaccacccccugggagcaccccuaccccgaccuccccucccgcuuccuccacuggcgccagguccucucccagcagucccucuaccuccaccgcuacuacuucgaggucgagaucuucggcgccggcaccuacgucggccucaccugcaagggcaucgaccgcaagggcgaggagcgcaacuccugcaucuccggcaacaacuucuccuggucccuccaguggaacggcaaggaguucaccgccugguacuccgacauggagaccccccucaaggccggccccuuccgccgccucggcgucuacaucgacuuccccggcggcauccucuccuucuacggcgucgaguacgacaccaugacccucguccacaaguucgccugcaaguucuccgagcccgucuacgccgccuucuggcucuccaagaaggagaacgccauccgcaucgucgaccucggcgaggagcccgagaagcccgcccccucccucgucggcaccgcccccuga

SEQ ID NO: 51141 - RNA, 1434 nt, Artificial Sequence
  derived and/or modified sequence opt2 from TRIM17__Homo_sapiens__NP_001020111
auggaggccgucgagcucgcccgcaagcuccaggaggaggccaccugcuccaucugccucgacuacuucaccgaccccgucaugaccaccugcggccacaacuucugccgcgccugcauccagcucuccugggagaaggcccgcggcaagaagggccgccgcaagcgcaagggcuccuuccccugccccgagugccgcgagauguccccccagcgcaaccuccuccccaaccgccuccucaccaaggucgccgagauggcccagcagcaccccggccuccagaagcaggaccucugccaggagcaccacgagccccucaagcucuucugccagaaggaccagucccccaucugcgucgucugccgcgagucccgcgagcaccgccuccaccgcguccuccccgccgaggaggccguccagggcuacaagcucaagcucgaggaggacauggaguaccuccgcgagcagaucacccgcaccggcaaccuccaggcccgcgaggagcagucccucgccgaguggcagggcaaggucaaggagcgccgcgagcgcaucguccucgaguucgagaagaugaaccucuaccucgucgaggaggagcagcgccuccuccaggcccucgagaccgaggaggaggagaccgccucccgccuccgcgaguccgucgccugccucgaccgccagggccacucccucgagcuccuccuccuccagcucgaggagcgcuccacccagggcccccuccagaugcuccaggacaugaaggagccccucucccgcaagaacaacgucuccguccagugccccgaggucgccccccccacccgcccccgcaccgucugccgcguccccggccagaucgagguccuccgcggcuuccucgaggacgucguccccgacgccaccuccgccuaccccuaccuccuccucuacgagucccgccagcgccgcuaccucggcuccucccccgagggcuccggcuucugcuccaaggaccgcuucgucgccuaccccugcgccgucggccagaccgccuucuccuccggccgccacuacugggaggucggcaugaacaucaccggcgacgcccucugggcccucggcgucugccgcgacaacgucucccgcaaggaccgcguccccaagugccccgagaacggcuucugggucguccagcucuccaagggcaccaaguaccucuccaccuucuccgcccucacccccgucaugcucauggagccccccucccacaugggcaucuuccucgacuucgaggccggcgaggucuccuucuacuccgucuccgacggcucccaccuccacaccuacucccaggccaccuuccccggcccccuccagcccuucuucugccucggcgcccccaaguccggccagauggucaucuccaccgucaccaugugggucaagggcuga

SEQ ID NO: 51142 - RNA, 1428 nt, Artificial Sequence
  derived and/or modified sequence opt2 from TRIM21__Homo_sapiens__NP_003132
auggccuccgccgcccgccucaccaugaugugggaggaggucaccugccccaucugccucgaccccuucgucgagcccgucuccaucgagugcggccacuccuucugccaggagugcaucucccaggucggcaagggcggcggcuccgucugccccgucugccgccagcgcuuccuccucaagaaccuccgccccaaccgccagcucgccaacauggucaacaaccucaaggagaucucccaggaggcccgcgagggcacccagggcgagcgcugcgccguccacggcgagcgccuccaccucuucugcgagaaggacggcaaggcccucugcugggucugcgcccagucccgcaagcaccgcgaccacgccauggucccccucgaggaggccgcccaggaguaccaggagaagcuccaggucgcccucggcgagcuccgccgcaagcaggagcucgccgagaagcucgaggucgagaucgccaucaagcgcgccgacuggaagaagaccgucgagacccagaagucccgcauccacgccgaguucguccagcagaagaacuuccucgucgaggaggagcagcgccagcuccaggagcucgagaaggacgagcgcgagcagcuccgcauccucggcgagaaggaggccaagcucgcccagcagucccaggcccuccaggagcucaucuccgagcucgaccgccgcugccacuccuccgcccucgagcuccuccaggaggucaucaucguccucgagcgcuccgaguccuggaaccucaaggaccucgacaucaccucccccgagcuccgcuccgucugccacguccccggccucaagaagaugcuccgcaccugcgccguccacaucacccucgaccccgacaccgccaaccccuggcucauccucuccgaggaccgccgccagguccgccucggcgacacccagcaguccauccccggcaacgaggagcgcuucgacuccuaccccaugguccucggcgcccagcacuuccacuccggcaagcacuacugggaggucgacgucaccggcaaggaggccugggaccucggcgucugccgcgacuccguccgccgcaagggccacuuccuccucuccuccaaguccggcuucuggaccaucuggcucuggaacaagcagaaguacgaggccggcaccuacccccagaccccccuccaccuccaggucccccccugccaggucggcaucuuccucgacuacgaggccggcauggucuccuucuacaacaucaccgaccacggcucccucaucuacuccuucuccgagugcgccuucaccggcccccuccgccccuucuucucccccggcuucaacgacggcggcaagaacaccgccccccucacccucugcccccucaacaucggcucccagggcuccaccgacuacuga

SEQ ID NO: 51143 - RNA, 1485 nt, Artificial Sequence
  derived and/or modified sequence opt2 from TRIM22__Homo_sapiens__NP_001186502
auggacuucuccgucaaggucgacaucgagaaggaggucaccugccccaucugccucgagcuccucaccgagccccucucccucgacugcggccacuccuucugccaggccugcaucaccgccaagaucaaggaguccgucaucaucucccgcggcgaguccuccugccccgucugccagacccgcuuccagcccggcaaccuccgccccaaccgccaccucgccaacaucgucgagcgcgucaaggaggucaagauguccccccaggagggccagaagcgcgacgucugcgagcaccacggcaagaagcuccagaucuucugcaaggaggacggcaaggucaucugcugggucugcgagcucucccaggagcaccagggccaccagaccuuccgcaucaacgaggucgucaaggagugccaggagaagcuccaggucgcccuccagcgccucaucaaggaggaccaggaggccgagaagcucgaggacgacauccgccaggagcgcaccgccuggaagaucgagcgccagaagauccucaagggcuucaacgagaugcgcgucauccucgacaacgaggagcagcgcgagcuccagaagcucgaggagggcgaggucaacguccucgacaaccucgccgccgccaccgaccagcucguccagcagcgccaggacgccuccacccucaucuccgaccuccagcgccgccuccgcggcuccuccgucgagaugcuccaggacgucaucgacgucaugaagcgcuccgaguccuggacccucaagaagcccaaguccgucuccaagaagcucaaguccgucuuccgcguccccgaccucuccggcaugcuccagguccucaaggagcucaccgacguccaguacuacugggucgacgucaugcucaaccccggcuccgccaccuccaacgucgccaucuccgucgaccagcgccaggucaagaccguccgcaccugcaccuucaagaacuccaaccccugcgacuucuccgccuucggcgucuucggcugccaguacuucuccuccggcaaguacuacugggaggucgacgucuccggcaagaucgccuggauccucggcguccacuccaagaucuccucccucaacaagcgcaaguccuccggcuucgccuucgaccccuccgucaacuacuccaaggucuacucccgcuaccgcccccaguacggcuacugggucaucggccuccagaacaccugcgaguacaacgccuucgaggacuccuccuccuccgaccccaagguccucacccucuucauggccgucccccccugccgcaucggcgucuuccucgacuacgaggccggcaucgucuccuucuucaacgucaccaaccacggcgcccucaucuacaaguucuccggcugccgcuucucccgccccgccuaccccuacuucaaccccuggaacugccucguccccaugaccgucugcccccccuccuccuga

SEQ ID NO: 51144 - RNA, 1725 nt, Artificial Sequence
  derived and/or modified sequence opt2 from TRIM23__Homo_sapiens__NP_001647
auggccacccucgucgucaacaagcucggcgccggcgucgacuccggccgccagggcucccgcggcaccgccgucgucaagguccucgagugcggcgucugcgaggacgucuucucccuccagggcgacaaggucccccgccuccuccucugcggccacaccgucugccacgacugccucacccgccucccccuccacggccgcgccauccgcugccccuucgaccgccaggucaccgaccucggcgacuccggcgucuggggccucaagaagaacuucgcccuccucgagcuccucgagcgccuccagaacggccccaucggccaguacggcgccgccgaggaguccaucggcaucuccggcgaguccaucauccgcugcgacgaggacgaggcccaccucgccuccgucuacugcaccgucugcgccacccaccucugcuccgagugcucccaggucacccacuccaccaagacccucgccaagcaccgccgcgucccccucgccgacaagccccacgagaagaccaugugcucccagcaccagguccacgccaucgaguucgucugccucgaggagggcugccagaccuccccccucaugugcugcgucugcaaggaguacggcaagcaccagggccacaagcacuccguccucgagcccgaggccaaccagauccgcgccuccauccucgacauggcccacugcauccgcaccuucaccgaggagaucuccgacuacucccgcaagcucgucggcaucguccagcacaucgagggcggcgagcagaucgucgaggacggcaucggcauggcccacaccgagcacguccccggcaccgccgagaacgcccgcuccugcauccgcgccuacuucuacgaccuccacgagacccucugccgccaggaggagauggcccucuccgucgucgacgcccacguccgcgagaagcucaucuggcuccgccagcagcaggaggacaugaccauccuccucuccgaggucuccgccgccugccuccacugcgagaagacccuccagcaggacgacugccgcgucguccucgccaagcaggagaucacccgccuccucgagacccuccagaagcagcagcagcaguucaccgaggucgccgaccacauccagcucgacgccuccauccccgucaccuucaccaaggacaaccgcguccacaucggccccaagauggagauccgcgucgucacccucggccucgacggcgccggcaagaccaccauccucuucaagcucaagcaggacgaguucaugcagcccauccccaccaucggcuucaacgucgagaccgucgaguacaagaaccucaaguucaccaucugggacgucggcggcaagcacaagcuccgcccccucuggaagcacuacuaccucaacacccaggccgucgucuucgucgucgacuccucccaccgcgaccgcaucuccgaggcccacuccgagcucgccaagcuccucaccgagaaggagcuccgcgacgcccuccuccucaucuucgccaacaagcaggacgucgccggcgcccucuccgucgaggagaucaccgagcuccucucccuccacaagcucugcugcggccgcuccugguacauccagggcugcgacgcccgcuccggcaugggccucuacgagggccucgacuggcucucccgccagcucgucgccgccggcguccucgacgucgccuga

SEQ ID NO: 51145 - RNA, 3051 nt, Artificial Sequence
  derived and/or modified sequence opt2 from TRIM24__Homo_sapiens__NP_003843
auggaggucgccgucgagaaggccgucgccgccgccgccgccgccuccgccgccgccuccggcggccccuccgccgcccccuccggcgagaacgaggccgagucccgccagggccccgacuccgagcgcggcggcgaggccgcccgccucaaccuccucgacaccugcgccgucugccaccagaacauccagucccgcgcccccaagcuccuccccugccuccacuccuucugccagcgcugccuccccgccccccagcgcuaccucaugcuccccgcccccaugcucggcuccgccgagacccccccccccguccccgcccccggcucccccgucuccggcuccucccccuucgccacccaggucggcgucauccgcugccccgucugcucccaggagugcgccgagcgccacaucaucgacaacuucuucgucaaggacaccaccgagguccccuccuccaccgucgagaaguccaaccaggucugcaccuccugcgaggacaacgccgaggccaacggcuucugcgucgagugcgucgaguggcucugcaagaccugcauccgcgcccaccagcgcgucaaguucaccaaggaccacaccguccgccagaaggaggaggucucccccgaggccgucggcgucaccucccagcgccccgucuucugccccuuccacaagaaggagcagcucaagcucuacugcgagaccugcgacaagcucaccugccgcgacugccagcuccucgagcacaaggagcaccgcuaccaguucaucgaggaggccuuccagaaccagaaggucaucaucgacacccucaucaccaagcucauggagaagaccaaguacaucaaguucaccggcaaccagauccagaaccgcaucaucgaggucaaccagaaccagaagcaggucgagcaggacaucaaggucgccaucuucacccucauggucgagaucaacaagaagggcaaggcccuccuccaccagcucgagucccucgccaaggaccaccgcaugaagcucaugcagcagcagcaggaggucgccggccucuccaagcagcucgagcacgucaugcacuucuccaagugggccgucuccuccggcuccuccaccgcccuccucuacuccaagcgccucaucaccuaccgccuccgccaccuccuccgcgcccgcugcgacgccucccccgucaccaacaacaccauccaguuccacugcgaccccuccuucugggcccagaacaucaucaaccucggcucccucgucaucgaggacaaggagucccagccccagaugcccaagcagaaccccgucgucgagcagaacucccagccccccuccggccucuccuccaaccagcucuccaaguuccccacccagaucucccucgcccagcuccgccuccagcacaugcagcagcagcagccccccccccgccucaucaacuuccagaaccacucccccaagcccaacggccccguccuccccccccacccccagcagcuccgcuacccccccaaccagaacaucccccgccaggccaucaagcccaacccccuccagauggccuuccucgcccagcaggccaucaagcaguggcagaucuccuccggccagggcacccccuccaccaccaacuccaccuccuccacccccuccucccccaccaucaccuccgccgccggcuacgacggcaaggccuucggcucccccaugaucgaccucuccucccccgucggcggcuccuacaaccuccccucccuccccgacaucgacugcuccuccaccaucaugcucgacaacaucguccgcaaggacaccaacaucgaccacggccagccccgcccccccuccaaccgcaccguccagucccccaacuccuccguccccucccccggccucgccggccccgucaccaugaccuccguccacccccccauccgcucccccuccgccuccuccgucggcucccgcggcuccuccggcuccuccuccaagcccgccggcgccgacuccacccacaagguccccgucgucaugcucgagcccauccgcaucaagcaggagaacuccggcccccccgagaacuacgacuuccccgucgucaucgucaagcaggaguccgacgaggagucccgcccccagaacgccaacuacccccgcuccauccucaccucccuccuccucaacuccucccaguccuccaccuccgaggagaccguccuccgcuccgacgcccccgacuccaccggcgaccagcccggccuccaccaggacaacuccuccaacggcaaguccgaguggcucgaccccucccagaaguccccccuccacgucggcgagacccgcaaggaggacgaccccaacgaggacuggugcgccgucugccagaacggcggcgagcuccucugcugcgagaagugccccaaggucuuccaccucuccugccacguccccacccucaccaacuuccccuccggcgaguggaucugcaccuucugccgcgaccucuccaagcccgaggucgaguacgacugcgacgcccccucccacaacuccgagaagaagaagaccgagggccucgucaagcucacccccaucgacaagcgcaagugcgagcgccuccuccucuuccucuacugccacgagaugucccucgccuuccaggaccccgucccccucaccguccccgacuacuacaagaucaucaagaaccccauggaccucuccaccaucaagaagcgccuccaggaggacuacuccauguacuccaagcccgaggacuucgucgccgacuuccgccucaucuuccagaacugcgccgaguucaacgagcccgacuccgaggucgccaacgccggcaucaagcucgagaacuacuucgaggagcuccucaagaaccucuaccccgagaagcgcuuccccaagcccgaguuccgcaacgaguccgaggacaacaaguucuccgacgacuccgacgacgacuucguccagccccgcaagaagcgccucaaguccaucgaggagcgccagcuccucaaguga

SEQ ID NO: 51146 - RNA, 1893 nt, Artificial Sequence
  derived and/or modified sequence opt2 from TRIM25__Homo_sapiens__NP_005073
auggccgagcucugcccccucgccgaggagcucuccugcuccaucugccucgagcccuucaaggagcccgucaccacccccugcggccacaacuucugcggcuccugccucaacgagaccugggccguccagggcucccccuaccucugcccccagugccgcgccgucuaccaggcccgcccccagcuccacaagaacaccguccucugcaacgucgucgagcaguuccuccaggccgaccucgcccgcgagccccccgccgacgucuggaccccccccgcccgcgccuccgcccccucccccaacgcccaggucgccugcgaccacugccucaaggaggccgccgucaagaccugccucgucugcauggccuccuucugccaggagcaccuccagccccacuucgacucccccgccuuccaggaccacccccuccagccccccguccgcgaccuccuccgccgcaagugcucccagcacaaccgccuccgcgaguucuucugccccgagcacuccgagugcaucugccacaucugccucgucgagcacaagaccugcucccccgccucccucucccaggccuccgccgaccucgaggccacccuccgccacaagcucaccgucauguacucccagaucaacggcgccucccgcgcccucgacgacguccgcaaccgccagcaggacguccgcaugaccgccaaccgcaaggucgagcagcuccagcaggaguacaccgagaugaaggcccuccucgacgccuccgagaccaccuccacccgcaagaucaaggaggaggagaagcgcgucaacuccaaguucgacaccaucuaccagauccuccucaagaagaaguccgagauccagacccucaaggaggagaucgagcagucccucaccaagcgcgacgaguucgaguuccucgagaaggccuccaagcuccgcggcaucuccaccaagcccgucuacauccccgaggucgagcucaaccacaagcucaucaagggcauccaccaguccaccaucgaccucaagaacgagcucaagcagugcaucggccgccuccaggagcccacccccuccuccggcgaccccggcgagcacgaccccgccuccacccacaaguccacccgccccgucaagaaggucuccaaggaggagaagaaguccaagaagcccccccccguccccgcccuccccuccaagcuccccaccuucggcgcccccgagcagcucgucgaccucaagcaggccggccucgaggccgccgccaaggccaccuccucccaccccaacuccaccucccucaaggccaagguccucgagaccuuccucgccaagucccgccccgagcuccucgaguacuacaucaaggucauccucgacuacaacaccgcccacaacaaggucgcccucuccgagugcuacaccgucgccuccgucgccgagaugccccagaacuaccgcccccacccccagcgcuucaccuacugcucccagguccucggccuccacugcuacaagaagggcauccacuacugggaggucgagcuccagaagaacaacuucugcggcgucggcaucugcuacggcuccaugaaccgccagggccccgagucccgccucggccgcaacuccgccuccuggugcgucgagugguucaacaccaagaucuccgccuggcacaacaacgucgagaagacccuccccuccaccaaggccacccgcgucggcguccuccucaacugcgaccacggcuucgucaucuucuucgccgucgccgacaagguccaccucauguacaaguuccgcgucgacuucaccgaggcccucuaccccgccuucugggucuucuccgccggcgccacccucuccaucugcucccccaaguga

SEQ ID NO: 51147 - RNA, 1620 nt, Artificial Sequence
  derived and/or modified sequence opt2 from TRIM26__Homo_sapiens__XP_005249435
auggccaccuccgccccccuccgcucccucgaggaggaggucaccugcuccaucugccucgacuaccuccgcgaccccgucaccaucgacugcggccacgucuucugccgcuccugcaccaccgacguccgccccaucuccggcucccgccccgucugcccccucugcaagaagcccuucaagaaggagaacauccgccccgucuggcagcucgccucccucgucgagaacaucgagcgccucaaggucgacaagggccgccagcccggcgaggucacccgcgagcagcaggacgccaagcucugcgagcgccaccgcgagaagcuccacuacuacugcgaggacgacggcaagcuccucugcgucaugugccgcgagucccgcgagcaccgcccccacaccgccguccucauggagaaggccgcccagccccaccgcgagaagauccucaaccaccucuccacccuccgccgcgaccgcgacaagauccagggcuuccaggccaagggcgaggccgacauccucgccgcccucaagaagcuccaggaccagcgccaguacaucgucgccgaguucgagcagggccaccaguuccuccgcgagcgcgaggagcaccuccucgagcagcucgccaagcucgagcaggagcucaccgagggccgcgagaaguucaagucccgcggcgucggcgagcucgcccgccucgcccucgucaucuccgagcucgagggcaaggcccagcagcccgccgccgagcucaugcaggacacccgcgacuuccucaaccgcuacccccgcaagaaguucugggucggcaagcccaucgcccgcgucgucaagaagaagaccggcgaguucuccgacaagcuccucucccuccagcgcggccuccgcgaguuccagggcaagcuccuccgcgaccucgaguacaagaccgucuccgucacccucgacccccaguccgccuccggcuaccuccagcucuccgaggacuggaagugcgucaccuacaccucccucuacaaguccgccuaccuccacccccagcaguucgacugcgagcccggcguccucggcuccaagggcuucaccuggggcaaggucuacugggaggucgaggucgagcgcgagggcugguccgaggacgaggaggagggcgacgaggaggaggagggcgaggaggaggaggaggaggaggaggccggcuacggcgacggcuacgacgacugggagaccgacgaggacgaggagucccucggcgacgaggaggaggaggaggaggaggaggaggaggagguccucgaguccugcauggucggcgucgcccgcgacuccgucaagcgcaagggcgaccucucccuccgccccgaggacggcgucugggcccuccgccucuccuccuccggcaucugggccaacaccucccccgaggccgagcucuuccccgcccuccgcccccgccgcgucggcaucgcccucgacuacgagggcggcaccgucaccuucaccaacgccgagucccaggagcucaucuacaccuucaccgccaccuucacccgccgccucguccccuuccucuggcucaaguggcccggcacccgccuccuccuccgccccuga

SEQ ID NO: 51148 - RNA, 1542 nt, Artificial Sequence
  derived and/or modified sequence opt2 from TRIM27__Homo_sapiens__NP_006501
auggccuccggcuccgucgccgagugccuccagcaggagaccaccugccccgucugccuccaguacuucgccgagcccaugaugcucgacugcggccacaacaucugcugcgccugccucgcccgcugcuggggcaccgccgagaccaacgucuccugcccccagugccgcgagaccuucccccagcgccacaugcgccccaaccgccaccucgccaacgucacccagcucgucaagcagcuccgcaccgagcgccccuccggccccggcggcgagaugggcgucugcgagaagcaccgcgagccccucaagcucuacugcgaggaggaccagaugcccaucugcgucgucugcgaccgcucccgcgagcaccgcggccacuccguccucccccucgaggaggccgucgagggcuucaaggagcagauccagaaccagcucgaccaccucaagcgcgucaaggaccucaagaagcgccgccgcgcccagggcgagcaggcccgcgccgagcuccucucccucacccagauggagcgcgagaagaucgucugggaguucgagcagcucuaccacucccucaaggagcacgaguaccgccuccucgcccgccucgaggagcucgaccucgccaucuacaacuccaucaacggcgccaucacccaguucuccugcaacaucucccaccucuccucccucaucgcccagcucgaggagaagcagcagcagcccacccgcgagcuccuccaggacaucggcgacacccucucccgcgccgagcgcauccgcauccccgagcccuggaucaccccccccgaccuccaggagaagauccacaucuucgcccagaagugccucuuccucaccgagucccucaagcaguucaccgagaagaugcaguccgacauggagaagauccaggagcuccgcgaggcccagcucuacuccgucgacgucacccucgaccccgacaccgccuaccccucccucauccucuccgacaaccuccgccagguccgcuacuccuaccuccagcaggaccuccccgacaaccccgagcgcuucaaccucuuccccugcguccucggcucccccugcuucaucgccggccgccacuacugggaggucgaggucggcgacaaggccaaguggaccaucggcgucugcgaggacuccgucugccgcaagggcggcgucaccuccgccccccagaacggcuucugggccgucucccucugguacggcaaggaguacugggcccucaccucccccaugaccgcccucccccuccgcaccccccuccagcgcgucggcaucuuccucgacuacgacgccggcgaggucuccuucuacaacgucaccgagcgcugccacaccuucaccuucucccacgccaccuucugcggccccguccgccccuacuucucccucuccuacuccggcggcaaguccgccgccccccucaucaucugccccauguccggcaucgacggcuucuccggccacgucggcaaccacggccacuccauggagaccucccccuga

SEQ ID NO: 51149 - RNA, 2508 nt, Artificial Sequence
  derived and/or modified sequence opt2 from TRIM28__Homo_sapiens__NP_005753
auggccgccuccgccgccgccgccuccgccgccgccgccuccgccgccuccggcucccccggccccggcgagggcuccgccggcggcgagaagcgcuccaccgcccccuccgccgccgccuccgccuccgccuccgccgccgccuccucccccgccggcggcggcgccgaggcccucgagcuccucgagcacugcggcgucugccgcgagcgccuccgccccgagcgcgagccccgccuccuccccugccuccacuccgccugcuccgccugccucggccccgccgcccccgccgccgccaacuccuccggcgacggcggcgccgccggcgacggcaccgucgucgacugccccgucugcaagcagcagugcuucuccaaggacaucgucgagaacuacuucaugcgcgacuccggcuccaaggccgccaccgacgcccaggacgccaaccagugcugcaccuccugcgaggacaacgcccccgccaccuccuacugcgucgagugcuccgagccccucugcgagaccugcgucgaggcccaccagcgcgucaaguacaccaaggaccacaccguccgcuccaccggccccgccaagucccgcgacggcgagcgcaccgucuacugcaacguccacaagcacgagccccucguccucuucugcgaguccugcgacacccucaccugccgcgacugccagcucaacgcccacaaggaccaccaguaccaguuccucgaggacgccguccgcaaccagcgcaagcuccucgccucccucgucaagcgccucggcgacaagcacgccacccuccagaaguccaccaaggagguccgcuccuccauccgccaggucuccgacguccagaagcgcguccaggucgacgucaagauggccauccuccagaucaugaaggagcucaacaagcgcggccgcguccucgucaacgacgcccagaaggucaccgagggccagcaggagcgccucgagcgccagcacuggaccaugaccaagauccagaagcaccaggagcacauccuccgcuucgccuccugggcccucgaguccgacaacaacaccgcccuccuccucuccaagaagcucaucuacuuccagcuccaccgcgcccucaagaugaucgucgaccccgucgagccccacggcgagaugaaguuccagugggaccucaacgccuggaccaaguccgccgaggccuucggcaagaucgucgccgagcgccccggcaccaacuccaccggccccgcccccauggcccccccccgcgcccccggcccccucuccaagcagggcuccggcuccucccagcccauggagguccaggagggcuacggcuucggcuccggcgacgaccccuacuccuccgccgagccccacgucuccggcgucaagcgcucccgcuccggcgagggcgaggucuccggccucaugcgcaaggucccccgcgucucccucgagcgccucgaccucgaccucaccgccgacucccagccccccgucuucaaggucuuccccggcuccaccaccgaggacuacaaccucaucgucaucgagcgcggcgccgccgccgccgccaccggccagcccggcaccgcccccgccggcacccccggcgcccccccccucgccggcauggccaucgucaaggaggaggagaccgaggccgccaucggcgccccccccaccgccaccgagggccccgagaccaagcccguccucauggcccucgccgagggccccggcgccgagggcccccgccucgccucccccuccggcuccaccuccuccggccucgaggucgucgcccccgagggcaccuccgcccccggcggcggccccggcacccucgacgacuccgccaccaucugccgcgucugccagaagcccggcgaccucgucaugugcaaccagugcgaguucugcuuccaccucgacugccaccuccccgcccuccaggacguccccggcgaggagugguccugcucccucugccacguccuccccgaccucaaggaggaggacggcucccucucccucgacggcgccgacuccaccggcgucgucgccaagcucucccccgccaaccagcgcaagugcgagcgcguccuccucgcccucuucugccacgagcccugccgcccccuccaccagcucgccaccgacuccaccuucucccucgaccagcccggcggcacccucgaccucacccucauccgcgcccgccuccaggagaagcucuccccccccuacuccuccccccaggaguucgcccaggacgucggccgcauguucaagcaguucaacaagcucaccgaggacaaggccgacguccaguccaucaucggccuccagcgcuucuucgagacccgcaugaacgaggccuucggcgacaccaaguucuccgccguccucgucgagcccccccccaugucccuccccggcgccggccucuccucccaggagcucuccggcggccccggcgacggccccuga

SEQ ID NO: 51150 - RNA, 1767 nt, Artificial Sequence
  derived and/or modified sequence opt2 from TRIM29__Homo_sapiens__NP_036233
auggaggccgccgacgccucccgcuccaacggcuccucccccgaggcccgcgacgcccgcucccccuccggccccuccggcucccucgagaacggcaccaaggccgacggcaaggacgccaagaccaccaacggccacggcggcgaggccgccgagggcaagucccucggcuccgcccucaagcccggcgagggccgcuccgcccucuucgccggcaacgaguggcgccgccccaucauccaguucgucgaguccggcgacgacaagaacuccaacuacuucuccauggacuccauggagggcaagcgcucccccuacgccggccuccagcucggcgccgccaagaagccccccgucaccuucgccgagaagggcgagcuccgcaaguccaucuucuccgagucccgcaagcccaccgucuccaucauggagcccggcgagacccgccgcaacuccuacccccgcgccgacaccggccucuucucccgcuccaaguccggcuccgaggagguccucugcgacuccugcaucggcaacaagcagaaggccgucaaguccugccucgucugccaggccuccuucugcgagcuccaccucaagccccaccucgagggcgccgccuuccgcgaccaccagcuccucgagcccauccgcgacuucgaggcccgcaagugccccguccacggcaagaccauggagcucuucugccagaccgaccagaccugcaucugcuaccucugcauguuccaggagcacaagaaccacuccaccgucaccgucgaggaggccaaggccgagaaggagaccgagcucucccuccagaaggagcagcuccagcucaagaucaucgagaucgaggacgaggccgagaaguggcagaaggagaaggaccgcaucaaguccuucaccaccaacgagaaggccauccucgagcagaacuuccgcgaccucguccgcgaccucgagaagcagaaggaggagguccgcgccgcccucgagcagcgcgagcaggacgccgucgaccaggucaaggucaucauggacgcccucgacgagcgcgccaagguccuccacgaggacaagcagacccgcgagcagcuccacuccaucuccgacuccguccucuuccuccaggaguucggcgcccucauguccaacuacucccucccccccccccuccccaccuaccacguccuccucgagggcgagggccucggccagucccucggcaacuucaaggacgaccuccucaacgucugcaugcgccacgucgagaagaugugcaaggccgaccucucccgcaacuucaucgagcgcaaccacauggagaacggcggcgaccaccgcuacgucaacaacuacaccaacuccuucggcggcgagugguccgcccccgacaccaugaagcgcuacuccauguaccucacccccaagggcggcguccgcaccuccuaccagcccuccucccccggccgcuucaccaaggagaccacccagaagaacuucaacaaccucuacggcaccaagggcaacuacaccucccgcgucugggaguacuccuccuccauccagaacuccgacaacgaccuccccgucguccagggcuccuccuccuucucccucaagggcuaccccucccucaugcgcucccagucccccaaggcccagccccagaccuggaaguccggcaagcagaccaugcucucccacuaccgccccuucuacgucaacaagggcaacggcaucggcuccaacgaggcccccuga

SEQ ID NO: 51151 - RNA, 2235 nt, Artificial Sequence
  derived and/or modified sequence opt2 from TRIM2__Homo_sapiens__NP_001123539
auggccuccgagggcaccaacauccccucccccgucguccgccagaucgacaagcaguuccucaucugcuccaucugccucgagcgcuacaagaaccccaagguccuccccugccuccacaccuucugcgagcgcugccuccagaacuacauccccgcccacucccucacccucuccugccccgucugccgccagaccuccauccuccccgagaagggcgucgccgcccuccagaacaacuucuucaucaccaaccucauggacguccuccagcgcacccccggcuccaacgccgaggaguccuccauccucgagaccgucaccgccgucgccgccggcaagccccucuccugccccaaccacgacggcaacgucauggaguucuacugccaguccugcgagaccgccaugugccgcgagugcaccgagggcgagcacgccgagcaccccaccgucccccucaaggacgucgucgagcagcacaaggccucccuccagguccagcucgacgccgucaacaagcgccuccccgagaucgacuccgcccuccaguucaucuccgagaucauccaccagcucaccaaccagaaggccuccaucgucgacgacauccacuccaccuucgacgagcuccagaagacccucaacguccgcaaguccguccuccucauggagcucgaggucaacuacggccucaagcacaagguccuccagucccagcucgacacccuccuccagggccaggaguccaucaaguccugcuccaacuucaccgcccaggcccucaaccacggcaccgagaccgagguccuccucgucaagaagcagauguccgagaagcucaacgagcucgccgaccaggacuucccccuccacccccgcgagaacgaccagcucgacuucaucgucgagaccgagggccucaagaaguccauccacaaccucggcaccauccucaccaccaacgccgucgccuccgagaccgucgccaccggcgagggccuccgccagaccaucaucggccagcccauguccgucaccaucaccaccaaggacaaggacggcgagcucugcaagaccggcaacgccuaccucaccgccgagcucuccacccccgacggcuccgucgccgacggcgagauccucgacaacaagaacggcaccuacgaguuccucuacaccguccagaaggagggcgacuucacccucucccuccgccucuacgaccagcacauccgcggcucccccuucaagcucaaggucauccgcuccgccgacgucucccccaccaccgagggcgucaagcgccgcgucaagucccccggcuccggccacgucaagcagaaggccgucaagcgccccgccuccauguacuccaccggcaagcgcaaggagaaccccaucgaggacgaccucaucuuccgcgucggcaccaagggccgcaacaagggcgaguucaccaaccuccagggcgucgccgccuccaccaacggcaagauccucaucgccgacuccaacaaccagugcguccagaucuucuccaacgacggccaguucaagucccgcuucggcauccgcggccgcucccccggccagcuccagcgccccaccggcgucgccguccaccccuccggcgacaucaucaucgccgacuacgacaacaagugggucuccaucuucuccuccgacggcaaguucaagaccaagaucggcuccggcaagcucaugggccccaagggcgucuccgucgaccgcaacggccacaucaucgucgucgacaacaaggccugcugcgucuucaucuuccagcccaacggcaagaucgucacccgcuucggcucccgcggcaacggcgaccgccaguucgccggcccccacuucgccgccgucaacuccaacaacgagaucaucaucaccgacuuccacaaccacuccgucaaggucuucaaccaggagggcgaguucaugcucaaguucggcuccaacggcgagggcaacggccaguucaacgcccccaccggcgucgccgucgacuccaacggcaacaucaucgucgccgacuggggcaacucccgcauccaggucuucgacggcuccggcuccuuccucuccuacaucaacaccuccgccgacccccucuacggcccccagggccucgcccucaccuccgacggccacgucgucgucgccgacuccggcaaccacugcuucaaggucuaccgcuaccuccaguga

SEQ ID NO: 51152 - RNA, 1278 nt, Artificial Sequence
  derived and/or modified sequence opt2 from TRIM31__Homo_sapiens__NP_008959
auggccuccggccaguucgucaacaagcuccaggaggaggucaucugccccaucugccucgacauccuccagaagcccgucaccaucgacugcggccacaacuucugccucaagugcaucacccagaucggcgagaccuccugcggcuucuucaagugcccccucugcaagaccuccguccgcaagaacgccauccgcuucaacucccuccuccgcaaccucgucgagaagauccaggcccuccaggccuccgagguccaguccaagcgcaaggaggccaccugcccccgccaccaggagauguuccacuacuucugcgaggacgacggcaaguuccucugcuucgucugccgcgaguccaaggaccacaagucccacaacgucucccucaucgaggaggccgcccagaacuaccagggccagauccaggagcagauccagguccuccagcagaaggagaaggagaccguccaggucaaggcccagggcguccaccgcgucgacgucuucaccgaccaggucgagcacgagaagcagcgcauccucaccgaguucgagcuccuccaccagguccucgaggaggagaagaacuuccuccucucccgcaucuacuggcucggccacgagggcaccgaggccggcaagcacuacgucgccuccaccgagccccagcucaacgaccucaagaagcucgucgacucccucaagaccaagcagaacaugcccccccgccagcuccucgaggacaucaaggucguccucugccgcuccgaggaguuccaguuccucaaccccacccccgucccccucgagcucgagaagaagcucuccgaggccaagucccgccacgacuccaucaccggcucccucaagaaguucaaggaccagcuccaggccgaccgcaagaaggacgagaaccgcuucuucaaguccaugaacaagaacgacaugaaguccuggggccuccuccagaagaacaaccacaagaugaacaagaccuccgagcccggcuccuccuccgccggcggccgcaccaccuccggcccccccaaccaccacuccuccgcccccucccacucccucuuccgcgccuccuccgccggcaaggucaccuuccccgucugccuccucgccuccuacgacgagaucuccggccagggcgccuccucccaggacaccaagaccuucgacgucgcccucuccgaggagcuccacgccgcccucuccgaguggcucaccgccauccgcgccugguucugcgagguccccuccuccuga

SEQ ID NO: 51153 - RNA, 1962 nt, Artificial Sequence
  derived and/or modified sequence opt2 from TRIM32__Homo_sapiens__XP_011516700
auggccgccgccgccgccucccaccucaaccucgacgcccuccgcgagguccucgagugccccaucugcauggaguccuucaccgaggagcagcuccgccccaagcuccuccacugcggccacaccaucugccgccagugccucgagaagcuccucgccuccuccaucaacggcguccgcugccccuucugcuccaagaucacccgcaucaccucccucacccagcucaccgacaaccucaccguccucaagaucaucgacaccgccggccucuccgaggccgucggccuccucaugugccgcuccugcggccgccgccucccccgccaguucugccgcuccugcggccucguccucugcgagcccugccgcgaggccgaccaccagccccccggccacugcacccuccccgucaaggaggccgccgaggagcgccgccgcgacuucggcgagaagcucacccgccuccgcgagcucaugggcgagcuccagcgccgcaaggccgcccucgagggcgucuccaaggaccuccaggcccgcuacaaggccguccuccaggaguacggccacgaggagcgccgcguccaggacgagcucgcccgcucccgcaaguucuucaccggcucccucgccgaggucgagaaguccaacucccaggucgucgaggagcaguccuaccuccucaacaucgccgagguccaggccgucucccgcugcgacuacuuccucgccaagaucaagcaggccgacgucgcccuccucgaggagaccgccgacgaggaggagcccgagcucaccgccucccucccccgcgagcucacccuccaggacgucgagcuccucaaggucggccacgucggcccccuccagaucggccaggccgucaagaagccccgcaccgucaacgucgaggacuccugggccauggaggccaccgccuccgccgccuccaccuccgucaccuuccgcgagauggacaugucccccgaggaggucgucgccuccccccgcgccucccccgccaagcagcgcggccccgaggccgccuccaacauccagcagugccucuuccucaagaagaugggcgccaagggcuccacccccggcauguucaaccuccccgucucccucuacgucaccucccagggcgagguccucgucgccgaccgcggcaacuaccgcauccaggucuucacccgcaagggcuuccucaaggagauccgccgcucccccuccggcaucgacuccuucguccucuccuuccucggcgccgaccuccccaaccucaccccccucuccgucgccaugaacugccagggccucaucggcgucaccgacuccuacgacaacucccucaaggucuacacccucgacggccacugcgucgccugccaccgcucccagcucuccaagcccuggggcaucaccgcccuccccuccggccaguucgucgucaccgacgucgagggcggcaagcucuggugcuucaccgucgaccgcggcuccggcgucgucaaguacuccugccucugcuccgccguccgccccaaguucgucaccugcgacgccgagggcaccgucuacuucacccagggccucggccucaaccucgagaaccgccagaacgagcaccaccucgagggcggcuucuccaucggcuccgucggccccgacggccagcucggccgccagaucucccacuucuucuccgagaacgaggacuuccgcugcaucgccggcaugugcgucgacgcccgcggcgaccucaucgucgccgacuccucccgcaaggagauccuccacuuccccaagggcggcggcuacuccguccucauccgcgagggccucaccugccccgucggcaucgcccucacccccaagggccagcuccucguccucgacugcugggaccacugcaucaagaucuacuccuaccaccuccgccgcuacuccacccccuga

SEQ ID NO: 51154 - RNA, 1467 nt, Artificial Sequence
  derived and/or modified sequence opt2 from TRIM34__Homo_sapiens__NP_067629
auggccuccaagauccuccucaacguccaggaggaggucaccugccccaucugccucgagcuccucaccgagccccucucccucgacugcggccacucccucugccgcgccugcaucaccgucuccaacaaggaggccgucaccuccaugggcggcaaguccuccugccccgucugcggcaucuccuacuccuucgagcaccuccaggccaaccagcaccucgccaacaucgucgagcgccucaaggaggucaagcucucccccgacaacggcaagaagcgcgaccucugcgaccaccacggcgagaagcuccuccucuucugcaaggaggaccgcaaggucaucugcuggcucugcgagcgcucccaggagcaccgcggccaccacaccguccucaccgaggaggucuucaaggagugccaggagaagcuccaggccguccucaagcgccucaagaaggaggaggaggaggccgagaagcucgaggccgacauccgcgaggagaagaccuccuggaaguaccagguccagaccgagcgccagcgcauccagaccgaguucgaccagcuccgcuccauccucaacaacgaggagcagcgcgagcuccagcgccucgaggaggaggagaagaagacccucgacaaguucgccgaggccgaggacgagcucguccagcagaagcagcucguccgcgagcucaucuccgacgucgagugccgcucccagugguccaccauggagcuccuccaggacauguccggcaucaugaagugguccgagaucuggcgccucaagaagcccaagauggucuccaagaagcucaagaccgucuuccacgcccccgaccucucccgcaugcuccagauguuccgcgagcucaccgccguccgcugcuacugggucgacgucacccucaacuccgucaaccucaaccucaaccucguccucuccgaggaccagcgccaggucaucuccguccccaucuggcccuuccagugcuacaacuacggcguccucggcucccaguacuucuccuccggcaagcacuacugggaggucgacgucuccaagaagaccgccuggauccucggcgucuacugccgcaccuacucccgccacaugaaguacgucguccgccgcugcgccaaccgccagaaccucuacaccaaguaccgcccccucuucggcuacugggucaucggccuccagaacaagugcaaguacggcgucuucgaggagucccucuccuccgaccccgagguccucacccucuccauggccgucccccccugccgcgucggcgucuuccucgacuacgaggccggcaucgucuccuucuucaacgucaccucccacggcucccucaucuacaaguucuccaagugcugcuucucccagcccgucuaccccuacuucaaccccuggaacugccccgcccccaugacccucugcccccccuccuccuga

SEQ ID NO: 51155 - RNA, 1482 nt, Artificial Sequence
  derived and/or modified sequence opt2 from TRIM35__Homo_sapiens__NP_741983
auggagcgcucccccgacgucucccccggccccucccgcuccuucaaggaggagcuccucugcgccgucugcuacgaccccuuccgcgacgccgucacccuccgcugcggccacaacuucugccgcggcugcgucucccgcugcugggagguccaggucucccccaccugccccgucugcaaggaccgcgccucccccgccgaccuccgcaccaaccacacccucaacaaccucgucgagaagcuccuccgcgaggaggccgagggcgcccgcuggaccuccuaccgcuucucccgcgucugccgccuccaccgcggccagcucucccucuucugccucgaggacaaggagcuccucugcugcuccugccaggccgacccccgccaccagggccaccgcguccagcccgucaaggacaccgcccacgacuuccgcgccaagugccgcaacauggagcacgcccuccgcgagaaggccaaggccuucugggccaugcgccgcuccuacgaggccaucgccaagcacaaccaggucgaggccgccuggcucgagggccgcauccgccaggaguucgacaagcuccgcgaguuccuccgcgucgaggagcaggccauccucgacgccauggccgaggagacccgccagaagcagcuccucgccgacgagaagaugaagcagcucaccgaggagaccgagguccucgcccacgagaucgagcgccuccagauggagaugaaggaggacgacgucuccuuccucaugaagcacaagucccgcaagcgccgccucuucugcaccauggagcccgagcccguccagcccggcaugcucaucgacgucugcaaguaccucggcucccuccaguaccgcgucuggaagaagaugcucgccuccgucgaguccguccccuucuccuucgaccccaacaccgccgccggcuggcucuccgucuccgacgaccucaccuccgucaccaaccacggcuaccgcguccaggucgagaaccccgagcgcuucuccuccgcccccugccuccucggcucccgcgucuucucccagggcucccacgccugggaggucgcccucggcggccuccaguccuggcgcgucggcgucguccgcguccgccaggacuccggcgccgagggccacucccacuccugcuaccacgacacccgcuccggcuucugguacgucugccgcacccagggcgucgagggcgaccacugcgucaccuccgaccccgccaccuccccccucguccucgccaucccccgccgccuccgcgucgagcucgagugcgaggagggcgagcucuccuucuacgacgccgagcgccacugccaccucuacaccuuccacgcccgcuucggcgagguccgccccuacuucuaccucggcggcgcccgcggcgccggcccccccgagccccuccgcaucugcccccuccacaucuccgucaaggaggagcucgacggcuga

SEQ ID NO: 51156 - RNA, 183 nt, Artificial Sequence
  derived and/or modified sequence opt2 from TRIM36__Homo_sapiens__NP_001017397
auguccgaguccggcgagauguccgaguucggcuacaucauggagcucaucgccaagggcaagaugcccgacuggcgccgcggcuaccgcugccgccagggcugcggcaagaccaccgagcucgccaccgccaccgacuucucccagaccggcaacaaguccggcaagcacuucaagaccuga

SEQ ID NO: 51157 - RNA, 2895 nt, Artificial Sequence
  derived and/or modified sequence opt2 from TRIM37__Homo_sapiens__NP_056109
auggacgagcaguccgucgaguccaucgccgaggucuuccgcugcuucaucugcauggagaagcuccgcgacgcccgccucugcccccacugcuccaagcucugcugcuucuccugcauccgccgcuggcucaccgagcagcgcgcccagugcccccacugccgcgccccccuccagcuccgcgagcucgucaacugccgcugggccgaggaggucacccagcagcucgacacccuccagcucugcucccucaccaagcacgaggagaacgagaaggacaagugcgagaaccaccacgagaagcucuccgucuucugcuggaccugcaagaagugcaucugccaccagugcgcccucuggggcggcaugcacggcggccacaccuucaagccccucgccgagaucuacgagcagcacgucaccaaggucaacgaggaggucgccaagcuccgccgccgccucauggagcucaucucccucguccaggaggucgagcgcaacgucgaggccguccgcaacgccaaggacgagcgcguccgcgagauccgcaacgccgucgagaugaugaucgcccgccucgacacccagcucaagaacaagcucaucacccucaugggccagaagaccucccucacccaggagaccgagcuccucgagucccuccuccaggaggucgagcaccagcuccgcuccugcuccaaguccgagcucaucuccaaguccuccgagauccucaugauguuccagcagguccaccgcaagcccauggccuccuucgucaccacccccgucccccccgacuucaccuccgagcucguccccuccuacgacuccgccaccuucguccucgagaacuucuccacccuccgccagcgcgccgaccccgucuacucccccccccuccaggucuccggccucugcuggcgccucaaggucuaccccgacggcaacggcgucguccgcggcuacuaccucuccgucuuccucgagcucuccgccggccuccccgagaccuccaaguacgaguaccgcgucgagaugguccaccaguccugcaacgaccccaccaagaacaucauccgcgaguucgccuccgacuucgaggucggcgagugcuggggcuacaaccgcuucuuccgccucgaccuccucgccaacgagggcuaccucaacccccagaacgacaccgucauccuccgcuuccagguccgcucccccaccuucuuccagaagucccgcgaccagcacugguacaucacccagcucgaggccgcccagaccuccuacauccagcagaucaacaaccucaaggagcgccucaccaucgagcucucccgcacccagaagucccgcgaccucuccccccccgacaaccaccucuccccccagaacgacgacgcccucgagacccgcgccaagaaguccgccugcuccgacaugcuccucgagggcggccccaccaccgccuccguccgcgaggccaaggaggacgaggaggacgaggagaagauccagaacgaggacuaccaccacgagcucuccgacggcgaccucgaccucgaccucgucuacgaggacgaggucaaccagcucgacggcuccuccuccuccgccuccuccaccgccaccuccaacaccgaggagaacgacaucgacgaggagaccauguccggcgagaacgacgucgaguacaacaacauggagcucgaggagggcgagcucauggaggacgccgccgccgccggccccgccggcuccucccacggcuacgucggcuccuccucccgcaucucccgccgcacccaccucugcuccgccgccaccuccucccuccucgacaucgacccccucauccucauccaccuccucgaccucaaggaccgcuccuccaucgagaaccucuggggccuccagccccgcccccccgccucccuccuccagcccaccgccuccuacucccgcaaggacaaggaccagcgcaagcagcaggccauguggcgcguccccuccgaccucaagaugcucaagcgccucaagacccagauggccgagguccgcugcaugaagaccgacgucaagaacacccucuccgagaucaaguccuccuccgccgccuccggcgacaugcagaccucccucuucuccgccgaccaggccgcccucgccgccugcggcaccgagaacuccggccgccuccaggaccucggcauggagcuccucgccaaguccuccgucgccaacugcuacauccgcaacuccaccaacaagaaguccaacucccccaagcccgcccgcuccuccgucgccggcucccucucccuccgccgcgccgucgaccccggcgagaacucccgcuccaagggcgacugccagacccucuccgagggcucccccggcuccucccaguccggcucccgccacuccuccccccgcgcccucauccacggcuccaucggcgacauccuccccaagaccgaggaccgccagugcaaggcccucgacuccgacgccgucgucgucgccgucuucuccggccuccccgccgucgagaagcgccgcaagauggucacccucggcgccaacgccaagggcggccaccucgagggccuccagaugaccgaccucgagaacaacuccgagaccggcgagcuccagcccguccuccccgagggcgccuccgccgcccccgaggagggcauguccuccgacuccgacaucgagugcgacaccgagaacgaggagcaggaggagcacaccuccgucggcggcuuccacgacuccuucauggucaugacccagccccccgacgaggacacccacuccuccuuccccgacggcgagcagaucggccccgaggaccucuccuucaacaccgacgagaacuccggccgcuga

SEQ ID NO: 51158 - RNA, 1398 nt, Artificial Sequence
  derived and/or modified sequence opt2 from TRIM38__Homo_sapiens__XP_005248857
auggccuccaccaccuccaccaagaagaugauggaggaggccaccugcuccaucugccucucccucaugaccaaccccgucuccaucaacugcggccacuccuacugccaccucugcaucaccgacuucuucaagaaccccucccagaagcagcuccgccaggagaccuucugcugcccccagugccgcgcccccuuccacauggacucccuccgccccaacaagcagcucggcucccucaucgaggcccucaaggagaccgaccaggagauguccugcgaggagcacggcgagcaguuccaccucuucugcgaggacgagggccagcucaucugcuggcgcugcgagcgcgccccccagcacaagggccacaccaccgcccucgucgaggacgucugccagggcuacaaggagaagcuccagaaggccgucaccaagcucaagcagcucgaggaccgcugcaccgagcagaagcucuccaccgccaugcgcaucaccaaguggaaggagaagguccagauccagcgccagaagauccgcuccgacuucaagaaccuccagugcuuccuccacgaggaggagaaguccuaccucuggcgccucgagaaggaggagcagcagacccucucccgccuccgcgacuacgaggccggccucggccucaaguccaacgagcucaagucccacauccucgagcucgaggagaagugccagggcuccgcccagaagcuccuccagaacgucaacgacacccucucccgcuccugggccgucaagcucgagaccuccgaggccgucucccucgagcuccacaccaugugcaacgucuccaagcucuacuucgacgucaagaagaugcuccgcucccaccaggucuccgucacccucgaccccgacaccgcccaccacgagcucauccucuccgaggaccgccgccaggucacccgcggcuacacccaggagaaccaggacaccuccucccgccgcuucaccgccuuccccugcguccucggcugcgagggcuucaccuccggccgccgcuacuucgaggucgacgucggcgagggcaccggcugggaccucggcgucugcauggagaacguccagcgcggcaccggcaugaagcaggagccccaguccggcuucuggacccuccgccucugcaagaagaagggcuacgucgcccucaccuccccccccaccucccuccaccuccacgagcagccccuccucgucggcaucuuccucgacuacgaggccggcgucgucuccuucuacaacggcaacaccggcugccacaucuucaccuuccccaaggccuccuucuccgacacccuccgccccuacuuccaggucuaccaguacuccccccucuuccuccccccccccggcgacuga

SEQ ID NO: 51159 - RNA, 1557 nt, Artificial Sequence
  derived and/or modified sequence opt2 from TRIM39__Homo_sapiens__NP_067076
auggccgagaccucccuccucgaggccggcgccuccgccgccuccaccgccgccgcccucgagaaccuccaggucgaggccuccugcuccgucugccucgaguaccucaaggagcccgucaucaucgagugcggccacaacuucugcaaggccugcaucacccgcuggugggaggaccucgagcgcgacuuccccugccccgucugccgcaagaccucccgcuaccgcucccuccgccccaaccgccagcucggcuccauggucgagaucgccaagcagcuccaggccgucaagcgcaagauccgcgacgagucccucugcccccagcaccacgaggcccucucccucuucugcuacgaggaccaggaggccgucugccucaucugcgccaucucccacacccaccgcgcccacaccgucgucccccucgacgacgccacccaggaguacaaggagaagcuccagaagugccucgagccccucgagcagaagcuccaggagaucacccgcugcaaguccuccgaggagaagaagcccggcgagcucaagcgccucgucgagucccgccgccagcagauccuccgcgaguucgaggagcuccaccgccgccucgacgaggagcagcagguccuccucucccgccucgaggaggaggagcaggacauccuccagcgccuccgcgagaacgccgcccaccucggcgacaagcgccgcgaccucgcccaccucgccgccgaggucgagggcaagugccuccaguccggcuucgagaugcucaaggacgucaaguccacccucgagaagaacaucccccgcaaguucggcggcucccucuccaccaucugcccccgcgaccacaaggcccuccucggccucgucaaggagaucaaccgcugcgagaaggucaagaccauggaggucaccuccgucuccaucgagcucgagaagaacuucuccaacuucccccgccaguacuucgcccuccgcaagauccucaagcagcucaucgccgacgucacccucgaccccgagaccgcccaccccaaccucguccucuccgaggaccgcaaguccgucaaguucgucgagacccgccuccgcgaccuccccgacaccccccgccgcuucaccuucuaccccugcguccucgccaccgagggcuucaccuccggccgccacuacugggaggucgaggucggcgacaagacccacugggccgucggcgucugccgcgacuccgucucccgcaagggcgagcucaccccccuccccgagaccggcuacuggcgcguccgccucuggaacggcgacaaguacgccgccaccaccacccccuucaccccccuccacaucaaggucaagcccaagcgcgucggcaucuuccucgacuacgaggccggcacccucuccuucuacaacgucaccgaccgcucccacaucuacaccuucaccgacaccuucaccgagaagcucuggccccucuucuaccccggcauccgcgccggccgcaagaacgccgccccccucaccauccgcccccccaccgacugggaguga

SEQ ID NO: 51160 - RNA, 2235 nt, Artificial Sequence
  derived and/or modified sequence opt2 from TRIM3__Homo_sapiens__XP_011518146
auggccaagcgcgaggacucccccggccccgagguccagcccauggacaagcaguuccucgucugcuccaucugccucgaccgcuaccagugccccaagguccuccccugccuccacaccuucugcgagcgcugccuccagaacuacauccccgcccagucccucacccucuccugccccgucugccgccagaccuccauccuccccgagcagggcgucuccgcccuccagaacaacuucuucaucuccucccucauggaggccaugcagcaggcccccgacggcgcccacgaccccgaggacccccacccccucuccgucgucgccggccgcccccucuccugccccaaccacgagggcaagaccauggaguucuacugcgaggccugcgagaccgccaugugcggcgagugccgcgccggcgagcaccgcgagcacggcaccguccuccuccgcgacgucgucgagcagcacaaggccgcccuccagcgccagcucgaggccguccgcggccgccucccccagcucuccgccgccaucgcccucgucggcggcaucucccagcagcuccaggagcgcaaggccgaggcccucgcccagaucuccgccgccuucgaggaccucgagcaggcccuccagcagcgcaagcaggcccucgucuccgaccucgagaccaucugcggcgccaagcagaagguccuccagucccagcucgacacccuccgccagggccaggagcacaucggcuccuccugcuccuucgccgagcaggcccuccgccucggcuccgcccccgagguccuccucguccgcaagcacaugcgcgagcgccucgccgcccucgccgcccaggccuuccccgagcgcccccacgagaacgcccagcucgagcucguccucgaggucgacggccuccgccgcuccguccucaaccucggcgcccuccucaccaccuccgccaccgcccacgagaccgucgccaccggcgagggccuccgccaggcccucgucggccagcccgccucccucaccgucaccaccaaggacaaggacggccgccucguccgcaccggcuccgccgagcuccgcgccgagaucaccggccccgacggcacccgccuccccguccccgucgucgaccacaagaacggcaccuacgagcucgucuacaccgcccgcaccgagggcgagcuccuccucuccguccuccucuacggccagcccguccgcggcucccccuuccgcguccgcgcccuccgccccggcgaccucccccccucccccgacgacgucaagcgccgcgucaagucccccggcggccccggcucccacguccgccagaaggccguccgccgccccuccuccauguacuccaccggcggcaagcgcaaggacaaccccaucgaggacgagcucgucuuccgcgucggcucccgcggccgcgagaagggcgaguucaccaaccuccagggcgucuccgccgccuccuccggccgcaucgucgucgccgacuccaacaaccagugcauccaggucuucuccaacgagggccaguucaaguuccgcuucggcguccgcggccgcucccccggccagcuccagcgccccaccggcgucgccgucgacaccaacggcgacaucaucgucgccgacuacgacaaccgcugggucuccaucuucucccccgagggcaaguucaagaccaagaucggcgccggccgccucaugggccccaagggcgucgccgucgaccgcaacggccacaucaucgucgucgacaacaaguccugcugcgucuucaccuuccagcccaacggcaagcucgucggccgcuucggcggccgcggcgccaccgaccgccacuucgccggcccccacuucgucgccgucaacaacaagaacgagaucgucgucaccgacuuccacaaccacuccgucaaggucuacuccgccgacggcgaguuccucuucaaguucggcucccacggcgagggcaacggccaguucaacgcccccaccggcgucgccgucgacuccaacggcaacaucaucgucgccgacuggggcaacucccgcauccaggucuucgacuccuccggcuccuuccucuccuacaucaacaccuccgccgagccccucuacggcccccagggccucgcccucaccuccgacggccacgucgucgucgccgacgccggcaaccacugcuucaaggccuaccgcuaccuccaguga

SEQ ID NO: 51161 - RNA, 777 nt, Artificial Sequence
  derived and/or modified sequence opt2 from TRIM40__Homo_sapiens__NP_001273562
augaucccccuccagaaggacaaccaggaggagggcgucugccccaucugccaggagucccucaaggaggccgucuccaccaacugcggccaccucuucugccgcgucugccucacccagcacgucgagaaggccuccgccuccggcgucuucugcugcccccucugccgcaagcccugcuccgaggagguccucggcaccggcuacaucugccccaaccaccagaagcgcgucugccgcuucugcgaggagucccgccuccuccucugcgucgagugccucgucucccccgagcacaugucccaccacgagcucaccaucgagaacgcccucucccacuacaaggagcgccucaaccgccgcucccgcaagcuccgcaaggacaucgccgagcuccagcgccucaaggcccagcaggagaagaagcuccaggcccuccaguuccaggucgaccacggcaaccaccgccucgaggccggccccgagucccagcaccagacccgcgagcagcucggcgcccucccccagcaguggcucggccagcucgagcacaugcccgccgaggccgcccgcauccucgacaucucccgcgccgucacccagcuccgcucccucgucaucgaccucgagcgcaccgccaaggagcucgacaccaacacccucaagaacgccggcgaccuccucaaccgcuccgccccccagaagcucgaggucaucuacccccagcucgagaagggcgucuccgagcuccuccuccagcccccccagaagcucuga

SEQ ID NO: 51162 - RNA, 2172 nt, Artificial Sequence
  derived and/or modified sequence opt2 from TRIM42__Homo_sapiens__NP_689829
auggagaccgccaugugcgucugcugccccugcugcaccuggcagcgcugcugcccccagcucugcuccugccucugcugcaaguucaucuucaccuccgagcgcaacugcaccugcuuccccugccccuacaaggacgagcgcaacugccaguucugccacugcaccugcuccgagucccccaacugccacuggugcugcugcuccugggccaacgaccccaacugcaagugcugcugcaccgccuccuccaaccucaacugcuacuacuacgagucccgcugcugccgcaacaccaucaucaccuuccacaagggccgccuccgcuccauccacaccuccuccaagaccgcccuccgcaccggcuccuccgacacccaggucgacgaggucaaguccauccccgccaacucccaccucgucaaccaccucaacugccccaugugcucccgccuccgccuccacuccuucaugcuccccugcaaccacucccucugcgagaagugccuccgccagcuccagaagcacgccgaggucaccgagaacuucuucauccucaucugccccgucugcgaccgcucccacugcaugcccuacuccaacaagaugcagcuccccgagaacuaccuccacggccgccucaccaagcgcuacaugcaggagcacggcuaccucaaguggcgcuucgaccgcuccuccggccccauccucugccaggucugccgcaacaagcgcaucgccuacaagcgcugcaucaccugccgccucaaccucugcaacgacugccucaaggccuuccacuccgacgucgccaugcaggaccacgucuucgucgacaccuccgccgaggagcaggacgagaagaucugcauccaccaccccuccucccgcaucaucgaguacugccgcaacgacaacaagcuccucugcaccuucugcaaguucuccuuccacaacggccacgacaccaucucccucaucgacgccugcuccgagcgcgccgccucccucuucuccgccaucgccaaguucaaggccguccgcuacgagaucgacaacgaccucauggaguucaacauccucaagaacuccuucaaggccgacaaggaggccaagcgcaaggagauccgcaacggcuuccucaagcuccgcuccauccuccaggagaaggagaagaucaucauggagcagaucgagaaccucgaggucucccgccagaaggagaucgagaaguacgucuacgucaccaccaugaaggucaacgagauggacggccucaucgccuacuccaaggaggcccucaaggagaccggccaggucgccuuccuccaguccgccaagauccucgucgaccagaucgaggacggcauccagaccaccuaccgccccgacccccagcuccgccuccacuccaucaacuacgucccccucgacuucgucgagcucuccuccgccauccacgagcucuuccccaccggccccaagaagguccgcuccuccggcgacucccuccccucccccuaccccguccacuccgagaccaugaucgcccgcaaggucaccuucuccacccacucccucggcaaccagcacaucuaccagcgcuccuccuccaugcucuccuucuccaacaccgacaagaaggccaaggucggccucgaggccugcggccgcgcccaguccgccacccccgccaagcccaccgacggccucuacaccuacugguccgccggcgccgacucccaguccguccagaacuccuccuccuuccacaacugguacuccuucaacgacggcuccgucaagacccccggccccaucgucaucuaccagacccucgucuacccccgcgccgccaaggucuacuggaccugccccgccgaggacgucgacuccuucgagauggaguucuacgaggucaucaccuccccccccaacaacguccagauggagcucugcggccagauccgcgacaucaugcagcagaaccucgagcuccacaaccucacccccaacaccgaguacgucuucaagguccgcgccaucaacgacaacggccccggccagugguccgacaucugcaaggucgucacccccgacggccacggcaagaaccgcgccaaguggggccuccucaagaacauccaguccgcccuccagaagcacuucuga

SEQ ID NO: 51163 - RNA, 1035 nt, Artificial Sequence
  derived and/or modified sequence opt2 from TRIM44__Homo_sapiens__NP_060053
auggccuccggcgucggcgccgccuucgaggagcucccccacgacggcaccugcgacgagugcgagcccgacgaggcccccggcgccgaggaggucugccgcgagugcggcuucugcuacugccgccgccacgccgaggcccaccgccagaaguuccucucccaccaccucgccgaguacguccacggcucccaggccuggaccccccccgccgacggcgagggcgccggcaaggaggaggccgaggucaaggucgagcaggagcgcgagaucgaguccgaggccggcgaggaguccgaguccgaggaggaguccgaguccgaggaggaguccgagaccgaggaggaguccgaggacgaguccgacgaggaguccgaggaggacuccgaggaggagauggaggacgagcaggaguccgaggccgaggaggacaaccaggaggagggcgaguccgaggccgagggcgagaccgaggccgaguccgaguucgaccccgagaucgagauggaggccgagcgcgucgccaagcgcaagugccccgaccacggccucgaccucuccaccuacugccaggaggaccgccagcucaucugcguccucugccccgucaucggcgcccaccagggccaccagcucuccacccucgacgaggccuucgaggagcuccgcuccaaggacuccggcggccucaaggccgccaugaucgagcucgucgagcgccucaaguucaaguccuccgaccccaaggucacccgcgaccagaugaagauguucauccagcaggaguucaagaagguccagaaggucaucgccgacgaggagcagaaggcccuccaccucgucgacauccaggaggccauggccaccgcccacgucaccgagauccucgccgacauccagucccacauggaccgccucaugacccagauggcccaggccaaggagcagcucgacaccuccaacgaguccgccgagcccaaggccgagggcgacgaggagggccccuccggcgccuccgaggaggaggacaccuga

SEQ ID NO: 51164 - RNA, 1464 nt, Artificial Sequence
  derived and/or modified sequence opt2 from TRIM50__Homo_sapiens__NP_835226
auggccuggcaggucucccuccccgagcucgaggaccgccuccagugccccaucugccucgaggucuucaaggagccccucaugcuccagugcggccacuccuacugcaagggcugccucgucucccucuccugccaccucgacgccgagcuccgcugccccgucugccgccaggccgucgacggcuccuccucccuccccaacgucucccucgcccgcgucaucgaggcccuccgccuccccggcgaccccgagcccaaggucugcguccaccaccgcaacccccucucccucuucugcgagaaggaccaggagcucaucugcggccucugcggccuccucggcucccaccagcaccaccccgucacccccgucuccaccgucuacucccgcaugaaggaggagcucgccgcccucaucuccgagcucaagcaggagcagaagaaggucgacgagcucaucgccaagcucgucaacaaccgcacccgcaucgucaacgaguccgacgucuucuccugggucauccgccgcgaguuccaggagcuccaccaccucgucgacgaggagaaggcccgcugccucgagggcaucggcggccacacccgcggccucgucgccucccucgacaugcagcucgagcaggcccagggcacccgcgagcgccucgcccaggccgagugcguccucgagcaguucggcaacgaggaccaccacaaguucauccgcaaguuccacuccauggccucccgcgccgagaugccccaggcccgcccccucgagggcgccuucucccccaucuccuucaagcccggccuccaccaggccgacaucaagcucaccgucuggaagcgccucuuccgcaagguccuccccgcccccgagccccucaagcucgaccccgccaccgcccacccccuccucgagcucuccaagggcaacaccgucguccagugcggccuccucgcccagcgccgcgccucccagcccgagcgcuucgacuacuccaccugcguccucgccucccgcggcuucuccugcggccgccacuacugggaggucgucgucggcuccaaguccgacuggcgccucggcgucaucaagggcaccgccucccgcaagggcaagcucaaccgcucccccgagcacggcgucuggcucaucggccucaaggagggccgcgucuacgaggccuucgccugcccccgcgucccccuccccgucgccggccacccccaccgcaucggccucuaccuccacuacgagcagggcgagcucaccuucuucgacgccgaccgccccgacgaccuccgcccccucuacaccuuccaggccgacuuccagggcaagcucuaccccauccucgacaccugcuggcacgagcgcggcuccaacucccuccccaugguccuccccccccccuccggccccggcccccucucccccgagcagcccaccaagcucuga

SEQ ID NO: 51165 - RNA, 2268 nt, Artificial Sequence
  derived and/or modified sequence opt2 from TRIM56__Homo_sapiens__NP_112223
auggucucccacggcuccucccccucccuccucgaggcccucuccuccgacuuccucgccugcaagaucugccucgagcagcuccgcgcccccaagacccuccccugccuccacaccuacugccaggacugccucgcccagcucgccgacggcggccgcguccgcugccccgagugccgcgagaccguccccgucccccccgagggcgucgccuccuucaagaccaacuucuucgucaacggccuccucgaccucgucaaggcccgcgccugcggcgaccuccgcgccggcaagcccgccugcgcccucugcccccucgucggcggcaccuccaccggcggccccgccaccgcccgcugccucgacugcgccgacgaccucugccaggccugcgccgacggccaccgcugcacccgccagacccacacccaccgcgucgucgaccucgucggcuaccgcgccggcugguacgacgaggaggcccgcgagcgccaggccgcccagugcccccagcaccccggcgaggcccuccgcuuccucugccagcccugcucccagcuccucugccgcgagugccgccucgacccccaccucgaccaccccugccucccccucgccgaggccguccgcgcccgccgccccggccucgagggccuccucgccggcgucgacaacaaccucgucgagcucgaggccgcccgccgcgucgagaaggaggcccucgcccgccuccgcgagcaggccgcccgcgucggcacccaggucgaggaggccgccgagggcguccuccgcgcccuccucgcccagaagcaggagguccucggccagcuccgcgcccacgucgaggccgccgaggaggccgcccgcgagcgccucgccgagcucgagggccgcgagcaggucgcccgcgccgccgccgccuucgcccgccgcguccucucccucggccgcgaggccgagauccucucccucgagggcgccaucgcccagcgccuccgccagcuccagggcugccccugggcccccggccccgcccccugccuccucccccagcucgagcuccaccccggccuccucgacaagaacugccaccuccuccgccucuccuucgaggagcagcagccccagaaggacggcggcaaggacggcgccggcacccagggcggcgaggagucccagucccgccgcgaggacgagcccaagaccgagcgccagggcggcguccagccccaggccggcgacggcgcccagacccccaaggaggagaaggcccagaccacccgcgaggagggcgcccagacccucgaggaggaccgcgcccagaccccccacgaggacggcggcccccagccccaccgcggcggccgccccaacaagaagaagaaguucaagggccgccucaaguccaucucccgcgagcccucccccgcccucggccccaaccucgacggcuccggccuccucccccgccccaucuucuacugcuccuuccccacccgcaugcccggcgacaagcgcuccccccgcaucaccggccucugccccuucggcccccgcgagauccucgucgccgacgagcagaaccgcgcccucaagcgcuucucccucaacggcgacuacaagggcaccguccccguccccgagggcugcucccccugcuccgucgccgcccuccaguccgccgucgccuucuccgccuccgcccgccucuaccucaucaaccccaacggcgagguccaguggcgccgcgcccucucccucucccaggccucccacgccgucgccgcccuccccuccggcgaccgcgucgccgucuccgucgccggccacgucgaggucuacaacauggagggcucccucgccacccgcuucauccccggcggcaaggccucccgcggccuccgcgcccucgucuuccucaccaccuccccccagggccacuucgucggcuccgacuggcagcagaacuccgucgucaucugcgacggccucggccaggucgucggcgaguacaagggccccggccuccacggcugccagcccggcuccgucuccgucgacaagaagggcuacaucuuccucacccuccgcgaggucaacaaggucgucauccucgaccccaagggcucccuccucggcgacuuccucaccgccuaccacggccucgagaagccccgcgucaccaccauggucgacggccgcuaccucgucgucucccucuccaacggcaccauccacaucuuccgcguccgcucccccgacuccuga

SEQ ID NO: 51166 - RNA, 1461 nt, Artificial Sequence
  derived and/or modified sequence opt2 from TRIM58__Homo_sapiens__NP_056246
auggccugggccccccccggcgagcgccuccgcgaggacgcccgcugccccgucugccucgacuuccuccaggagcccgucuccgucgacugcggccacuccuucugccuccgcugcaucuccgaguucugcgagaaguccgacggcgcccagggcggcgucuacgccugcccccagugccgcggccccuuccgccccuccggcuuccgccccaaccgccagcucgccggccucgucgaguccguccgccgccucggccucggcgccggccccggcgcccgccgcugcgcccgccacggcgaggaccucucccgcuucugcgaggaggacgaggccgcccucugcugggucugcgacgccggccccgagcaccgcacccaccgcaccgccccccuccaggaggccgccggcuccuaccaggucaagcuccagauggcccucgagcucaugcgcaaggagcucgaggacgcccucacccaggaggccaacgucggcaagaagaccgucaucuggaaggagaaggucgagaugcagcgccagcgcuuccgccucgaguucgagaagcaccgcggcuuccucgcccaggaggagcagcgccagcuccgccgccucgaggccgaggagcgcgccacccuccagcgccuccgcgaguccaagucccgccucguccagcaguccaaggcccucaaggagcucgccgacgagcuccaggagcgcugccagcgccccgcccucggccuccucgagggcguccgcggcguccucucccgcuccaaggccgucacccgccucgaggccgagaacauccccauggagcucaagaccgccugcugcauccccggccgccgcgagcuccuccgcaaguuccaggucgacgucaagcucgaccccgccaccgcccaccccucccuccuccucaccgccgaccuccgcuccguccaggacggcgagcccuggcgcgacguccccaacaaccccgagcgcuucgacaccuggcccugcauccucggccuccaguccuucuccuccggccgccacuacugggagguccucgucggcgagggcgccgaguggggccucggcgucugccaggacacccucccccgcaagggcgagaccacccccucccccgagaacggcgucugggcccucuggcuccucaagggcaacgaguacaugguccucgccucccccuccgucccccuccuccagcucgaguccccccgcugcaucggcaucuuccucgacuacgaggccggcgagaucuccuucuacaacgucaccgacggcuccuacaucuacaccuucaaccagcucuucuccggccuccuccgccccuacuucuucaucugcgacgccaccccccucauccucccccccaccaccaucgccggcuccggcaacugggccucccgcgaccaccucgaccccgccuccgacguccgcgacgaccaccucuga

SEQ ID NO: 51167 - RNA, 1212 nt, Artificial Sequence
  derived and/or modified sequence opt2 from TRIM59__Homo_sapiens__NP_775107
augcacaacuucgaggaggagcucaccugccccaucugcuacuccaucuucgaggacccccgcguccuccccugcucccacaccuucugccgcaacugccucgagaacauccuccaggccuccggcaacuucuacaucuggcgcccccuccgcaucccccucaagugccccaacugccgcuccaucaccgagaucgcccccaccggcaucgagucccuccccgucaacuucgcccuccgcgccaucaucgagaaguaccagcaggaggaccaccccgacaucgucaccugccccgagcacuaccgccagccccucaacgucuacugccuccucgacaagaagcucgucugcggccacugccucaccaucggccagcaccacggccaccccaucgacgaccuccaguccgccuaccucaaggagaaggacaccccccagaagcuccucgagcagcucaccgacacccacuggaccgaccucacccaccucaucgagaagcucaaggagcagaagucccacuccgagaagaugauccagggcgacaaggaggccguccuccaguacuucaaggagcucaacgacacccucgagcagaagaagaaguccuuccucaccgcccucugcgacgucggcaaccucaucaaccaggaguacaccccccagaucgagcgcaugaaggagauccgcgagcagcagcucgagcucauggcccucaccaucucccuccaggaggaguccccccucaaguuccucgagaaggucgacgacguccgccagcacguccagauccucaagcagcgcccccuccccgagguccagcccgucgagaucuacccccgcgucuccaagauccucaaggaggaguggucccgcaccgagaucggccagaucaagaacguccucauccccaagaugaagaucucccccaagcgcauguccugcuccuggcccggcaaggacgagaaggaggucgaguuccucaagauccucaacaucgucgucgucacccucaucuccgucauccucauguccauccucuucuucaaccagcacaucaucaccuuccucuccgagaucacccucaucugguucuccgaggccucccucuccgucuaccagucccucuccaacucccuccacaaggucaagaacauccucugccacaucuucuaccuccucaaggaguucgucuggaagaucgucucccacuga

SEQ ID NO: 51168 - RNA, 1482 nt, Artificial Sequence
  derived and/or modified sequence opt2 from TRIM5__Homo_sapiens__NP_149023
auggccuccggcauccucgucaacgucaaggaggaggucaccugccccaucugccucgagcuccucacccagccccucucccucgacugcggccacuccuucugccaggccugccucaccgccaaccacaagaaguccaugcucgacaagggcgaguccuccugccccgucugccgcaucuccuaccagcccgagaacauccgccccaaccgccacgucgccaacaucgucgagaagcuccgcgaggucaagcucucccccgagggccagaaggucgaccacugcgcccgccacggcgagaagcuccuccucuucugccaggaggacggcaaggucaucugcuggcucugcgagcgcucccaggagcaccgcggccaccacaccuuccucaccgaggaggucgcccgcgaguaccaggucaagcuccaggccgcccucgagaugcuccgccagaagcagcaggaggccgaggagcucgaggccgacauccgcgaggagaaggccuccuggaagacccagauccaguacgacaagaccaacguccucgccgacuucgagcagcuccgcgacauccucgacugggaggaguccaacgagcuccagaaccucgagaaggaggaggaggacauccucaagucccucaccaacuccgagaccgagaugguccagcagacccagucccuccgcgagcucaucuccgaccucgagcaccgccuccagggcuccgucauggagcuccuccagggcgucgacggcgucaucaagcgcaccgagaacgucacccucaagaagcccgagaccuuccccaagaaccagcgccgcgucuuccgcgcccccgaccucaagggcaugcucgaggucuuccgcgagcucaccgacguccgccgcuacugggucgacgucaccgucgcccccaacaacaucuccugcgccgucaucuccgaggacaagcgccaggucuccucccccaagccccagaucaucuacggcgcccgcggcacccgcuaccagaccuucgucaacuucaacuacugcaccggcauccucggcucccaguccaucaccuccggcaagcacuacugggaggucgacgucuccaagaagaccgccuggauccucggcgucugcgccggcuuccagcccgacgccaugugcaacaucgagaagaacgagaacuaccagcccaaguacggcuacugggucaucggccucgaggagggcgucaagugcuccgccuuccaggacuccuccuuccacacccccuccguccccuucaucgucccccucuccgucaucaucugccccgaccgcgucggcgucuuccucgacuacgaggccugcaccgucuccuucuucaacaucaccaaccacggcuuccucaucuacaaguucucccacugcuccuucucccagcccgucuuccccuaccucaacccccgcaagugcggcguccccaugacccucugcucccccuccuccuga

SEQ ID NO: 51169 - RNA, 1065 nt, Artificial Sequence
  derived and/or modified sequence opt2 from TRIM62__Homo_sapiens__XP_011540007
augcccgagaagaccgccgucgaccagcccuggacccaggcccuccgcgagcucaaggaccagcuccaggcccuccaggacuccgagcgcgagcacaccgaggcccuccagcuccucaagcgccagcucgccgagaccaaguccuccaccaagucccuccgcaccaccaucggcgaggccuucgagcgccuccaccgccuccuccgcgagcgccagaaggccaugcucgaggagcucgaggccgacaccgcccgcacccucaccgacaucgagcagaagguccagcgcuacucccagcagcuccgcaagguccaggagggcgcccagauccuccaggagcgccucgccgagaccgaccgccacaccuuccucgccggcgucgccucccucuccgagcgccucaagggcaagauccacgagaccaaccucaccuacgaggacuuccccaccuccaaguacaccggcccccuccaguacaccaucuggaagucccucuuccaggacauccaccccguccccgccgcccucacccucgaccccggcaccgcccaccagcgccucauccucuccgacgacugcaccaucgucgccuacggcaaccuccacccccagccccuccaggacucccccaagcgcuucgacgucgaggucuccguccucggcuccgaggccuucuccuccggcguccacuacugggaggucgucgucgccgagaagacccagugggucaucggccucgcccacgaggccgccucccgcaagggcuccauccagauccagcccucccgcggcuucuacugcaucgucaugcacgacggcaaccaguacuccgccugcaccgagcccuggacccgccucaacguccgcgacaagcucgacaaggucggcgucuuccucgacuacgaccagggccuccucaucuucuacaacgccgacgacauguccuggcucuacaccuuccgcgagaaguuccccggcaagcucugcuccuacuucucccccggccagucccacgccaacggcaagaacguccagccccuccgcaucaacaccguccgcaucuga

SEQ ID NO: 51170 - RNA, 3651 nt, Artificial Sequence
  derived and/or modified sequence opt2 from TRIM66__Homo_sapiens__NP_055633
auggcccgcaacugcuccgagugcaaggagaagcgcgccgcccacauccucugcaccuacugcaaccgcuggcucugcuccuccugcaccgaggagcaccgccacucccccguccccggcggccccuucuucccccgcgcccagaagggcucccccggcgucaacggcggccccggcgacuucacccucuacugcccccuccacacccaggagguccucaagcucuucugcgagaccugcgacaugcucaccugccacuccugccucgucgucgagcacaaggagcaccgcugccgccacgucgaggagguccuccagaaccagcgcaugcuccucgagggcgucaccacccaggucgcccacaagaaguccucccuccagaccuccgccaagcagaucgaggaccgcaucuucgaggucaagcaccagcaccgcaaggucgagaaccagaucaagauggccaagaugguccucaugaacgagcucaacaagcaggccaacggccucaucgaggagcucgagggcaucaccaacgagcgcaagcgcaagcucgagcagcagcuccaguccaucaugguccucaaccgccaguucgagcacguccagaacuucaucaacugggccgucugcuccaagaccuccguccccuuccucuucuccaaggagcucaucgucuuccagaugcagcgccuccucgagaccuccugcaacaccgaccccggcucccccugguccauccgcuucaccugggagcccaacuucuggaccaagcagcucgccucccucggcugcaucaccaccgagggcggccagaugucccgcgccgacgcccccgccuacggcggccuccagggcuccucccccuucuaccagucccaccagucccccgucgcccagcaggaggcccucucccaccccucccacaaguuccagucccccgccgucugcuccuccuccgucugcugcucccacugcucccccgucucccccucccucaagggccagguccccccccccuccauccaccccgcccacuccuuccgccagccccccgagauggucccccagcagcucggcucccuccagugcuccgcccuccucccccgcgagaaggagcucgccugcuccccccacccccccaagcuccuccagcccuggcucgagacccagccccccgucgagcaggaguccaccucccagcgccucggccagcagcucaccucccagcccgucugcaucguccccccccaggacguccagcagggcgcccacgcccagcccacccuccagacccccuccauccagguccaguucggccaccaccagaagcucaagcucucccacuuccagcagcagccccagcagcagcuccccccccccccccccccccucccccaccccccccccccccuccccccccccccccagcagccccaccccccccucccccccucccagcaccucgccuccucccagcacgaguccccccccggccccgccugcucccagaacauggacaucaugcaccacaaguucgagcucgaggagaugcagaaggaccucgagcuccuccuccaggcccagcagcccucccuccagcucucccagaccaaguccccccagcaccuccagcagaccaucgucggccagaucaacuacaucguccgccagcccgcccccguccagucccagucccaggaggagacccuccaggccaccgacgagccccccgccucccagggcuccaagcccgcccucccccucgacaagaacaccgccgccgcccucccccaggccuccggcgaggagaccccccucuccgucccccccgucgacuccaccauccagcacuccucccccaacgucguccgcaagcacuccaccucccucuccaucaugggcuucuccaacacccucgagauggagcucuccuccacccgccucgagcgcccccucgagccccagauccaguccgucuccaaccucaccgccggcgccccccaggccguccccucccuccucuccgccccccccaagauggucuccucccucaccuccguccagaaccaggccaugcccucccucaccaccucccaccuccagaccguccccucccucguccacuccaccuuccaguccaugcccaaccucaucuccgacuccccccaggccauggccucccucgccuccgaccacccccaggccggccccucccucauguccggccacacccaggccguccccucccucgccaccugcccccuccaguccaucccccccgucuccgacaugcagcccgagaccggcuccuccuccuccuccggccgcaccuccggcucccucugcccccgcgacggcgccgaccccucccucgagaacgcccucugcaaggucaagcucgaggagcccaucaaccucuccgucaagaagcccccccucgcccccgucgucuccaccuccaccgcccuccagcaguaccagaaccccaaggagugcgagaacuucgagcagggcgcccucgagcucgacgccaaggagaaccaguccauccgcgccuucaacuccgagcacaagauccccuacguccgccucgagcgccucaagaucugcgccgccuccuccggcgagaugcccgucuucaagcucaagccccagaagaacgaccaggacggcuccuuccuccucaucaucgagugcggcaccgaguccuccuccauguccaucaaggucucccaggaccgccucuccgaggccacccaggcccccggccucgagggccgcaaggucaccgucaccucccucgccggccagcgcccccccgaggucgagggcaccucccccgaggagcaccgccucaucccccgcacccccggcgccaagaagggcccccccgcccccaucgagaacgaggacuucugcgccgucugccucaacggcggcgagcuccucugcugcgaccgcugccccaaggucuuccaccucuccugccacguccccgcccuccucuccuuccccggcggcgagugggucugcacccucugccgcucccucacccagcccgagauggaguacgacugcgagaacgccugcuacaaccagcccggcaugcgcgccucccccggccucuccauguacgaccagaagaagugcgagaagcucguccucucccucugcugcaacaaccucucccuccccuuccacgagcccgucuccccccucgcccgccacuacuaccagaucaucaagcgccccauggaccucuccaucauccgccgcaagcuccagaagaaggaccccgcccacuacaccacccccgaggaggucgucuccgacguccgccucauguucuggaacugcgccaaguucaacuaccccgacuccgaggucgccgaggccggccgcugccucgaggucuucuucgagggcuggcucaaggagaucuaccccgagaagcgcuucgcccagccccgccaggaggacuccgacuccgaggaggucuccuccgaguccggcugcuccaccccccagggcuuccccuggccccccuacaugcaggagggcauccagcccaagcgccgccgccgccacauggagaacgagcgcgccaagcgcauguccuuccgccucgccaacuccaucucccaggucuga

SEQ ID NO: 51171 - RNA, 789 nt, Artificial Sequence
  derived and/or modified sequence opt2 from TRIM68__Homo_sapiens__NP_001291425
augcagaagcucgagcucaaccacuccgagcucauccagcagucccagguccucuggcgcaugaucgccgagcucaaggagcgcucccagcgccccguccgcuggaugcuccaggacauccaggagguccucaaccgcuccaaguccuggucccuccagcagcccgagcccaucucccucgagcucaagaccgacugccgcguccucggccuccgcgagauccucaagaccuacgccgccgacguccgccucgaccccgacaccgccuacucccgccucaucgucuccgaggaccgcaagcgcguccacuacggcgacaccaaccagaagcuccccgacaaccccgagcgcuucuaccgcuacaacaucguccucggcucccagugcaucuccuccggccgccacuacugggaggucgaggucggcgaccgcuccgaguggggccucggcgucugcaagcagaacgucgaccgcaaggaggucgucuaccucuccccccacuacggcuucugggucauccgccuccgcaagggcaacgaguaccgcgccggcaccgacgaguaccccauccucucccuccccguccccccccgccgcgucggcaucuucgucgacuacgaggcccacgacaucuccuucuacaacgucaccgacugcggcucccacaucuucaccuucccccgcuaccccuuccccggccgccuccuccccuacuucucccccugcuacuccaucggcaccaacaacaccgccccccucgccaucugcucccucgacggcgaggacuga

SEQ ID NO: 51172 - RNA, 891 nt, Artificial Sequence
  derived and/or modified sequence opt2 from TRIM69__Homo_sapiens__NP_001288073
auggaguuccucaagcuccaccaguuccuccacuccaaggagaaggacauccucaccgagcuccgcgaggagggcaaggcccucaacgaggagauggagcucaaccucucccagcuccaggagcagugccuccucgccaaggacaugcucgucuccauccaggccaagaccgagcagcagaacuccuucgacuuccucaaggacaucaccacccuccuccacucccucgagcagggcaugaagguccucgccacccgcgagcucaucucccgcaagcucaaccucggccaguacaagggccccauccaguacauggucuggcgcgagaugcaggacacccucugccccggccucuccccccucacccucgaccccaagaccgcccaccccaaccucguccucuccaagucccagaccuccgucuggcacggcgacaucaagaagaucaugcccgacgaccccgagcgcuucgacuccuccgucgccguccucggcucccgcggcuucaccuccggcaagugguacugggaggucgaggucgccaagaagaccaaguggaccgucggcgucguccgcgaguccaucauccgcaagggcuccugcccccucacccccgagcagggcuucuggcuccuccgccuccgcaaccagaccgaccucaaggcccucgaccuccccuccuucucccucacccucaccaacaaccucgacaaggucggcaucuaccucgacuacgagggcggccagcucuccuucuacaacgccaagaccaugacccacaucuacaccuucuccaacaccuucauggagaagcucuaccccuacuucugccccugccucaacgacggcggcgagaacaaggagccccuccacauccuccacccccaguga

SEQ ID NO: 51173 - RNA, 2529 nt, Artificial Sequence
  derived and/or modified sequence opt2 from TRIM6-TRIM34__Homo_sapiens__NP_001003819
augugcggcuccgagcgcauccuccaggccggcaacauccucgagauccgcgucggccaggccggcgcccgccgcgucgccaccaugaccucccccguccucgucgacauccgcgaggaggucaccugccccaucugccucgagcuccucaccgagccccucuccaucgacugcggccacuccuucugccaggccugcaucacccccaacggccgcgaguccgucaucggccaggagggcgagcgcuccugccccgucugccagaccuccuaccagcccggcaaccuccgccccaaccgccaccucgccaacaucguccgccgccuccgcgaggucguccucggccccggcaagcagcucaaggccguccucugcgccgaccacggcgagaagcuccagcucuucugccaggaggacggcaaggucaucugcuggcucugcgagcgcucccaggagcaccgcggccaccacaccuuccucgucgaggaggucgcccaggaguaccaggagaaguuccaggagucccucaagaagcucaagaacgaggagcaggaggccgagaagcucaccgccuucauccgcgagaagaagaccuccuggaagaaccagauggagcccgagcgcugccgcauccagaccgaguucaaccagcuccgcaacauccucgaccgcgucgagcagcgcgagcucaagaagcucgagcaggaggagaagaagggccuccgcaucaucgaggaggccgagaacgaccucguccaccagacccagucccuccgcgagcucaucuccgaccucgagcgccgcugccagggcuccaccauggagcuccuccaggacgucuccgacgucaccgagcgcuccgaguucuggacccuccgcaagcccgaggcccuccccaccaagcuccgcuccauguuccgcgcccccgaccucaagcgcaugcuccgcgucugccgcgagcucaccgacguccaguccuacugggccauccagggcucccucacccgccgcgagcgccgcgccuccggcguccgcacccgccgcucccagggcuccuccgccauggccuccaagauccuccucaacguccaggaggaggucaccugccccaucugccucgagcuccucaccgagccccucucccucgacugcggccacucccucugccgcgccugcaucaccgucuccaacaaggaggccgucaccuccaugggcggcaaguccuccugccccgucugcggcaucuccuacuccuucgagcaccuccaggccaaccagcaccucgccaacaucgucgagcgccucaaggaggucaagcucucccccgacaacggcaagaagcgcgaccucugcgaccaccacggcgagaagcuccuccucuucugcaaggaggaccgcaaggucaucugcuggcucugcgagcgcucccaggagcaccgcggccaccacaccguccucaccgaggaggucuucaaggagugccaggagaagcuccaggccguccucaagcgccucaagaaggaggaggaggaggccgagaagcucgaggccgacauccgcgaggagaagaccuccuggaaguaccagguccagaccgagcgccagcgcauccagaccgaguucgaccagcuccgcuccauccucaacaacgaggagcagcgcgagcuccagcgccucgaggaggaggagaagaagacccucgacaaguucgccgaggccgaggacgagcucguccagcagaagcagcucguccgcgagcucaucuccgacgucgagugccgcucccagugguccaccauggagcuccuccaggacauguccggcaucaugaagugguccgagaucuggcgccucaagaagcccaagauggucuccaagaagcucaagaccgucuuccacgcccccgaccucucccgcaugcuccagauguuccgcgagcucaccgccguccgcugcuacugggucgacgucacccucaacuccgucaaccucaaccucaaccucguccucuccgaggaccagcgccaggucaucuccguccccaucuggcccuuccagugcuacaacuacggcguccucggcucccaguacuucuccuccggcaagcacuacugggaggucgacgucuccaagaagaccgccuggauccucggcgucuacugccgcaccuacucccgccacaugaaguacgucguccgccgcugcgccaaccgccagaaccucuacaccaaguaccgcccccucuucggcuacugggucaucggccuccagaacaagugcaaguacggcgucuucgaggagucccucuccuccgaccccgagguccucacccucuccauggccgucccccccugccgcgucggcgucuuccucgacuacgaggccggcaucgucuccuucuucaacgucaccucccacggcucccucaucuacaaguucuccaagugcugcuucucccagcccgucuaccccuacuucaaccccuggaacugccccgcccccaugacccucugcccccccuccuccuga

SEQ ID NO: 51174 - RNA, 2607 nt, Artificial Sequence
  derived and/or modified sequence opt2 from TRIM71__Homo_sapiens__NP_001034200
auggccuccuuccccgagaccgacuuccagaucugccuccucugcaaggagaugugcggcucccccgccccccucuccuccaacuccuccgccuccuccuccuccucccagaccuccaccuccuccggcggcggcggcggcggccccggcgccgccgcccgccgccuccacguccuccccugccuccacgccuucugccgccccugccucgaggcccaccgccuccccgccgccggcggcggcgccgccggcgagccccucaagcuccgcugccccgucugcgaccagaaggucguccucgccgaggccgccggcauggacgcccuccccuccuccgccuuccuccucuccaaccuccucgacgccgucgucgccaccgccgacgagcccccccccaagaacggccgcgccggcgcccccgccggcgccggcggccacuccaaccaccgccaccacgcccaccacgcccacccccgcgccuccgccuccgcccccccccucccccaggccccccagccccccgcccccucccgcuccgcccccggcggccccgccgccucccccuccgcccuccuccuccgccgcccccacggcugcuccuccugcgacgagggcaacgccgccuccucccgcugccucgacugccaggagcaccucugcgacaacugcguccgcgcccaccagcgcguccgccucaccaaggaccacuacaucgagcgcggcccccccggccccggcgccgccgccgccgcccagcagcucggccucggcccccccuuccccggcccccccuucuccauccucuccgucuuccccgagcgccucggcuucugccagcaccacgacgacgagguccuccaccucuacugcgacaccugcuccguccccaucugccgcgagugcaccaugggccgccacggcggccacuccuucaucuaccuccaggaggcccuccaggacucccgcgcccucaccauccagcuccucgccgacgcccagcagggccgccaggccauccagcucuccaucgagcaggcccagaccgucgccgagcaggucgagaugaaggccaaggucguccaguccgaggucaaggccgucaccgcccgccacaagaaggcccucgaggagcgcgagugcgagcuccucuggaaggucgagaagauccgccaggucaaggccaagucccucuaccuccaggucgagaagcuccgccagaaccucaacaagcucgaguccaccaucuccgccguccagcagguccucgaggagggccgcgcccucgacauccuccucgcccgcgaccgcaugcucgcccagguccaggagcucaagaccguccgcucccuccuccagccccaggaggacgaccgcgucauguucaccccccccgaccaggcccucuaccucgccaucaaguccuucggcuucgucuccuccggcgccuucgccccccucaccaaggccaccggcgacggccucaagcgcgcccuccagggcaaggucgccuccuucaccgucaucggcuacgaccacgacggcgagccccgccucuccggcggcgaccucauguccgccgucguccucggccccgacggcaaccucuucggcgccgaggucuccgaccagcagaacggcaccuacgucgucuccuaccgcccccagcucgagggcgagcaccucgucuccgucacccucugcaaccagcacaucgagaacucccccuucaaggucgucgucaaguccggccgcuccuacgucggcaucggccuccccggccucuccuucggcuccgagggcgacuccgacggcaagcucugccgccccuggggcgucuccgucgacaaggagggcuacaucaucgucgccgaccgcuccaacaaccgcauccaggucuucaagcccugcggcgccuuccaccacaaguucggcacccucggcucccgccccggccaguucgaccgccccgccggcgucgccugcgacgccucccgccgcaucgucgucgccgacaaggacaaccaccgcauccagaucuucaccuucgagggccaguuccuccucaaguucggcgagaagggcaccaagaacggccaguucaacuaccccugggacgucgccgucaacuccgagggcaagauccucgucuccgacacccgcaaccaccgcauccagcucuucggccccgacggcgucuuccucaacaaguacggcuucgagggcgcccucuggaagcacuucgacuccccccgcggcgucgccuucaaccacgagggccaccucgucgucaccgacuucaacaaccaccgccuccucgucauccaccccgacugccaguccgcccgcuuccucggcuccgagggcaccggcaacggccaguuccuccgcccccagggcgucgccgucgaccaggagggccgcaucaucgucgccgacucccgcaaccaccgcguccagauguucgaguccaacggcuccuuccucugcaaguucggcgcccagggcuccggcuucggccagauggaccgccccuccggcaucgccaucacccccgacggcaugaucgucgucgucgacuucggcaacaaccgcauccucgucuucuga

SEQ ID NO: 51175 - RNA, 1434 nt, Artificial Sequence
  derived and/or modified sequence opt2 from TRIM72__Homo_sapiens__NP_001008275
auguccgccgcccccggccuccuccaccaggagcucuccugcccccucugccuccagcucuucgacgcccccgucaccgccgagugcggccacuccuucugccgcgccugccucggccgcgucgccggcgagcccgccgccgacggcaccguccucugccccugcugccaggcccccacccgcccccaggcccucuccaccaaccuccagcucgcccgccucgucgagggccucgcccaggucccccagggccacugcgaggagcaccucgacccccucuccaucuacugcgagcaggaccgcgcccucgucugcggcgucugcgccucccucggcucccaccgcggccaccgccuccuccccgccgccgaggcccacgcccgccucaagacccagcucccccagcagaagcuccagcuccaggaggccugcaugcgcaaggagaaguccgucgccguccucgagcaccagcucgucgaggucgaggagaccguccgccaguuccgcggcgccgucggcgagcagcucggcaagaugcgcgucuuccucgccgcccucgagggcucccucgaccgcgaggccgagcgcguccgcggcgaggccggcgucgcccuccgccgcgagcucggcucccucaacuccuaccucgagcagcuccgccagauggagaagguccucgaggaggucgccgacaagccccagaccgaguuccucaugaaguacugccucgucaccucccgccuccagaagauccucgccgagucccccccccccgcccgccucgacauccagcuccccaucaucuccgacgacuucaaguuccaggucuggcgcaagauguuccgcgcccucaugcccgcccucgaggagcucaccuucgaccccuccuccgcccaccccucccucgucgucuccuccuccggccgccgcgucgagugcuccgagcagaaggccccccccgccggcgaggacccccgccaguucgacaaggccgucgccgucgucgcccaccagcagcucuccgagggcgagcacuacugggaggucgacgucggcgacaagccccgcugggcccucggcgucaucgccgccgaggccccccgccgcggccgccuccacgccguccccucccagggccucuggcuccucggccuccgcgagggcaagauccucgaggcccacgucgaggccaaggagccccgcgcccuccgcucccccgagcgccgccccacccgcaucggccucuaccucuccuucggcgacggcguccucuccuucuacgacgccuccgacgccgacgcccucgucccccucuucgccuuccacgagcgccucccccgccccgucuaccccuucuucgacgucugcuggcacgacaagggcaagaacgcccagccccuccuccucgucggccccgagggcgccgaggccuga

SEQ ID NO: 51176 - RNA, 753 nt, Artificial Sequence
  derived and/or modified sequence opt2 from TRIM73__Homo_sapiens__NP_944606
auggccuggcaggucucccuccucgagcucgaggaccgccuccagugccccaucugccucgaggucuucaaggagucccucaugcuccagugcggccacuccuacugcaagggcugccucgucucccucuccuaccaccucgacaccaagguccgcugccccaugugcuggcaggucgucgacggcuccuccucccuccccaacgucucccucgccugggucaucgaggcccuccgccuccccggcgaccccgagcccaaggucugcguccaccaccgcaacccccucucccucuucugcgagaaggaccaggagcucaucugcggccucugcggccuccucggcucccaccagcaccaccccgucacccccgucuccaccgucugcucccgcaugaaggaggagcucgccgcccucuucuccgagcucaagcaggagcagaagaaggucgacgagcucaucgccaagcucgucaagaaccgcacccgcaucgucaacgaguccgacgucuucuccugggucauccgccgcgaguuccaggagcuccgccaccccgucgacgaggagaaggcccgcugccucgagggcaucggcggccacacccgcggccucgucgccucccucgacaugcagcucgagcaggcccagggcacccgcgagcgccucgcccaggccgagugcguccucgagcaguucggcaacgaggaccaccacgaguucaucuggaaguuccacuccauggccucccgcuga

SEQ ID NO: 51177 - RNA, 750 nt, Artificial Sequence
  derived and/or modified sequence opt2 from TRIM74__Homo_sapiens__XP_011514491
auggccuggcaggucucccuccucgagcucgaggacuggcuccagugccccaucugccucgaggucuucaaggagucccucaugcuccagugcggccacuccuacugcaagggcugccucgucucccucuccuaccaccucgacaccaagguccgcugccccaugugcuggcaggucgucgacggcuccuccucccuccccaacgucucccucgccugggucaucgaggcccuccgccuccccggcgaccccgagcccaaggucugcguccaccaccgcaacccccucucccucuucugcgagaaggaccaggagcucaucugcggccucugcggccuccucggcucccaccagcaccaccccgucacccccgucuccaccgucugcucccgcaugaaggaggagcucgccgcccucuucuccgagcucaagcaggagcagaagaaggucgacgagcucaucgccaagcucgucaagaaccgcacccgcaucgucaacgaguccgacgucuucuccugggucauccgccgcgaguuccaggagcuccgccaccccgucgacgaggagaaggcccgcugccucgagggcaucggcggccacacccgcggccucgucgccucccucgacaugcagcucgagcaggcccagggcacccgcgagcgccucgcccaggccgagugcguccucgagcaguucggcaacgaggaccaccacgaguucaucugguuccacuccauggccucccgcuga

SEQ ID NO: 51178 - RNA, 1656 nt, Artificial Sequence
  derived and/or modified sequence opt2 from TRIM8__Homo_sapiens__NP_112174
auggccgagaacuggaagaacugcuucgaggaggagcucaucugccccaucugccuccacgucuucgucgagcccguccagcuccccugcaagcacaacuucugccgcggcugcaucggcgaggccugggccaaggacuccggccucguccgcugccccgagugcaaccaggccuacaaccagaagcccggccucgagaagaaccucaagcucaccaacaucgucgagaaguucaacgcccuccacgucgagaagccccccgccgcccuccacugcgucuucugccgccgcggccccccccuccccgcccagaaggucugccuccgcugcgaggcccccugcugccagucccacguccagacccaccuccagcagcccuccaccgcccgcggccaccuccucgucgaggccgacgacguccgcgccugguccugcccccagcacaacgccuaccgccucuaccacugcgaggccgagcaggucgccgucugccaguacugcugcuacuacuccggcgcccaccagggccacuccgucugcgacgucgagauccgccgcaacgagauccgcaagaugcucaugaagcagcaggaccgccucgaggagcgcgagcaggacaucgaggaccagcucuacaagcucgaguccgacaagcgccucgucgaggagaaggucaaccagcucaaggaggagguccgccuccaguacgagaagcuccaccagcuccucgacgaggaccuccgccagaccgucgagguccucgacaaggcccaggccaaguucugcuccgagaacgccgcccaggcccuccaccucggcgagcgcaugcaggaggccaagaagcuccucggcucccuccagcuccucuucgacaagaccgaggacgucuccuucaugaagaacaccaaguccgucaagauccucauggaccgcacccagaccugcaccuccuccucccucucccccaccaagaucggccaccucaacuccaagcucuuccucaacgaggucgccaagaaggagaagcagcuccgcaagaugcucgagggccccuucuccacccccguccccuuccuccaguccgucccccucuaccccugcggcgucuccuccuccggcgccgagaagcgcaagcacuccaccgccuuccccgaggccuccuuccucgagaccuccuccggccccgucggcggccaguacggcgccgccggcaccgccuccggcgagggccaguccggccagccccucggccccugcuccuccacccagcaccucgucgcccuccccggcggcgcccagcccguccacuccucccccgucuucccccccucccaguaccccaacggcuccgccgcccagcagcccaugcucccccaguacggcggccgcaagauccucgucugcuccgucgacaacugcuacugcuccuccgucgccaaccacggcggccaccagcccuacccccgcuccggccacuuccccuggaccguccccucccaggaguacucccacccccucccccccacccccuccgucccccagucccuccccucccucgccguccgcgacuggcucgacgccucccagcagcccggccaccaggacuucuaccgcgucuacggccagcccuccaccaagcacuacgucaccuccuga

SEQ ID NO: 51179 - RNA, 2133 nt, Artificial Sequence
  derived and/or modified sequence opt2 from TRIM9__Homo_sapiens__NP_055978
auggaggagauggaggaggagcucaagugccccgucugcggcuccuucuaccgcgagcccaucauccuccccugcucccacaaccucugccaggccugcgcccgcaacauccucguccagacccccgaguccgaguccccccagucccaccgcgccgccggcuccggcgucuccgacuacgacuaccucgaccucgacaagaugucccucuacuccgaggccgacuccggcuacggcuccuacggcggcuucgccuccgcccccaccacccccugccagaagucccccaacggcguccgcgucuucccccccgccaugcccccccccgccacccaccucucccccgcccucgcccccgucccccgcaacuccugcaucaccugcccccagugccaccgcucccucauccucgacgaccgcggccuccgcggcuuccccaagaaccgcguccucgagggcgucaucgaccgcuaccagcaguccaaggccgccgcccucaagugccagcucugcgagaaggcccccaaggaggccaccgucaugugcgagcagugcgacgucuucuacugcgaccccugccgccuccgcugccaccccccccgcggcccccucgccaagcaccgccucgucccccccgcccagggccgcgucucccgccgccucuccccccgcaaggucuccaccugcaccgaccacgagcucgagaaccacuccauguacugcguccagugcaagaugcccgucugcuaccagugccucgaggagggcaagcacuccucccacgaggucaaggcccucggcgccauguggaagcuccacaagucccagcucucccaggcccucaacggccucuccgaccgcgccaaggaggccaaggaguuccucguccagcuccgcaacaugguccagcagauccaggagaacuccgucgaguucgaggccugccucgucgcccagugcgacgcccucaucgacgcccucaaccgccgcaaggcccagcuccucgcccgcgucaacaaggagcacgagcacaagcucaaggucguccgcgaccagaucucccacugcaccgucaagcuccgccagaccaccggccucauggaguacugccucgaggucaucaaggagaacgaccccuccggcuuccuccagaucuccgacgcccucauccgccgcguccaccucaccgaggaccaguggggcaagggcacccucaccccccgcaugaccaccgacuucgaccucucccucgacaacuccccccuccuccaguccauccaccagcucgacuucguccaggucaaggccuccucccccguccccgccacccccauccuccagcucgaggagugcugcacccacaacaacuccgccacccucuccuggaagcagcccccccucuccaccguccccgccgacggcuacauccucgagcucgacgacggcaacggcggccaguuccgcgaggucuacgucggcaaggagaccaugugcaccgucgacggccuccacuucaacuccaccuacaacgcccgcgucaaggccuucaacaagaccggcgucucccccuacuccaagacccucguccuccagaccuccgaggucgccugguucgccuucgaccccggcuccgcccacuccgacaucauccucuccaacgacaaccucaccgucaccugcuccuccuacgacgaccgcgucguccucggcaagaccggcuucuccaagggcauccacuacugggagcucaccgucgaccgcuacgacaaccaccccgaccccgccuucggcgucgcccgcauggacgucaugaaggacgucaugcucggcaaggacgacaaggccugggccauguacgucgacaacaaccgcuccugguucaugcacaacaacucccacaccaaccgcaccgagggcggcaucaccaagggcgccaccaucggcguccuccucgaccucaaccgcaagaaccucaccuucuucaucaacgacgagcagcagggccccaucgccuucgacaacgucgagggccucuucuuccccgccgucucccucaaccgcaacguccaggucacccuccacaccggccuccccguccccgacuucuacuccucccgcgccuccaucgccuga

SEQ ID NO: 51180 - RNA, 7098 nt, Artificial Sequence
  derived and/or modified sequence opt2 from TRIOBP__Homo_sapiens__NP_001034230
auggaggagguccccggcgacgcccucugcgagcacuucgaggccaacauccucacccagaaccgcugccagaacugcuuccaccccgaggaggcccacggcgcccgcuaccaggagcuccgcucccccuccggcgccgagguccccuacugcgaccucccccgcugcccccccgcccccgaggacccccucuccgccuccaccuccggcugccaguccgucgucgaccccggccuccgccccggccccaagcgcggccccucccccuccgccggccuccccgaggagggccccaccgccgccccccgcucccgcucccgcgagcucgaggccguccccuaccucgagggccucaccaccucccucugcggcuccugcaacgaggaccccggcuccgaccccaccuccucccccgacuccgccacccccgacgacaccuccaacuccuccuccgucgacugggacaccgucgagcgccaggaggaggaggcccccuccugggacgagcucgccgucaugaucccccgccgcccccgcgagggcccccgcgccgacuccucccagcgcgcccccucccuccucacccgcucccccgucggcggcgacgccgccggccagaagaaggaggacaccggcggcggcggccgcuccgccggccagcacugggcccgccuccgcggcgaguccggccucucccucgagcgccaccgcuccacccucacccaggccuccuccaugaccccccacuccggcccccgcuccaccaccucccaggccucccccgcccagcgcgacaccgcccaggccgccuccacccgcgagaucccccgcgccuccuccccccaccgcaucacccagcgcgacaccucccgcgccuccuccacccagcaggagaucucccgcgccuccuccacccagcaggagaccucccgcgccuccuccacccaggaggacaccccccgcgccuccuccacccaggaggacaccccccgcgccuccuccacccaguggaacaccccccgcgccuccucccccucccgcuccacccagcucgacaacccccgcaccuccuccacccagcaggacaacccccagaccuccuuccccaccugcaccccccagcgcgagaacccccgcacccccugcguccagcaggacgacccccgcgccuccucccccaaccgcaccacccagcgcgagaacucccgcaccuccugcgcccagcgcgacaaccccaaggccucccgcaccuccucccccaaccgcgccacccgcgacaacccccgcaccuccugcgcccagcgcgacaacccccgcgccuccucccccucccgcgccacccgcgacaaccccaccaccuccugcgcccagcgcgacaacccccgcgccucccgcaccuccucccccaaccgcgccacccgcgacaacccccgcaccuccugcgcccagcgcgacaacccccgcgccuccucccccucccgcgccacccgcgacaaccccaccaccuccugcgcccagcgcgacaacccccgcgccucccgcaccuccucccccaaccgcgccacccgcgacaacccccgcaccuccugcgcccagcgcgacaacccccgcgccuccucccccaaccgcgccgcccgcgacaaccccaccaccuccugcgcccagcgcgacaacccccgcgccucccgcaccuccucccccaaccgcgccacccgcgacaacccccgcaccuccugcgcccagcgcgacaacccccgcgccuccucccccaaccgcgccacccgcgacaaccccaccaccuccugcgcccagcgcgacaacccccgcgccucccgcaccuccucccccaaccgcgccacccgcgacaacccccgcaccuccugcgcccagcgcgacaacccccgcgccuccucccccaaccgcaccacccagcaggacuccccccgcaccuccugcgcccgccgcgacgacccccgcgccuccucccccaaccgcaccauccagcaggagaacccccgcaccuccugcgcccuccgcgacaacccccgcgccuccucccccucccgcaccauccagcaggagaacccccgcaccuccugcgcccagcgcgacgacccccgcgccuccucccccaaccgcaccacccagcaggagaacccccgcaccuccugcgcccgccgcgacaacccccgcgccuccucccgcaaccgcaccauccagcgcgacaacccccgcaccuccugcgcccagcgcgacaacccccgcgccuccucccccaaccgcaccauccagcaggagaaccuccgcaccuccugcacccgccaggacaacccccgcaccuccucccccaaccgcgccacccgcgacaacccccgcaccuccugcgcccagcgcgacaaccuccgcgccuccucccccauccgcgccacccagcaggacaacccccgcaccugcauccagcagaacaucccccgcuccuccuccacccagcaggacaaccccaagaccuccugcaccaagcgcgacaaccuccgccccaccugcacccagcgcgaccgcacccaguccuucuccuuccagcgcgacaaccccggcaccuccuccucccagugcugcacccagaaggagaaccuccgccccuccuccccccaccgcuccacccaguggaacaacccccgcaacuccuccccccaccgcaccaacaaggacauccccugggccuccuucccccuccgccccacccaguccgacggcccccgcaccuccucccccucccgcuccaagcaguccgagguccccugggccuccaucgcccuccgccccacccagggcgaccgcccccagaccuccucccccucccgccccgcccagcacgaccccccccaguccuccuucggccccacccaguacaaccuccccucccgcgccaccuccuccucccacaaccccggccaccaguccaccucccgcaccuccucccccgucuaccccgccgccuacggcgccccccucaccucccccgagcccucccagccccccugcgccgucugcaucggccaccgcgacgccccccgcgccuccucccccccccgcuaccuccagcacgaccccuuccccuucuuccccgagccccgcgcccccgaguccgagcccccccaccacgagccccccuacaucccccccgccgucugcaucggccaccgcgacgccccccgcgccuccucccccccccgccacacccaguucgaccccuuccccuuccuccccgacaccuccgacgccgagcaccagugccaguccccccagcacgagccccuccagcuccccgcccccgucugcaucggcuaccgcgacgccccccgcgccuccucccccccccgccaggcccccgagcccucccuccucuuccaggaccucccccgcgccuccaccgagucccucguccccuccauggacucccuccacgagugcccccacauccccacccccgucugcaucggccaccgcgacgcccccuccuucuccucccccccccgccaggcccccgagcccucccucuucuuccaggacccccccggcaccuccauggagucccucgcccccuccaccgacucccuccacggcucccccguccucaucccccaggucugcaucggccaccgcgacgccccccgcgccuccucccccccccgccacccccccuccgaccucgccuuccucgcccccucccccucccccggcuccuccggcggcucccgcggcuccgccccccccggcgagacccgccacaaccucgagcgcgaggaguacaccguccucgccgaccucccccccccccgccgccucgcccagcgccagcccggcccccaggcccagugcuccuccggcggccgcacccacucccccggccgcgccgaggucgagcgccucuucggccaggagcgccgcaaguccgaggccgccggcgccuuccaggcccaggacgagggccgcucccagcagcccucccagggccagucccagcuccuccgccgccaguccucccccgcccccucccgccaggucaccaugcuccccgccaagcaggccgagcucacccgccgcucccaggccgagcccccccaccccuggucccccgagaagcgccccgagggcgaccgccagcuccagggcuccccccuccccccccgcaccuccgcccgcacccccgagcgcgagcuccgcacccagcgcccccucgaguccggccaggccggcccccgccagccccucggcgucuggcagucccaggaggagccccccggcucccagggcccccaccgccaccucgagcgcuccugguccucccaggagggcggccucggccccggcggcugguggggcugcggcgagcccucccucggcgccgccaaggcccccgagggcgccuggggcggcaccucccgcgaguacaaggaguccuggggccagcccgaggccugggaggagaagcccacccacgagcucccccgcgagcucggcaagcgcuccccccucaccuccccccccgagaacuggggcggccccgccgaguccucccaguccuggcacuccggcacccccaccgccgucggcuggggcgccgagggcgccugccccuacccccgcggcuccgagcgccgccccgagcucgacuggcgcgaccuccucggccuccuccgcgcccccggcgagggcgucugggcccgcguccccucccucgacugggagggccuccucgagcuccuccaggcccgccucccccgcaaggaccccgccggccaccgcgacgaccucgcccgcgcccucggccccgagcucggcccccccggcaccaacgacguccccgagcaggagucccacucccagcccgagggcugggccgaggccacccccgucaacggccacucccccgcccuccagucccagucccccguccagcuccccucccccgccugcaccuccacccaguggcccaagaucaaggucacccgcggccccgccaccgccacccucgccggccucgagcagaccggcccccucggcucccgcuccaccgccaagggccccucccuccccgagcuccaguuccagcccgaggagcccgaggaguccgagcccucccgcggccaggacccccucaccgaccagaagcaggccgacuccgccgacaagcgccccgccgagggcaaggccggcuccccccucaagggccgccucgucaccuccuggcgcaugcccggcgaccgccccacccucuucaaccccuuccuccucucccucggcguccuccgcuggcgccgccccgaccuccucaacuucaagaagggcuggauguccauccucgacgagcccggcgagccccccucccccucccucaccaccaccuccaccucccaguggaagaagcacugguucguccucaccgacuccucccucaaguacuaccgcgacuccaccgccgaggaggccgacgagcucgacggcgagaucgaccuccgcuccugcaccgacgucaccgaguacgccguccagcgcaacuacggcuuccagauccacaccaaggacgccgucuacacccucuccgccaugaccuccggcauccgccgcaacuggaucgaggcccuccgcaagaccguccgccccaccuccgcccccgacgucaccaagcucuccgacuccaacaaggagaacgcccuccacuccuacuccacccagaagggcccccucaaggccggcgagcagcgcgccggcuccgaggucaucucccgcggcggcccccgcaaggccgacggccagcgccaggcccucgacuacgucgagcucuccccccucacccaggccuccccccagcgcgcccgcacccccgcccgcacccccgaccgccucgccaagcaggaggagcucgagcgcgaccucgcccagcgcuccgaggagcgccgcaagugguucgaggccaccgacucccgcacccccgagguccccgccggcgagggcccccgccgcggccucggcgccccccucaccgaggaccagcagaaccgccucuccgaggagaucgagaagaaguggcaggagcucgagaagcucccccuccgcgagaacaagcgcgucccccucaccgcccuccucaaccagucccgcggcgagcgccgcggcccccccuccgacggccacgaggcccucgagaaggagguccaggcccuccgcgcccagcucgaggccuggcgccuccagggcgaggccccccaguccgcccuccgcucccaggaggacggccacaucccccccggcuacaucucccaggaggccugcgagcgcucccucgccgagauggaguccucccaccagcaggucauggaggagcuccagcgccaccacgagcgcgagcuccagcgccuccagcaggagaaggaguggcuccucgccgaggagaccgccgccaccgccuccgccaucgaggccaugaagaaggccuaccaggaggagcucucccgcgagcucuccaagacccgcucccuccagcagggccccgacggccuccgcaagcagcaccaguccgacgucgaggcccucaagcgcgagcuccagguccucuccgagcaguacucccagaagugccucgagaucggcgcccucaugcgccaggccgaggagcgcgagcacacccuccgccgcugccagcaggagggccaggagcuccuccgccacaaccaggagcuccacggccgccucuccgaggagaucgaccagcuccgcggcuucaucgccucccagggcaugggcaacggcugcggccgcuccaacgagcgcuccuccugcgagcucgagguccuccuccgcgucaaggagaacgagcuccaguaccucaagaaggagguccagugccuccgcgacgagcuccagaugaugcagaaggacaagcgcuucaccuccggcaaguaccaggacgucuacgucgagcucucccacaucaagacccgcuccgagcgcgagaucgagcagcucaaggagcaccuccgccucgccauggccgcccuccaggagaaggaguccaugcgcaacucccucgccgaguga

SEQ ID NO: 51181 - RNA, 9294 nt, Artificial Sequence
  derived and/or modified sequence opt2 from TRIO__Homo_sapiens__NP_009049
auguccggcuccuccggcggcgccgccgcccccgccgccuccuccggccccgccgccgccgccuccgccgccggcuccggcugcggcggcggcgccggcgagggcgccgaggaggccgccaaggaccucgccgacaucgccgccuucuuccgcuccggcuuccgcaagaacgacgagaugaaggccauggacguccuccccauccucaaggagaaggucgccuaccucuccggcggccgcgacaagcgcggcggccccauccucaccuuccccgcccgcuccaaccacgaccgcauccgccaggaggaccuccgccgccucaucuccuaccucgccugcauccccuccgaggaggucugcaagcgcggcuucaccgucaucgucgacaugcgcggcuccaagugggacuccaucaagccccuccucaagauccuccaggaguccuuccccugcugcauccacgucgcccucaucaucaagcccgacaacuucuggcagaagcagcgcaccaacuucggcuccuccaaguucgaguucgagaccaacauggucucccucgagggccucaccaaggucgucgaccccucccagcucacccccgaguucgacggcugccucgaguacaaccacgaggaguggaucgagauccgcgucgccuucgaggacuacaucuccaacgccacccacaugcucucccgccucgaggagcuccaggacauccucgccaagaaggagcucccccaggaccucgagggcgcccgcaacaugaucgaggagcacucccagcucaagaagaaggucaucaaggcccccaucgaggaccucgaccucgagggccagaagcuccuccagcgcauccaguccuccgaguccuuccccaagaagaacuccggcuccggcaacgccgaccuccagaaccuccuccccaaggucuccaccaugcucgaccgccuccacuccacccgccagcaccuccaccagauguggcacguccgcaagcucaagcucgaccagugcuuccagcuccgccucuucgagcaggacgccgagaagauguucgacuggaucacccacaacaagggccucuuccucaacuccuacaccgagaucggcaccucccacccccacgccauggagcuccagacccagcacaaccacuucgccaugaacugcaugaacgucuacgucaacaucaaccgcaucauguccgucgccaaccgccucgucgaguccggccacuacgccucccagcagauccgccagaucgccucccagcucgagcaggaguggaaggccuucgccgccgcccucgacgagcgcuccacccuccucgacauguccuccaucuuccaccagaaggccgagaaguacauguccaacgucgacuccuggugcaaggccugcggcgaggucgaccuccccuccgagcuccaggaccucgaggacgccauccaccaccaccagggcaucuacgagcacaucacccucgccuacuccgaggucucccaggacggcaagucccuccucgacaagcuccagcgcccccucacccccggcuccuccgacucccucaccgccuccgccaacuacuccaaggccguccaccacguccucgacgucauccacgagguccuccaccaccagcgccagcucgagaacaucuggcagcaccgcaagguccgccuccaccagcgccuccagcucugcgucuuccagcaggacguccagcagguccucgacuggaucgagaaccacggcgaggccuuccucuccaagcacaccggcgucggcaagucccuccaccgcgcccgcgcccuccagaagcgccacgaggacuucgaggaggucgcccagaacaccuacaccaacgccgacaagcuccucgaggccgccgagcagcucgcccagaccggcgagugcgaccccgaggagaucuaccaggccgcccaccagcucgaggaccgcauccaggacuucguccgccgcgucgagcagcgcaagauccuccucgacauguccgucuccuuccacacccacgucaaggagcucuggaccuggcucgaggagcuccagaaggagcuccucgacgacgucuacgccgaguccgucgaggccguccaggaccucaucaagcgcuucggccagcagcagcagaccacccuccaggucaccgucaacgucaucaaggagggcgaggaccucauccagcagcuccgcgacuccgccaucuccuccaacaagaccccccacaacuccuccaucaaccacaucgagaccguccuccagcagcucgacgaggcccagucccagauggaggagcucuuccaggagcgcaagaucaagcucgagcucuuccuccagcuccgcaucuucgagcgcgacgccaucgacaucaucuccgaccucgaguccuggaacgacgagcucucccagcagaugaacgacuucgacaccgaggaccucaccaucgccgagcagcgccuccagcaccacgccgacaaggcccucaccaugaacaaccucaccuucgacgucauccaccagggccaggaccuccuccaguacgucaacgagguccaggccuccggcgucgagcuccucugcgaccgcgacgucgacauggccacccgcguccaggaccuccucgaguuccuccacgagaagcagcaggagcucgaccucgccgccgagcagcaccgcaagcaccucgagcagugcguccagcuccgccaccuccaggccgaggucaagcagguccucggcuggauccgcaacggcgaguccaugcucaacgccggccucaucaccgccuccucccuccaggaggccgagcagcuccagcgcgagcacgagcaguuccagcacgccaucgagaagacccaccaguccgcccuccagguccagcagaaggccgaggccaugcuccaggccaaccacuacgacauggacaugauccgcgacugcgccgagaaggucgccucccacuggcagcagcucaugcucaagauggaggaccgccucaagcucgucaacgccuccgucgccuucuacaagaccuccgagcaggucugcuccguccucgagucccucgagcaggaguacaagcgcgaggaggacuggugcggcggcgccgacaagcucggccccaacuccgagaccgaccacgucacccccaugaucuccaagcaccucgagcagaaggaggccuuccucaaggccugcacccucgcccgccgcaacgccgacgucuuccucaaguaccuccaccgcaacuccgucaacaugcccggcauggucacccacaucaaggcccccgagcagcaggucaagaacauccucaacgagcucuuccagcgcgagaaccgcguccuccacuacuggaccaugcgcaagcgccgccucgaccagugccagcaguacgucgucuucgagcgcuccgccaagcaggcccucgaguggauccacgacaacggcgaguucuaccucuccacccacaccuccaccggcuccuccauccagcacacccaggagcuccucaaggagcacgaggaguuccagaucaccgccaagcagaccaaggagcgcgucaagcuccucauccagcucgccgacggcuucugcgagaagggccacgcccacgccgccgagaucaagaagugcgucaccgccgucgacaagcgcuaccgcgacuucucccuccgcauggagaaguaccgcaccucccucgagaaggcccucggcaucuccuccgacuccaacaaguccuccaagucccuccagcucgacaucauccccgccuccauccccggcuccgaggucaagcuccgcgacgccgcccacgagcucaacgaggagaagcgcaaguccgcccgccgcaaggaguucaucauggccgagcucauccagaccgagaaggccuacguccgcgaccuccgcgagugcauggacaccuaccucugggagaugaccuccggcgucgaggagaucccccccggcaucgucaacaaggagcucaucaucuucggcaacaugcaggagaucuacgaguuccacaacaacaucuuccucaaggagcucgagaaguacgagcagcuccccgaggacgucggccacugcuucgucaccugggccgacaaguuccagauguacgucaccuacugcaagaacaagcccgacuccacccagcucauccucgagcacgccggcuccuacuucgacgagauccagcagcgccacggccucgccaacuccaucuccuccuaccucaucaagcccguccagcgcaucaccaaguaccagcuccuccucaaggagcuccucaccugcugcgaggagggcaagggcgagaucaaggacggccucgaggucaugcucuccguccccaagcgcgccaacgacgccaugcaccucuccaugcucgagggcuucgacgagaacaucgagucccagggcgagcucauccuccaggaguccuuccaggucugggaccccaagacccucauccgcaagggccgcgagcgccaccucuuccucuucgagaugucccucgucuucuccaaggaggucaaggacuccuccggccgcuccaaguaccucuacaaguccaagcucuucaccuccgagcucggcgucaccgagcacgucgagggcgaccccugcaaguucgcccucugggucggccgcacccccaccuccgacaacaagaucguccucaaggccuccuccaucgagaacaagcaggacuggaucaagcacauccgcgaggucauccaggagcgcaccauccaccucaagggcgcccucaaggagcccauccacauccccaagaccgcccccgccacccgccagaagggccgccgcgacggcgaggaccucgacucccagggcgacggcuccucccagcccgacaccaucuccaucgccucccgcaccucccagaacacccucgacuccgacaagcucuccggcggcugcgagcucaccgucgucauccacgacuucaccgccugcaacuccaacgagcucaccauccgccgcggccagaccgucgagguccucgagcgcccccacgacaagcccgacuggugccucguccgcaccaccgaccgcucccccgccgccgagggccucguccccugcggcucccucugcaucgcccacucccgcuccuccauggagauggagggcaucuucaaccacaaggacucccucuccgucuccuccaacgacgccuccccccccgccuccgucgccucccuccagccccacaugaucggcgcccaguccucccccggccccaagcgccccggcaacacccuccgcaaguggcucaccucccccguccgccgccucuccuccggcaaggccgacggccacgucaagaagcucgcccacaagcacaagaagucccgcgagguccgcaaguccgccgacgccggcucccagaaggacuccgacgacuccgccgccaccccccaggacgagaccgucgaggagcgcggccgcaacgagggccucuccuccggcacccucuccaaguccuccuccuccggcaugcaguccugcggcgaggaggagggcgaggagggcgccgacgccgucccccuccccccccccauggccauccagcagcacucccuccuccagcccgacucccaggacgacaaggccuccucccgccuccucguccgccccaccuccuccgagacccccuccgccgccgagcucgucuccgccaucgaggagcucgucaaguccaagauggcccucgaggaccgccccuccucccuccucgucgaccagggcgacuccuccucccccuccuucaaccccuccgacaacucccuccucuccuccuccucccccaucgacgagauggaggagcgcaaguccuccucccucaagcgccgccacuacguccuccaggagcucgucgagaccgagcgcgacuacguccgcgaccucggcuacgucgucgagggcuacauggcccucaugaaggaggacggcguccccgacgacaugaagggcaaggacaagaucgucuucggcaacauccaccagaucuacgacuggcaccgcgacuucuuccucggcgagcucgagaagugccucgaggaccccgagaagcucggcucccucuucgucaagcacgagcgccgccuccacauguacaucgccuacugccagaacaagcccaaguccgagcacaucgucuccgaguacaucgacaccuucuucgaggaccucaagcagcgccucggccaccgccuccagcucaccgaccuccucaucaagcccguccagcgcaucaugaaguaccagcuccuccucaaggacuuccucaaguacuccaagaaggccucccucgacaccuccgagcucgagcgcgccgucgaggucaugugcaucgucccccgccgcugcaacgacaugaugaacgucggccgccuccagggcuucgacggcaagaucgucgcccagggcaagcuccuccuccaggacaccuuccucgucaccgaccaggacgccggccuccucccccgcugccgcgagcgccgcaucuuccucuucgagcagaucgucaucuucuccgagccccucgacaagaagaagggcuucuccaugcccggcuuccucuucaagaacuccaucaaggucuccugccucugccucgaggagaacgucgagaacgaccccugcaaguucgcccucaccucccgcaccggcgacgucgucgagaccuucauccuccacuccuccucccccuccguccgccagaccuggauccacgagaucaaccagauccucgagaaccagcgcaacuuccucaacgcccucaccucccccaucgaguaccagcgcaaccacuccggcggcggcggcggcggcggcuccggcggcuccggcggcggcggcggcuccggcggcggcggcgcccccuccggcggcuccggccacuccggcggccccuccuccugcggcggcgcccccuccaccucccgcucccgccccucccgcaucccccagcccguccgccaccacccccccguccucgucuccuccgccgccuccucccaggccgaggccgacaagauguccggcaccuccacccccggccccucccuccccccccccggcgccgcccccgaggccggccccuccgcccccucccgccgcccccccggcgccgacgccgagggcuccgagcgcgaggccgagcccauccccaagaugaagguccucgaguccccccgcaagggcgccgccaacgccuccggcuccucccccgacgcccccgccaaggacgcccgcgccucccucggcacccucccccucggcaagccccgcgccggcgccgccuccccccucaacuccccccucuccuccgccguccccucccucggcaaggagcccuucccccccuccuccccccuccagaagggcggcuccuucugguccuccauccccgccucccccgccucccgccccggcuccuucaccuuccccggcgacuccgacucccuccagcgccagaccccccgccacgccgcccccggcaaggacaccgaccgcauguccaccugcuccuccgccuccgagcaguccguccaguccacccaguccaacggcuccgaguccuccuccuccuccaacaucuccaccaugcucgucacccacgacuacaccgccgucaaggaggacgagaucaacgucuaccagggcgaggucguccagauccucgccuccaaccagcagaacauguuccucgucuuccgcgccgccaccgaccagugccccgccgccgagggcuggauccccggcuucguccucggccacaccuccgccgucaucgucgagaaccccgacggcacccucaagaaguccaccuccuggcacaccgcccuccgccuccgcaagaaguccgagaagaaggacaaggacggcaagcgcgagggcaagcucgagaacggcuaccgcaagucccgcgagggccucuccaacaaggucuccgucaagcuccucaaccccaacuacaucuacgacgucccccccgaguucgucaucccccucuccgaggucaccugcgagaccggcgagaccgucguccuccgcugccgcgucugcggccgccccaaggccuccaucaccuggaagggccccgagcacaacacccucaacaacgacggccacuacuccaucuccuacuccgaccucggcgaggccacccucaagaucgucggcgucaccaccgaggacgacggcaucuacaccugcaucgccgucaacgacaugggcuccgccuccuccuccgccucccuccgcguccucggccccggcauggacggcaucauggucaccuggaaggacaacuucgacuccuucuacuccgaggucgccgagcucggccgcggccgcuucuccgucgucaagaagugcgaccagaagggcaccaagcgcgccgucgccaccaaguucgucaacaagaagcucaugaagcgcgaccaggucacccacgagcucggcauccuccagucccuccagcacccccuccucgucggccuccucgacaccuucgagacccccaccuccuacauccucguccucgagauggccgaccagggccgccuccucgacugcgucguccgcuggggcucccucaccgagggcaagauccgcgcccaccucggcgagguccucgaggccguccgcuaccuccacaacugccgcaucgcccaccucgaccucaagcccgagaacauccucgucgacgagucccucgccaagcccaccaucaagcucgccgacuucggcgacgccguccagcucaacaccaccuacuacauccaccagcuccucggcaaccccgaguucgccgcccccgagaucauccucggcaaccccgucucccucaccuccgacaccugguccgucggcguccucaccuacguccuccucuccggcgucucccccuuccucgacgacuccgucgaggagaccugccucaacaucugccgccucgacuucuccuuccccgacgacuacuucaagggcgucucccagaaggccaaggaguucgucugcuuccuccuccaggaggaccccgccaagcgccccuccgccgcccucgcccuccaggagcaguggcuccaggccggcaacggccgcuccaccggcguccucgacaccucccgccucaccuccuucaucgagcgccgcaagcaccagaacgacguccgccccauccgcuccaucaagaacuuccuccagucccgccuccucccccgcgucuga

SEQ ID NO: 51182 - RNA, 1806 nt, Artificial Sequence
  derived and/or modified sequence opt2 from TRIP10__Homo_sapiens__NP_001275891
auggacuggggcaccgagcucugggaccaguucgagguccucgagcgccacacccaguggggccucgaccuccucgaccgcuacgucaaguucgucaaggagcgcaccgaggucgagcaggccuacgccaagcagcuccgcucccucgucaagaaguaccuccccaagcgccccgccaaggacgaccccgaguccaaguucucccagcagcaguccuucguccagauccuccaggaggucaacgacuucgccggccagcgcgagcucgucgccgagaaccucuccguccgcgucugccucgagcucaccaaguacucccaggagaugaagcaggagcgcaagaugcacuuccaggagggccgccgcgcccagcagcagcucgagaacggcuucaagcagcucgagaacuccaagcgcaaguucgagcgcgacugccgcgaggccgagaaggccgcccagaccgccgagcgccucgaccaggacaucaacgccaccaaggccgacgucgagaaggccaagcagcaggcccaccuccgcucccacauggccgaggaguccaagaacgaguacgccgcccagcuccagcgcuucaaccgcgaccaggcccacuucuacuucucccagaugccccagaucuucgacaagcuccaggacauggacgagcgccgcgccacccgccucggcgccggcuacggccuccucuccgaggccgagcucgaggucguccccaucaucgccaagugccucgagggcaugaaggucgccgccaacgccgucgaccccaagaacgacucccacguccucaucgagcuccacaaguccggcuucgcccgccccggcgacgucgaguucgaggacuucucccagcccaugaaccgcgcccccuccgacuccucccucggcacccccuccgacggccgccccgagcuccgcggccccggccgcucccgcaccaagcgcuggcccuucggcaagaagaacaagccccgcccccccccccucuccccccucggcggccccguccccuccgcccuccccaacggcccccccuccccccgcuccggccgcgacccccucgccauccucuccgagaucuccaaguccgucaagccccgccucgccuccuuccgcucccuccgcggcucccgcggcaccgucgucaccgaggacuucucccaccucccccccgagcagcagcgcaagcgccuccagcagcagcucgaggagcgcucccgcgagcuccagaaggaggucgaccagcgcgaggcccucaagaagaugaaggacgucuacgagaagaccccccagaugggcgaccccgccucccucgagccccagaucgccgagacccucuccaacaucgagcgccucaagcucgagguccagaaguacgaggccuggcucgccgaggccgagucccgcguccucuccaaccgcggcgacucccucucccgccacgcccgcccccccgacccccccgccuccgccccccccgacuccuccuccaacuccgccucccaggacaccaaggaguccuccgaggagccccccuccgaggagucccaggacacccccaucuacaccgaguucgacgaggacuucgaggaggagcccaccucccccaucggccacugcgucgccaucuaccacuucgagggcuccuccgagggcaccaucuccauggccgagggcgaggaccucucccucauggaggaggacaagggcgacggcuggacccgcguccgccgcaaggagggcggcgagggcuacguccccaccuccuaccuccgcgucacccucaacuga

SEQ ID NO: 51183 - RNA, 5940 nt, Artificial Sequence
  derived and/or modified sequence opt2 from TRIP11__Homo_sapiens__NP_004230
auguccuccuggcucggcggccucggcuccggccucggccagucccucggccaggucggcggcucccucgccucccucaccggccagaucuccaacuucaccaaggacaugcucauggagggcaccgaggaggucgaggccgagcuccccgacucccgcaccaaggagaucgaggccauccacgccauccuccgcuccgagaacgagcgccucaagaagcucugcaccgaccucgaggagaagcacgaggccuccgagauccagaucaagcagcaguccaccuccuaccgcaaccagcuccagcagaaggaggucgagaucucccaccucaaggcccgccagaucgcccuccaggaccagcuccucaagcuccaguccgccgcccaguccguccccuccggcgccggcguccccgccaccaccgccuccuccuccuucgccuacggcaucucccaccaccccuccgccuuccacgacgacgacauggacuucggcgacaucaucuccucccagcaggagaucaaccgccucuccaacgaggucucccgccucgaguccgaggucggccacuggcgccacaucgcccagaccuccaaggcccagggcaccgacaacuccgaccaguccgagaucugcaagcuccagaacaucaucaaggagcucaagcagaaccgcucccaggagaucgacgaccaccagcacgagauguccguccuccagaacgcccaccagcagaagcucaccgagaucucccgccgccaccgcgaggagcucuccgacuacgaggagcgcaucgaggagcucgagaaccuccuccagcagggcggcuccggcgucaucgagaccgaccucuccaagaucuacgagaugcagaagaccauccagguccuccagaucgagaaggucgaguccaccaagaagauggagcagcucgaggacaagaucaaggacaucaacaagaagcucuccuccgccgagaacgaccgcgacauccuccgccgcgagcaggagcagcucaacgucgagaagcgccagaucauggaggagugcgagaaccucaagcucgagugcuccaagcuccagcccuccgccgucaagcaguccgacaccaugaccgagaaggagcgcauccucgcccaguccgccuccgucgaggaggucuuccgccuccagcaggcccucuccgacgccgagaacgagaucaugcgccucuccucccucaaccaggacaacucccucgccgaggacaaccucaagcucaagaugcgcaucgagguccucgagaaggagaagucccuccucucccaggagaaggaggagcuccagaugucccuccucaagcucaacaacgaguacgaggucaucaaguccaccgccacccgcgacaucucccucgacuccgagcuccacgaccuccgccucaaccucgaggccaaggagcaggagcucaaccaguccaucuccgagaaggagacccucaucgccgagaucgaggagcucgaccgccagaaccaggaggccaccaagcacaugauccucaucaaggaccagcucuccaagcagcagaacgagggcgacuccaucaucuccaagcucaagcaggaccucaacgacgagaagaagcgcguccaccagcucgaggacgacaagauggacaucaccaaggagcucgacguccagaaggagaagcucauccaguccgaggucgcccucaacgaccuccaccucaccaagcagaagcucgaggacaaggucgagaaccucgucgaccagcucaacaagucccaggaguccaacgucuccauccagaaggagaaccucgagcucaaggagcacauccgccagaacgaggaggagcucucccgcauccgcaacgagcucaugcagucccucaaccaggacuccaacuccaacuucaaggacacccuccucaaggagcgcgaggccgagguccgcaaccucaagcagaaccucuccgagcucgagcagcucaacgagaaccucaagaaggucgccuucgacgucaagauggagaacgagaagcucguccucgccugcgaggacguccgccaccagcucgaggagugccucgccggcaacaaccagcucucccucgagaagaacaccaucgucgagacccucaagauggagaagggcgagaucgaggccgagcucugcugggccaagaagcgccuccucgaggaggccaacaaguacgagaagaccaucgaggagcucuccaacgcccgcaaccucaacaccuccgcccuccagcucgagcacgagcaccucaucaagcucaaccagaagaaggacauggagaucgccgagcucaagaagaacaucgagcagauggacaccgaccacaaggagaccaaggacguccucuccuccucccucgaggagcagaagcagcucacccagcucaucaacaagaaggagaucuucaucgagaagcucaaggagcgcuccuccaagcuccaggaggagcucgacaaguacucccaggcccuccgcaagaacgagauccuccgccagaccaucgaggagaaggaccgcucccucggcuccaugaaggaggagaacaaccaccuccaggaggagcucgagcgccuccgcgaggagcagucccgcaccgcccccgucgccgaccccaagacccucgacuccgucaccgagcucgccuccgaggucucccagcucaacaccaucaaggagcaccucgaggaggagaucaagcaccaccagaagaucaucgaggaccagaaccaguccaagaugcagcuccuccagucccuccaggagcagaagaaggagauggacgaguuccgcuaccagcacgagcagaugaacgccacccacacccagcucuuccucgagaaggacgaggagaucaagucccuccagaagaccaucgagcagaucaagacccagcuccacgaggagcgccaggacauccagaccgacaacuccgacaucuuccaggagaccaagguccagucccucaacaucgagaacggcuccgagaagcacgaccucuccaaggccgagaccgagcgccucgucaagggcaucaaggagcgcgagcucgagaucaagcuccucaacgagaagaacaucucccucaccaagcagaucgaccagcucuccaaggacgaggucggcaagcucacccagaucauccagcagaaggaccucgagauccaggcccuccacgcccgcaucuccuccaccucccacacccaggacgucgucuaccuccagcagcagcuccaggccuacgccauggagcgcgagaaggucuucgccguccucaacgagaagacccgcgagaacucccaccucaagaccgaguaccacaagaugauggacaucgucgccgccaaggaggccgcccucaucaagcuccaggacgagaacaagaagcucuccacccgcuucgaguccuccggccaggacauguuccgcgagaccauccagaaccucucccgcaucauccgcgagaaggacaucgagaucgacgcccucucccagaagugccagacccuccucgccguccuccagaccuccuccaccggcaacgaggccggcggcgucaacuccaaccaguucgaggagcuccuccaggagcgcgacaagcucaagcagcaggucaagaagauggaggaguggaagcagcaggucaugaccaccguccagaacaugcagcacgaguccgcccagcuccaggaggagcuccaccagcuccaggcccagguccucgucgacuccgacaacaacuccaagcuccaggucgacuacaccggccucauccaguccuacgagcagaacgagaccaagcucaagaacuucggccaggagcucgcccagguccagcacuccaucggccagcucugcaacaccaaggaccuccuccucggcaagcucgacaucaucuccccccagcucuccuccgccucccuccucaccccccaguccgccgagugccuccgcgccuccaaguccgagguccucuccgaguccuccgagcuccuccagcaggagcucgaggagcuccgcaagucccuccaggagaaggacgccaccauccgcacccuccaggagaacaaccaccgccucuccgacuccaucgccgccaccuccgagcucgagcgcaaggagcacgagcagaccgacuccgagaucaagcagcucaaggagaagcaggacguccuccagaagcuccucaaggagaaggaccuccucaucaaggccaaguccgaccagcuccucuccuccaacgagaacuucaccaacaaggucaacgagaacgagcuccuccgccaggccgucaccaaccucaaggagcgcauccucauccucgagauggacaucggcaagcucaagggcgagaacgagaagaucgucgagaccuaccgcggcaaggagaccgaguaccaggcccuccaggagaccaacaugaaguucuccaugaugcuccgcgagaaggaguucgagugccacuccaugaaggagaaggcccucgccuucgagcagcuccucaaggagaaggagcagggcaagaccggcgagcucaaccagcuccucaacgccgucaaguccaugcaggagaagaccgucgucuuccagcaggagcgcgaccaggucaugcucgcccucaagcagaagcagauggagaacaccgcccuccagaacgagguccagcgccuccgcgacaaggaguuccgcuccaaccaggagcucgagcgccuccgcaaccaccuccucgaguccgaggacuccuacacccgcgaggcccucgccgccgaggaccgcgaggccaagcuccgcaagaaggucaccguccucgaggagaagcucgucuccuccuccaacgccauggagaacgccucccaccaggccuccguccaggucgagucccuccaggagcagcucaacgucgucuccaagcagcgcgacgagaccgcccuccagcucuccgucucccaggagcaggucaagcaguacgcccucucccucgccaaccuccagaugguccucgagcacuuccagcaggaggagaaggccauguacuccgccgagcucgagaagcagaagcagcucaucgccgaguggaagaagaacgccgagaaccucgagggcaaggucaucucccuccaggagugccucgacgaggccaacgccgcccucgacuccgccucccgccucaccgagcagcucgacgucaaggaggagcagaucgaggagcucaagcgccagaacgagcuccgccaggagaugcucgacgacguccagaagaagcucaugucccucgccaacuccuccgagggcaaggucgacaagguccucaugcgcaaccucuucaucggccacuuccacacccccaagaaccagcgccacgagguccuccgccucaugggcuccauccucggcguccgccgcgaggagauggagcagcucuuccacgacgaccagggcggcgucacccgcuggaugaccggcuggcucggcggcggcuccaaguccguccccaacaccccccuccgccccaaccagcaguccgucgucaacuccuccuucuccgagcucuucgucaaguuccucgagaccgagucccaccccuccauccccccccccaagcucuccguccacgacaugaagccccucgacucccccggccgccgcaagcgcgacaccaacgcccccgaguccuucaaggacaccgccgagucccgcuccggccgccgcaccgacgucaaccccuuccucgccccccgcuccgccgccgucccccucaucaaccccgccggccucggccccggcggccccggccaccuccuccucaagcccaucuccgacguccuccccaccuucaccccccuccccgcccuccccgacaacuccgccggcgucguccucaaggaccuccucaagcaguga

SEQ ID NO: 51184 - RNA, 870 nt, Artificial Sequence
  derived and/or modified sequence opt2 from TRIP13__Homo_sapiens__NP_001159732
auggacgaggccgucggcgaccucaagcaggcccuccccugcgucgccgagucccccaccguccacgucgagguccaccagcgcggcuccuccaccgccaagaaggaggacaucaaccucuccguccgcaagcuccucaaccgccacaacaucgucuucggcgacuacaccuggaccgaguucgacgagcccuuccucacccgcaacguccaguccgucuccaucaucgacaccgagcucaaggucaaggacucccagcccaucgaccucuccgccugcaccgucgcccuccacaucuuccagcucaacgaggacggccccuccuccgagaaccucgaggaggagaccgagaacaucaucgccgccaaccacuggguccuccccgccgccgaguuccacggccucugggacucccucgucuacgacgucgaggucaagucccaccuccucgacuacgucaugaccacccuccucuucuccgacaagaacgucaacuccaaccucaucaccuggaaccgcgucguccuccuccacggcccccccggcaccggcaagaccucccucugcaaggcccucgcccagaagcucaccauccgccucuccucccgcuaccgcuacggccagcucaucgagaucaacucccacucccucuucuccaagugguucuccgaguccggcaagcucgucaccaagauguuccagaagauccaggaccucaucgacgacaaggacgcccucgucuucguccucaucgacgaggucgagucccucaccgccgcccgcaacgccugccgcgccggcaccgagcccuccgacgccauccgcgucgucaacgccguccucacccagaucgaccagaucaagcgcuga

SEQ ID NO: 51185 - RNA, 1746 nt, Artificial Sequence
  derived and/or modified sequence opt2 from TRIP4__Homo_sapiens__NP_057297
auggccgucgccggcgccgucuccggcgagccccucguccacuggugcacccagcagcuccgcaagaccuucggccucgacgucuccgaggagaucauccaguacguccucuccaucgaguccgccgaggagauccgcgaguacgucaccgaccuccuccagggcaacgagggcaagaagggccaguucaucgaggagcucaucaccaaguggcagaagaacgaccaggagcucaucuccgacccccuccagcagugcuucaagaaggacgagauccucgacggccagaaguccggcgaccaccucaagcgcggccgcaagaagggccgcaaccgccaggagguccccgccuucaccgagcccgacaccaccgccgaggucaagacccccuucgaccucgccaaggcccaggagaacuccaacuccgucaagaagaagaccaaguucgucaaccucuacacccgcgagggccaggaccgccucgccguccuccuccccggccgccaccccugcgacugccucggccagaagcacaagcucaucaacaacugccucaucugcggccgcaucgucugcgagcaggagggcuccggccccugccucuucugcggcacccucgucugcacccacgaggagcaggacauccuccagcgcgacuccaacaagucccagaagcuccucaagaagcucauguccggcgucgagaacuccggcaaggucgacaucuccaccaaggaccuccucccccaccaggagcuccgcaucaaguccggccucgagaaggccaucaagcacaaggacaagcuccucgaguucgaccgcaccuccauccgccgcacccaggucaucgacgacgaguccgacuacuucgccuccgacuccaaccaguggcucuccaagcucgagcgcgagacccuccagaagcgcgaggaggagcuccgcgagcuccgccacgccucccgccucuccaagaaggucaccaucgacuucgccggccgcaagauccucgaggaggagaacucccucgccgaguaccacucccgccucgacgagaccauccaggccaucgccaacggcacccucaaccagccccucaccaagcucgaccgcuccuccgaggagccccucggcguccucgucaaccccaacauguaccagucccccccccagugggucgaccacaccggcgccgccucccagaagaaggccuuccgcuccuccggcuucggccucgaguucaacuccuuccagcaccagcuccgcauccaggaccaggaguuccaggagggcuucgacggcggcuggugccucuccguccaccagcccugggccucccuccucguccgcggcaucaagcgcgucgagggccgcuccugguacaccccccaccgcggccgccucuggaucgccgccaccgccaagaagcccuccccccaggaggucuccgagcuccaggccaccuaccgccuccuccgcggcaaggacgucgaguuccccaacgacuaccccuccggcugccuccucggcugcgucgaccucaucgacugccucucccagaagcaguucaaggagcaguuccccgacaucucccaggaguccgacucccccuucgucuucaucugcaagaacccccaggagauggucgucaaguuccccaucaagggcaaccccaagaucuggaagcucgacuccaagauccaccagggcgccaagaagggccucaugaagcagaacaaggccgucuga

SEQ ID NO: 51186 - RNA, 1431 nt, Artificial Sequence
  derived and/or modified sequence opt2 from TRIP6__Homo_sapiens__XP_011514847
auguccggccccaccuggcucccccccaagcagcccgagcccgcccgcgccccccagggccgcgccaucccccgcggcacccccggccccccccccgcccacggcgccgcccuccagccccacccccgcgucaacuucugcccccuccccuccgagcagugcuaccaggcccccggcggccccgaggaccgcggccccgccugggucggcucccacggcguccuccagcacacccagggccuccccgccgaccgcggcggccuccgccccggcucccucgacgccgagaucgaccuccucuccuccacccucgccgagcucaacggcggccgcggccacgccucccgccgccccgaccgccaggccuacgagcccccccccccccccgccuaccgcaccggcucccucaagcccaaccccgccuccccccuccccgccucccccuacggcggccccacccccgccuccuacaccaccgccuccacccccgccggccccgccuuccccguccaggucaaggucgcccagcccguccgcggcugcggccccccccgccgcggcgccucccaggccuccggcccccuccccggcccccacuucccccuccccggccgcggcgaggucuggggccccggcuaccgcucccagcgcgagcccggccccggcgccaaggaggaggccgccggcgucuccggccccgccggccgcggccgcggcggcgagcacggcccccaggucccccucucccagccccccgaggacgagcucgaccgccucaccaagaagcucguccacgacaugaaccacccccccuccggcgaguacuucggccagugcggcggcugcggcgaggacgucgucggcgacggcgccggcgucgucgcccucgaccgcgucuuccacgucggcugcuucgucugcuccaccugccgcgcccagcuccgcggccagcacuucuacgccgucgagcgccgcgccuacugcgagggcugcuacgucgccacccucgagaagugcgccaccugcucccagcccauccucgaccgcauccuccgcgccaugggcaaggccuaccaccccggcugcuucaccugcgucgucugccaccgcggccucgacggcauccccuucaccgucgacgccaccucccagauccacugcaucgaggacuuccaccgcaaguucgccccccgcugcuccgucugcggcggcgccaucaugcccgagcccggccaggaggagaccguccgcaucgucgcccucgaccgcuccuuccacaucggcugcuacaagugcgaggagugcggccuccuccucuccuccgagggcgagugccagggcugcuacccccucgacggccacauccucugcaaggccugcuccgccuggcgcauccaggagcucuccgccaccgucaccaccgacugcuga

SEQ ID NO: 51187 - RNA, 261 nt, Artificial Sequence
  derived and/or modified sequence opt2 from TRIQK__Homo_sapiens__XP_011515284
augggccgcaaggacgccgccaccaucaagcuccccgucgaccaguaccgcaagcagaucggcaagcaggacuacaagaagaccaagcccauccuccgcgccaccaagcucaaggccgaggccaagaagaccgccaucggcaucaaggaggucggccucguccucgccgccauccucgcccuccuccucgccuucuacgccuucuucuaccuccgccucaccaccgacgucgaccccgaccucgaccaggacgaggacuga

SEQ ID NO: 51188 - RNA, 1020 nt, Artificial Sequence
  derived and/or modified sequence opt2 from TRMT10A__Homo_sapiens__NP_001128137
auguccuccgagaugcuccccgccuucaucgagaccuccaacgucgacaagaagcagggcaucaacgaggaccaggaggagucccagaagccccgccucggcgagggcugcgagcccaucuccaagcgccagaugaagaagcucaucaagcagaagcagugggaggagcagcgcgagcuccgcaagcagaagcgcaaggagaagcgcaagcgcaagaagcucgagcgccagugccagauggagcccaacuccgacggccacgaccgcaagcgcguccgccgcgacgucguccacuccacccuccgccucaucaucgacugcuccuucgaccaccucaugguccucaaggacaucaagaagcuccacaagcagauccagcgcugcuacgccgagaaccgccgcgcccuccaccccguccaguucuaccucaccucccacggcggccagcucaagaagaacauggacgagaacgacaagggcugggucaacuggaaggacauccacaucaagcccgagcacuacuccgagcucaucaagaaggaggaccucaucuaccucaccuccgacucccccaacauccucaaggagcucgacgaguccaaggccuacgucaucggcggccucgucgaccacaaccaccacaagggccucaccuacaagcaggccuccgacuacggcaucaaccacgcccagcucccccucggcaacuucgucaagaugaacucccgcaagguccucgccgucaaccacgucuucgagaucauccucgaguaccucgagacccgcgacuggcaggaggccuucuucaccauccucccccagcgcaagggcgccguccccaccgacaaggccugcgaguccgccucccacgacaaccaguccguccgcauggaggagggcggcuccgacuccgacuccuccgaggaggaguacucccgcaacgagcucgacuccccccacgaggagaagcaggacaaggagaaccacaccgaguccaccgucaacucccucccccacuga

SEQ ID NO: 51189 - RNA, 1347 nt, Artificial Sequence
  derived and/or modified sequence opt2 from TRMT12__Homo_sapiens__NP_060426
augcgcgagaacgucgucgucuccaacauggagcgcgaguccggcaagcccgucgccgucgucgccgucgucaccgagcccugguucacccagcgcuaccgcgaguaccuccagcgccagaagcucuucgacacccagcaccgcgucgagaagaugcccgacggcuccgucgcccuccccguccucggcgagacccuccccgagcagcaccuccaggagcuccgcaaccgcgucgcccccggcucccccugcaugcucacccagcuccccgaccccguccccuccaagcgcgcccagggcugcucccccgcccagaagcucugccucgaggucucccgcugggucgagggccgcggcgucaagugguccgccgagcucgaggccgaccucccccgcuccuggcagcgccacggcaaccuccuccuccucuccgaggacugcuuccaggccaagcaguggaagaaccucggccccgagcucugggagaccgucgcccucgcccucggcguccagcgccucgccaagcgcggccgcgucucccccgacggcacccgcacccccgccgucacccuccuccucggcgaccacggcugggucgagcacgucgacaacggcauccgcuacaaguucgacgucacccagugcauguucuccuucggcaacaucaccgagaagcuccgcgucgccucccucuccugcgccggcgagguccucgucgaccucuacgccggcaucggcuacuucacccuccccuuccucguccacgccggcgccgccuucguccacgccugcgaguggaacccccacgccgucgucgcccuccgcaacaaccucgagaucaacggcgucgccgaccgcugccagauccacuucggcgacaaccgcaagcucaagcucuccaacaucgccgaccgcgucauccucggccucauccccuccuccgaggagggcuggcccaucgccugccagguccuccgccaggacgccggcggcauccuccacauccaccagaacgucgaguccuuccccggcaagaaccuccaggcccucggcgucuccaaggucgagaaggagcacuggcucuacccccagcagaucaccaccaaccaguggaagaacggcgccacccgcgacucccgcggcaagaugcucucccccgccaccaagcccgaguggcagcgcugggccgaguccgccgagacccgcaucgccacccuccuccagcagguccacggcaagcccuggaagacccagauccuccacauccagcccgucaaguccuacgccccccacgucgaccacaucguccucgaccucgagugcugccccugccccuccgucggcuga

SEQ ID NO: 51190 - RNA, 1893 nt, Artificial Sequence
  derived and/or modified sequence opt2 from TRMT1__Homo_sapiens__NP_001136026
augcagggcuccucccucuggcucucccucaccuuccgcuccgcccgcguccucucccgcgcccgcuucuucgaguggcagucccccggccuccccaacaccgccgccauggagaacggcaccggccccuacggcgaggagcgcccccgcgagguccaggagaccaccgucaccgagggcgccgccaagaucgccuuccccuccgccaacgaggucuucuacaaccccguccaggaguucaaccgcgaccucaccugcgccgucaucaccgaguucgcccgcauccagcucggcgccaagggcauccagaucaagguccccggcgagaaggacacccagaaggucgucgucgaccucuccgagcaggaggaggagaaggucgagcucaaggaguccgagaaccucgccuccggcgaccagccccgcaccgccgccgucggcgagaucugcgaggagggccuccacguccucgagggccucgccgccuccggccuccgcuccauccgcuucgcccucgagguccccggccuccgcuccgucgucgccaacgacgccuccacccgcgccgucgaccucauccgccgcaacguccagcucaacgacgucgcccaccucguccagcccucccaggccgacgcccgcaugcucauguaccagcaccagcgcgucuccgagcgcuucgacgucaucgaccucgaccccuacggcucccccgccaccuuccucgacgccgccguccaggccgucuccgagggcggccuccucugcgucaccugcaccgacauggccguccucgccggcaacuccggcgagaccugcuacuccaaguacggcgccauggcccucaagucccgcgccugccacgagauggcccuccgcaucguccuccacucccucgaccuccgcgccaacugcuaccagcgcuucgucgucccccuccucuccaucuccgccgacuucuacguccgcgucuucguccgcgucuucaccggccaggccaaggucaaggccuccgcccgcgccaaguucuccgccgccugcggcccccccgucacccccgagugcgagcacugcggccagcgccaccagcucggcggccccaugugggccgagcccauccacgaccucgacuucgucggccgcguccucgaggccgucuccgccaaccccggccgcuuccacaccuccgagcgcauccgcggcguccucuccgucaucaccgaggagcuccccgacgucccccucuacuacacccucgaccagcucuccuccaccauccacugcaacacccccucccuccuccagcuccgcuccgcccuccuccacgccgacuuccgcgucucccucucccacgccugcaagaacgccgucaagaccgacgcccccgccuccgcccucugggacaucaugcgcugcugggagaaggagugccccgucaagcgcgagcgccucuccgagaccucccccgccuuccgcauccucuccgucgagccccgccuccaggccaacuucaccauccgcgaggacgccaaccccuccucccgccagcgcggccucaagcgcuuccaggccaaccccgaggccaacuggggcccccgcccccgcgcccgccccggcggcaaggccgccgacgaggccauggaggagcgccgccgccuccuccagaacaagcgcaaggagccccccgaggacgucgcccagcgcgccgcccgccucaagaccuuccccugcaagcgcuucaaggagggcaccugccagcgcggcgaccagugcugcuacucccacuccccccccaccccccgcgucuccgccgacgccgcccccgacugccccgagaccuccaaccagaccccccccggccccggcgccgccgccggccccggcaucgacuga

SEQ ID NO: 51191 - RNA, 2274 nt, Artificial Sequence
  derived and/or modified sequence opt2 from TRMT44__Homo_sapiens__NP_689757
auggccgaggucggccgcaccggcaucuccuaccccggcgcccuccucccccagggcuucugggccgccgucgaggucuggcucgagcgcccccaggucgccaacaagcgccucugcggcgcccgccucgaggcccgcugguccgccgcccuccccugcgccgaggcccgcggccccggcaccuccgccggcuccgagcagaaggagcgcggccccggccccggccagggcucccccggcggcggccccggcccccgcucccucuccggccccgagcagggcaccgccugcugcgagcucgaggaggcccagggccagugccagcaggaggaggcccagcgcgaggccgccuccgucccccuccgcgacuccggccaccccggccacgccgagggccgcgagggcgacuuccccgccgccgaccucgacucccucugggaggacuucucccagucccucgcccgcggcaacuccgagcuccucgccuuccucaccuccuccggcgccggcucccagcccgaggcccagcgcgagcucgacgucguccuccgcaccgucauccccaagaccuccccccacugcccccucaccaccccccgccgcgagaucgucguccaggacguccucaacggcaccaucaccuuccucccccucgaggaggacgacgagggcaaccucaaggucaagauguccaacgucuaccagauccagcucucccacuccaaggaggagugguucaucuccguccucaucuucugccccgagcgcuggcacuccgacggcaucgucuaccccaagcccaccuggcucggcgaggagcuccucgccaagcucgccaagugguccgucgagaacaagaaguccgacuucaaguccacccucucccucaucuccaucaugaaguacuccaaggccuaccaggagcucaaggagaaguacaaggagauggucaaggucuggcccgaggucaccgaccccgagaaguucgucuacgaggacgucgccaucgccgccuaccuccucauccucugggaggaggagcgcgccgagcgccgccucaccgcccgccaguccuucgucgaccucggcugcggcaacggccuccucguccacauccucuccuccgagggccaccccggccgcggcaucgacguccgccgccgcaagaucugggacauguacggcccccagacccagcucgaggaggacgccaucacccccaacgacaagacccucuuccccgacgucgacuggcucaucggcaaccacuccgacgagcucacccccuggauccccgucaucgccgcccgcuccuccuacaacugccgcuucuucguccuccccugcugcuucuucgacuucaucggccgcuacucccgccgccaguccaagaagacccaguaccgcgaguaccucgacuucaucaaggaggucggcuucaccugcggcuuccacgucgacgaggacugccuccgcauccccuccaccaagcgcgucugccucgucggcaagucccgcaccuaccccuccucccgcgaggccuccgucgacgagaagcgcacccaguacaucaagucccgccgcggcugccccgucuccccccccggcugggagcucucccccuccccccgcugggucgccgccggcuccgccggccacugcgacggccagcaggcccucgacgcccgcgucggcugcgucacccgcgccugggccgccgagcacggcgccggcccccaggccgagggccccuggcuccccggcuuccacccccgcgagaaggccgagcgcguccgcaacugcgccgcccucccccgcgacuucaucgaccaggucguccuccaggucgccaaccuccuccucggcggcaagcagcucaacacccgcuccucccgcaacggcucccucaagaccuggaacggcggcgagucccucucccucgccgaggucgccaacgagcucgacaccgagacccuccgccgccucaagcgcgagugcggcggccuccagacccuccuccgcaacucccaccaggucuuccaggucgucaacggccgcguccacauccgcgacuggcgcgaggagacccucuggaagaccaagcagcccgaggccaagcagcgccuccucuccgaggccugcaagacccgccucugcugguucuucaugcaccaccccgacggcugcgcccucuccaccgacugcugccccuucgcccacggccccgccgagcuccgccccccccgcaccaccccccgcaagaagaucuccuga

SEQ ID NO: 51192 - RNA, 1530 nt, Artificial Sequence
  derived and/or modified sequence opt2 from TRMT5__Homo_sapiens__NP_065861
augguccucuggauccucuggcgccccuucggcuucuccggccgcuuccucaagcucgagucccacuccaucaccgaguccaagucccucauccccgucgccuggaccucccucacccagaugcuccucgaggcccccggcaucuuccuccucggccagcgcaagcgcuucuccaccaugcccgagaccgagacccacgagcgcgagaccgagcucuucuccccccccuccgacguccgcggcaugaccaagcucgaccgcaccgccuucaagaagaccgucaacauccccguccucaagguccgcaaggagaucgucuccaagcucaugcgcucccucaagcgcgccgcccuccagcgccccggcauccgccgcgucaucgaggaccccgaggacaaggagucccgccucaucaugcucgaccccuacaagaucuucacccacgacuccuucgagaaggccgagcucuccguccucgagcagcucaacgucuccccccagaucuccaaguacaaccucgagcucaccuacgagcacuucaaguccgaggagauccuccgcgccguccuccccgagggccaggacgucaccuccggcuucucccgcaucggccacaucgcccaccucaaccuccgcgaccaccagcuccccuucaagcaccucaucggccaggucaugaucgacaagaaccccggcaucaccuccgccgucaacaagaucaacaacaucgacaacauguaccgcaacuuccagauggagguccucuccggcgagcagaacaugaugaccaagguccgcgagaacaacuacaccuacgaguucgacuucuccaaggucuacuggaacccccgccucuccaccgagcacucccgcaucaccgagcuccucaagcccggcgacguccucuucgacgucuucgccggcgucggccccuucgccauccccgucgccaagaagaacugcaccgucuucgccaacgaccucaaccccgagucccacaaguggcuccucuacaacugcaagcucaacaaggucgaccagaaggucaaggucuucaaccucgacggcaaggacuuccuccagggccccgucaaggaggagcucaugcagcuccucggccucuccaaggagcgcaagcccuccguccacgucgucaugaaccuccccgccaaggccaucgaguuccucuccgccuucaaguggcuccucgacggccagcccugcuccuccgaguuccuccccaucguccacugcuacuccuucuccaaggacgccaaccccgccgaggacguccgccagcgcgccggcgccguccucggcaucucccucgaggccugcuccuccguccaccucguccgcaacgucgcccccaacaaggagaugcucugcaucaccuuccagauccccgccuccguccucuacaagaaccagacccgcaaccccgagaaccacgaggaccccccccucaagcgccagcgcaccgccgaggccuucuccgacgagaagacccagaucgucuccaacaccuga

SEQ ID NO: 51193 - RNA, 924 nt, Artificial Sequence
  derived and/or modified sequence opt2 from TRMU__Homo_sapiens__NP_001269711
augaugugcuccggcgccgacgccaucgccaccggccacuacgcccgcaccucccucgaggacgaggaggucuucgagcagaagcacgucaagaagcccgagggccucuuccgcaaccgcuucgagguccgcaacgccgucaagcuccuccaggccgccgacuccuucaaggaccagaccuucuuccucucccaggucucccaggacgcccuccgccgcaccaucuucccccucggcggccucaccaaggaguucgucaagaagaucgccgccgagaaccgccuccaccacguccuccagaagaaggaguccaugggcaugugcuucaucggcaagcgcaacuucgagcacuuccuccuccaguaccuccagccccgccccggccacuucaucuccaucgaggacaacaagguccucggcacccacaagggcugguuccucuacacccucggccagcgcgccaacaucggcggccuccgcgagcccugguacgucgucgagaaggacuccgucaagggcgacgucuucgucgccccccgcaccgaccaccccgcccucuaccgcgaccuccuccgcaccucccgcguccacuggaucgccgaggagccccccgccgcccucguccgcgacaagaugauggagugccacuuccgcuuccgccaccagauggcccucguccccugcguccucacccucaaccaggacggcaccgucugggucaccgccguccaggccguccgcgcccucgccaccggccaguucgccgucuucuacaagggcgacgagugccucggcuccggcaagauccuccgccucggccccuccgccuacacccuccagaagggccagcgccgcgccggcauggccaccgagucccccuccgacucccccgaggacggccccggccucuccccccuccucuga

SEQ ID NO: 51194 - RNA, 4296 nt, Artificial Sequence
  derived and/or modified sequence opt2 from TRO__Homo_sapiens__NP_001034794
auggaccgccgcaacgacuacggcuaccgcgucccccucuuccagggcccccuccccccccccggcucccucggccuccccuucccccccgacauccagaccgagaccaccgaggaggacuccguccuccucaugcacacccuccucgccgccaccaaggacucccucgccauggacccccccgucgucaaccgccccaagaaguccaagaccaagaaggcccccaucaagaccaucaccaaggccgcccccgccgccccccccguccccgccgccaacgagaucgccaccaacaagcccaagaucaccuggcaggcccucaaccuccccgucaucacccagaucucccaggcccuccccaccaccgaggucaccaacacccaggccuccuccgucaccgcccagcccaagaaggccaacaagaugaagcgcgucaccgccaaggccgcccagggcucccagucccccaccggccacgagggcggcaccauccagcucaaguccccccuccagguccucaagcuccccgucaucucccagaacauccacgcccccaucgccaacgaguccgccuccucccaggcccucaucaccuccaucaagcccaagaaggccuccaaggccaagaaggccgccaacaaggccaucgccuccgccaccgaggucucccucgccgccaccgccacccacaccgccaccacccagggccagaucaccaacgagaccgccuccauccacaccaccgccgccuccauccgcaccaagaaggccuccaaggcccgcaagaccaucgccaaggucaucaacaccgacaccgagcacaucgaggcccucaacgucaccgacgccgccacccgccagaucgaggccuccgucgucgccauccgccccaagaaguccaagggcaagaaggccgccucccgcggccccaacuccgucuccgagaucuccgaggccccccucgccacccagaucgucaccaaccaggcccucgccgccacccuccgcgucaagcgcggcucccgcgcccgcaaggccgccaccaaggcccgcgccaccgagucccagacccccaacgccgaccagggcgcccaggccaagaucgccuccgcccagaccaacgucuccgcccucgagacccaggucgccgccgccguccaggcccucgccgacgacuaccucgcccagcucucccucgagcccaccacccgcacccgcggcaagcgcaaccgcaaguccaagcaccucaacggcgacgagcgcuccggcuccaacuaccgccgcauccccuggggccgccgccccgcccccccccgcgacgucgccauccuccaggagcgcgccaacaagcucgucaaguaccuccucgucaaggaccagaccaagauccccaucaagcgcuccgacaugcuccgcgacgucauccaggaguacgacgaguacuuccccgagaucaucgagcgcgccuccuacacccucgagaagauguuccgcgucaaccucaaggagaucgacaagcaguccucccucuacauccucaucuccacccaggaguccuccgccggcauccucggcaccaccaaggacacccccaagcucggccuccucauggucauccucuccgucaucuucaugaacggcaacaaggccuccgaggccgucaucugggagguccuccgcaagcucggccuccgccccggcguccgccacucccucuucggcgagguccgcaagcucaucaccgacgaguucgucaagcagaaguaccucgaguacaagcgcguccccaacucccgcccccccgaguacgaguucuucuggggccuccgcuccuaccacgagaccuccaagaugaagguccucaaguucgccugccgcguccagaagaaggaccccaaggacugggccguccaguaccgcgaggccgucgagauggagguccaggccgccgccgucgccgucgccgaggccgaggcccgcgccgaggcccgcgcccagaugggcaucggcgaggaggccgucgccggccccuggaacugggacgacauggacaucgacugccucacccgcgaggagcucggcgacgacgcccaggccuggucccgcuucuccuucgagaucgaggcccgcgcccaggagaacgccgacgccuccaccaacgucaacuucucccgcggcgccuccacccgcgccggcuucuccgacggcgccuccaucuccuucaacggcgcccccuccuccuccggcggcuucuccggcggccccggcaucaccuucggcgucgcccccuccaccuccgccuccuucuccaacaccgccuccaucuccuucggcggcacccucuccaccuccuccuccuucuccuccgccgccuccaucuccuucggcugcgcccacuccaccuccaccuccuucuccuccgaggccuccaucuccuucggcggcaugcccugcaccuccgccuccuucuccggcggcgucuccuccuccuucuccggcccccucuccaccuccgccaccuucuccggcggcgccuccuccggcuucggcggcacccucuccaccaccgccggcuucuccggcguccucuccaccuccaccuccuucggcuccgcccccaccaccuccaccgucuucuccuccgcccucuccaccuccaccggcuucggcggcauccucuccaccuccgucugcuucggcggcucccccuccuccuccggcuccuucggcggcacccucuccaccuccaucugcuucggcggcucccccugcaccuccaccggcuucggcggcacccucuccaccuccgucuccuucggcggcuccuccuccaccuccgccaacuucggcggcacccucuccaccuccaucugcuucgacggcucccccuccaccggcgccggcuucggcggcgcccucaacaccuccgccuccuucggcuccguccucaacaccuccaccggcuucggcggcgccauguccaccuccgccgacuucggcggcacccucuccaccuccgucugcuucggcggcucccccggcaccuccgucuccuucggcuccgcccucaacaccaacgccggcuacggcggcgccgucuccaccaacaccgacuucggcggcacccucuccaccuccgucugcuucggcggcucccccuccaccuccgccggcuucggcggcgcccucaacaccaacgccuccuucggcugcgccgucuccaccuccgccuccuucuccggcgccgucuccaccuccgccugcuucuccggcgcccccaucaccaaccccggcuucggcggcgccuucuccaccuccgccggcuucggcggcgcccucuccaccgccgccgacuucggcggcacccccuccaacuccaucggcuucggcgccgcccccuccaccuccgucuccuucggcggcgcccacggcaccucccucugcuucggcggcgcccccuccaccucccucugcuucggcuccgccuccaacaccaaccucugcuucggcggcccccccuccaccuccgccugcuucuccggcgccaccucccccuccuucugcgacggccccuccaccuccaccggcuucuccuucggcaacggccucuccaccaacgccggcuucggcggcggccucaacaccuccgccggcuucggcggcggccucggcaccuccgccggcuucuccggcggccucuccaccuccuccggcuucgacggcggccucggcaccuccgccggcuucggcggcggccccggcaccuccaccggcuucggcggcggccucggcaccuccgccggcuucuccggcggccucggcaccuccgccggcuucggcggcggccucgucaccuccgacggcuucggcggcggccucggcaccaacgccuccuucggcuccacccucggcaccuccgccggcuucuccggcggccucuccaccuccgacggcuucggcucccgccccaacgccuccuucgaccgcggccucuccaccaucaucggcuucggcuccggcuccaacaccuccaccggcuucaccggcgagcccuccaccuccaccggcuucuccuccggccccuccuccaucgucggcuucuccggcggccccuccaccggcgucggcuucugcuccggccccuccaccuccggcuucuccggcggccccuccaccggcgccggcuucggcggcggccccaacaccggcgccggcuucggcggcggccccuccaccuccgccggcuucggcuccggcgccgccucccucggcgccugcggcuucuccuacggcuga

SEQ ID NO: 51195 - RNA, 1578 nt, Artificial Sequence
  derived and/or modified sequence opt2 from TROVE2__Homo_sapiens__NP_001035828
auggaggaguccgucaaccagaugcagccccucaacgagaagcagaucgccaacucccaggacggcuacgucuggcaggucaccgacaugaaccgccuccaccgcuuccucugcuucggcuccgagggcggcaccuacuacaucaaggagcagaagcucggccucgagaacgccgaggcccucauccgccucaucgaggacggccgcggcugcgaggucauccaggagaucaaguccuucucccaggagggccgcaccaccaagcaggagcccaugcucuucgcccucgccaucugcucccagugcuccgacaucuccaccaagcaggccgccuucaaggccgucuccgaggucugccgcauccccacccaccucuucaccuucauccaguucaagaaggaccucaaggaguccaugaagugcggcauguggggccgcgcccuccgcaaggccaucgccgacugguacaacgagaagggcggcauggcccucgcccucgccgucaccaaguacaagcagcgcaacggcuggucccacaaggaccuccuccgccucucccaccucaagcccuccuccgagggccucgccaucgucaccaaguacaucaccaagggcuggaaggagguccacgagcucuacaaggagaaggcccucuccgucgagaccgagaagcuccucaaguaccucgaggccgucgagaaggucaagcgcacccgcgacgagcucgaggucauccaccucaucgaggagcaccgccucguccgcgagcaccuccucaccaaccaccucaaguccaaggaggucuggaaggcccuccuccaggagaugccccucaccgcccuccuccgcaaccucggcaagaugaccgccaacuccguccucgagcccggcaacuccgaggucucccucgucugcgagaagcucugcaacgagaagcuccucaagaaggcccgcauccaccccuuccacauccucaucgcccucgagaccuacaagaccggccacggccuccgcggcaagcucaaguggcgccccgacgaggagauccucaaggcccucgacgccgccuucuacaagaccuucaagaccgucgagcccaccggcaagcgcuuccuccucgccgucgacgucuccgccuccaugaaccagcgcguccucggcuccauccucaacgccuccaccgucgccgccgccaugugcauggucgucacccgcaccgagaaggacuccuacgucgucgccuucuccgacgagaugguccccugccccgucaccaccgacaugacccuccagcagguccucauggccaugucccagauccccgccggcggcaccgacugcucccuccccaugaucugggcccagaagaccaacacccccgccgacgucuucaucgucuucaccgacaacgagaccuucgccggcggcguccaccccgccaucgcccuccgcgaguaccgcaagaagauggacauccccgccaagcucaucgucugcggcaugaccuccaacggcuucaccaucgccgaccccgacgaccgcgcccuccagaacacccuccucaacaaguccuucuga

SEQ ID NO: 51196 - RNA, 3435 nt, Artificial Sequence
  derived and/or modified sequence opt2 from TRPA1__Homo_sapiens__XP_011515926
auguccaucuccaugaagaagggcgcccgcgcccgcggcgagcagcuccaccaggucgccuccggcgucggcuccaugaagcgcucccuccgcaagauguggcgccccggcgagaagaaggagccccagggcgucgucuacgaggacguccccgacgacaccgaggacuucaaggagucccucaaggucgucuucgagggcuccgccuacggccuccagaacuucaacaagcagaagaagcucaagcgcugcgacgacauggacaccuucuuccuccacuacgccgccgccgagggccagaucgagcucauggagaagaucacccgcgacuccucccucgagguccuccacgagauggacgacuacggcaacaccccccuccacugcgccgucgagaagaaccagaucgaguccgucaaguuccuccucucccgcggcgccaaccccaaccuccgcaacuucaacaugauggccccccuccacaucgccguccagggcaugaacaacgaggucaugaagguccuccucgagcaccgcaccaucgacgucaaccucgagggcgagaacggcaacaccgccgucaucaucgccugcaccaccaacaacuccgaggcccuccagauccuccucaagaagggcgccaagcccugcaaguccaacaaguggggcugcuuccccauccaccaggccgccuucuccggcuccaaggagugcauggagaucauccuccgcuucggcgaggagcacggcuacucccgccagcuccacaucaacuucaugaacaacggcaaggccaccccccuccaccucgccguccagaacggcgaccucgagaugaucaagaugugccucgacaacggcgcccagaucgaccccgucgagaagggccgcugcaccgccauccacuucgccgccacccagggcgccaccgagaucgucaagcucaugaucuccuccuacuccggcuccgucgacaucgucaacaccaccgacggcugccacgagaccaugcuccaccgcgccucccucuucgaccaccacgagcucgccgacuaccucaucuccgucggcgccgacaucaacaagaucgacuccgagggccgcuccccccucauccucgccaccgccuccgccuccuggaacaucgucaaccuccuccucuccaagggcgcccaggucgacaucaaggacaacuucggccgcaacuuccuccaccucaccguccagcagcccuacggccucaagaaccuccgccccgaguucaugcagaugcagcagaucaaggagcucgucauggacgaggacaacgacggcugcaccccccuccacuacgccugccgccagggcggccccggcuccgucaacaaccuccucggcuucaacgucuccauccacuccaaguccaaggacaagaaguccccccuccacuucgccgccuccuacggccgcaucaacaccugccagcgccuccuccaggacaucuccgacacccgccuccucaacgagggcgaccuccacggcaugaccccccuccaccucgccgccaagaacggccacgacaaggucguccagcuccuccucaagaagggcgcccucuuccucuccgaccacaacggcuggaccgcccuccaccacgccuccaugggcggcuacacccagaccaugaaggucauccucgacaccaaccucaagugcaccgaccgccucgacgaggacggcaacaccgcccuccacuucgccgcccgcgagggccacgccaaggccgucgcccuccuccucucccacaacgccgacaucguccucaacaagcagcaggccuccuuccuccaccucgcccuccacaacaagcgcaaggaggucguccucaccaucauccgcuccaagcgcugggacgagugccucaagaucuucucccacaacucccccggcaacaagugccccaucaccgagaugaucgaguaccuccccgagugcaugaagguccuccucgacuucugcaugcuccacuccaccgaggacaaguccugccgcgacuacuacaucgaguacaacuucaaguaccuccagugcccccucgaguucaccaagaagacccccacccaggacgucaucuacgagccccucaccgcccucaacgccaugguccagaacaaccgcaucgagcuccucaaccaccccgucugcaaggaguaccuccucaugaaguggcucgccuacggcuuccgcgcccacaugaugaaccucggcuccuacugccucggccucauccccaugaccauccucgucgucaacaucaagcccggcauggccuucaacuccaccggcaucaucaacgagaccuccgaccacuccgagauccucgacaccaccaacuccuaccucaucaagaccugcaugauccucgucuuccucuccuccaucuucggcuacugcaaggaggccggccagaucuuccagcagaagcgcaacuacuucauggacaucuccaacguccucgaguggaucaucuacaccaccggcaucaucuucguccucccccucuucgucgagauccccgcccaccuccaguggcagugcggcgccaucgccgucuacuucuacuggaugaacuuccuccucuaccuccagcgcuucgagaacugcggcaucuucaucgucaugcucgaggucauccucaagacccuccuccgcuccaccgucgucuucaucuuccuccuccucgccuucggccucuccuucuacauccuccucaaccuccaggaccccuucuccuccccccuccucuccaucauccagaccuucuccaugaugcucggcgacaucaacuaccgcgaguccuuccucgagcccuaccuccgcaacgagcucgcccaccccguccucuccuucgcccagcucgucuccuucaccaucuucguccccaucguccucaugaaccuccucaucggccucgccgucggcgacaucgccgagguccagaagcacgccucccucaagcgcaucgccaugcaggucgagcuccacaccucccucgagaagaagcucccccucugguuccuccgcaaggucgaccagaaguccaccaucgucuaccccaacaagccccgcuccggcggcaugcucuuccacaucuucugcuuccucuucugcaccggcgagauccgccaggagauccccaacgccgacaagucccucgagauggagauccucaagcagaaguaccgccucaaggaccucaccuuccuccucgagaagcagcacgagcucaucaagcucaucauccagaagauggagaucaucuccgagaccgaggacgacgacucccacugcuccuuccaggaccgcuucaagaaggagcagauggagcagcgcaacucccgcuggaacaccguccuccgcgccgucaaggccaagacccaccaccucgagcccuga

SEQ ID NO: 51197 - RNA, 2382 nt, Artificial Sequence
  derived and/or modified sequence opt2 from TRPC1__Homo_sapiens__NP_001238774
augauggccgcccucuaccccuccaccgaccucuccggcgccuccuccuccucccuccccuccucccccuccuccuccucccccaacgaggucauggcccucaaggacguccgcgaggucaaggaggagaacacccucaacgagaagcucuuccuccucgccugcgacaagggcgacuacuacauggucaagaagauccucgaggagaacuccuccggcgaccucaacaucaacugcgucgacguccucggccgcaacgccgucaccaucaccaucgagaacgagaaccucgacauccuccagcuccuccucgacuacggcugccaguccgccgacgcccuccucgucgccaucgacuccgaggucgucggcgccgucgacauccuccucaaccaccgccccaagcgcuccucccgccccaccaucgucaagcucauggagcgcauccagaaccccgaguacuccaccaccauggacgucgcccccgucauccucgccgcccaccgcaacaacuacgagauccucaccaugcuccucaagcaggacgucucccuccccaagccccacgccgucggcugcgagugcacccucugcuccgccaagaacaagaaggacucccuccgccacucccgcuuccgccucgacaucuaccgcugccucgccucccccgcccucaucaugcucaccgaggaggaccccauccuccgcgccuucgagcucuccgccgaccucaaggagcucucccucgucgaggucgaguuccgcaacgacuacgaggagcucgcccgccagugcaagauguucgccaaggaccuccucgcccaggcccgcaacucccgcgagcucgaggucauccucaaccacaccuccuccgacgagccccucgacaagcgcggccuccucgaggagcgcaugaaccucucccgccucaagcucgccaucaaguacaaccagaaggaguucgucucccaguccaacugccagcaguuccucaacaccgucugguucggccagauguccggcuaccgccgcaagcccaccugcaagaagaucaugaccguccucaccgucggcaucuucuggcccguccucucccucugcuaccucaucgcccccaagucccaguucggccgcaucauccacacccccuucaugaaguucaucauccacggcgccuccuacuucaccuuccuccuccuccucaaccucuacucccucgucuacaacgaggacaagaagaacaccaugggccccgcccucgagcgcaucgacuaccuccucauccucuggaucaucggcaugaucugguccgacaucaagcgccucugguacgagggccucgaggacuuccucgaggagucccgcaaccagcucuccuucgucaugaacucccucuaccucgccaccuucgcccucaaggucgucgcccacaacaaguuccacgacuucgccgaccgcaaggacugggacgccuuccaccccacccucgucgccgagggccucuucgccuucgccaacguccucuccuaccuccgccucuucuucauguacaccaccuccuccauccucggcccccuccagaucuccaugggccagaugcuccaggacuucggcaaguuccucggcauguuccuccucguccucuucuccuucaccaucggccucacccagcucuacgacaagggcuacaccuccaaggagcagaaggacugcgucggcaucuucugcgagcagcaguccaacgacaccuuccacuccuucaucggcaccugcuucgcccucuucugguacaucuucucccucgcccacgucgccaucuucgucacccgcuucuccuacggcgaggagcuccaguccuucgucggcgccgucaucgucggcaccuacaacgucgucgucgucaucguccucaccaagcuccucgucgccaugcuccacaaguccuuccagcucaucgccaaccacgaggacaaggaguggaaguucgcccgcgccaagcucuggcucuccuacuucgacgacaagugcacccuccccccccccuucaacaucauccccucccccaagaccaucugcuacaugaucuccucccucuccaaguggaucugcucccacaccuccaagggcaaggucaagcgccagaacucccucaaggaguggcgcaaccucaagcagaagcgcgacgagaacuaccagaaggucaugugcugccucguccaccgcuaccucaccuccaugcgccagaagaugcaguccaccgaccaggccaccgucgagaaccucaacgagcuccgccaggaccucuccaaguuccgcaacgagauccgcgaccuccucggcuuccgcaccuccaaguacgccauguucuacccccgcaacuga

SEQ ID NO: 51198 - RNA, 2766 nt, Artificial Sequence
  derived and/or modified sequence opt2 from TRPC3__Homo_sapiens__NP_001124170
auguccaccaagguccgcaagugcaaggagcaggcccgcgucaccuuccccgcccccgaggaggaggaggacgagggcgaggacgagggcgccgagccccagcgccgccgccgcggcuggcgcggcgucaacggcggccucgagccccgcuccgcccccucccagcgcgagccccacggcuacugccccccccccuucucccacggccccgaccucuccauggagggcucccccucccuccgccgcaugaccgucaugcgcgagaagggccgccgccaggccguccgcggccccgccuucauguucaacgaccgcggcaccucccucaccgccgaggaggagcgcuuccucgacgccgccgaguacggcaacauccccgucguccgcaagaugcucgaggaguccaagacccucaacgucaacugcgucgacuacaugggccagaacgcccuccagcucgccgucggcaacgagcaccucgaggucaccgagcuccuccucaagaaggagaaccucgcccgcaucggcgacgcccuccuccucgccaucuccaagggcuacguccgcaucgucgaggccauccucaaccaccccggcuucgccgccuccaagcgccucacccucucccccugcgagcaggagcuccaggacgacgacuucuacgccuacgacgaggacggcacccgcuucucccccgacaucacccccaucauccucgccgcccacugccagaaguacgaggucguccacaugcuccucaugaagggcgcccgcaucgagcgcccccacgacuacuucugcaagugcggcgacugcauggagaagcagcgccacgacuccuucucccacucccgcucccgcaucaacgccuacaagggccucgccucccccgccuaccucucccucuccuccgaggaccccguccucaccgcccucgagcucuccaacgagcucgccaagcucgccaacaucgagaaggaguucaagaacgacuaccgcaagcucuccaugcagugcaaggacuucgucgucggcguccucgaccucugccgcgacuccgaggaggucgaggccauccucaacggcgaccucgaguccgccgagccccucgagguccaccgccacaaggccucccucucccgcgucaagcucgccaucaaguacgaggucaagaaguucgucgcccaccccaacugccagcagcagcuccucaccaucugguacgagaaccucuccggccuccgcgagcagaccaucgccaucaagugccucgucguccucgucgucgcccucggccuccccuuccucgccaucggcuacuggaucgcccccugcucccgccucggcaagauccuccgcucccccuucaugaaguucgucgcccacgccgccuccuucaucaucuuccucggccuccucgucuucaacgccuccgaccgcuucgagggcaucaccacccuccccaacaucaccgucaccgacuaccccaagcagaucuuccgcgucaagaccacccaguucaccuggaccgagaugcucaucauggucuggguccucggcaugaugugguccgagugcaaggagcucuggcucgagggcccccgcgaguacauccuccagcucuggaacguccucgacuucggcaugcucuccaucuucaucgccgccuucaccgcccgcuuccucgccuuccuccaggccaccaaggcccagcaguacgucgacuccuacguccaggaguccgaccucuccgaggucacccucccccccgagauccaguacuucaccuacgcccgcgacaaguggcuccccuccgacccccagaucaucuccgagggccucuacgccaucgccgucguccucuccuucucccgcaucgccuacauccuccccgccaacgaguccuucggcccccuccagaucucccucggccgcaccgucaaggacaucuucaaguucaugguccucuucaucauggucuucuucgccuucaugaucggcauguucauccucuacuccuacuaccucggcgccaaggucaacgccgccuucaccaccgucgaggaguccuucaagacccucuucugguccaucuucggccucuccgaggucaccuccgucguccucaaguacgaccacaaguucaucgagaacaucggcuacguccucuacggcaucuacaacgucaccauggucgucguccuccucaacaugcucaucgccaugaucaacuccuccuaccaggagaucgaggacgacuccgacgucgaguggaaguucgcccgcuccaagcucuggcucuccuacuucgacgacggcaagacccuccccccccccuucucccucguccccucccccaaguccuucgucuacuucaucaugcgcaucgucaacuuccccaagugccgccgccgccgccuccagaaggacaucgagaugggcaugggcaacuccaagucccgccucaaccucuucacccaguccaacucccgcgucuucgagucccacuccuucaacuccauccucaaccagcccacccgcuaccagcagaucaugaagcgccucaucaagcgcuacguccucaaggcccaggucgacaaggagaacgacgaggucaacgagggcgagcucaaggagaucaagcaggacaucuccucccuccgcuacgagcuccucgaggacaagucccaggccaccgaggagcucgccauccucauccacaagcucuccgagaagcucaaccccuccaugcuccgcugcgaguga

SEQ ID NO: 51199 - RNA, 2370 nt, Artificial Sequence
  derived and/or modified sequence opt2 from TRPC4AP__Homo_sapiens__NP_955400
auggccgccgcccccgucgccgccggcuccggcgccggccgcggccgccgcuccgccgccaccgucgccgccuggggcggcuggggcggccgcccccgccccggcaacauccuccuccagcuccgccagggccagcucaccggccgcggccucguccgcgccguccaguucaccgagaccuuccucaccgagcgcgacaagcaguccaagugguccggcaucccccagcuccuccucaagcuccacaccaccucccaccuccacuccgacuucgucgagugccagaacauccucaaggagaucuccccccuccucuccauggaggccauggccuucgucaccgaggagcgcaagcucacccaggagaccaccuaccccaacaccuacaucuucgaccucuucggcggcgucgaccuccucgucgagauccucaugcgccccaccaucuccauccgcggccagaagcucaagaucuccgacgagauguccaaggacugccucuccauccucuacaacaccugcgucugcaccgagggcgucaccaagcgccucgccgagaagaacgacuucgucaucuuccucuucacccucaugaccuccaagaagaccuuccuccagaccgccacccucaucgaggacauccucggcgucaagaaggagaugauccgccucgacgagguccccaaccucuccucccucgucuccaacuucgaccagcagcagcucgccaacuucugccgcauccucgccgucaccaucuccgagauggacaccggcaacgacgacaagcacacccuccucgccaagaacgcccagcagaagaagucccucucccucggccccuccgccgccgagaucaaccaggccgcccuccucuccauccccggcuucgucgagcgccucugcaagcucgccacccgcaaggucuccgaguccaccggcaccgccuccuuccuccaggagcucgaggagugguacaccuggcucgacaacgcccucguccucgacgcccucaugcgcgucgccaacgaggaguccgagcacaaccagggcgccuccgaggagaacggccucccccacaccuccgcccgcacccagcucccccaguccaugaagaucaugcacgagaucauguacaagcucgagguccucuacguccucugcguccuccucaugggccgccagcgcaaccagguccaccgcaugaucgccgaguucaagcucauccccggccucaacaaccucuucgacaagcucaucuggcgcaagcacuccgccuccgcccucguccuccacggccacaaccagaacugcgacugcucccccgacaucacccucaagauccaguuccuccgccuccuccaguccuucuccgaccaccacgagaacaaguaccuccuccucaacaaccaggagcucaacgagcucuccgccaucucccucaaggccaacauccccgaggucgaggccguccucaacaccgaccgcucccucgucugcgacggcaagcgcggccuccucacccgccuccuccaggucaugaagaaggagcccgccgaguccuccuuccgcuucuggcaggcccgcgccgucgaguccuuccuccgcggcaccaccuccuacgccgaccagauguuccuccucaagcgcggccuccucgagcacauccucuacugcaucgucgacuccgagugcaagucccgcgacguccuccaguccuacuucgaccuccucggcgagcucaugaaguucaacgucgacgccuucaagcgcuucaacaaguacaucaacaccgacgccaaguuccaggucuuccucaagcagaucaacuccucccucgucgacuccaacaugcucguccgcugcgucacccucucccucgaccgcuucgagaaccaggucgacaugaaggucgccgagguccucuccgagugccgccuccucgccuacaucucccagguccccacccagauguccuuccucuuccgccucaucaacaucauccacguccagacccucacccaggagaacgucuccugccucaacaccucccucgucauccucaugcucgcccgccgcaaggagcgccucccccucuaccuccgccuccuccagcgcauggagcacuccaagaaguaccccggcuuccuccucaacaacuuccacaaccuccuccgcuucuggcagcagcacuaccuccacaaggacaaggacuccaccugccucgagaacuccuccugcaucuccuucuccuacuggaaggagaccgucuccauccuccucaaccccgaccgccagucccccuccgcccucgucuccuacaucgaggagcccuacauggacaucgaccgcgacuucaccgaggaguga

SEQ ID NO: 51200 - RNA, 2682 nt, Artificial Sequence
  derived and/or modified sequence opt2 from TRPC4__Homo_sapiens__NP_001129427
auggcccaguucuacuacaagcgcaacgucaacgcccccuaccgcgaccgcaucccccuccgcaucguccgcgccgaguccgagcucucccccuccgagaaggccuaccucaacgccgucgagaagggcgacuacgccuccgucaagaagucccucgaggaggccgagaucuacuucaagaucaacaucaacugcaucgacccccucggccgcaccgcccuccucaucgccaucgagaacgagaaccucgagcucaucgagcuccuccucuccuucaacgucuacgucggcgacgcccuccuccacgccauccgcaaggaggucgucggcgccgucgagcuccuccucaaccacaagaagcccuccggcgagaagcaggucccccccauccuccucgacaagcaguucuccgaguucacccccgacaucacccccaucauccucgccgcccacaccaacaacuacgagaucaucaagcuccucguccagaagggcgucuccgucccccgcccccacgagguccgcugcaacugcgucgagugcgucuccuccuccgacgucgacucccuccgccacucccgcucccgccucaacaucuacaaggcccucgccucccccucccucaucgcccucuccuccgaggaccccuuccucaccgccuuccagcucuccugggagcuccaggagcucuccaaggucgagaacgaguucaaguccgaguacgaggagcucucccgccagugcaagcaguucgccaaggaccuccucgaccagacccgcuccucccgcgagcucgagaucauccucaacuaccgcgacgacaacucccucaucgaggagcaguccggcaacgaccucgcccgccucaagcucgccaucaaguaccgccagaaggaguucgucgcccagcccaacugccagcagcuccucgccucccgcugguacgacgaguuccccggcuggcgccgccgccacugggccgucaagauggucaccugcuucaucaucggccuccucuuccccgucuucuccgucugcuaccucaucgcccccaaguccccccucggccucuucauccgcaagcccuucaucaaguucaucugccacaccgccuccuaccucaccuuccucuuccuccuccuccucgccucccagcacaucgaccgcuccgaccucaaccgccagggccccccccccaccaucgucgaguggaugauccuccccuggguccucggcuucaucuggggcgagaucaagcagaugugggacggcggccuccaggacuacauccacgacugguggaaccucauggacuucgucaugaacucccucuaccucgccaccaucucccucaagaucgucgccuucgucaaguacuccgcccucaacccccgcgaguccugggacauguggcaccccacccucgucgccgaggcccucuucgccaucgccaacaucuucuccucccuccgccucaucucccucuucaccgccaacucccaccucggcccccuccagaucucccucggccgcaugcuccucgacauccucaaguuccucuucaucuacugccucguccuccucgccuucgccaacggccucaaccagcucuacuucuacuacgaggagaccaagggccucaccugcaagggcauccgcugcgagaagcagaacaacgccuucuccacccucuucgagacccuccagucccucuucugguccaucuucggccucaucaaccucuacgucaccaacgucaaggcccagcacgaguucaccgaguucgucggcgccaccauguucggcaccuacaacgucaucucccucgucguccuccucaacaugcucaucgccaugaugaacaacuccuaccagcucaucgccgaccacgccgacaucgaguggaaguucgcccgcaccaagcucuggauguccuacuucgaggagggcggcacccuccccacccccuucaacgucauccccucccccaagucccucugguaccucaucaaguggaucuggacccaccucugcaagaagaagaugcgccgcaagcccgaguccuucggcaccaucggccgccgcgccgccgacaaccuccgccgccaccaccaguaccaggaggucaugcgcaaccucgucaagcgcuacgucgccgccaugauccgcgacgccaagaccgaggagggccucaccgaggagaacuucaaggagcucaagcaggacaucuccuccuuccgcuucgagguccucggccuccuccgcggcuccaagcucuccaccauccaguccgccaacgccuccaaggaguccuccaacuccgccgacuccgacgagaaguccgacuccgaggaggaggucgcccgccagcaggccgccggcccccucgagcgcaacauccagcucgagucccgcggccucgccucccgcggcgaccucuccauccccggccucuccgagcagugcguccucgucgaccaccgcgagcgcaacaccgacacccucggccuccaggucggcaagcgcgucugccccuucaaguccgagaaggucgucgucgaggacaccguccccaucauccccaaggagaagcacgccaaggaggaggacuccuccaucgacuacgaccucaaccuccccgacaccgucacccacgaggacuacgucaccacccgccucuga

SEQ ID NO: 51201 - RNA, 2922 nt, Artificial Sequence
  derived and/or modified sequence opt2 from TRPC5__Homo_sapiens__NP_036603
auggcccagcucuacuacaagaaggucaacuacucccccuaccgcgaccgcaucccccuccagaucguccgcgccgagaccgagcucuccgccgaggagaaggccuuccucaacgccgucgagaagggcgacuacgccaccgucaagcaggcccuccaggaggccgagaucuacuacaacgucaacaucaacugcauggacccccucggccgcuccgcccuccucaucgccaucgagaacgagaaccucgagaucauggagcuccuccucaaccacuccgucuacgucggcgacgcccuccucuacgccauccgcaaggaggucgucggcgccgucgagcuccuccucuccuaccgccgccccuccggcgagaagcagguccccacccucaugauggacacccaguucuccgaguucacccccgacaucacccccaucaugcucgccgcccacaccaacaacuacgagaucaucaagcuccucguccagaagcgcgucaccaucccccgcccccaccagauccgcugcaacugcgucgagugcgucuccuccuccgaggucgacucccuccgccacucccgcucccgccucaacaucuacaaggcccucgccucccccucccucaucgcccucuccuccgaggaccccauccucaccgccuuccgccucggcugggagcucaaggagcucuccaaggucgagaacgaguucaaggccgaguacgaggagcucucccagcagugcaagcucuucgccaaggaccuccucgaccaggcccgcuccucccgcgagcucgagaucauccucaaccaccgcgacgaccacuccgaggagcucgacccccagaaguaccacgaccucgccaagcucaaggucgccaucaaguaccaccagaaggaguucgucgcccagcccaacugccagcagcuccucgccacccucugguacgacggcuuccccggcuggcgccgcaagcacugggucgucaagcuccucaccugcaugaccaucggcuuccucuuccccaugcucuccaucgccuaccucaucuccccccgcuccaaccucggccucuucaucaagaagcccuucaucaaguucaucugccacaccgccuccuaccucaccuuccucuucaugcuccuccucgccucccagcacaucguccgcaccgaccuccacguccagggccccccccccaccgucgucgaguggaugauccuccccuggguccucggcuucaucuggggcgagaucaaggagaugugggacggcggcuucaccgaguacauccacgacugguggaaccucauggacuucgccaugaacucccucuaccucgccaccaucucccucaagaucgucgccuacgucaaguacaacggcucccgcccccgcgaggagugggagauguggcaccccacccucaucgccgaggcccucuucgccaucuccaacauccucuccucccuccgccucaucucccucuucaccgccaacucccaccucggcccccuccagaucucccucggccgcaugcuccucgacauccucaaguuccucuucaucuacugccucguccuccucgccuucgccaacggccucaaccagcucuacuucuacuacgagacccgcgccaucgacgagcccaacaacugcaagggcauccgcugcgagaagcagaacaacgccuucuccacccucuucgagacccuccagucccucuucugguccgucuucggccuccucaaccucuacgucaccaacgucaaggcccgccacgaguucaccgaguucgucggcgccaccauguucggcaccuacaacgucaucucccucgucguccuccucaacaugcucaucgccaugaugaacaacuccuaccagcucaucgccgaccacgccgacaucgaguggaaguucgcccgcaccaagcucuggauguccuacuucgacgagggcggcacccuccccccccccuucaacaucauccccucccccaaguccuuccucuaccucggcaacugguucaacaacaccuucugccccaagcgcgaccccgacggccgccgccgccgccgcaaccuccgcuccuucaccgagcgcaacgccgacucccucauccagaaccagcacuaccaggaggucauccgcaaccucgucaagcgcuacgucgccgccaugauccgcaacuccaagacccacgagggccucaccgaggagaacuucaaggagcucaagcaggacaucuccuccuuccgcuacgagguccucgaccuccucggcaaccgcaagcacccccgcuccuucuccaccuccuccaccgagcucucccagcgcgacgacaacaacgacggcuccggcggcgcccgcgccaaguccaaguccgucuccuucaaccucggcugcaagaagaagaccugccacggccccccccucauccgcaccaugccccgcuccuccggcgcccagggcaaguccaaggccgaguccuccuccaagcgcuccuucaugggccccucccucaagaagcucggccuccucuucuccaaguucaacggccacauguccgagcccuccuccgagcccauguacaccaucuccgacggcaucguccagcagcacugcauguggcaggacauccgcuacucccagauggagaagggcaaggccgaggccugcucccaguccgagaucaaccucuccgaggucgagcucggcgagguccagggcgccgcccaguccuccgagugcccccucgccugcuccuccucccuccacugcgccuccuccaucugcuccuccaacuccaagcuccucgacuccuccgaggacgucuucgagaccuggggcgaggccugcgaccuccucaugcacaaguggggcgacggccaggaggagcaggucaccacccgccucuga

SEQ ID NO: 51202 - RNA, 2796 nt, Artificial Sequence
  derived and/or modified sequence opt2 from TRPC6__Homo_sapiens__NP_004612
augucccagucccccgccuucggcccccgccgcggcuccuccccccgcggcgccgccggcgccgccgcccgccgcaacgagucccaggacuaccuccucauggacuccgagcucggcgaggacggcugcccccaggccccccuccccugcuacggcuacuaccccugcuuccgcggcuccgacaaccgccucgcccaccgccgccagaccguccuccgcgagaagggccgccgccucgccaaccgcggccccgccuacauguucuccgaccgcuccaccucccucuccaucgaggaggagcgcuuccucgacgccgccgaguacggcaacauccccgucguccgcaagaugcucgaggagugccacucccucaacgucaacugcgucgacuacaugggccagaacgcccuccagcucgccgucgccaacgagcaccucgagaucaccgagcuccuccucaagaaggagaaccucucccgcgucggcgacgcccuccuccucgccaucuccaagggcuacguccgcaucgucgaggccauccucucccaccccgccuucgccgagggcaagcgccucgccaccucccccucccaguccgagcuccagcaggacgacuucuacgccuacgacgaggacggcacccgcuucucccacgacgucacccccaucauccucgccgcccacugccaggaguacgagaucguccacacccuccuccgcaagggcgcccgcaucgagcgcccccacgacuacuucugcaagugcaacgacugcaaccagaagcagaagcacgacuccuucucccacucccgcucccgcaucaacgccuacaagggccucgccucccccgccuaccucucccucuccuccgaggaccccgucaugaccgcccucgagcucuccaacgagcucgccguccucgccaacaucgagaaggaguucaagaacgacuacaagaagcucuccaugcagugcaaggacuucgucgucggccuccucgaccucugccgcaacaccgaggaggucgaggccauccucaacggcgacgucgagacccuccaguccggcgaccacggccgccccaaccucucccgccucaagcucgccaucaaguacgaggucaagaaguucgucgcccaccccaacugccagcagcagcuccucuccaucugguacgagaaccucuccggccuccgccagcagaccauggccgucaaguuccucgucguccucgccgucgccaucggccuccccuuccucgcccucaucuacugguucgcccccugcuccaagaugggcaagaucaugcgcggccccuucaugaaguucgucgcccacgccgccuccuucaccaucuuccucggccuccucgucaugaacgccgccgaccgcuucgagggcaccaagcuccuccccaacgagaccuccaccgacaacgccaagcagcucuuccgcaugaagaccuccugcuucuccuggauggagaugcucaucaucuccugggucaucggcaugaucugggccgagugcaaggagaucuggacccagggccccaaggaguaccucuucgagcucuggaacaugcucgacuucggcaugcucgccaucuucgccgccuccuucaucgcccgcuucauggccuucuggcacgccuccaaggcccaguccaucaucgacgccaacgacacccucaaggaccucaccaaggucacccucggcgacaacgucaaguacuacaaccucgcccgcaucaagugggaccccuccgacccccagaucaucuccgagggccucuacgccaucgccgucguccucuccuucucccgcaucgccuacauccuccccgccaacgaguccuucggcccccuccagaucucccucggccgcaccgucaaggacaucuucaaguucauggucaucuucaucauggucuucgucgccuucaugaucggcauguucaaccucuacuccuacuacaucggcgccaagcagaacgaggccuucaccaccgucgaggaguccuucaagacccucuucugggccaucuucggccucuccgaggucaaguccgucgucaucaacuacaaccacaaguucaucgagaacaucggcuacguccucuacggcgucuacaacgucaccauggucaucguccuccucaacaugcucaucgccaugaucaacuccuccuuccaggagaucgaggacgacgccgacgucgaguggaaguucgcccgcgccaagcucugguucuccuacuucgaggagggccgcacccuccccguccccuucaaccucguccccucccccaagucccucuucuaccuccuccucaagcucaagaaguggaucuccgagcucuuccagggccacaagaagggcuuccaggaggacgccgagaugaacaagaucaacgaggagaagaagcucggcauccucggcucccacgaggaccucuccaagcucucccucgacaagaagcaggucggccacaacaagcagcccuccauccgcuccuccgaggacuuccaccucaacuccuucaacaaccccccccgccaguaccagaagaucaugaagcgccucaucaagcgcuacguccuccaggcccagaucgacaaggaguccgacgaggucaacgagggcgagcucaaggagaucaagcaggacaucuccucccuccgcuacgagcuccucgaggagaagucccagaacaccgaggaccucgccgagcucauccgcgagcucggcgagaagcucuccauggagcccaaccaggaggagaccaaccgcuga

SEQ ID NO: 51203 - RNA, 2241 nt, Artificial Sequence
  derived and/or modified sequence opt2 from TRPC7__Homo_sapiens__NP_001161048
augcuccgcaacuccaccuucaagaacaugcagcgccgccacaccacccuccgcgagaagggccgccgccaggccauccgcggccccgccuacauguucaacgagaagggcaccucccucacccccgaggaggagcgcuuccucgacuccgccgaguacggcaacauccccgucguccgcaagaugcucgaggaguccaagacccucaacuucaacugcgucgacuacaugggccagaacgcccuccagcucgccgucggcaacgagcaccucgaggucaccgagcuccuccucaagaaggagaaccucgcccgcgucggcgacgcccuccuccucgccaucuccaagggcuacguccgcaucgucgaggccauccucaaccaccccgccuucgcccagggccagcgccucacccucuccccccucgagcaggagcuccgcgacgacgacuucuacgccuacgacgaggacggcacccgcuucucccacgacaucacccccaucauccucgccgcccacugccaggaguacgagaucguccacauccuccuccucaagggcgcccgcaucgagcgcccccacgacuacuucugcaagugcaacgagugcaccgagaagcagcgcaaggacuccuucucccacucccgcucccgcaugaacgccuacaagggccucgccuccgccgccuaccucucccucuccuccgaggaccccguccucaccgcccucgagcucuccaacgagcucgcccgccucgccaacaucgagaccgaguucaagcucggccgcacccuccgcucccccuucaugaaguucgucgcccacgccgucuccuucaccaucuuccucggccuccucgucgucaacgccuccgaccgcuucgagggcgucaagacccuccccaacgagaccuucaccgacuaccccaagcagaucuuccgcgucaagaccacccaguucuccuggaccgagaugcucaucaugaaguggguccucggcaugaucugguccgagugcaaggagaucugggaggagggcccccgcgaguacguccuccaccucuggaaccuccucgacuucggcaugcucuccaucuucgucgccuccuucaccgcccgcuucauggccuuccucaaggccaccgaggcccagcucuacgucgaccagcacguccaggacgacacccuccacaacgucucccucccccccgaggucgccuacuucaccuacgcccgcgacaagugguggcccuccgacccccagaucaucuccgagggccucuacgccaucgccgucguccucuccuucucccgcaucgccuacauccuccccgccaacgaguccuucggcccccuccagaucucccucggccgcaccgucaaggacaucuucaaguucauggucaucuucaucauggucuucgucgccuucaugaucggcauguucaaccucuacuccuacuaccgcggcgccaaguacaaccccgccuucaccaccgucgaggaguccuucaagacccucuucugguccaucuucggccucuccgaggucaucuccgucguccucaaguacgaccacaaguucaucgagaacaucggcuacguccucuacggcgucuacaacgucaccauggucgucguccuccucaacaugcucaucgccaugaucaacaacuccuaccaggagaucgaggaggacgccgacgucgaguggaaguucgcccgcgccaagcucuggcucuccuacuucgacgagggccgcacccuccccgcccccuucaaccucguccccucccccaaguccuucuacuaccucaucaugcgcaucaagaugugccucaucaagcucugcaaguccaaggccaaguccugcgagaacgaccucgagaugggcaugcucaacuccaaguucaagaagacccgcuaccaggccggcaugcgcaacuccgagaaccucaccgccaacaacacccucuccaagcccacccgcuaccagaagaucaugaagcgccucaucaagcgcuacguccucaaggcccaggucgaccgcgagaacgacgaggucaacgagggcgagcucaaggagaucaagcaggacaucuccucccuccgcuacgagcuccucgaggagaagucccaggccaccggcgagcucgccgaccucauccagcagcucuccgagaaguucggcaagaaccucaacaaggaccaccuccgcgucaacaagggcaaggacaucuga

SEQ ID NO: 51204 - RNA, 4929 nt, Artificial Sequence
  derived and/or modified sequence opt2 from TRPM1__Homo_sapiens__NP_001238949
auguccuccuucaagcgcggcucccucaaguccuccaccuccggcucccagaagggccagaaguccuggaucgagaagaccuucugcaagcgcgagugcaucuucgucauccccuccaugaaggacuccaaccgcugcugcugcggccaguucaccaaccagcacauccccccccuccccuccgccacccccuccaagaacgaggaggaguccaagcaggucgagacccagcccgagaagugguccgucgccaagcacacccaguccuaccccaccgacuccuacggcguccucgaguuccagggcggcggcuacuccaacaaggccauguacauccgcgucuccuacgacaccaagcccgacucccuccuccaccucauggucaaggacuggcagcucgagcuccccaagcuccucaucuccguccacggcggccuccagaacuucgagaugcagcccaagcucaagcaggucuucggcaagggccucaucaaggccgccaugaccaccggcgccuggaucuucaccggcggcgucuccaccggcgucaucucccacgucggcgacgcccucaaggaccacuccuccaagucccgcggccgcgucugcgccaucggcaucgcccccuggggcaucgucgagaacaaggaggaccucgucggcaaggacgucacccgcgucuaccagaccauguccaacccccucuccaagcucuccguccucaacaacucccacacccacuucauccucgccgacaacggcacccucggcaaguacggcgccgaggucaagcuccgccgccuccucgagaagcacaucucccuccagaagaucaacacccgccucggccagggcgucccccucgucggccucgucgucgagggcggccccaacgucgucuccaucguccucgaguaccuccaggaggagccccccauccccgucgucaucugcgacggcuccggccgcgccuccgacauccucuccuucgcccacaaguacugcgaggagggcggcaucaucaacgagucccuccgcgagcagcuccucgucaccauccagaagaccuucaacuacaacaaggcccagucccaccagcucuucgccaucaucauggagugcaugaagaagaaggagcucgucaccgucuuccgcaugggcuccgagggccagcaggacaucgagauggccauccucaccgcccuccucaagggcaccaacgucuccgcccccgaccagcucucccucgcccucgccuggaaccgcgucgacaucgcccgcucccagaucuucgucuucggcccccacuggcccccccucggcucccucgccccccccaccgacuccaaggccaccgagaaggagaagaagccccccauggccaccaccaagggcggccgcggcaagggcaagggcaagaagaagggcaaggucaaggaggaggucgaggaggagaccgacccccgcaagaucgagcuccucaacugggucaacgcccucgagcaggccaugcucgacgcccucguccucgaccgcgucgacuucgucaagcuccucaucgagaacggcgucaacaugcagcacuuccucaccaucccccgccucgaggagcucuacaacacccgccucggcccccccaacacccuccaccuccucguccgcgacgucaagaaguccaaccucccccccgacuaccacaucucccucaucgacaucggccucguccucgaguaccucaugggcggcgccuaccgcugcaacuacacccgcaagaacuuccgcacccucuacaacaaccucuucggccccaagcgccccaaggcccucaagcuccucggcauggaggacgacgagccccccgccaagggcaagaagaagaagaagaagaagaaggaggaggagaucgacaucgacgucgacgaccccgccgucucccgcuuccaguaccccuuccacgagcucauggucugggccguccucaugaagcgccagaagauggccgucuuccucuggcagcgcggcgaggaguccauggccaaggcccucgucgccugcaagcucuacaaggccauggcccacgaguccuccgaguccgaccucgucgacgacaucucccaggaccucgacaacaacuccaaggacuucggccagcucgcccucgagcuccucgaccaguccuacaagcacgacgagcagaucgccaugaagcuccucaccuacgagcucaagaacugguccaacuccaccugccucaagcucgccgucgccgccaagcaccgcgacuucaucgcccacaccugcucccagaugcuccucaccgacauguggaugggccgccuccgcaugcgcaagaaccccggccucaaggucaucaugggcauccuccucccccccaccauccucuuccucgaguuccgcaccuacgacgacuucuccuaccagaccuccaaggagaacgaggacggcaaggagaaggaggaggagaacaccgacgccaacgccgacgccggcucccgcaagggcgacgaggagaacgagcacaagaagcagcgcuccauccccaucggcaccaagaucugcgaguucuacaacgcccccaucgucaaguucugguucuacaccaucuccuaccucggcuaccuccuccucuucaacuacgucauccucguccgcauggacggcuggcccucccuccaggaguggaucgucaucuccuacaucgucucccucgcccucgagaagauccgcgagauccucauguccgagcccggcaagcucucccagaagaucaaggucuggcuccaggaguacuggaacaucaccgaccucgucgccaucuccaccuucaugaucggcgccauccuccgccuccagaaccagcccuacaugggcuacggccgcgucaucuacugcgucgacaucaucuucugguacauccgcguccucgacaucuucggcgucaacaaguaccucggccccuacgucaugaugaucggcaagaugaugaucgacaugcucuacuucgucgucaucaugcucgucguccucauguccuucggcgucgcccgccaggccauccuccaccccgaggagaagcccuccuggaagcucgcccgcaacaucuucuacaugcccuacuggaugaucuacggcgaggucuucgccgaccagaucgaccucuacgccauggagaucaacccccccugcggcgagaaccucuacgacgaggagggcaagcgccucccccccugcauccccggcgccuggcucacccccgcccucauggccugcuaccuccucgucgccaacauccuccucgucaaccuccucaucgccgucuucaacaacaccuucuucgaggucaaguccaucuccaaccaggucuggaaguuccagcgcuaccagcucaucaugaccuuccacgaccgccccguccuccccccccccaugaucauccucucccacaucuacaucaucaucaugcgccucuccggccgcugccgcaagaagcgcgagggcgaccaggaggagcgcgaccgcggccucaagcucuuccucuccgacgaggagcucaagcgccuccacgaguucgaggagcagugcguccaggagcacuuccgcgagaaggaggacgagcagcaguccuccuccgacgagcgcauccgcgucaccuccgagcgcgucgagaacauguccaugcgccucgaggagaucaacgagcgcgagaccuucaugaagaccucccuccagaccgucgaccuccgccucgcccagcucgaggagcucuccaaccgcauggucaacgcccucgagaaccucgccggcaucgaccgcuccgaccucauccaggcccgcucccgcgccuccuccgagugcgaggccaccuaccuccuccgccaguccuccaucaacuccgccgacggcuacucccucuaccgcuaccacuucaacggcgaggagcuccucuucgaggacaccucccucuccaccucccccggcaccggcguccgcaagaagaccugcuccuuccgcaucaaggaggagaaggacgucaagacccaccucguccccgagugccagaacucccuccaccucucccucggcaccuccaccuccgccacccccgacggcucccaccucgccgucgacgaccucaagaacgccgaggaguccaagcucggccccgacaucggcaucuccaaggaggacgacgagcgccagaccgacuccaagaaggaggagaccaucucccccucccucaacaagaccgacgucauccacggccaggacaaguccgacguccagaacacccagcucaccgucgagaccaccaacaucgagggcaccaucuccuacccccucgaggagaccaagaucacccgcuacuuccccgacgagaccaucaacgccugcaagaccaugaagucccgcuccuucgucuacucccgcggccgcaagcucgucggcggcgucaaccaggacgucgaguacuccuccaucaccgaccagcagcucaccaccgaguggcagugccagguccagaagaucacccgcucccacuccaccgacauccccuacaucgucuccgaggccgccguccaggccgagcacaaggagcaguucgccgacaugcaggacgagcaccacgucgccgaggccaucccccgcaucccccgccucucccucaccaucaccgaccgcaacggcauggagaaccuccucuccgucaagcccgaccagacccucggcuuccccucccuccgcuccaagucccuccacggccacccccgcaacgucaaguccauccagggcaagcucgaccgcuccggccacgccuccuccgucuccucccucgucaucgucuccggcaugaccgccgaggagaagaaggucaagaaggagaaggccuccaccgagaccgagugcuga

SEQ ID NO: 51205 - RNA, 4512 nt, Artificial Sequence
  derived and/or modified sequence opt2 from TRPM2__Homo_sapiens__XP_005261228
auggagcccuccgcccuccgcaaggccggcuccgagcaggaggagggcuucgagggccucccccgccgcgucaccgaccucggcauggucuccaaccuccgccgcuccaacuccucccucuucaaguccuggcgccuccagugccccuucggcaacaacgacaagcaggagucccucuccuccuggauccccgagaacaucaagaagaaggagugcgucuacuucgucgaguccuccaagcucuccgacgccggcaaggucgucugccagugcggcuacacccacgagcagcaccucgaggaggccaccaagccccacaccuuccagggcacccagugggaccccaagaagcacguccaggagaugcccaccgacgccuucggcgacaucgucuucaccggccucucccagaaggucaagaaguacguccgcgucucccaggacacccccuccuccgucaucuaccaccucaugacccagcacuggggccucgacguccccaaccuccucaucuccgucaccggcggcgccaagaacuucaacaugaagccccgccucaaguccaucuuccgccgcggccucgucaaggucgcccagaccaccggcgccuggaucaucaccggcggcucccacaccggcgucaugaagcaggucggcgaggccguccgcgacuucucccucuccuccuccuacaaggagggcgagcucaucaccaucggcgucgccaccuggggcaccguccaccgccgcgagggccucauccaccccaccggcuccuuccccgccgaguacauccucgacgaggacggccagggcaaccucaccugccucgacuccaaccacucccacuucauccucgucgacgacggcacccacggccaguacggcgucgagaucccccuccgcacccgccucgagaaguucaucuccgagcagaccaaggagcgcggcggcgucgccaucaagauccccaucgucugcgucguccucgagggcggccccggcacccuccacaccaucgacaacgccaccaccaacggcacccccugcgucgucgucgagggcuccggccgcgucgccgacgucaucgcccaggucgccaaccuccccgucuccgacaucaccaucucccucauccagcagaagcucuccgucuucuuccaggagauguucgagaccuucaccgagucccgcaucgucgaguggaccaagaagauccaggacaucguccgccgccgccagcuccucaccgucuuccgcgagggcaaggacggccagcaggacgucgacgucgccauccuccaggcccuccucaaggccucccgcucccaggaccacuucggccacgagaacugggaccaccagcucaagcucgccgucgccuggaaccgcgucgacaucgcccgcuccgagaucuucauggacgaguggcaguggaagcccuccgaccuccaccccaccaugaccgccgcccucaucuccaacaagcccgaguucgucaagcucuuccucgagaacggcguccagcucaaggaguucgucaccugggacacccuccucuaccucuacgagaaccucgaccccuccugccucuuccacuccaagcuccagaagguccucgucgaggaccccgagcgccccgccugcgcccccgccgccccccgccuccagaugcaccacgucgcccagguccuccgcgagcuccucggcgacuucacccagccccucuacccccgcccccgccacaacgaccgccuccgccuccuccuccccgucccccacgucaagcucaacguccagggcgucucccuccgcucccucuacaagcgcuccuccggccacgucaccuucaccauggaccccauccgcgaccuccucaucugggccaucguccagaaccgccgcgagcucgccggcaucaucugggcccagucccaggacugcaucgccgccgcccucgccugcuccaagauccucaaggagcucuccaaggaggaggaggacaccgacuccuccgaggagaugcucgcccucgccgaggaguacgagcaccgcgccaucggcgucuucaccgagugcuaccgcaaggacgaggagcgcgcccagaagcuccucacccgcgucuccgaggccuggggcaagaccaccugccuccagcucgcccucgaggccaaggacaugaaguucgucucccacggcggcauccaggccuuccucaccaaggucugguggggccagcucuccgucgacaacggccucuggcgcgucacccucugcaugcucgccuucccccuccuccucaccggccucaucuccuuccgcgagaagcgccuccaggacgucggcacccccgccgcccgcgcccgcgccuucuucaccgcccccgucgucgucuuccaccucaacauccucuccuacuucgccuuccucugccucuucgccuacguccucauggucgacuuccagcccguccccuccuggugcgagugcgccaucuaccucuggcucuucucccucgucugcgaggagaugcgccagcucuucuacgaccccgacgagugcggccucaugaagaaggccgcccucuacuucuccgacuucuggaacaagcucgacgucggcgccauccuccucuucgucgccggccucaccugccgccucauccccgccacccucuaccccggccgcgucauccucucccucgacuucauccucuucugccuccgccucaugcacaucuucaccaucuccaagacccucggccccaagaucaucaucgucaagcgcaugaugaaggacgucuucuucuuccucuuccuccucgccgucugggucgucuccuucggcgucgccaagcaggccauccucauccacaacgagcgccgcgucgacuggcucuuccgcggcgccgucuaccacuccuaccucaccaucuucggccagauccccggcuacaucgacggcgucaacuucaaccccgagcacugcucccccaacggcaccgaccccuacaagcccaagugccccgaguccgacgccacccagcagcgccccgccuuccccgaguggcucaccguccuccuccucugccucuaccuccucuucaccaacauccuccuccucaaccuccucaucgccauguucaacuacaccuuccagcagguccaggagcacaccgaccagaucuggaaguuccagcgccacgaccucaucgaggaguaccacggccgccccgccgcccccccccccuucauccuccucucccaccuccagcucuucaucaagcgcgucguccucaagacccccgccaagcgccacaagcagcucaagaacaagcucgagaagaacgaggaggccgcccuccucuccugggagaucuaccucaaggagaacuaccuccagaaccgccaguuccagcagaagcagcgccccgagcagaagaucgaggacaucuccaacaaggucgacgccauggucgaccuccucgaccucgacccccucaagcgcuccggcuccauggagcagcgccucgccucccucgaggagcaggucgcccagaccgcccaggcccuccacuggaucguccgcacccuccgcgccuccggcuucuccuccgaggccgacguccccacccucgccucccagaaggccgccgaggagcccgacgccgagcccggcggccgcaagaagaccgaggagcccggcgacuccuaccacgucaacgcccgccaccuccucuaccccaacugccccgucacccgcuuccccguccccaacgagaagguccccugggagaccgaguuccucaucuacgacccccccuucuacaccgccgagcgcaaggacgccgccgccauggaccccaugggcgacacccucgagccccucuccaccauccaguacaacgucgucgacggccuccgcgaccgccgcuccuuccacggccccuacaccguccaggccggccucccccucaaccccaugggccgcaccggccuccgcggccgcggcucccucuccugcuucggccccaaccacacccucuaccccauggucacccgcuggcgccgcaacgaggacggcgccaucugccgcaaguccaucaagaagaugcucgagguccucgucgucaagcucccccucuccgagcacugggcccuccccggcggcucccgcgagcccggcgagaugcucccccgcaagcucaagcgcauccuccgccaggagcacuggcccuccuucgagaaccuccucaagugcggcauggaggucuacaagggcuacauggacgacccccgcaacaccgacaacgccuggaucgagaccgucgccgucuccguccacuuccaggaccagaacgacgucgagcucaaccgccucaacuccaaccuccacgccugcgacuccggcgccuccauccgcuggcaggucgucgaccgccgcaucccccucuacgccaaccacaagacccuccuccagaaggccgccgccgaguucggcgcccacuacuga

SEQ ID NO: 51206 - RNA, 5124 nt, Artificial Sequence
  derived and/or modified sequence opt2 from TRPM3__Homo_sapiens__NP_001007472
augcccgagcccuggggcaccgucuacuuccucggcaucgcccaggucuucuccuuccucuucuccugguggaaccucgagggcgucaugaaccaggccgacgccccccgcccccucaacuggaccauccgcaagcucugccacgccgccuuccuccccuccguccgccuccucaaggcccagaaguccuggaucgagcgcgccuucuacaagcgcgagugcguccacaucauccccuccaccaaggacccccaccgcugcugcugcggccgccucaucggccagcacgucggccucacccccuccaucuccguccuccagaacgagaagaacgagucccgccucucccgcaacgacauccaguccgagaagugguccaucuccaagcacacccagcucucccccaccgacgccuucggcaccaucgaguuccagggcggcggccacuccaacaaggccauguacguccgcgucuccuucgacaccaagcccgaccuccuccuccaccucaugaccaaggaguggcagcucgagcuccccaagcuccucaucuccguccacggcggccuccagaacuucgagcuccagcccaagcucaagcaggucuucggcaagggccucaucaaggccgccaugaccaccggcgccuggaucuucaccggcggcgucaacaccggcgucauccgccacgucggcgacgcccucaaggaccacgccuccaagucccgcggcaagaucugcaccaucggcaucgcccccuggggcaucgucgagaaccaggaggaccucaucggccgcgacgucguccgccccuaccagaccauguccaaccccauguccaagcucaccguccucaacuccaugcacucccacuucauccucgccgacaacggcaccaccggcaaguacggcgccgaggucaagcuccgccgccagcucgagaagcacaucucccuccagaagaucaacacccgcaucggccagggcguccccgucgucgcccucaucgucgagggcggccccaacgucaucuccaucguccucgaguaccuccgcgacaccccccccguccccgucgucgucugcgacggcuccggccgcgccuccgacauccucgccuucggccacaaguacuccgaggagggcggccucaucaacgagucccuccgcgaccagcuccucgucaccauccagaagaccuucaccuacacccgcacccaggcccagcaccucuucaucauccucauggagugcaugaagaagaaggagcucaucaccgucuuccgcaugggcuccgagggccaccaggacaucgaccucgccauccucaccgcccuccucaagggcgccaacgccuccgcccccgaccagcucucccucgcccucgccuggaaccgcgucgacaucgcccgcucccagaucuucaucuacggccagcaguggcccgucggcucccucgagcaggccaugcucgacgcccucguccucgaccgcgucgacuucgucaagcuccucaucgagaacggcgucuccaugcaccgcuuccucaccaucucccgccucgaggagcucuacaacacccgccacggccccuccaacacccucuaccaccucguccgcgacgucaagaagggcaaccucccccccgacuaccgcaucucccucaucgacaucggccucgucaucgaguaccucaugggcggcgccuaccgcugcaacuacacccgcaagcgcuuccgcacccucuaccacaaccucuucggccccaagcgccccaaggcccucaagcuccucggcauggaggacgacaucccccuccgccgcggccgcaagaccaccaagaagcgcgaggaggaggucgacaucgaccucgacgaccccgagaucaaccacuuccccuuccccuuccacgagcucauggucugggccguccucaugaagcgccagaagauggcccucuucuucuggcagcacggcgaggaggccauggccaaggcccucgucgccugcaagcucugcaaggccauggcccacgaggccuccgagaacgacauggucgacgacaucucccaggagcucaaccacaacucccgcgacuucggccagcucgccgucgagcuccucgaccaguccuacaagcaggacgagcagcucgccaugaagcuccucaccuacgagcucaagaacugguccaacgccaccugccuccagcucgccgucgccgccaagcaccgcgacuucaucgcccacaccugcucccagaugcuccucaccgacauguggaugggccgccuccgcaugcgcaagaacuccggccucaaggucauccucggcauccuccucccccccuccauccucucccucgaguucaagaacaaggacgacaugcccuacaugucccaggcccaggagauccaccuccaggagaaggaggccgaggagcccgagaagcccaccaaggagaaggaggaggaggacauggagcucaccgccaugcucggccgcaacaacggcgaguccucccgcaagaaggacgaggaggagguccaguccaagcaccgccucaucccccucggccgcaagaucuacgaguucuacaacgcccccaucgucaaguucugguucuacacccucgccuacaucggcuaccucaugcucuucaacuacaucguccucgucaagauggagcgcuggcccuccacccaggaguggaucgucaucuccuacaucuucacccucggcaucgagaagaugcgcgagauccucauguccgagcccggcaagcuccuccagaaggucaaggucuggcuccaggaguacuggaacgucaccgaccucaucgccauccuccucuucuccgucggcaugauccuccgccuccaggaccagcccuuccgcuccgacggccgcgucaucuacugcgucaacaucaucuacugguacauccgccuccucgacaucuucggcgucaacaaguaccucggccccuacgucaugaugaucggcaagaugaugaucgacaugauguacuucgucaucaucaugcucgucguccucauguccuucggcgucgcccgccaggccauccucuuccccaacgaggagcccuccuggaagcucgccaagaacaucuucuacaugcccuacuggaugaucuacggcgaggucuucgccgaccagaucgacccccccugcggccagaacgagacccgcgaggacggcaagaucauccagcucccccccugcaagaccggcgccuggaucguccccgccaucauggccugcuaccuccucgucgccaacauccuccucgucaaccuccucaucgccgucuucaacaacaccuucuucgaggucaaguccaucuccaaccaggucuggaaguuccagcgcuaccagcucaucaugaccuuccacgagcgccccguccucccccccccccucaucaucuucucccacaugaccaugaucuuccagcaccucugcugccgcuggcgcaagcacgaguccgaccccgacgagcgcgacuacggccucaagcucuucaucaccgacgacgagcucaagaagguccacgacuucgaggagcagugcaucgaggaguacuuccgcgagaaggacgaccgcuucaacuccuccaacgacgagcgcauccgcgucaccuccgagcgcgucgagaacauguccaugcgccucgaggaggucaacgagcgcgagcacuccaugaaggccucccuccagaccgucgacauccgccucgcccagcucgaggaccucaucggccgcauggccaccgcccucgagcgccucaccggccucgagcgcgccgaguccaacaagauccgcucccgcaccuccuccgacugcaccgacgccgccuacaucguccgccaguccuccuucaacucccaggagggcaacaccuucaagcuccaggaguccaucgaccccgccggcgaggagaccaugucccccaccucccccacccucaugccccgcaugcgcucccacuccuucuacuccgucaacaugaaggacaagggcggcaucgagaagcucgaguccaucuucaaggagcgcucccucucccuccaccgcgccaccuccucccacuccgucgccaaggagcccaaggcccccgccgcccccgccaacacccucgccaucguccccgacucccgccgccccuccuccugcaucgacaucuacgucuccgccauggacgagcuccacugcgacaucgacccccucgacaacuccgucaacauccucggccucggcgagcccuccuucuccacccccguccccuccaccgcccccuccuccuccgccuacgccacccucgcccccaccgaccgcccccccucccgcuccaucgacuucgaggacaucaccuccauggacacccgcuccuucuccuccgacuacacccaccuccccgagugccagaaccccugggacuccgagccccccauguaccacaccaucgagcgcuccaaguccucccgcuaccucgccaccacccccuuccuccucgaggaggcccccaucgucaagucccacuccuucauguucucccccucccgcuccuacuacgccaacuucggcguccccgucaagaccgccgaguacaccuccaucaccgacugcaucgacacccgcugcgucaacgccccccaggccaucgccgaccgcgccgccuuccccggcggccucggcgacaaggucgaggaccucaccugcugccaccccgagcgcgaggccgagcucucccaccccuccuccgacuccgaggagaacgaggccaagggccgccgcgccaccaucgccaucuccucccaggagggcgacaacuccgagcgcacccucuccaacaacaucaccguccccaagaucgagcgcgccaacuccuacuccgccgaggagcccuccgcccccuacgcccacacccgcaaguccuucuccaucuccgacaagcucgaccgccagcgcaacaccgccucccuccgcaaccccuuccagcgcuccaaguccuccaagcccgagggccgcggcgacucccucuccaugcgccgccucucccgcaccuccgccuuccaguccuucgaguccaagcacaacuga

SEQ ID NO: 51207 - RNA, 3210 nt, Artificial Sequence
  derived and/or modified sequence opt2 from TRPM4__Homo_sapiens__NP_001182156
auggucguccccgagaaggagcaguccuggauccccaagaucuucaagaagaagaccugcaccaccuucaucgucgacuccaccgaccccggcggcacccucugccagugcggccgcccccgcaccgcccaccccgccgucgccauggaggacgccuucggcgccgccgucgucaccgucugggacuccgacgcccacaccaccgagaagcccaccgacgccuacggcgagcucgacuucaccggcgccggccgcaagcacuccaacuuccuccgccucuccgaccgcaccgaccccgccgccgucuacucccucgucacccgcaccuggggcuuccgcgcccccaaccucgucgucuccguccucggcggcuccggcggccccguccuccagaccuggcuccaggaccuccuccgccgcggccucguccgcgccgcccaguccaccggcgccuggaucgucaccggcggccuccacaccggcaucggccgccacgucggcgucgccguccgcgaccaccagauggccuccaccggcggcaccaaggucgucgccaugggcgucgcccccuggggcgucguccgcaaccgcgacacccucaucaaccccaagggcuccuuccccgcccgcuaccgcuggcgcggcgaccccgaggacggcguccaguucccccucgacuacaacuacuccgccuucuuccucgucgacgacggcacccacggcugccucggcggcgagaaccgcuuccgccuccgccucgaguccuacaucucccagcagaagaccggcgucggcggcaccggcaucgacauccccguccuccuccuccucaucgacggcgacgagaagaugcucacccgcaucgagaacgccacccaggcccagcuccccugccuccucgucgccggcuccggcggcgccgccgacugccucgccgagacccucgaggacacccucgcccccggcuccggcggcgcccgccagggcgaggcccgcgaccgcauccgccgcuucuuccccaagggcgaccucgagguccuccaggcccaggucgagcgcaucaugacccgcaaggagcuccucaccgucuacuccuccgaggacggcuccgaggaguucgagaccaucguccucaaggcccucgucaaggccugcggcuccuccgaggccuccgccuaccucgacgagcuccgccucgccgucgccuggaaccgcgucgacaucgcccaguccgagcucuuccgcggcgacauccaguggcgcuccuuccaccucgaggccucccucauggacgcccuccucaacgaccgccccgaguucguccgccuccucaucucccacggccucucccucggccacuuccucacccccaugcgccucgcccagcucuacuccgccgcccccuccaacucccucauccgcaaccuccucgaccaggccucccacuccgccggcaccaaggcccccgcccucaagggcggcgccgccgagcuccgcccccccgacgucggccacguccuccgcaugcuccucggcaagaugugcgccccccgcuaccccuccggcggcgccugggacccccaccccggccagggcuucggcgaguccauguaccuccucuccgacaaggccaccuccccccucucccucgacgccggccucggccaggcccccugguccgaccuccuccucugggcccuccuccucaaccgcgcccagauggccauguacuucugggagaugggcuccaacgccgucuccuccgcccucggcgccugccuccuccuccgcgucauggcccgccucgagcccgacgccgaggaggccgcccgccgcaaggaccucgccuucaaguucgagggcaugggcgucgaccucuucggcgagugcuaccgcuccuccgagguccgcgccgcccgccuccuccuccgccgcugcccccucuggggcgacgccaccugccuccagcucgccaugcaggccgacgcccgcgccuucuucgcccaggacggcguccagucccuccucacccagaagugguggggcgacauggccuccaccacccccaucugggcccucguccucgccuucuucugccccccccucaucuacacccgccucaucaccuuccgcaaguccgaggaggagcccacccgcgaggagcucgaguucgacauggacuccgucaucaacggcgagggccccgucggccucacccccggccucuaccaccucggccgcaccguccucugcaucgacuucauggucuucaccguccgccuccuccacaucuucaccgucaacaagcagcucggccccaagaucgucaucgucuccaagaugaugaaggacgucuucuucuuccucuucuuccucggcgucuggcucgucgccuacggcgucgccaccgagggccuccuccgcccccgcgacuccgacuuccccuccauccuccgccgcgucuucuaccgccccuaccuccagaucuucggccagaucccccaggaggacauggacgucgcccucauggagcacuccaacugcuccuccgagcccggcuucugggcccacccccccggcgcccaggccggcaccugcgucucccaguacgccaacuggcucgucguccuccuccucgucaucuuccuccucgucgccaacauccuccucgucaaccuccucaucgccauguucuccuacaccuucggcaagguccagggcaacuccgaccucuacuggaaggcccagcgcuaccgccucauccgcgaguuccacucccgccccgcccucgccccccccuucaucgucaucucccaccuccgccuccuccuccgccagcucugccgccgcccccgcuccccccagcccuccucccccgcccucgagcacuuccgcgucuaccucuccaaggaggccgagcgcaagcuccucaccugggaguccguccacaaggagaacuuccuccucgcccgcgcccgcgacaagcgcgaguccgacuccgagcgccucaagcgcaccucccagaaggucgaccucgcccucaagcagcucggccacauccgcgaguacgagcagcgccucaagguccucgagcgcgagguccagcagugcucccgcguccucggcugggucgccgaggcccucucccgcuccgcccuccucccccccggcggcccccccccccccgaccuccccggcuccaaggacuga

SEQ ID NO: 51208 - RNA, 3498 nt, Artificial Sequence
  derived and/or modified sequence opt2 from TRPM5__Homo_sapiens__NP_055370
augcaggacguccagggcccccgccccggcucccccggcgacgccgaggaccgccgcgagcucggccuccaccgcggcgaggucaacuucggcggcuccggcaagaagcgcggcaaguucguccgcguccccuccggcgucgcccccuccguccucuucgaccuccuccucgccgaguggcaccuccccgcccccaaccucgucgucucccucgucggcgaggagcagcccuucgccaugaaguccuggcuccgcgacguccuccgcaagggccucgucaaggccgcccaguccaccggcgccuggauccucaccuccgcccuccgcgucggccucgcccgccacgucggccaggccguccgcgaccacucccucgccuccaccuccaccaagguccgcgucgucgccgucggcauggccucccucggccgcguccuccaccgccgcauccucgaggaggcccaggaggacuuccccguccacuaccccgaggacgacggcggcucccagggcccccucugcucccucgacuccaaccucucccacuucauccucgucgagcccggcccccccggcaagggcgacggccucaccgagcuccgccuccgccucgagaagcacaucuccgagcagcgcgccggcuacggcggcaccggcuccaucgagauccccguccucugccuccucgucaacggcgaccccaacacccucgagcgcaucucccgcgccgucgagcaggccgcccccuggcucauccucgucggcuccggcggcaucgccgacguccucgccgcccucgucaaccagccccaccuccucguccccaaggucgccgagaagcaguucaaggagaaguuccccuccaagcacuucuccugggaggacaucguccgcuggaccaagcuccuccagaacaucaccucccaccagcaccuccucaccgucuacgacuucgagcaggagggcuccgaggagcucgacaccgucauccucaaggcccucgucaaggccugcaagucccacucccaggagccccaggacuaccucgacgagcucaagcucgccgucgccugggaccgcgucgacaucgccaaguccgagaucuucaacggcgacgucgaguggaaguccugcgaccucgaggaggucauggucgacgcccucgucuccaacaagcccgaguucguccgccucuucgucgacaacggcgccgacgucgccgacuuccucaccuacggccgccuccaggagcucuaccgcuccgucucccgcaagucccuccucuucgaccuccuccagcgcaagcaggaggaggcccgccucacccucgccggccucggcacccagcaggcccgcgagccccccgccggcccccccgccuucucccuccacgaggucucccgcguccucaaggacuuccuccaggacgccugccgcggcuucuaccaggacggccgccccggcgaccgccgccgcgccgagaagggccccgccaagcgccccaccggccagaaguggcuccucgaccucaaccagaaguccgagaaccccuggcgcgaccucuuccucugggccguccuccagaaccgccacgagauggccaccuacuucugggccaugggccaggagggcgucgccgccgcccucgccgccugcaagauccucaaggagaugucccaccucgagaccgaggccgaggccgcccgcgccacccgcgaggccaaguacgagcgccucgcccucgaccucuucuccgagugcuacuccaacuccgaggcccgcgccuucgcccuccucguccgccgcaaccgcugcugguccaagaccaccugccuccaccucgccaccgaggccgacgccaaggccuucuucgcccacgacggcguccaggccuuccucacccgcaucugguggggcgacauggccgccggcacccccauccuccgccuccucggcgccuuccucugccccgcccucgucuacaccaaccucaucaccuucuccgaggaggccccccuccgcaccggccucgaggaccuccaggaccucgacucccucgacaccgagaaguccccccucuacggccuccagucccgcgucgaggagcucgucgaggccccccgcgcccagggcgaccgcggcccccgcgccgucuuccuccucacccgcuggcgcaaguucuggggcgcccccgucaccgucuuccucggcaacgucgucauguacuucgccuuccucuuccucuucaccuacguccuccucgucgacuuccgcccccccccccagggccccuccggccccgaggucacccucuacuucugggucuucacccucguccucgaggagauccgccagggcuucuucaccgacgaggacacccaccucgucaagaaguucacccucuacgucggcgacaacuggaacaagugcgacauggucgccaucuuccucuucaucgucggcgucaccugccgcaugcuccccuccgccuucgaggccggccgcaccguccucgccauggacuucauggucuucacccuccgccucauccacaucuucgccauccacaagcagcucggccccaagaucaucgucgucgagcgcaugaugaaggacgucuucuucuuccucuucuuccucuccgucuggcucgucgccuacggcgucaccacccaggcccuccuccacccccacgacggccgccucgaguggaucuuccgccgcguccucuaccgccccuaccuccagaucuucggccagaucccccucgacgagaucgacgaggcccgcgucaacugcuccacccacccccuccuccucgaggacucccccuccugccccucccucuacgccaacuggcucgucauccuccuccucgucaccuuccuccucgucaccaacguccuccucaugaaccuccucaucgccauguucuccuacaccuuccaggucguccagggcaacgccgacauguucuggaaguuccagcgcuacaaccucaucgucgaguaccacgagcgccccgcccucgccccccccuucauccuccucucccaccucucccucacccuccgccgcgucuucaagaaggaggccgagcacaagcgcgagcaccucgagcgcgaccuccccgacccccucgaccagaaggucgucaccugggagaccguccagaaggagaacuuccucuccaagauggagaagcgccgccgcgacuccgagggcgagguccuccgcaagaccgcccaccgcgucgacuucaucgccaaguaccucggcggccuccgcgagcaggagaagcgcaucaagugccucgagucccagaucaacuacugcuccguccucgucuccuccgucgccgacguccucgcccagggcggcggcccccgcuccucccagcacugcggcgagggcucccagcucgucgccgccgaccaccgcggcggccucgacggcugggagcagcccggcgccggccagccccccuccgacaccuga

SEQ ID NO: 51209 - RNA, 6054 nt, Artificial Sequence
  derived and/or modified sequence opt2 from TRPM6__Homo_sapiens__NP_001170781
augaucauccucuccaagucccagaaguccuggaucaagggcgucuucgacaagcgcgagugcuccaccaucauccccuccuccaagaacccccaccgcugcacccccgucugccaggucugccagaaccucauccgcugcuacugcggccgccucaucggcgaccacgccggcaucgacuacuccuggaccaucuccgccgccaagggcaaggaguccgagcagugguccgucgagaagcacaccaccaagucccccaccgacaccuucggcaccaucaacuuccaggacggcgagcacacccaccacgccaaguacauccgcaccuccuacgacaccaagcucgaccaccuccuccaccucaugcucaaggaguggaagauggagcuccccaagcucgucaucuccguccacggcggcauccagaacuucaccaugcccuccaaguucaaggagaucuucucccagggccucgucaaggccgccgagaccaccggcgccuggaucaucaccgagggcaucaacaccggcgucuccaagcacgucggcgacgcccucaagucccacuccucccacucccuccgcaagaucuggaccgucggcaucccccccuggggcgucaucgagaaccagcgcgaccucaucggcaaggacgucgucugccucuaccagacccucgacaacccccucuccaagcucaccacccucaacuccaugcacucccacuucauccucuccgacgacggcaccgucggcaaguacggcaacgagaugaagcuccgccgcaaccucgagaaguaccucucccuccagaagauccacugccgcucccgccagggcguccccgucgucggccucgucgucgagggcggccccaacgucauccucuccgucugggagaccgucaaggacaaggaccccgucgucgucugcgagggcaccggccgcgccgccgaccuccucgccuucacccacaagcaccucgccgacgagggcaugcuccgcccccaggucaaggaggagaucaucugcaugauccagaacaccuucaacuucucccucaagcaguccaagcaccucuuccagauccucauggagugcaugguccaccgcgacugcaucaccaucuucgacgccgacuccgaggagcagcaggaccucgaccucgccauccucaccgcccuccucaagggcaccaaccucuccgccuccgagcagcucaaccucgccauggccugggaccgcgucgacaucgccaagaagcacauccucaucuacgagcagcacuggaagcccgacgcccucgagcaggccauguccgacgcccucgucauggaccgcgucgacuucgucaagcuccucaucgaguacggcgucaaccuccaccgcuuccucaccaucccccgccucgaggagcucuacaacaccaagcagggccccaccaacacccuccuccaccaccucguccaggacgucaagcagcacacccuccucuccggcuaccgcaucacccucaucgacaucggccucgucgucgaguaccucaucggccgcgccuaccgcuccaacuacacccgcaagcacuuccgcgcccucuacaacaaccucuaccgcaaguacaagcaccagcgccacuccuccggcaaccgcaacgaguccgccgaguccacccuccacucccaguucauccgcaccgcccagcccuacaaguucaaggagaaguccaucguccuccacaagucccgcaagaaguccaaggagcagaacgucuccgacgaccccgaguccaccggcuuccucuaccccuacaacgaccuccucgucugggccguccucaugaagcgccagaagauggccauguucuucuggcagcacggcgaggaggccaccgucaaggccgucaucgccugcauccucuaccgcgccauggcccacgaggccaaggagucccacauggucgacgacgccuccgaggagcucaagaacuacuccaagcaguucggccagcucgcccucgaccuccucgagaaggccuucaagcagaacgagcgcauggccaugacccuccucaccuacgagcuccgcaacugguccaacuccaccugccucaagcucgccgucuccggcggccuccgccccuucgucucccacaccugcacccagaugcuccucaccgacauguggaugggccgccucaagaugcgcaagaacuccuggcucaagaucaucaucuccaucauccucccccccaccauccucacccucgaguucaaguccaaggccgagaugucccacgucccccagucccaggacuuccaguucaugugguacuacuccgaccagaacgccuccuccuccaaggaguccgccuccgucaaggaguacgaccucgagcgcggccacgacgagaagcucgacgagaaccagcacuucggccucgaguccggccaccagcaccuccccuggacccgcaaggucuacgaguucuacuccgcccccaucgucaaguucugguucuacaccauggccuaccucgccuuccucaugcucuucaccuacaccguccucgucgagaugcagccccagcccuccguccaggaguggcucgucuccaucuacaucuucaccaacgccaucgaggucguccgcgagaucugcaucuccgagcccggcaaguucacccagaaggucaaggucuggaucuccgaguacuggaaccucaccgagaccgucgccaucggccucuucuccgccggcuucguccuccgcuggggcgacccccccuuccacaccgccggccgccucaucuacugcaucgacaucaucuucugguucucccgccuccucgacuucuucgccgucaaccagcacgccggccccuacgucaccaugaucgccaagaugaccgccaacauguucuacaucgucaucaucauggccaucguccuccucuccuucggcgucgcccgcaaggccauccucucccccaaggagccccccuccuggucccucgcccgcgacaucgucuucgagcccuacuggaugaucuacggcgaggucuacgccggcgagaucgacgucugcuccucccagcccuccugcccccccggcuccuuccucacccccuuccuccaggccgucuaccucuucguccaguacaucaucauggucaaccuccucaucgccuucuucaacaacgucuaccucgacauggaguccaucuccaacaaccucuggaaguacaaccgcuaccgcuacaucaugaccuaccacgagaagcccuggcucccccccccccucauccuccucucccacgucggccuccuccuccgccgccucugcugccaccgcgccccccacgaccaggaggagggcgacgucggccucaagcucuaccucuccaaggaggaccucaagaagcuccacgacuucgaggagcagugcgucgagaaguacuuccacgagaagauggaggacgucaacugcuccugcgaggagcgcauccgcgucaccuccgagcgcgucaccgagauguacuuccagcucaaggagaugaacgagaaggucuccuucaucaaggacucccuccucucccucgacucccaggucggccaccuccaggaccucuccgcccucaccgucgacacccucaagguccucuccgccgucgacacccuccaggaggacgaggcccuccucgccaagcgcaagcacuccaccugcaagaagcucccccacuccugguccaacgucaucugcgccgagguccucggcuccauggagaucgccggcgagaagaaguaccaguacuacuccaugcccuccucccuccuccgcucccucgccggcggccgccaccccccccgcguccagcgcggcgcccuccucgagaucaccaacuccaagcgcgaggccaccaacguccgcaacgaccaggagcgccaggagacccaguccuccaucgucgucuccggcgucucccccaaccgccaggcccacuccaaguacggccaguuccuccucguccccuccaaccucaagcgcguccccuucuccgccgagaccguccucccccucucccgccccuccguccccgacguccucgccaccgagcaggacauccagaccgagguccucguccaccucaccggccagacccccgucgucuccgacugggccuccgucgacgagcccaaggagaagcacgagcccaucgcccaccuccucgacggccaggacaaggccgagcagguccuccccacccucuccugcacccccgagcccaugaccauguccuccccccucucccaggccaagaucaugcagaccggcggcggcuacgucaacugggccuucuccgagggcgacgagaccggcgucuucuccaucaagaagaaguggcagaccugccuccccuccaccugcgacuccgacuccucccgcuccgagcagcaccagaagcaggcccaggacuccucccucuccgacaacuccacccgcuccgcccaguccuccgagugcuccgaggucggccccuggcuccagcccaacaccuccuucuggaucaacccccuccgccgcuaccgccccuucgcccgcucccacuccuuccgcuuccacaaggaggagaagcucaugaagaucugcaagaucaagaaccucuccggcuccuccgagaucggccagggcgccugggucaaggccaagaugcucaccaaggaccgccgccucuccaagaagaagaagaacacccagggccuccagguccccaucaucaccgucaacgccugcucccaguccgaccagcucaaccccgagcccggcgagaacuccaucuccgaggaggaguacuccaagaacugguucaccgucuccaaguucucccacaccggcgucgagcccuacauccaccagaagaugaagaccaaggagaucggccagugcgccauccagaucuccgacuaccucaagcagucccaggaggaccucuccaagaacucccucuggaacucccgcuccaccaaccucaaccgcaacucccuccucaaguccuccaucggcgucgacaagaucuccgccucccucaaguccccccaggagccccaccaccacuacuccgccaucgagcgcaacaaccucaugcgccucucccagaccauccccuucacccccguccagcucuucgccggcgaggagaucaccgucuaccgccucgaggaguccuccccccucaaccucgacaaguccauguccuccuggucccagcgcggccgcgccgccaugauccagguccucucccgcgaggagauggacggcggccuccgcaaggccaugcgcgucgucuccaccugguccgaggacgacauccucaagcccggccaggucuucaucgucaaguccuuccuccccgaggucguccgcaccuggcacaagaucuuccaggaguccaccguccuccaccucugccuccgcgagauccagcagcagcgcgccgcccagaagcucaucuacaccuucaaccaggucaagccccagaccauccccuacaccccccgcuuccucgaggucuuccucaucuacugccacuccgccaaccaguggcucaccaucgagaaguacaugaccggcgaguuccgcaaguacaacaacaacaacggcgacgagaucacccccaccaacacccucgaggagcucaugcucgccuucucccacuggaccuacgaguacacccgcggcgagcuccucguccucgaccuccagggcgucggcgagaaccucaccgaccccuccgucaucaagcccgaggucaagcagucccgcggcauggucuucggccccgccaaccucggcgaggacgccauccgcaacuucaucgccaagcaccacugcaacuccugcugccgcaagcucaagcuccccgaccucaagcgcaacgacuacucccccgagcgcaucaacuccaccuucggccucgagaucaagaucgaguccgccgaggagccccccgcccgcgagaccggccgcaacucccccgaggacgacaugcagcucuga

SEQ ID NO: 51210 - RNA, 5598 nt, Artificial Sequence
  derived and/or modified sequence opt2 from TRPM7__Homo_sapiens__NP_060142
augucccagaaguccuggaucgaguccacccucaccaagcgcgagugcgucuacaucauccccuccuccaaggacccccaccgcugccuccccggcugccagaucugccagcagcucguccgcugcuucugcggccgccucgucaagcagcacgccugcuucaccgccucccucgccaugaaguacuccgacgucaagcucggcgaccacuucaaccaggccaucgaggagugguccgucgagaagcacaccgagcagucccccaccgacgccuacggcgucaucaacuuccagggcggcucccacuccuaccgcgccaaguacguccgccucuccuacgacaccaagcccgaggucauccuccagcuccuccucaaggaguggcagauggagcuccccaagcucgucaucuccguccacggcggcaugcagaaguucgagcuccacccccgcaucaagcagcuccucggcaagggccucaucaaggccgccgucaccaccggcgccuggauccucaccggcggcgucaacaccggcgucgccaagcacgucggcgacgcccucaaggagcacgccucccgcuccucccgcaagaucugcaccaucggcaucgcccccuggggcgucaucgagaaccgcaacgaccucgucggccgcgacgucgucgcccccuaccagacccuccucaacccccucuccaagcucaacguccucaacaaccuccacucccacuucauccucgucgacgacggcaccgucggcaaguacggcgccgagguccgccuccgccgcgagcucgagaagaccaucaaccagcagcgcauccacgcccgcaucggccagggcguccccgucgucgcccucaucuucgagggcggccccaacgucauccucaccguccucgaguaccuccaggaguccccccccguccccgucgucgucugcgagggcaccggccgcgccgccgaccuccucgccuacauccacaagcagaccgaggagggcggcaaccuccccgacgccgccgagcccgacaucaucuccaccaucaagaagaccuucaacuucggccagaacgaggcccuccaccucuuccagacccucauggagugcaugaagcgcaaggagcucaucaccgucuuccacaucggcuccgacgagcaccaggacaucgacgucgccauccucaccgcccuccucaagggcaccaacgccuccgccuucgaccagcucauccucacccucgccugggaccgcgucgacaucgccaagaaccacgucuucgucuacggccagcaguggcucgucggcucccucgagcaggccaugcucgacgcccucgucauggaccgcgucgccuucgucaagcuccucaucgagaacggcgucuccaugcacaaguuccucaccaucccccgccucgaggagcucuacaacaccaagcagggccccaccaaccccaugcucuuccaccucguccgcgacgucaagcagggcaaccucccccccggcuacaagaucacccucaucgacaucggccucgucaucgaguaccucaugggcggcaccuaccgcugcaccuacacccgcaagcgcuuccgccucaucuacaacucccucggcggcaacaaccgccgcuccggccgcaacaccuccuccuccaccccccagcuccgcaagucccacgaguccuucggcaaccgcgccgacaagaaggagaagaugcgccacaaccacuucaucaagaccgcccagcccuaccgccccaagaucgacaccgucauggaggagggcaagaagaagcgcaccaaggacgagaucgucgacaucgacgaccccgagaccaagcgcuuccccuacccccucaacgagcuccucaucugggccugccucaugaagcgccaggucauggcccgcuuccucuggcagcacggcgaggaguccauggccaaggcccucgucgccugcaagaucuaccgcuccauggccuacgaggccaagcaguccgaccucgucgacgacaccuccgaggagcucaagcaguacuccaacgacuucggccagcucgccgucgagcuccucgagcaguccuuccgccaggacgagaccauggccaugaagcuccucaccuacgagcucaagaacugguccaacuccaccugccucaagcucgccgucuccucccgccuccgccccuucgucgcccacaccugcacccagaugcuccucuccgacauguggaugggccgccucaacaugcgcaagaacuccugguacaaggucauccucuccauccucgucccccccgccauccuccuccucgaguacaagaccaaggccgagaugucccacaucccccagucccaggacgcccaccagaugaccauggacgacuccgagaacaacuuccagaacaucaccgaggagauccccauggaggucuucaaggagguccgcauccucgacuccaacgagggcaagaacgagauggagauccagaugaaguccaagaagcuccccaucacccgcaaguucuacgccuucuaccacgcccccaucgucaaguucugguucaacacccucgccuaccucggcuuccucaugcucuacaccuucgucguccucguccagauggagcagcuccccuccguccaggaguggaucgucaucgccuacaucuucaccuacgccaucgagaagguccgcgagaucuucauguccgaggccggcaaggucaaccagaagaucaaggucugguucuccgacuacuucaacaucuccgacaccaucgccaucaucuccuucuucaucggcuucggccuccgcuucggcgccaaguggaacuucgccaacgccuacgacaaccacgucuucgucgccggccgccucaucuacugccucaacaucaucuucugguacguccgccuccucgacuuccucgccgucaaccagcaggccggccccuacgucaugaugaucggcaagauggucgccaacauguucuacaucgucgucaucauggcccucguccuccucuccuucggcgucccccgcaaggccauccucuacccccacgaggcccccuccuggacccucgccaaggacaucgucuuccaccccuacuggaugaucuucggcgaggucuacgccuacgagaucgacgucugcgccaacgacuccgucaucccccagaucugcggccccggcaccuggcucacccccuuccuccaggccgucuaccucuucguccaguacaucaucauggucaaccuccucaucgccuucuucaacaacgucuaccuccaggucaaggccaucuccaacaucgucuggaaguaccagcgcuaccacuucaucauggccuaccacgagaagcccguccucccccccccccucaucauccucucccacaucgucucccucuucugcugcaucugcaagcgccgcaagaaggacaagaccuccgacggccccaagcucuuccucaccgaggaggaccagaagaagcuccacgacuucgaggagcagugcgucgagauguacuucaacgagaaggacgacaaguuccacuccggcuccgaggagcgcauccgcgucaccuucgagcgcgucgagcagaugugcauccagaucaaggaggucggcgaccgcgucaacuacaucaagcgcucccuccagucccucgacucccagaucggccaccuccaggaccucuccgcccucaccgucgacacccucaagacccucaccgcccagaaggccuccgaggccuccaagguccacaacgagaucacccgcgagcucuccaucuccaagcaccucgcccagaaccucaucgacgacggccccguccgccccuccgucuggaagaagcacggcgucgucaacacccucuccuccucccucccccagggcgaccucgaguccaacaaccccuuccacugcaacauccucaugaaggacgacaaggacccccagugcaacaucuucggccaggaccuccccgccgucccccagcgcaaggaguucaacuuccccgaggccggcuccuccuccggcgcccucuuccccuccgccgucuccccccccgagcuccgccagcgccuccacggcgucgagcuccucaagaucuucaacaagaaccagaagcucggcuccuccuccaccuccaucccccaccucuccuccccccccaccaaguucuucgucuccacccccucccagcccuccugcaagucccaccucgagaccggcaccaaggaccaggagaccgucugcuccaaggccaccgagggcgacaacaccgaguucggcgccuucgucggccaccgcgacuccauggaccuccagcgcuucaaggagaccuccaacaagaucaagauccucuccaacaacaacaccuccgagaacacccucaagcgcgucuccucccucgccggcuucaccgacugccaccgcaccuccauccccguccacuccaagcaggccgagaagaucucccgccgccccuccaccgaggacacccacgaggucgacuccaaggccgcccucauccccgacuggcuccaggaccgccccuccaaccgcgagaugcccuccgaggagggcacccucaacggccucaccucccccuucaagcccgccauggacaccaacuacuacuacuccgccgucgagcgcaacaaccucaugcgccucucccaguccauccccuucacccccguccccccccgcggcgagcccgucaccgucuaccgccucgaggaguccucccccaacauccucaacaacuccauguccuccuggucccagcucggccucugcgccaagaucgaguuccucuccaaggaggagaugggcggcggccuccgccgcgccgucaagguccagugcaccugguccgagcacgacauccucaaguccggccaccucuacaucaucaaguccuuccuccccgaggucgucaacaccugguccuccaucuacaaggaggacaccguccuccaccucugccuccgcgagauccagcagcagcgcgccgcccagaagcucaccuucgccuucaaccagaugaagcccaaguccauccccuacuccccccgcuuccucgaggucuuccuccucuacugccacuccgccggccagugguucgccgucgaggagugcaugaccggcgaguuccgcaaguacaacaacaacaacggcgacgagaucauccccaccaacacccucgaggagaucaugcucgccuucucccacuggaccuacgaguacacccgcggcgagcuccucguccucgaccuccagggcgucggcgagaaccucaccgaccccuccgucaucaaggccgaggagaagcgcuccugcgacauggucuucggccccgccaaccucggcgaggacgccaucaagaacuuccgcgccaagcaccacugcaacuccugcugccgcaagcucaagcuccccgaccucaagcgcaacgacuacacccccgacaagaucaucuucccccaggacgagcccuccgaccucaaccuccagcccggcaacuccaccaaggaguccgaguccaccaacuccguccgccucaugcucuga

SEQ ID NO: 51211 - RNA, 3315 nt, Artificial Sequence
  derived and/or modified sequence opt2 from TRPM8__Homo_sapiens__NP_076985
auguccuuccgcgccgcccgccucuccaugcgcaaccgccgcaacgacacccucgacuccacccgcacccucuacuccuccgccucccgcuccaccgaccucuccuacuccgaguccgaccucgucaacuucauccaggccaacuucaagaagcgcgagugcgucuucuucaccaaggacuccaaggccaccgagaacgucugcaagugcggcuacgcccagucccagcacauggagggcacccagaucaaccaguccgagaaguggaacuacaagaagcacaccaaggaguuccccaccgacgccuucggcgacauccaguucgagacccucggcaagaagggcaaguacauccgccucuccugcgacaccgacgccgagauccucuacgagcuccucacccagcacuggcaccucaagacccccaaccucgucaucuccgucaccggcggcgccaagaacuucgcccucaagccccgcaugcgcaagaucuucucccgccucaucuacaucgcccaguccaagggcgccuggauccucaccggcggcacccacuacggccucaugaaguacaucggcgaggucguccgcgacaacaccaucucccgcuccuccgaggagaacaucgucgccaucggcaucgccgccuggggcauggucuccaaccgcgacacccucauccgcaacugcgacgccgagggcuacuuccucgcccaguaccucauggacgacuucacccgcgacccccucuacauccucgacaacaaccacacccaccuccuccucgucgacaacggcugccacggccaccccaccgucgaggccaagcuccgcaaccagcucgagaaguacaucuccgagcgcaccauccaggacuccaacuacggcggcaagauccccaucgucugcuucgcccagggcggcggcaaggagacccucaaggccaucaacaccuccaucaagaacaagauccccugcgucgucgucgagggcuccggccagaucgccgacgucaucgccucccucgucgaggucgaggacgcccucaccuccuccgccgucaaggagaagcucguccgcuuccucccccgcaccgucucccgccuccccgaggaggagaccgaguccuggaucaaguggcucaaggagauccucgagugcucccaccuccucaccgucaucaagauggaggaggccggcgacgagaucgucuccaacgccaucuccuacgcccucuacaaggccuucuccaccuccgagcaggacaaggacaacuggaacggccagcucaagcuccuccucgaguggaaccagcucgaccucgccaacgacgagaucuucaccaacgaccgccgcugggaguccgccgaccuccaggaggucauguucaccgcccucaucaaggaccgccccaaguucguccgccucuuccucgagaacggccucaaccuccgcaaguuccucacccacgacguccucaccgagcucuucuccaaccacuucuccacccucgucuaccgcaaccuccagaucgccaagaacuccuacaacgacgcccuccucaccuucgucuggaagcucgucgccaacuuccgccgcggcuuccgcaaggaggaccgcaacggccgcgacgagauggacaucgagcuccacgacgucucccccaucacccgccacccccuccaggcccucuucaucugggccauccuccagaacaagaaggagcucuccaaggucaucugggagcagacccgcggcugcacccucgccgcccucggcgccuccaagcuccucaagacccucgccaaggucaagaacgacaucaacgccgccggcgaguccgaggagcucgccaacgaguacgagacccgcgccgucgagcucuucaccgagugcuacuccuccgacgaggaccucgccgagcagcuccucgucuacuccugcgaggccuggggcggcuccaacugccucgagcucgccgucgaggccaccgaccagcacuucaucgcccagcccggcguccagaacuuccucuccaagcagugguacggcgagaucucccgcgacaccaagaacuggaagaucauccucugccucuucaucaucccccucgucggcugcggcuucgucuccuuccgcaagaagcccgucgacaagcacaagaagcuccucugguacuacgucgccuucuucaccucccccuucgucgucuucuccuggaacgucgucuucuacaucgccuuccuccuccucuucgccuacguccuccucauggacuuccacuccgucccccacccccccgagcucguccucuacucccucgucuucguccucuucugcgacgagguccgccagugguacgucaacggcgucaacuacuucaccgaccucuggaacgucauggacacccucggccucuucuacuucaucgccggcaucgucuuccgccuccacuccuccaacaaguccucccucuacuccggccgcgucaucuucugccucgacuacaucaucuucacccuccgccucauccacaucuucaccgucucccgcaaccucggccccaagaucaucaugcuccagcgcaugcucaucgacgucuucuucuuccucuuccucuucgccgucuggauggucgccuucggcgucgcccgccagggcauccuccgccagaacgagcagcgcuggcgcuggaucuuccgcuccgucaucuacgagcccuaccucgccauguucggccagguccccuccgacgucgacggcaccaccuacgacuucgcccacugcaccuucaccggcaacgaguccaagccccucugcgucgagcucgacgagcacaaccucccccgcuuccccgaguggaucaccaucccccucgucugcaucuacaugcucuccaccaacauccuccucgucaaccuccucgucgccauguucggcuacaccgucggcaccguccaggagaacaacgaccaggucuggaaguuccagcgcuacuuccucguccaggaguacugcucccgccucaacauccccuuccccuucaucgucuucgccuacuucuacauggucgucaagaagugcuucaagugcugcugcaaggagaagaacauggaguccuccgucugcugcuucaagaacgaggacaacgagacccucgccugggagggcgucaugaaggagaacuaccucgucaagaucaacaccaaggccaacgacaccuccgaggagaugcgccaccgcuuccgccagcucgacaccaagcucaacgaccucaagggccuccucaaggagaucgccaacaagaucaaguga

SEQ ID NO: 51212 - RNA, 3858 nt, Artificial Sequence
  derived and/or modified sequence opt2 from TRPS1__Homo_sapiens__NP_001269831
augcaguccaacaugguccgcaagaagaaccccccccuccgcaacgucgccuccgagggcgagggccagauccucgagcccaucggcaccgaguccaaggucuccggcaagaacaaggaguucuccgccgaccagauguccgagaacaccgaccaguccgacgccgccgagcucaaccacaaggaggagcacucccuccacguccaggaccccuccuccuccuccaagaaggaccucaaguccgccguccucuccgagaaggccggcuucaacuacgagucccccuccaagggcggcaacuuccccuccuucccccacgacgaggucaccgaccgcaacaugcucgccuucuccucccccgccgccggcggcgucugcgagccccucaaguccccccagcgcgccgaggccgacgacccccaggacauggccugcacccccuccggcgacucccucgagaccaaggaggaccagaagaugucccccaaggccaccgaggagaccggccaggcccaguccggccaggccaacugccagggccucucccccgucuccgucgccuccaagaacccccagguccccuccgacggcggcguccgccucaacaaguccaagaccgaccuccucgucaacgacaaccccgaccccgccccccucucccccgagcuccaggacuucaagugcaacaucugcggcuacggcuacuacggcaacgaccccaccgaccucaucaagcacuuccgcaaguaccaccucggccuccacaaccgcacccgccaggacgccgagcucgacuccaagauccucgcccuccacaacaugguccaguucucccacuccaaggacuuccagaaggucaaccgcuccgucuucuccggcguccuccaggacaucaacuccucccgccccguccuccucaacggcaccuacgacguccaggucaccuccggcggcaccuucaucggcaucggccgcaagacccccgacugccagggcaacaccaaguacuuccgcugcaaguucugcaacuucaccuacaugggcaacuccuccaccgagcucgagcagcacuuccuccagacccaccccaacaagaucaaggccucccuccccuccuccgaggucgccaagcccuccgagaagaacuccaacaaguccauccccgcccuccaguccuccgacuccggcgaccucggcaaguggcaggacaagaucaccgucaaggccggcgacgacacccccgucggcuacuccguccccaucaagccccucgacuccucccgccagaacggcaccgaggccaccuccuacuacuggugcaaguucugcuccuucuccugcgaguccuccuccucccucaagcuccucgagcacuacggcaagcagcacggcgccguccaguccggcggccucaaccccgagcucaacgacaagcucucccgcggcuccgucaucaaccagaacgaccucgccaaguccuccgagggcgagaccaugaccaagaccgacaaguccuccuccggcgccaagaagaaggacuucuccuccaagggcgccgaggacaacauggucaccuccuacaacugccaguucugcgacuuccgcuacuccaagucccacggccccgacgucaucgucgucggcccccuccuccgccacuaccagcagcuccacaacauccacaagugcaccaucaagcacugccccuucugcccccgcggccucugcucccccgagaagcaccucggcgagaucaccuaccccuucgccugccgcaaguccaacugcucccacugcgcccuccuccuccuccaccucucccccggcgccgccggcuccucccgcgucaagcaccagugccaccagugcuccuucaccacccccgacgucgacguccuccucuuccacuacgaguccguccacgagucccaggccuccgacgucaagcaggaggccaaccaccuccagggcuccgacggccagcaguccgucaaggaguccaaggagcacuccugcaccaagugcgacuucaucacccaggucgaggaggagaucucccgccacuaccgccgcgcccacuccugcuacaagugccgccagugcuccuucaccgccgccgacacccagucccuccucgagcacuucaacaccguccacugccaggagcaggacaucaccaccgccaacggcgaggaggacggccacgccaucuccaccaucaaggaggagcccaagaucgacuuccgcgucuacaaccuccucacccccgacuccaagaugggcgagcccgucuccgaguccgucgucaagcgcgagaagcucgaggagaaggacggccucaaggagaaggucuggaccgaguccuccuccgacgaccuccgcaacgucaccuggcgcggcgccgacauccuccgcggcucccccuccuacacccaggccucccucggccuccucacccccgucuccggcacccaggagcagaccaagacccuccgcgacucccccaacgucgaggccgcccaccucgcccgccccaucuacggccucgccgucgagaccaagggcuuccuccagggcgcccccgccggcggcgagaaguccggcgcccucccccagcaguaccccgccuccggcgagaacaaguccaaggacgagucccagucccuccuccgccgccgccgcggcuccggcgucuucugcgccaacugccucaccaccaagaccucccucuggcgcaagaacgccaacggcggcuacgucugcaacgccugcggccucuaccagaagcuccacuccaccccccgcccccucaacaucaucaagcagaacaacggcgagcagaucauccgccgccgcacccgcaagcgccucaaccccgaggcccuccaggccgagcagcucaacaagcagcagcgcggcuccaacgaggagcaggucaacggcuccccccucgagcgccgcuccgaggaccaccucaccgagucccaccagcgcgagaucccccuccccucccucuccaaguacgaggcccagggcucccucaccaagucccacuccgcccagcagcccguccucgucucccagacccucgacauccacaagcgcaugcagccccuccacauccagaucaaguccccccaggaguccaccggcgaccccggcaacuccuccuccgucuccgagggcaagggcuccuccgagcgcggcucccccaucgagaaguacaugcgccccgccaagcaccccaacuacuccccccccggcucccccaucgagaaguaccaguacccccucuucggccuccccuucguccacaacgacuuccaguccgaggccgacuggcuccgcuucugguccaaguacaagcucuccguccccggcaacccccacuaccucucccacguccccggccuccccaaccccugccagaacuacguccccuaccccaccuucaaccuccccccccacuucuccgccgucggcuccgacaacgacaucccccucgaccucgccaucaagcacucccgccccggccccaccgccaacggcgccuccaaggagaagaccaaggccccccccaacgucaagaacgagggcccccucaacgucgucaagaccgagaaggucgaccgcuccacccaggacgagcucuccaccaagugcguccacugcggcaucgucuuccucgacgaggucauguacgcccuccacauguccugccacggcgacuccggccccuuccagugcuccaucugccagcaccucugcaccgacaaguacgacuucaccacccacauccagcgcggccuccaccgcaacaacgcccaggucgagaagaacggcaagcccaaggaguga

SEQ ID NO: 51213 - RNA, 2520 nt, Artificial Sequence
  derived and/or modified sequence opt2 from TRPV1__Homo_sapiens__NP_542437
augaagaagugguccuccaccgaccucggcgccgccgccgacccccuccagaaggacaccugccccgacccccucgacggcgaccccaacucccgccccccccccgccaagccccagcucuccaccgccaagucccgcacccgccucuucggcaagggcgacuccgaggaggccuuccccgucgacugcccccacgaggagggcgagcucgacuccugccccaccaucaccgucucccccgucaucaccauccagcgccccggcgacggccccaccggcgcccgccuccucucccaggacuccgucgccgccuccaccgagaagacccuccgccucuacgaccgccgcuccaucuucgaggccgucgcccagaacaacugccaggaccucgagucccuccuccucuuccuccagaaguccaagaagcaccucaccgacaacgaguucaaggaccccgagaccggcaagaccugccuccucaaggccaugcucaaccuccacgacggccagaacaccaccaucccccuccuccucgagaucgcccgccagaccgacucccucaaggagcucgucaacgccuccuacaccgacuccuacuacaagggccagaccgcccuccacaucgccaucgagcgccgcaacauggcccucgucacccuccucgucgagaacggcgccgacguccaggccgccgcccacggcgacuucuucaagaagaccaagggccgccccggcuucuacuucggcgagcucccccucucccucgccgccugcaccaaccagcucggcaucgucaaguuccuccuccagaacuccuggcagaccgccgacaucuccgcccgcgacuccgucggcaacaccguccuccacgcccucgucgaggucgccgacaacaccgccgacaacaccaaguucgucaccuccauguacaacgagauccucaugcucggcgccaagcuccaccccacccucaagcucgaggagcucaccaacaagaagggcaugaccccccucgcccucgccgccggcaccggcaagaucggcguccucgccuacauccuccagcgcgagauccaggagcccgagugccgccaccucucccgcaaguucaccgagugggccuacggccccguccacuccucccucuacgaccucuccugcaucgacaccugcgagaagaacuccguccucgaggucaucgccuacuccuccuccgagacccccaaccgccacgacaugcuccucgucgagccccucaaccgccuccuccaggacaagugggaccgcuucgucaagcgcaucuucuacuucaacuuccucgucuacugccucuacaugaucaucuucaccauggccgccuacuaccgccccgucgacggccucccccccuucaagauggagaagaccggcgacuacuuccgcgucaccggcgagauccucuccguccucggcggcgucuacuucuucuuccgcggcauccaguacuuccuccagcgccgccccuccaugaagacccucuucgucgacuccuacuccgagaugcucuucuuccuccagucccucuucaugcucgccaccgucguccucuacuucucccaccucaaggaguacgucgccuccauggucuucucccucgcccucggcuggaccaacaugcucuacuacacccgcggcuuccagcagaugggcaucuacgccgucaugaucgagaagaugauccuccgcgaccucugccgcuucauguucgucuacaucgucuuccucuucggcuucuccaccgccgucgucacccucaucgaggacggcaagaacgacucccuccccuccgaguccaccucccaccgcuggcgcggccccgccugccgcccccccgacuccuccuacaacucccucuacuccaccugccucgagcucuucaaguucaccaucggcaugggcgaccucgaguucaccgagaacuacgacuucaaggccgucuucaucauccuccuccucgccuacgucauccucaccuacauccuccuccucaacaugcucaucgcccucaugggcgagaccgucaacaagaucgcccaggaguccaagaacaucuggaagcuccagcgcgccaucaccauccucgacaccgagaaguccuuccucaagugcaugcgcaaggccuuccgcuccggcaagcuccuccaggucggcuacacccccgacggcaaggacgacuaccgcuggugcuuccgcgucgacgaggucaacuggaccaccuggaacaccaacgucggcaucaucaacgaggaccccggcaacugcgagggcgucaagcgcacccucuccuucucccuccgcuccucccgcgucuccggccgccacuggaagaacuucgcccucgucccccuccuccgcgaggccuccgcccgcgaccgccaguccgcccagcccgaggaggucuaccuccgccaguucuccggcucccucaagcccgaggacgccgaggucuucaagucccccgccgccuccggcgagaaguga

SEQ ID NO: 51214 - RNA, 2295 nt, Artificial Sequence
  derived and/or modified sequence opt2 from TRPV2__Homo_sapiens__NP_057197
augaccucccccuccuccucccccgucuuccgccucgagacccucgacggcggccaggaggacggcuccgaggccgaccgcggcaagcucgacuucggcuccggccucccccccauggagucccaguuccagggcgaggaccgcaaguucgccccccagauccgcgucaaccucaacuaccgcaagggcaccggcgccucccagcccgaccccaaccgcuucgaccgcgaccgccucuucaacgccgucucccgcggcguccccgaggaccucgccggccuccccgaguaccucuccaagaccuccaaguaccucaccgacuccgaguacaccgagggcuccaccggcaagaccugccucaugaaggccguccucaaccucaaggacggcgucaacgccugcauccucccccuccuccagaucgaccgcgacuccggcaacccccagccccucgucaacgcccagugcaccgacgacuacuaccgcggccacuccgcccuccacaucgccaucgagaagcgcucccuccagugcgucaagcuccucgucgagaacggcgccaacguccacgcccgcgccugcggccgcuucuuccagaagggccagggcaccugcuucuacuucggcgagcucccccucucccucgccgccugcaccaagcagugggacgucgucuccuaccuccucgagaacccccaccagcccgccucccuccaggccaccgacucccagggcaacaccguccuccacgcccucgucaugaucuccgacaacuccgccgagaacaucgcccucgucaccuccauguacgacggccuccuccaggccggcgcccgccucugccccaccguccagcucgaggacauccgcaaccuccaggaccucaccccccucaagcucgccgccaaggagggcaagaucgagaucuuccgccacauccuccagcgcgaguucuccggccucucccaccucucccgcaaguucaccgaguggugcuacggccccguccgcgucucccucuacgaccucgccuccgucgacuccugcgaggagaacuccguccucgagaucaucgccuuccacugcaaguccccccaccgccaccgcauggucguccucgagccccucaacaagcuccuccaggccaagugggaccuccucauccccaaguucuuccucaacuuccucugcaaccucaucuacauguucaucuucaccgccgucgccuaccaccagcccacccucaagaagcaggccgccccccaccucaaggccgaggucggcaacuccaugcuccucaccggccacauccucauccuccucggcggcaucuaccuccucgucggccagcucugguacuucuggcgccgccacgucuucaucuggaucuccuucaucgacuccuacuucgagauccucuuccucuuccaggcccuccucaccgucgucucccagguccucugcuuccucgccaucgagugguaccucccccuccucgucuccgcccucguccucggcuggcucaaccuccucuacuacacccgcggcuuccagcacaccggcaucuacuccgucaugauccagaaggucauccuccgcgaccuccuccgcuuccuccucaucuaccucgucuuccucuucggcuucgccgucgcccucgucucccucucccaggaggccuggcgccccgaggcccccaccggccccaacgccaccgaguccguccagcccauggagggccaggaggacgagggcaacggcgcccaguaccgcggcauccucgaggccucccucgagcucuucaaguucaccaucggcaugggcgagcucgccuuccaggagcagcuccacuuccgcggcaugguccuccuccuccuccucgccuacguccuccucaccuacauccuccuccucaacaugcucaucgcccucauguccgagaccgucaacuccgucgccaccgacuccugguccaucuggaagcuccagaaggccaucuccguccucgagauggagaacggcuacugguggugccgcaagaagcagcgcgccggcgucaugcucaccgucggcaccaagcccgacggcucccccgacgagcgcuggugcuuccgcgucgaggaggucaacugggccuccugggagcagacccuccccacccucugcgaggaccccuccggcgccggcgucccccgcacccucgagaaccccguccucgccuccccccccaaggaggacgaggacggcgccuccgaggagaacuacguccccguccagcuccuccaguccaacuga

SEQ ID NO: 51215 - RNA, 2376 nt, Artificial Sequence
  derived and/or modified sequence opt2 from TRPV3__Homo_sapiens__NP_001245134
augaaggcccaccccaaggagauggucccccucaugggcaagcgcgucgccgcccccuccggcaaccccgccauccuccccgagaagcgccccgccgagaucacccccaccaagaaguccgcccacuucuuccucgagaucgagggcuucgagcccaaccccaccgucgccaagaccuccccccccgucuucuccaagcccauggacuccaacauccgccagugcaucuccggcaacugcgacgacauggacuccccccaguccccccaggacgacgucaccgagacccccuccaaccccaacucccccuccgcccagcucgccaaggaggagcagcgccgcaagaagcgccgccucaagaagcgcaucuucgccgccgucuccgagggcugcgucgaggagcucgucgagcuccucgucgagcuccaggagcucugccgccgccgccacgacgaggacguccccgacuuccucaugcacaagcucaccgccuccgacaccggcaagaccugccucaugaaggcccuccucaacaucaaccccaacaccaaggagaucguccgcauccuccucgccuucgccgaggagaacgacauccucggccgcuucaucaacgccgaguacaccgaggaggccuacgagggccagaccgcccucaacaucgccaucgagcgccgccagggcgacaucgccgcccuccucaucgccgccggcgccgacgucaacgcccacgccaagggcgccuucuucaaccccaaguaccagcacgagggcuucuacuucggcgagaccccccucgcccucgccgccugcaccaaccagcccgagaucguccagcuccucauggagcacgagcagaccgacaucaccucccgcgacucccgcggcaacaacauccuccacgcccucgucaccgucgccgaggacuucaagacccagaacgacuucgucaagcgcauguacgacaugauccuccuccgcuccggcaacugggagcucgagaccacccgcaacaacgacggccucaccccccuccagcucgccgccaagaugggcaaggccgagauccucaaguacauccucucccgcgagaucaaggagaagcgccuccgcucccucucccgcaaguucaccgacugggccuacggccccgucuccuccucccucuacgaccucaccaacgucgacaccaccaccgacaacuccguccucgagaucaccgucuacaacaccaacaucgacaaccgccacgagaugcucacccucgagccccuccacacccuccuccacaugaaguggaagaaguucgccaagcacauguucuuccucuccuucugcuucuacuucuucuacaacaucacccucacccucgucuccuacuaccgcccccgcgaggaggaggccaucccccacccccucgcccucacccacaagaugggcuggcuccagcuccucggccgcauguucguccucaucugggccaugugcaucuccgucaaggagggcaucgccaucuuccuccuccgccccuccgaccuccaguccauccucuccgacgccugguuccacuucgucuucuucauccaggccguccucgucauccucuccgucuuccucuaccucuucgccuacaaggaguaccucgccugccucguccucgccauggcccucggcugggccaacaugcucuacuacacccgcggcuuccaguccaugggcauguacuccgucaugauccagaaggucauccuccacgacguccucaaguuccucuucgucuacaucgucuuccuccucggcuucggcgucgcccucgccucccucaucgagaagugccccaaggacaacaaggacugcuccuccuacggcuccuucuccgacgccguccucgagcucuucaagcucaccaucggccucggcgaccucaacauccagcagaacuccaaguaccccauccucuuccucuuccuccucaucaccuacgucauccucaccuucguccuccuccucaacaugcucaucgcccucaugggcgagaccgucgagaacgucuccaaggaguccgagcgcaucuggcgccuccagcgcgcccgcaccauccucgaguucgagaagaugcuccccgaguggcuccgcucccgcuuccgcaugggcgagcucugcaaggucgccgaggacgacuuccgccucugccuccgcaucaacgaggucaaguggaccgaguggaagacccacgucuccuuccucaacgaggaccccggccccguccgccgcaccgccgacuucaacaagauccaggacuccucccgcaacaacuccaagaccacccucaacgccuucgaggaggucgaggaguuccccgagaccuccgucuga

SEQ ID NO: 51216 - RNA, 2514 nt, Artificial Sequence
  derived and/or modified sequence opt2 from TRPV4__Homo_sapiens__NP_001170902
auggccgacuccuccgagggcccccgcgccggccccggcgaggucgccgagcuccccggcgacgaguccggcacccccggcgacggccgccccaaccuccgcaugaaguuccagggcgccuuccgcaagggcguccccaaccccaucgaccuccucgaguccacccucuacgaguccuccgucguccccggccccaagaaggcccccauggacucccucuucgacuacggcaccuaccgccaccacuccuccgacaacaagcgcuggcgcaagaagaucaucgagaagcagccccagucccccaaggcccccgccccccagcccccccccauccucaaggucuucaaccgccccauccucuucgacaucgucucccgcggcuccaccgccgaccucgacggccuccuccccuuccuccucacccacaagaagcgccucaccgacgaggaguuccgcgagcccuccaccggcaagaccugccuccccaaggcccuccucaaccucuccaacggccgcaacgacaccauccccguccuccucgacaucgccgagcgcaccggcaacaugcgcgaguucaucaacucccccuuccgcgacaucuacuaccgcggccagaccgcccuccacaucgccaucgagcgccgcugcaagcacuacgucgagcuccucgucgcccagggcgccgacguccacgcccaggcccgcggccgcuucuuccagcccaaggacgagggcggcuacuucuacuucggcgagcucccccucucccucgccgccugcaccaaccagccccacaucgucaacuaccucaccgagaacccccacaagaaggccgacaugcgccgccaggacucccgcggcaacaccguccuccacgcccucgucgccaucgccgacaacacccgcgagaacaccaaguucgucaccaagauguacgaccuccuccuccucaagugcgcccgccucuuccccgacuccaaccucgaggccguccucaacaacgacggccucuccccccucaugauggccgccaagaccggcaagaucggcaucuuccagcacaucauccgccgcgaggucaccgacgaggacacccgccaccucucccgcaaguucaaggacugggccuacggccccgucuacuccucccucuacgaccucuccucccucgacaccugcggcgaggaggccuccguccucgagauccucgucuacaacuccaagaucgagaaccgccacgagaugcucgccgucgagcccaucaacgagcuccuccgcgacaaguggcgcaaguucggcgccgucuccuucuacaucaacgucgucuccuaccucugcgccauggucaucuucacccucaccgccuacuaccagccccucgagggcaccccccccuaccccuaccgcaccaccgucgacuaccuccgccucgccggcgaggucaucacccucuucaccggcguccucuucuucuucaccaacaucaaggaccucuucaugaagaagugccccggcgucaacucccucuucaucgacggcuccuuccagcuccucuacuucaucuacuccguccucgucaucgucuccgccgcccucuaccucgccggcaucgaggccuaccucgccgucauggucuucgcccucguccucggcuggaugaacgcccucuacuucacccgcggccucaagcucaccggcaccuacuccaucaugauccagaagauccucuucaaggaccucuuccgcuuccuccucgucuaccuccucuucaugaucggcuacgccuccgcccucgucucccuccucaaccccugcgccaacaugaaggucugcaacgaggaccagaccaacugcaccguccccaccuaccccuccugccgcgacuccgagaccuucuccaccuuccuccucgaccucuucaagcucaccaucggcaugggcgaccucgagaugcucuccuccaccaaguaccccgucgucuucaucauccuccucgucaccuacaucauccucaccuucguccuccuccucaacaugcucaucgcccucaugggcgagaccgucggccaggucuccaaggaguccaagcacaucuggaagcuccagugggccaccaccauccucgacaucgagcgcuccuuccccgucuuccuccgcaaggccuuccgcuccggcgagauggucaccgucggcaaguccuccgacggcacccccgaccgccgcuggugcuuccgcgucgacgaggucaacuggucccacuggaaccagaaccucggcaucaucaacgaggaccccggcaagaacgagaccuaccaguacuacggcuucucccacaccgucggccgccuccgccgcgaccgcugguccuccgucgucccccgcgucgucgagcucaacaagaacuccaaccccgacgaggucgucgucccccucgacuccaugggcaacccccgcugcgacggccaccagcagggcuacccccgcaaguggcgcaccgacgacgccccccucuga

SEQ ID NO: 51217 - RNA, 2190 nt, Artificial Sequence
  derived and/or modified sequence opt2 from TRPV5__Homo_sapiens__NP_062815
augggcggcuuccuccccaaggccgagggccccggcucccagcuccagaagcuccuccccuccuuccucguccgcgagcaggacugggaccagcaccucgacaagcuccacaugcuccagcagaagcgcauccucgaguccccccuccuccgcgccuccaaggagaacgaccucuccguccuccgccagcuccuccucgacugcaccugcgacguccgccagcgcggcgcccucggcgagaccgcccuccacaucgccgcccucuacgacaaccucgaggccgcccucguccucauggaggccgcccccgagcucgucuucgagcccaccaccugcgaggccuucgccggccagaccgcccuccacaucgccgucgucaaccagaacgucaaccucguccgcgcccuccucacccgccgcgccuccgucuccgcccgcgccaccggcaccgccuuccgccacuccccccgcaaccucaucuacuucggcgagcacccccucuccuucgccgccugcgucaacuccgaggagaucguccgccuccucaucgagcacggcgccgacauccgcgcccaggacucccucggcaacaccguccuccacauccucauccuccagcccaacaagaccuucgccugccagauguacaaccuccuccucuccuacgacggccacggcgaccaccuccagccccucgaccucguccccaaccaccagggccucacccccuucaagcucgccggcgucgagggcaacaccgucauguuccagcaccucaugcagaagcgccgccacauccaguggaccuacggcccccucaccuccauccucuacgaccucaccgagaucgacuccuggggcgaggagcucuccuuccucgagcucgucgucuccuccgacaagcgcgaggcccgccagauccucgagcagacccccgucaaggagcucgucuccuucaaguggaacaaguacggccgccccuacuucugcauccucgccgcccucuaccuccucuacaugaucugcuucaccaccugcugcgucuaccgcccccucaaguuccgcggcggcaaccgcacccacucccgcgacaucaccauccuccagcagaagcuccuccaggaggccuacgagacccgcgaggacaucauccgccucgucggcgagcucgucuccaucgucggcgccgucaucauccuccuccucgagauccccgacaucuuccgcgucggcgccucccgcuacuucggcaagaccauccucggcggccccuuccacgucaucaucaucaccuacgccucccucguccucgucaccauggucaugcgccucaccaacaccaacggcgaggucguccccauguccuucgcccucguccucggcuggugcuccgucauguacuucacccgcggcuuccagaugcucggccccuucaccaucaugauccagaagaugaucuucggcgaccucaugcgcuucugcuggcucauggccgucgucauccucggcuucgccuccgccuucuacaucaucuuccagaccgaggaccccaccucccucggccaguucuacgacuaccccauggcccucuucaccaccuucgagcucuuccucaccgucaucgacgcccccgccaacuacgacgucgaccuccccuucauguucuccaucgucaacuucgccuucaccaucaucgccacccuccucaugcucaaccucuucaucgccaugaugggcgacacccacuggcgcgucgcccaggagcgcgacgagcucuggcgcgcccaggucgucgccaccaccgucaugcucgagcgcaagcucccccgcugccucuggccccgcuccggcaucugcggcugcgaguucggccucggcgaccgcugguuccuccgcgucgagaaccacaacgaccagaacccccuccgcguccuccgcuacgucgaggucuucaagaacuccgacaaggaggacgaccaggagcaccccuccgagaagcagcccuccggcgccgaguccggcacccucgcccgcgccucccucgcccuccccaccuccucccucucccgcaccgccucccaguccuccucccaccgcggcugggagauccuccgccagaacacccucggccaccucaaccucggccucaaccucuccgagggcgacggcgaggaggucuaccacuucuga

SEQ ID NO: 51218 - RNA, 2298 nt, Artificial Sequence
  derived and/or modified sequence opt2 from TRPV6__Homo_sapiens__NP_061116
augggcccccuccagggcgacggcggccccgcccucggcggcgccgacgucgccccccgccucucccccguccgcgucuggccccgcccccaggcccccaaggagcccgcccuccaccccaugggccucucccuccccaaggagaagggccucauccucugccucugguccaaguucugccgcugguuccagcgccgcgaguccugggcccagucccgcgacgagcagaaccuccuccagcagaagcgcaucugggaguccccccuccuccucgccgccaaggacaacgacguccaggcccucaacaagcuccucaaguacgaggacugcaagguccaccagcgcggcgccaugggcgagaccgcccuccacaucgccgcccucuacgacaaccucgaggccgccaugguccucauggaggccgcccccgagcucgucuucgagcccaugaccuccgagcucuacgagggccagaccgcccuccacaucgccgucgucaaccagaacaugaaccucguccgcgcccuccucgcccgccgcgccuccgucuccgcccgcgccaccggcaccgccuuccgccgcucccccugcaaccucaucuacuucggcgagcacccccucuccuucgccgccugcgucaacuccgaggagaucguccgccuccucaucgagcacggcgccgacauccgcgcccaggacucccucggcaacaccguccuccacauccucauccuccagcccaacaagaccuucgccugccagauguacaaccuccuccucuccuacgaccgccacggcgaccaccuccagccccucgaccucguccccaaccaccagggccucacccccuucaagcucgccggcgucgagggcaacaccgucauguuccagcaccucaugcagaagcgcaagcacacccaguggaccuacggcccccucaccuccacccucuacgaccucaccgagaucgacuccuccggcgacgagcagucccuccucgagcucaucaucaccaccaagaagcgcgaggcccgccagauccucgaccagacccccgucaaggagcucgucucccucaaguggaagcgcuacggccgccccuacuucugcaugcucggcgccaucuaccuccucuacaucaucugcuucaccaugugcugcaucuaccgcccccucaagccccgcaccaacaaccgcaccuccccccgcgacaacacccuccuccagcagaagcuccuccaggaggccuacaugacccccaaggacgacauccgccucgucggcgagcucgucaccgucaucggcgccaucaucauccuccucgucgagguccccgacaucuuccgcaugggcgucacccgcuucuucggccagaccauccucggcggccccuuccacguccucaucaucaccuacgccuucaugguccucgucaccauggucaugcgccucaucuccgccuccggcgaggucguccccauguccuucgcccucguccucggcuggugcaacgucauguacuucgcccgcggcuuccagaugcucggccccuucaccaucaugauccagaagaugaucuucggcgaccucaugcgcuucugcuggcucauggccgucgucauccucggcuucgccuccgccuucuacaucaucuuccagaccgaggaccccgaggagcucggccacuucuacgacuaccccauggcccucuucuccaccuucgagcucuuccucaccaucaucgacggccccgccaacuacaacgucgaccuccccuucauguacuccaucaccuacgccgccuucgccaucaucgccacccuccucaugcucaaccuccucaucgccaugaugggcgacacccacuggcgcgucgcccacgagcgcgacgagcucuggcgcgcccagaucgucgccaccaccgucaugcucgagcgcaagcucccccgcugccucuggccccgcuccggcaucugcggccgcgaguacggccucggcgaccgcugguuccuccgcgucgaggaccgccaggaccucaaccgccagcgcauccagcgcuacgcccaggccuuccacacccgcggcuccgaggaccucgacaaggacuccgucgagaagcucgagcucggcugccccuucuccccccaccucucccuccccaugcccuccgucucccgcuccaccucccgcuccuccgccaacugggagcgccuccgccagggcacccuccgccgcgaccuccgcggcaucaucaaccgcggccucgaggacggcgaguccugggaguaccagaucuga

SEQ ID NO: 51219 - RNA, 11580 nt, Artificial Sequence
  derived and/or modified sequence opt2 from TRRAP__Homo_sapiens__NP_001231509
auggccuucgucgccacccagggcgccaccgucgucgaccagaccacccucaugaagaaguaccuccaguucgucgccgcccucaccgacgucaacacccccgacgagaccaagcucaagaugaugcaggaggucuccgagaacuucgagaacgucaccuccuccccccaguacuccaccuuccucgagcacaucaucccccgcuuccucaccuuccuccaggacggcgagguccaguuccuccaggagaagcccgcccagcagcuccgcaagcucguccucgagaucauccaccgcauccccaccaacgagcaccuccgcccccacaccaagaacguccucuccgucauguuccgcuuccucgagaccgagaacgaggagaacguccucaucugccuccgcaucaucaucgagcuccacaagcaguuccgcccccccaucacccaggagauccaccacuuccucgacuucgucaagcagaucuacaaggagcuccccaaggucgucaaccgcuacuucgagaacccccaggucauccccgagaacaccguccccccccccgagauggucggcaugaucaccaccaucgccgucaaggucaaccccgagcgcgaggacuccgagacccgcacccacuccaucaucccccgcggcucccucucccucaagguccucgccgagcuccccaucaucgucguccucauguaccagcucuacaagcucaacauccacaacgucgucgccgaguucgucccccucaucaugaacaccaucgccauccaggucuccgcccaggcccgccagcacaagcucuacaacaaggagcucuacgccgacuucaucgccgcccagaucaagacccucuccuuccucgccuacaucauccgcaucuaccaggagcucgucaccaaguacucccagcagauggucaagggcaugcuccagcuccucuccaacugccccgccgagaccgcccaccuccgcaaggagcuccucaucgccgccaagcacauccucaccaccgagcuccgcaaccaguucauccccugcauggacaagcucuucgacgaguccauccucaucggcuccggcuacaccgcccgcgagacccuccgcccccucgccuacuccacccucgccgaccucguccaccacguccgccagcaccucccccucuccgaccucucccucgccguccagcucuucgccaagaacaucgacgacgagucccuccccuccuccauccagaccauguccugcaagcuccuccucaaccucgucgacugcauccgcuccaaguccgagcaggaguccggcaacggccgcgacguccucaugcgcaugcucgaggucuucguccucaaguuccacaccaucgcccgcuaccagcucuccgccaucuucaagaagugcaagccccaguccgagcucggcgccgucgaggccgcccuccccggcguccccaccgcccccgccgcccccggccccgcccccucccccgcccccguccccgccccccccccccccccccccccccccccccccgccacccccgucacccccgcccccgucccccccuucgagaagcagggcgagaaggacaaggaggacaagcagaccuuccaggucaccgacugccgcucccucgucaagacccucgucugcggcgucaagaccaucaccuggggcaucaccuccugcaaggcccccggcgaggcccaguucauccccaacaagcagcuccagcccaaggagacccagaucuacaucaagcucgucaaguacgccaugcaggcccucgacaucuaccagguccagaucgccggcaacggccagaccuacauccgcgucgccaacugccagaccguccgcaugaaggaggagaaggagguccucgagcacuucgccggcgucuucaccaugaugaacccccucaccuucaaggagaucuuccagaccaccguccccuacauggucgagcgcaucuccaagaacuacgcccuccagaucgucgccaacuccuuccucgccaaccccaccaccuccgcccucuucgccaccauccucgucgaguaccuccucgaccgccuccccgagaugggcuccaacgucgagcucuccaaccucuaccucaagcucuucaagcucgucuucggcuccgucucccucuucgccgccgagaacgagcagaugcucaagccccaccuccacaagaucgucaacuccuccauggagcucgcccagaccgccaaggagcccuacaacuacuuccuccuccuccgcgcccucuuccgcuccaucggcggcggcucccacgaccuccucuaccaggaguuccucccccuccuccccaaccuccuccagggccucaacaugcuccaguccggccuccacaagcagcacaugaaggaccucuucgucgagcucugccucaccguccccguccgccucuccucccuccuccccuaccuccccaugcucauggacccccucgucuccgcccucaacggcucccagacccucgucucccagggccuccgcacccucgagcucugcgucgacaaccuccagcccgacuuccucuacgaccacauccagcccguccgcgccgagcucaugcaggcccucuggcgcacccuccgcaaccccgccgacuccaucucccacgucgccuaccgcguccucggcaaguucggcggcuccaaccgcaagaugcucaaggagucccagaagcuccacuacgucgucaccgagguccagggccccuccaucaccgucgaguucuccgacugcaaggccucccuccagcuccccauggagaaggccaucgagaccgcccucgacugccucaaguccgccaacaccgagcccuacuaccgccgccaggccugggaggucaucaagugcuuccucgucgccaugaugucccucgaggacaacaagcacgcccucuaccagcuccucgcccaccccaacuucaccgagaagaccauccccaacgucaucaucucccaccgcuacaaggcccaggacacccccgcccgcaagaccuucgagcaggcccucaccggcgccuucauguccgccgucaucaaggaccuccgccccuccgcccuccccuucgucgccucccucauccgccacuacaccauggucgccgucgcccagcagugcggccccuuccuccuccccugcuaccaggucggcucccagcccuccaccgccauguuccacuccgaggagaacggcuccaagggcauggacccccucguccucaucgacgccaucgccaucugcauggccuacgaggagaaggagcucugcaagaucggcgaggucgcccucgccgucaucuucgacgucgccuccaucauccucggcuccaaggagcgcgccugccagcucccccucuucuccuacaucgucgagcgccucugcgccugcugcuacgagcaggccugguacgccaagcucggcggcgucgucuccaucaaguuccucauggagcgccucccccucaccuggguccuccagaaccagcagaccuuccucaaggcccuccucuucgucaugauggaccucaccggcgaggucuccaacggcgccgucgccauggccaagaccacccucgagcagcuccucaugcgcugcgccaccccccucaaggacgaggagcgcgccgaggagaucgucgccgcccaggagaaguccuuccaccacgucacccacgaccucguccgcgaggucaccucccccaacuccaccguccgcaagcaggccaugcacucccuccagguccucgcccaggucaccggcaaguccgucaccgucaucauggagccccacaaggagguccuccaggacauggucccccccaagaagcaccuccuccgccaccagcccgccaacgcccagaucggccucauggagggcaacaccuucugcaccacccuccagccccgccucuucaccauggaccucaacgucgucgagcacaaggucuucuacaccgagcuccucaaccucugcgaggccgaggacuccgcccucaccaagcuccccugcuacaagucccuccccucccucgucccccuccgcaucgccgcccucaacgcccucgccgccugcaacuaccucccccagucccgcgagaagaucaucgccgcccucuucaaggcccucaacuccaccaacuccgagcuccaggaggccggcgaggccugcaugcgcaaguuccucgagggcgccaccaucgaggucgaccagauccacacccacaugcgcccccuccucaugaugcucggcgacuaccgcucccucacccucaacgucgucaaccgccucaccuccgucacccgccucuuccccaacuccuucaacgacaaguucugcgaccagaugaugcagcaccuccgcaaguggauggaggucgucgucaucacccacaagggcggccagcgcuccgacggcaacgaguccaucuccgagugcggccgcugcccccucucccccuucugccaguucgaggagaugaagaucugcuccgccaucaucaaccucuuccaccucauccccgccgccccccagacccucgucaagccccuccucgaggucgucaugaagaccgagcgcgccaugcucaucgaggccggcucccccuuccgcgagccccucaucaaguuccucacccgccaccccucccagaccgucgagcucuucaugauggaggccacccucaacgacccccaguggucccgcauguucauguccuuccucaagcacaaggacgcccgcccccuccgcgacguccucgccgccaaccccaaccgcuucaucacccuccuccuccccggcggcgcccagaccgccguccgccccggcucccccuccaccuccaccaugcgccucgaccuccaguuccaggccaucaagaucaucuccaucaucgucaagaacgacgacuccuggcucgccucccagcacucccucgucucccagcuccgccgcgucugggucuccgagaacuuccaggagcgccaccgcaaggagaacauggccgccaccaacuggaaggagcccaagcuccucgccuacugccuccucaacuacugcaagcgcaacuacggcgacaucgagcuccucuuccagcuccuccgcgccuucaccggccgcuuccucugcaacaugaccuuccucaaggaguacauggaggaggagauccccaagaacuacuccaucgcccagaagcgcgcccucuucuuccgcuucgucgacuucaacgaccccaacuucggcgacgagcucaaggccaagguccuccagcacauccucaaccccgccuuccucuacuccuucgagaagggcgagggcgagcagcuccucggcccccccaaccccgagggcgacaaccccgaguccaucaccuccgucuucaucaccaagguccucgaccccgagaagcaggccgacaugcucgacucccuccgcaucuaccuccuccaguacgccacccuccucgucgagcacgccccccaccacauccacgacaacaacaagaaccgcaacuccaagcuccgccgccucaugaccuucgccuggcccugccuccucuccaaggccugcgucgaccccgccugcaaguacuccggccaccuccuccucgcccacaucaucgccaaguucgccauccacaagaagaucguccuccaggucuuccacucccuccucaaggcccacgccauggaggcccgcgccaucguccgccaggccauggccauccucacccccgccguccccgcccgcauggaggacggccaccagaugcucacccacuggacccgcaagaucaucgucgaggagggccacaccgucccccagcucguccacauccuccaccucaucguccagcacuucaaggucuacuaccccguccgccaccaccucguccagcacauggucuccgccaugcagcgccucggcuucacccccuccgucaccaucgagcagcgccgccucgccgucgaccucuccgaggucgucaucaagugggagcuccagcgcaucaaggaccagcagcccgacuccgacauggaccccaacuccuccggcgagggcgucaacuccgucuccuccuccaucaagcgcggccucuccgucgacuccgcccaggaggucaagcgcuuccgcaccgccaccggcgccaucuccgccgucuucggccgcucccagucccuccccggcgccgacucccuccucgccaagcccaucgacaagcagcacaccgacaccgucgucaacuuccucauccgcgucgccugccaggucaacgacaacaccaacaccgccggcucccccggcgagguccucucccgccgcugcgucaaccuccucaagaccgcccuccgccccgacauguggcccaaguccgagcucaagcuccagugguucgacaagcuccucaugaccgucgagcagcccaaccaggucaacuacggcaacaucugcaccggccucgagguccucuccuuccuccucaccguccuccagucccccgccauccucuccuccuucaagccccuccagcgcggcaucgccgccugcaugaccugcggcaacaccaagguccuccgcgccguccacucccuccucucccgccucauguccaucuuccccaccgagcccuccaccuccuccgucgccuccaaguacgaggagcucgagugccucuacgccgccgucggcaaggucaucuacgagggccucaccaacuacgagaaggccaccaacgccaaccccucccagcucuucggcacccucaugauccucaaguccgccugcuccaacaaccccuccuacaucgaccgccucaucuccgucuucaugcgcucccuccagaagaugguccgcgagcaccucaacccccaggccgccuccggcuccaccgaggccaccuccggcaccuccgagcucgucaugcucucccucgagcucgucaagacccgccucgccgucauguccauggagaugcgcaagaacuucauccaggccauccucaccucccucaucgagaagucccccgacgccaagauccuccgcgccgucgucaagaucgucgaggagugggucaagaacaacucccccauggccgccaaccagacccccacccuccgcgagaaguccauccuccucgucaagaugaugaccuacaucgagaagcgcuuccccgaggaccucgagcucaacgcccaguuccucgaccucgucaacuacgucuaccgcgacgagacccucuccggcuccgagcucaccgccaagcucgagcccgccuuccucuccggccuccgcugcgcccagccccucauccgcgccaaguucuucgaggucuucgacaacuccaugaagcgccgcgucuacgagcgccuccucuacgucaccugcucccagaacugggaggccaugggcaaccacuucuggaucaagcagugcaucgagcuccuccucgccgucugcgagaaguccacccccaucggcaccuccugccagggcgccaugcuccccuccaucaccaacgucaucaaccucgccgacucccacgaccgcgccgccuucgccauggucacccacgucaagcaggagccccgcgagcgcgagaacuccgaguccaaggaggaggacgucgagaucgacaucgagcucgcccccggcgaccagaccuccacccccaagaccaaggagcucuccgagaaggacaucggcaaccagcuccacaugcucaccaaccgccacgacaaguuccucgacacccuccgcgaggucaagaccggcgcccuccucuccgccuucguccagcucugccacaucuccaccacccucgccgagaagaccuggguccagcucuucccccgccucuggaagauccucuccgaccgccagcagcacgcccucgccggcgagaucucccccuuccucugcuccggcucccaccagguccagcgcgacugccagcccuccgcccucaacugcuucgucgaggccaugucccagugcgucccccccauccccauccgccccugcguccucaaguaccucggcaagacccacaaccucugguuccgcuccacccucaugcucgagcaccaggccuucgagaagggccucucccuccagaucaagcccaagcagaccaccgaguucuacgagcaggaguccaucacccccccccagcaggagauccucgacucccucgccgagcucuacucccuccuccaggaggaggacaugugggccggccucuggcagaagcgcugcaaguacuccgagaccgccaccgccaucgccuacgagcagcacggcuucuucgagcaggcccaggaguccuacgagaaggccauggacaaggccaagaaggagcacgagcgcuccaacgccucccccgccaucuuccccgaguaccagcucugggaggaccacuggauccgcugcuccaaggagcucaaccagugggaggcccucaccgaguacggccaguccaagggccacaucaaccccuaccucguccucgagugcgccuggcgcgucuccaacuggaccgccaugaaggaggcccucguccaggucgaggucuccugccccaaggagauggccuggaaggucaacauguaccgcggcuaccucgccaucugccaccccgaggagcagcagcucuccuucaucgagcgccucgucgagauggccuccucccucgccauccgcgaguggcgccgccucccccacgucgucucccacguccacaccccccuccuccaggccgcccagcagaucaucgagcuccaggaggccgcccagaucaacgccggccuccagcccaccaaccucggccgcaacaacucccuccacgacaugaagaccgucgucaagaccuggcgcaaccgccuccccaucgucuccgacgaccucucccacugguccuccaucuucauguggcgccagcaccacuaccagggcaagcccaccugguccggcaugcacuccuccuccaucgucaccgccuacgagaacuccucccagcacgaccccuccuccaacaacgccaugcucggcguccacgccuccgccuccgccaucauccaguacggcaagaucgcccgcaagcagggccucgucaacgucgcccucgacauccucucccgcauccacaccauccccaccguccccaucgucgacugcuuccagaagauccgccagcaggucaagugcuaccuccagcucgccggcgucaugggcaagaacgagugcaugcagggccucgaggucaucgaguccaccaaccucaaguacuucaccaaggagaugaccgccgaguucuacgcccucaagggcauguuccucgcccagaucaacaaguccgaggaggccaacaaggccuucuccgccgccguccagaugcacgacguccucgucaaggccugggccauguggggcgacuaccucgagaacaucuucgucaaggagcgccagcuccaccucggcgucuccgccaucaccugcuaccuccacgccugccgccaccagaacgaguccaagucccgcaaguaccucgccaagguccucuggcuccucuccuucgacgacgacaagaacacccucgccgacgccgucgacaaguacugcaucggcgucccccccauccaguggcucgccuggaucccccagcuccucaccugccucgucggcuccgagggcaagcuccuccucaaccucaucucccaggucggccgcgucuacccccaggccgucuacuuccccauccgcacccucuaccucacccucaagaucgagcagcgcgagcgcuacaaguccgaccccggccccauccgcgccaccgcccccauguggcgcugcucccgcaucaugcacaugcagcgcgagcuccaccccacccuccucuccucccucgagggcaucgucgaccagauggucugguuccgcgagaacuggcacgaggagguccuccgccagcuccagcagggccucgccaagugcuacuccgucgccuucgagaaguccggcgccgucuccgacgccaagaucaccccccacacccucaacuucgucaagaagcucgucuccaccuucggcgucggccucgagaacgucuccaacgucuccaccauguucuccuccgccgccuccgagucccucgcccgccgcgcccaggccaccgcccaggaccccgucuuccagaagcucaagggccaguucaccaccgacuucgacuucuccguccccggcuccaugaagcuccacaaccucaucuccaagcucaagaaguggaucaagauccucgaggccaagaccaagcagcuccccaaguucuuccucaucgaggagaagugccgcuuccucuccaacuucuccgcccagaccgccgaggucgagauccccggcgaguuccucaugcccaagcccacccacuacuacaucaagaucgcccgcuucaugccccgcgucgagaucguccagaagcacaacaccgccgcccgccgccucuacauccgcggccacaacggcaagaucuaccccuaccucgucaugaacgacgccugccucaccgagucccgccgcgaggagcgcguccuccagcuccuccgccuccucaaccccugccucgagaagcgcaaggagaccaccaagcgccaccucuucuucaccgucccccgcgucgucgccgucuccccccagaugcgccucgucgaggacaaccccuccucccucucccucgucgagaucuacaagcagcgcugcgccaagaagggcaucgagcacgacaaccccaucucccgcuacuacgaccgccucgccaccguccaggcccgcggcacccaggccucccaccagguccuccgcgacauccucaaggagguccaguccaacauggucccccgcuccaugcucaaggagugggcccuccacaccuuccccaacgccaccgacuacuggaccuuccgcaagauguucaccauccagcucgcccucaucggcuucgccgaguucguccuccaccucaaccgccucaaccccgagaugcuccagaucgcccaggacaccggcaagcucaacgucgccuacuuccgcuucgacaucaacgacgccaccggcgaccucgacgccaaccgccccguccccuuccgccucacccccaacaucuccgaguuccucaccaccaucggcgucuccggcccccucaccgccuccaugaucgccgucgcccgcugcuucgcccagcccaacuucaaggucgacggcauccucaagaccguccuccgcgacgagaucaucgccuggcacaagaagacccaggaggacaccuccuccccccucuccgccgccggccagcccgagaacauggacucccagcagcucgucucccucguccagaaggccgucaccgccaucaugacccgccuccacaaccucgcccaguucgagggcggcgaguccaaggucaacacccucgucgccgccgccaacucccucgacaaccucugccgcauggaccccgccuggcaccccuggcucuga

SEQ ID NO: 51220 - RNA, 432 nt, Artificial Sequence
  derived and/or modified sequence opt2 from TSACC__Homo_sapiens__NP_001291755
augggcgagcgccccgccggccucgcccagggcaccacccccgucggcguccagauggagcgccacaccucccaccccaaccgcaagguccccgccaaggaggaggccaacgccgucccccucugccgcgccaagcccucccccuccuacaucaaccuccaggccuccuccccccccgccaccuuccucaacauccagaccaccaagcuccccuccgucgaccacaagcccaaggagugccucggccuccucgagugcauguacgccaaccuccagcuccagacccagcucgcccagcagcagauggccguccucgagcaccuccaggccuccgucacccagcucgcccccggccgcggcuccaacaacuccucccuccccgcccucucccccaacccccuccucaaccaccucccccaguucuccaaguga

SEQ ID NO: 51221 - RNA, 3342 nt, Artificial Sequence
  derived and/or modified sequence opt2 from TSC1__Homo_sapiens__NP_001155899
auggcccagcaggccaacgucggcgagcuccucgccaugcucgacucccccaugcucggcguccgcgacgacgucaccgccgucuucaaggagaaccucaacuccgaccgcggccccaugcucgucaacacccucgucgacuacuaccucgagaccuccucccagcccgcccuccacauccucaccacccuccaggagccccacgacaagauggacaccgacgucgucguccucaccaccggcguccucguccucaucaccaugcuccccaugaucccccaguccggcaagcagcaccuccucgacuucuucgacaucuucggccgccucuccuccuggugccucaagaagcccggccacgucgccgaggucuaccucguccaccuccacgccuccgucuacgcccucuuccaccgccucuacggcauguaccccugcaacuucgucuccuuccuccgcucccacuacuccaugaaggagaaccucgagaccuucgaggaggucgucaagcccaugauggagcacguccgcauccaccccgagcucgucaccggcuccaaggaccacgagcucgacccccgccgcuggaagcgccucgagacccacgacgucgucaucgagugcgccaagaucucccucgaccccaccgaggccuccuacgaggacggcuacuccgucucccaccagaucuccgcccgcuucccccaccgcuccgccgacgucaccaccucccccuacgccgacacccagaacuccuacggcugcgccaccuccacccccuacuccaccucccgccucaugcuccucaacaugcccggccagcucccccagacccucuccucccccuccacccgccucaucaccgagcccccccaggccacccucuggucccccuccauggucugcggcaugaccaccccccccaccucccccggcaacgucccccccgaccucucccaccccuacuccaaggucuucggcaccaccgccggcggcaagggcaccccccucggcacccccgccaccucccccccccccgccccccucugccacuccgacgacuacguccacaucucccucccccaggccaccgucacccccccccgcaaggaggagcgcauggacuccgcccgccccugccuccaccgccagcaccaccuccucaacgaccgcggcuccgaggagccccccggcuccaagggcuccgucacccucuccgaccuccccggcuuccucggcgaccucgccuccgaggaggacuccaucgagaaggacaaggaggaggccgccaucucccgcgagcucuccgagaucaccaccgccgaggccgagcccgucgucccccgcggcggcuucgacucccccuucuaccgcgacucccuccccggcucccagcgcaagacccacuccgccgccuccuccucccagggcgccuccgucaaccccgagccccuccacuccucccucgacaagcucggccccgacacccccaagcaggccuucacccccaucgaccuccccugcggcuccgccgacgagucccccgccggcgaccgcgagugccagaccucccucgagaccuccaucuucacccccucccccugcaagauccccccccccacccgcgucggcuucggcuccggccagcccccccccuacgaccaccucuucgaggucgcccuccccaagaccgcccaccacuucgucauccgcaagaccgaggagcuccucaagaaggccaagggcaacaccgaggaggacggcguccccuccaccucccccauggagguccucgaccgccucauccagcagggcgccgacgcccacuccaaggagcucaacaagcucccccuccccuccaaguccgucgacuggacccacuucggcggcuccccccccuccgacgagauccgcacccuccgcgaccagcuccuccuccuccacaaccagcuccucuacgagcgcuucaagcgccagcagcacgcccuccgcaaccgccgccuccuccgcaaggucaucaaggccgccgcccucgaggagcacaacgccgccaugaaggaccagcucaagcuccaggagaaggacauccagauguggaaggucucccuccagaaggagcaggcccgcuacaaccagcuccaggagcagcgcgacaccauggucaccaagcuccacucccagauccgccagcuccagcacgaccgcgaggaguucuacaaccagucccaggagcuccagaccaagcucgaggacugccgcaacaugaucgccgagcuccgcaucgagcucaagaaggccaacaacaaggucugccacaccgagcuccuccucucccaggucucccagaagcucuccaacuccgaguccguccagcagcagauggaguuccucaaccgccagcuccucguccucggcgaggucaacgagcucuaccucgagcagcuccagaacaagcacuccgacaccaccaaggaggucgagaugaugaaggccgccuaccgcaaggagcucgagaagaaccgcucccacguccuccagcagacccagcgccucgacaccucccagaagcgcauccucgagcucgagucccaccucgccaagaaggaccaccuccuccucgagcagaagaaguaccucgaggacgucaagcuccaggcccgcggccagcuccaggccgccgagucccgcuacgaggcccagaagcgcaucacccaggucuucgagcucgagauccucgaccucuacggccgccucgagaaggacggccuccucaagaagcucgaggaggagaaggccgaggccgccgaggccgccgaggagcgccucgacugcugcaacgacggcugcuccgacuccauggucggccacaacgaggaggccuccggccacaacggcgagaccaagaccccccgccccuccuccgcccgcggcuccuccggcucccgcggcggcggcggcuccuccuccuccuccuccgagcucuccacccccgagaagcccccccaccagcgcgccggccccuucuccucccgcugggagaccaccaugggcgaggccuccgccuccauccccaccaccgucggcucccuccccuccuccaaguccuuccucggcaugaaggcccgcgagcucuuccgcaacaaguccgagucccagugcgacgaggacggcaugaccuccucccucuccgagucccucaagaccgagcucggcaaggaccucggcgucgaggccaagaucccccucaaccucgacggcccccaccccuccccccccacccccgacuccgucggccagcuccacaucauggacuacaacgagacccaccacgagcacuccuga

SEQ ID NO: 51222 - RNA, 1713 nt, Artificial Sequence
  derived and/or modified sequence opt2 from TSC22D1__Homo_sapiens__NP_001230728
augcaccagccccccgaguccaccgccgccgccgccgccgccgccgacaucuccgcccgcaagauggcccaccccgccauguucccccgccgcggcuccggcuccggcuccgccuccgcccucaacgccgccggcaccggcgucggcuccaacgccaccuccuccgaggacuuccccccccccucccuccuccagccccccccccccgccgccuccuccaccuccggcccccagcccccccccccccagucccucaaccuccucucccaggcccagcuccaggcccagccccucgcccccggcggcacccagaugaagaagaaguccggcuuccagaucaccuccgucacccccgcccagaucuccgccuccaucuccuccaacaacuccaucgccgaggacaccgaguccuacgacgaccucgacgagucccacaccgaggaccucuccuccuccgagauccucgacgucucccucucccgcgccaccgaccucggcgagcccgagcgcuccuccuccgaggagacccucaacaacuuccaggaggccgagacccccggcgccgucucccccaaccagccccaccucccccagccccaccucccccaccucccccagcagaacgucgucaucaacggcaacgcccacccccaccaccuccaccaccaccaccagauccaccacggccaccaccuccagcacggccaccaccaccccucccacgucgccgucgccuccgccuccaucaccggcggcccccccuccucccccgucucccgcaagcucuccaccaccggcuccuccgacuccaucacccccgucgcccccaccuccgccgucuccuccuccggcucccccgccuccgucaugaccaacaugcgcgcccccuccaccaccggcggcaucggcaucaacuccgucaccggcaccuccaccgucaacaacgucaacaucaccgccgucggcuccuucaaccccaacgucaccuccuccaugcucggcaacgucaacaucuccaccuccaacauccccuccgccgccggcgucuccgucggccccggcgucaccuccggcgucaacgucaacauccucuccggcaugggcaacggcaccaucuccuccuccgccgccgucuccuccguccccaacgccgccgccggcaugaccggcggcuccgucuccucccagcagcagcagcccaccgucaacaccucccgcuuccgcgucgucaagcucgacuccuccuccgagcccuucaagaagggccgcuggaccugcaccgaguucuacgagaaggagaacgccguccccgccaccgagggcguccucaucaacaaggucgucgagaccgucaagcagaaccccaucgaggucaccuccgagcgcgaguccaccuccggcuccuccgucuccuccuccgucuccacccucucccacuacaccgaguccgucggcuccggcgagaugggcgcccccaccgucgucguccagcagcagcagcagcagcagcagcagcagcagcagcagcccgcccuccagggcgucacccuccagcagauggacuucggcuccaccggcccccaguccauccccgccgucuccaucccccaguccaucucccagucccagaucucccagguccagcuccagucccaggagcucuccuaccucaccaugaaggucguccuccucaucgucuaccucugcauguga

SEQ ID NO: 51223 - RNA, 234 nt, Artificial Sequence
  derived and/or modified sequence opt2 from TSC22D3__Homo_sapiens__NP_001015881
auggaccucgucaagaaccaccucauguacgccguccgcgaggaggucgagauccucaaggagcagauccgcgagcucgucgagaagaacucccagcucgagcgcgagaacacccuccucaagacccucgccucccccgagcagcucgagaaguuccaguccugccucucccccgaggagcccgcccccgaguccccccagguccccgaggcccccggcggcuccgccgucuga

SEQ ID NO: 51224 - RNA, 1188 nt, Artificial Sequence
  derived and/or modified sequence opt2 from TSC22D4__Homo_sapiens__NP_001289972
auguccggcggcaagaagaaguccuccuuccagaucaccuccgucaccaccgacuacgagggccccggcucccccggcgccuccgacccccccaccccccagccccccaccggcccccccccccgccuccccaacggcgagcccucccccgaccccggcggcaagggcaccccccgcaacggcucccccccccccggcgcccccuccucccgcuuccgcgucgucaagcucccccacggccucggcgagcccuaccgccgcggccgcuggaccugcgucgacgucuacgagcgcgaccucgagccccacuccuucggcggccuccucgagggcauccgcggcgccuccggcggcgccggcggccgcucccucgacucccgccucgagcucgccucccucggccucggcgcccccaccccccccuccggccucucccagggccccaccuccuggcuccgccccccccccaccucccccggcccccaggcccgcuccuucaccggcggccucggccagcucgucguccccuccaaggccaaggccgagaagcccccccucuccgccuccuccccccagcagcgcccccccgagcccgagaccggcgaguccgccggcaccucccgcgccgccaccccccuccccucccuccgcgucgaggccgaggccggcggcuccggcgcccgcacccccccccucucccgccgcaaggccgucgacaugcgccuccgcauggagcucggcgcccccgaggagaugggccagguccccccccucgacucccgccccuccucccccgcccucuacuucacccacgacgccucccucguccacaagucccccgaccccuucggcgccgucgccgcccagaaguucucccucgcccacuccaugcucgccaucuccggccaccucgacuccgacgacgacuccggcuccggcucccucgucggcaucgacaacaagaucgagcaggccauggaccucgucaagucccaccucauguucgccguccgcgaggaggucgagguccucaaggagcagauccgcgagcucgccgagcgcaacgccgcccucgagcaggagaacggccuccuccgcgcccucgccucccccgagcagcucgcccagcuccccuccuccggcgucccccgccucggcccccccgcccccaacggccccuccgucuga

SEQ ID NO: 51225 - RNA, 5424 nt, Artificial Sequence
  derived and/or modified sequence opt2 from TSC2__Homo_sapiens__NP_000539
auggccaagcccaccuccaaggacuccggccucaaggagaaguucaagauccuccucggccucggcaccccccgccccaacccccgcuccgccgagggcaagcagaccgaguucaucaucaccgccgagauccuccgcgagcucuccauggagugcggccucaacaaccgcauccgcaugaucggccagaucugcgaggucgccaagaccaagaaguucgaggagcacgccgucgaggcccucuggaaggccgucgccgaccuccuccagcccgagcgcccccucgaggcccgccacgccguccucgcccuccucaaggccaucguccagggccagggcgagcgccucggcguccuccgcgcccucuucuucaaggucaucaaggacuaccccuccaacgaggaccuccacgagcgccucgaggucuucaaggcccucaccgacaacggccgccacaucaccuaccucgaggaggagcucgccgacuucguccuccaguggauggacgucggccucuccuccgaguuccuccucguccucgucaaccucgucaaguucaacuccugcuaccucgacgaguacaucgcccgcaugguccagaugaucugccuccucugcguccgcaccgccuccuccgucgacaucgaggucucccuccagguccucgacgccgucgucugcuacaacugccuccccgccgagucccucccccucuucaucgucacccucugccgcaccaucaacgucaaggagcucugcgagcccugcuggaagcucaugcgcaaccuccucggcacccaccucggccacuccgccaucuacaacaugugccaccucauggaggaccgcgccuacauggaggacgccccccuccuccgcggcgccgucuucuucgucggcauggcccucuggggcgcccaccgccucuacucccuccgcaacucccccaccuccguccuccccuccuucuaccaggccauggccugccccaacgaggucgucuccuacgagaucguccucuccaucacccgccucaucaagaaguaccgcaaggagcuccaggucgucgccugggacauccuccucaacaucaucgagcgccuccuccagcagcuccagacccucgacucccccgagcuccgcaccaucguccacgaccuccucaccaccgucgaggagcucugcgaccagaacgaguuccacggcucccaggagcgcuacuucgagcucgucgagcgcugcgccgaccagcgccccgaguccucccuccucaaccucaucuccuaccgcgcccaguccauccaccccgccaaggacggcuggauccagaaccuccaggcccucauggagcgcuucuuccgcuccgagucccgcggcgccguccgcaucaagguccucgacguccucuccuucguccuccucaucaaccgccaguucuacgaggaggagcucaucaacuccgucgucaucucccagcucucccacauccccgaggacaaggaccaccagguccgcaagcucgccacccagcuccucgucgaccucgccgagggcugccacacccaccacuucaacucccuccucgacaucaucgagaaggucauggcccgcucccucucccccccccccgagcucgaggagcgcgacgucgccgccuacuccgccucccucgaggacgucaagaccgccguccucggccuccucgucauccuccagaccaagcucuacacccuccccgccucccacgccacccgcgucuacgagaugcucgucucccacauccagcuccacuacaagcacuccuacacccuccccaucgccuccuccauccgccuccaggccuucgacuuccuccuccuccuccgcgccgacucccuccaccgccucggccuccccaacaaggacggcgucguccgcuucucccccuacugcgucugcgacuacauggagcccgagcgcggcuccgagaagaagaccuccggcccccucuccccccccaccggcccccccggccccgcccccgccggccccgccguccgccucggcuccguccccuacucccuccucuuccgcguccuccuccagugccucaagcaggaguccgacuggaagguccucaagcucguccucggccgccuccccgagucccuccgcuacaagguccucaucuucaccucccccugcuccgucgaccagcucugcuccgcccucugcuccaugcucuccggccccaagacccucgagcgccuccgcggcgcccccgagggcuucucccgcaccgaccuccaccucgccgucguccccguccucaccgcccucaucuccuaccacaacuaccucgacaagaccaagcagcgcgagauggucuacugccucgagcagggccucauccaccgcugcgccucccagugcgucgucgcccucuccaucugcuccgucgagaugcccgacaucaucaucaaggcccuccccguccucgucgucaagcucacccacaucuccgccaccgccuccauggccgucccccuccucgaguuccucuccacccucgcccgccucccccaccucuaccgcaacuucgccgccgagcaguacgccuccgucuucgccaucucccuccccuacaccaaccccuccaaguucaaccaguacaucgucugccucgcccaccacgucaucgccaugugguucauccgcugccgccuccccuuccgcaaggacuucguccccuucaucaccaagggccuccgcuccaacguccuccucuccuucgacgacacccccgagaaggacuccuuccgcgcccgcuccaccucccucaacgagcgccccaagucccuccgcaucgcccgcccccccaagcagggccucaacaacuccccccccgucaaggaguucaaggaguccuccgccgccgaggccuuccgcugccgcuccaucuccgucuccgagcacgucguccgcucccgcauccagaccucccucaccuccgccucccucggcuccgccgacgagaacuccgucgcccaggccgacgacucccucaagaaccuccaccucgagcucaccgagaccugccucgacaugauggcccgcuacgucuucuccaacuucaccgccguccccaagcgcucccccgucggcgaguuccuccucgccggcggccgcaccaagaccuggcucgucggcaacaagcucgucaccgucaccaccuccgucggcaccggcacccgcucccuccucggccucgacuccggcgagcuccaguccggccccgaguccuccuccucccccggcguccacguccgccagaccaaggaggcccccgccaagcucgagucccaggccggccagcaggucucccgcggcgcccgcgaccgcguccgcuccauguccggcggccacggccuccgcgucggcgcccucgacguccccgccucccaguuccucggcuccgccaccucccccggcccccgcaccgcccccgccgccaagcccgagaaggccuccgccggcacccgcguccccguccaggagaagaccaaccucgccgccuacgucccccuccucacccagggcugggccgagauccucguccgccgccccaccggcaacaccuccuggcucaugucccucgagaacccccucucccccuucuccuccgacaucaacaacaugccccuccaggagcucuccaacgcccucauggccgccgagcgcuucaaggagcaccgcgacaccgcccucuacaagucccucuccguccccgccgccuccaccgccaagccccccccccucccccgcuccaacaccgucgccuccuucuccucccucuaccaguccuccugccagggccagcuccaccgcuccgucuccugggccgacuccgccgucgucauggaggagggcucccccggcgagguccccguccucgucgagccccccggccucgaggacgucgaggccgcccucggcauggaccgccgcaccgacgccuacucccgcuccuccuccgucuccucccaggaggagaagucccuccacgccgaggagcucgucggccgcggcauccccaucgagcgcgucgucuccuccgagggcggccgccccuccgucgaccucuccuuccagcccucccagccccucuccaaguccuccuccucccccgagcuccagacccuccaggacauccucggcgaccccggcgacaaggccgacgucggccgccucucccccgaggucaaggcccgcucccaguccggcacccucgacggcgaguccgccgccugguccgccuccggcgaggacucccgcggccagcccgagggcccccuccccuccuccuccccccgcucccccuccggccuccgcccccgcggcuacaccaucuccgacuccgcccccucccgccgcggcaagcgcgucgagcgcgacgcccucaagucccgcgccaccgccuccaacgccgagaagguccccggcaucaaccccuccuucgucuuccuccagcucuaccacucccccuucuucggcgacgaguccaacaagcccauccuccuccccaacgagucccaguccuucgagcgcuccguccagcuccucgaccagauccccuccuacgacacccacaagaucgccguccucuacgucggcgagggccaguccaacuccgagcucgccauccucuccaacgagcacggcuccuaccgcuacaccgaguuccucaccggccucggccgccucaucgagcucaaggacugccagcccgacaaggucuaccucggcggccucgacgucugcggcgaggacggccaguucaccuacugcuggcacgacgacaucaugcaggccgucuuccacaucgccacccucaugcccaccaaggacgucgacaagcaccgcugcgacaagaagcgccaccucggcaacgacuucgucuccaucgucuacaacgacuccggcgaggacuucaagcucggcaccaucaagggccaguucaacuucguccacgucaucgucaccccccucgacuacgagugcaaccucgucucccuccagugccgcaaggacauggagggccucgucgacaccuccgucgccaagaucgucuccgaccgcaaccuccccuucgucgcccgccagauggcccuccacgccaacauggccucccagguccaccacucccgcuccaaccccaccgacaucuaccccuccaaguggaucgcccgccuccgccacaucaagcgccuccgccagcgcaucugcgaggaggccgccuacuccaaccccucccucccccucguccacccccccucccacuccaaggcccccgcccagacccccgccgagcccacccccggcuacgaggucggccagcgcaagcgccucaucuccuccgucgaggacuucaccgaguucgucuga

SEQ ID NO: 51226 - RNA, 1320 nt, Artificial Sequence
  derived and/or modified sequence opt2 from TSEN2__Homo_sapiens__NP_001138865
auggccgaggccgucuuccacgcccccaagcgcaagcgccgcgucuacgagaccuacgaguccccccuccccauccccuucggccaggaccacggcccccucaaggaguucaagaucuuccgcgccgagaugaucaacaacaacgucaucguccgcaacgccgaggacaucgagcagcucuacggcaagggcuacuucggcaagggcauccucucccgcucccgccccuccuucaccaucuccgaccccaagcucgucgccaaguggaaggacaugaagaccaacaugcccaucaucaccuccaagcgcuaccagcacuccgucgagugggccgccgagcucaugcgccgccagggccaggacgaguccaccguccgccgcauccucaaggacuacaccaagccccucgagcacccccccgucaagcgcaacgaggaggcccagguccacgacaagcucaacuccggcauggucuccaacauggagggcaccgccggcggcgagcgccccuccgucgucaacggcgacuccggcaaguccggcggcgucggcgacccccgcgagccccucggcugccuccaggagggcuccggcugccaccccaccaccgaguccuucgagaaguccguccgcgaggacgccuccccccucccccacgucugcugcugcaagcaggacgcccucauccuccagcgcggccuccaccacgaggacggcucccagcacaucggccuccuccaccccggcgaccgcggccccgaccacgaguacguccucgucgaggaggccgagugcgccauguccgagcgcgaggccgcccccaacgaggaggccuucuuccucgucuacgcccucggcugccucuccaucuacuacgagaaggagccccucaccaucgucaagcucuggaaggccuucaccgucguccagcccaccuuccgcaccaccuacauggccuaccacuacuuccgcuccaagggcuggguccccaaggucggccucaaguacggcaccgaccuccuccucuaccgcaagggcccccccuucuaccacgccuccuacuccgucaucaucgagcucgucgacgaccacuucgagggcucccuccgccgcccccucuccuggaagucccucgccgcccucucccgcgucuccgucaacgucuccaaggagcucaugcucugcuaccucaucaagcccuccaccaugaccgacaaggagauggagucccccgagugcaugaagcgcaucaagguccaggaggucauccucucccgcugggucuccucccgcgagcgcuccgaccaggacgaccucuga

SEQ ID NO: 51227 - RNA, 933 nt, Artificial Sequence
  derived and/or modified sequence opt2 from TSEN34__Homo_sapiens__NP_001269261
augcucgucgucgaggucgccaacggccgcucccucgucuggggcgccgaggccguccaggcccuccgcgagcgccucggcgucggcggccgcaccgucggcgcccucccccgcggcccccgccagaacucccgccucggccucccccuccuccucaugcccgaggaggcccgccuccucgccgagaucggcgccgucacccucgucuccgccccccgccccgacucccgccaccacucccucgcccucaccuccuucaagcgccagcaggaggaguccuuccaggagcaguccgcccucgccgccgaggcccgcgagacccgccgccaggagcuccucgagaagaucaccgagggccaggccgccaagaagcagaagcucgagcaggccuccggcgccuccuccucccaggaggccggcuccucccaggccgccaaggaggacgagaccuccgacggccaggccuccggcgagcaggaggaggccggccccuccuccucccaggccggccccuccaacggcgucgccccccucccccgcuccgcccuccucguccagcucgccaccgcccgcccccgccccgucaaggcccgcccccucgacuggcgcguccaguccaaggacuggccccacgccggccgccccgcccacgagcuccgcuacuccaucuaccgcgaccucugggagcgcggcuucuuccucuccgccgccggcaaguucggcggcgacuuccucgucuaccccggcgacccccuccgcuuccacgcccacuacaucgcccagugcugggcccccgaggacaccaucccccuccaggaccucgucgccgccggccgccucggcaccuccguccgcaagacccuccuccucugcuccccccagcccgacggcaaggucgucuacaccucccuccagugggccucccuccaguga

SEQ ID NO: 51228 - RNA, 1581 nt, Artificial Sequence
  derived and/or modified sequence opt2 from TSEN54__Homo_sapiens__NP_997229
auggagcccgagcccgagcccgccgccgucgagguccccgccggccgcguccucuccgcccgcgagcucuucgccgcccgcucccgcucccagaagcucccccagcgcucccacggccccaaggacuuccuccccgacggcuccgccgcccaggccgagcgccuccgccgcugccgcgaggagcucuggcagcuccucgccgagcagcgcgucgagcgccucggcucccucgucgccgccgaguggcgccccgaggagggcuucgucgagcucaagucccccgccggcaaguucuggcagaccaugggcuucuccgagcagggccgccagcgccuccaccccgaggaggcccucuaccuccucgagugcggcuccauccaccucuuccaccaggaccucccccucuccauccaggaggccuaccagcuccuccucaccgaccacaccgucaccuuccuccaguaccaggucuucucccaccucaagcgccucggcuacgucguccgccgcuuccagcccuccuccguccucucccccuacgagcgccagcucaaccucgacgccuccguccagcaccucgaggacggcgacggcaagcgcaagcgcuccuccuccuccccccgcuccaucaacaagaaggccaaggcccucgacaacucccuccagcccaagucccucgccgccuccucccccccccccugcucccagcccucccagugccccgaggagaagccccaggaguccucccccaugaagggccccggcggccccuuccagcuccucggcucccucggccccucccccggccccgcccgcgagggcgucggcugcuccugggaguccggccgcgccgagaacggcgucaccggcgccggcaagcgccgcuggaacuucgagcagaucuccuuccccaacauggccuccgacucccgccacacccuccuccgcgcccccgcccccgagcuccuccccgccaacgucgccggccgcgagaccgacgccgaguccuggugccagaagcucaaccagcgcaaggagaagcucucccgccgcgagcgcgagcaccacgccgaggccgcccaguuccaggaggacgucaacgccgaccccgagguccagcgcugcuccuccuggcgcgaguacaaggagcuccuccagcgccgccagguccagcgcucccagcgccgcgccccccaccucuggggccagcccgucaccccccuccucucccccggccaggccuccucccccgccgucguccuccagcacaucuccguccuccagaccacccaccuccccgacggcggcgcccgccuccucgagaaguccggcggccucgagaucaucuucgacgucuaccaggccgacgccgucgccaccuuccgcaagaacaaccccggcaagcccuacgcccgcaugugcaucuccggcuucgacgagcccguccccgaccucugcucccucaagcgccucuccuaccaguccggcgacgucccccucaucuucgcccucgucgaccacggcgacaucuccuucuacuccuuccgcgacuucacccucccccaggacgucggccacuga

SEQ ID NO: 51229 - RNA, 504 nt, Artificial Sequence
  derived and/or modified sequence opt2 from TSFM__Homo_sapiens__NP_001166166
augucccuccuccgcucccuccgcgucuuccucgucgcccgcaccggcuccuaccccgccggcucccuccuccgccaguccccccagccccgccacaccuucuacgccggcccccgccucuccgccuccgccuccuccaaggagcuccucaugaagcuccgccgcaagaccggcuacuccuucgucaacugcaagaaggcccucgagaccugcggcggcgaccucaagcaggccgagaucuggcuccacaaggaggcccagaaggagggcugguccaaggccgccaagcuccagggccgcaagaccaaggagggccucaucggccuccuccaggagggcaacaccaccguccucgucgaggucaacugcgagaccgacuucgucucccgcaaccucaaguuccagcuccucguccagcaggucgcccucggcaccaugaugcacugccagacccucaaggaccagcccuccgccuacuccaaggagaacugggagaagaccuga

SEQ ID NO: 51230 - RNA, 1173 nt, Artificial Sequence
  derived and/or modified sequence opt2 from TSG101__Homo_sapiens__NP_006283
auggccgucuccgagucccagcucaagaagauggucuccaaguacaaguaccgcgaccucaccguccgcgagaccgucaacgucaucacccucuacaaggaccucaagcccguccucgacuccuacgucuucaacgacggcuccucccgcgagcucaugaaccucaccggcaccauccccguccccuaccgcggcaacaccuacaacauccccaucugccucuggcuccucgacaccuaccccuacaacccccccaucugcuucgucaagcccaccuccuccaugaccaucaagaccggcaagcacgucgacgccaacggcaagaucuaccuccccuaccuccacgaguggaagcacccccaguccgaccuccucggccucauccaggucaugaucgucgucuucggcgacgagccccccgucuucucccgccccaucuccgccuccuacccccccuaccaggccaccggcccccccaacaccuccuacaugcccggcaugcccggcggcaucucccccuaccccuccggcuacccccccaaccccuccggcuaccccggcugccccuacccccccggcggccccuaccccgccaccaccuccucccaguaccccucccagccccccgucaccaccgucggccccucccgcgacggcaccaucuccgaggacaccauccgcgccucccucaucuccgccgucuccgacaagcuccgcuggcgcaugaaggaggagauggaccgcgcccaggccgagcucaacgcccucaagcgcaccgaggaggaccucaagaagggccaccagaagcucgaggagauggucacccgccucgaccaggaggucgccgaggucgacaagaacaucgagcuccucaagaagaaggacgaggagcucuccuccgcccucgagaagauggagaaccaguccgagaacaacgacaucgacgaggucaucauccccaccgccccccucuacaagcagauccucaaccucuacgccgaggagaacgccaucgaggacaccaucuucuaccucggcgaggcccuccgccgcggcgucaucgaccucgacgucuuccucaagcacguccgccuccucucccgcaagcaguuccagcuccgcgcccucaugcagaaggcccgcaagaccgccggccucuccgaccucuacuga

SEQ ID NO: 51231 - RNA, 2097 nt, Artificial Sequence
  derived and/or modified sequence opt2 from TSGA10__Homo_sapiens__NP_878915
augaugcgcucccgcuccaaguccccccgccgccccucccccaccgcccgcggcgccaacugcgacgucgagcuccucaagaccaccacccgcgaccgcgaggagcucaagugcaugcucgagaaguacgagcgccaccucgccgagauccagggcaacgucaagguccucaaguccgagcgcgacaagaucuuccuccucuacgagcaggcccaggaggagaucacccgccuccgccgcgagaugaugaaguccugcaagucccccaaguccaccaccgcccacgccauccuccgccgcgucgagaccgagcgcgacgucgccuucaccgaccuccgccgcaugaccaccgagcgcgacucccuccgcgagcgccucaagaucgcccaggagaccgccuucaacgagaaggcccaccucgagcagcgcaucgaggagcucgagugcaccguccacaaccucgacgacgagcgcauggagcagauguccaacaugacccucaugaaggagaccaucuccaccgucgagaaggagaugaagucccucgcccgcaaggccauggacaccgaguccgagcucggccgccagaaggccgagaacaacucccuccgccuccucuacgagaacaccgagaaggaccucuccgacacccagcgccaccucgccaagaagaaguacgagcuccagcucacccaggagaagaucaugugccucgacgagaagaucgacaacuucacccgccagaacaucgcccagcgcgaggagaucuccauccucggcggcacccucaacgaccucgccaaggagaaggagugccuccaggccugccucgacaagaaguccgagaacaucgccucccucggcgagucccucgccaugaaggagaagaccaucuccggcaugaagaacaucaucgccgagauggagcaggccucccgccagugcaccgaggcccucaucgucugcgagcaggacgucucccgcaugcgccgccagcucgacgagaccaacgacgagcucgcccagaucgcccgcgagcgcgacauccucgcccacgacaacgacaaccuccaggagcaguucgccaaggccaagcaggagaaccaggcccucuccaagaagcucaacgacacccacaacgagcucaacgacaucaagcagaagguccaggacaccaaccucgaggucaacaagcucaagaacauccucaaguccgaggaguccgagaaccgccagaugauggagcagcuccgcaaggccaacgaggacgccgagaacugggagaacaaggcccgccaguccgaggccgacaacaacacccucaagcucgagcucaucaccgccgaggccgagggcaaccgccucaaggagaaggucgacucccucaaccgcgaggucgagcagcaccucaacgccgagcgcuccuacaagucccagaucuccacccuccacaaguccgucgucaagauggaggaggagcuccagaagguccaguucgagaaggucuccgcccucgccgaccucuccuccacccgcgagcucugcaucaagcucgacuccuccaaggagcuccucaaccgccagcucgucgccaaggaccaggagaucgagaugcgcgagaacgagcucgacuccgcccacuccgagaucgagcuccuccgcucccagauggccaacgagcgcaucuccaugcagaaccucgaggcccuccucgucgccaaccgcgacaaggaguaccagucccagaucgcccuccaggagaaggaguccgagauccagcuccucaaggagcaccucugccucgccgagaacaagauggccauccagucccgcgacgucgcccaguuccgcaacgucgucacccagcucgaggccgaccucgacaucaccaagcgccagcucggcaccgagcgcuucgagcgcgagcgcgccguccaggagcuccgccgccagaacuacuccuccaacgccuaccacauguccuccaccaugaagcccaacaccaagugccacucccccgagcgcgcccaccaccgcucccccgaccgcggccucgaccgcucccucgaggagaaccucugcuaccgcgacuucuga

SEQ ID NO: 51232 - RNA, 2295 nt, Artificial Sequence
  derived and/or modified sequence opt2 from TSHR__Homo_sapiens__XP_005268094
augcgccccgccgaccuccuccagcucguccuccuccucgaccucccccgcgaccucggcggcaugggcugcuccuccccccccugcgagugccaccaggaggaggacuuccgcgucaccugcaaggacauccagcgcauccccucccucccccccuccacccagacccucaagcucaucgagacccaccuccgcaccauccccucccacgccuucuccaaccuccccaacaucucccgcaucuacgucuccaucgacgucacccuccagcagcucgagucccacuccuucuacaaccucuccaaggucacccacaucgagauccgcaacacccgcaaccucaccuacaucgaccccgacgcccucaaggagcucccccuccucaaguuccucggcaucuucaacaccggccucaagauguuccccgaccucaccaaggucuacuccaccgacaucuucuucauccucgagaucaccgacaaccccuacaugaccuccauccccgucaacgccuuccagggccucugcaacgagacccucacccucaagcucuacaacaacggcuucaccuccguccagggcuacgccuucaacggcaccaagcucgacgccgucuaccucaacaagaacaaguaccucaccgucaucgacaaggacgccuucggcggcgucuacuccggccccucccuccucgacgucucccagaccuccgucaccgcccuccccuccaagggccucgagcaccucaaggagcucaucgcccgcaacaccuggacccucaagaagcucccccucucccucuccuuccuccaccucacccgcgccgaccucuccuaccccucccacugcugcgccuucaagaaccagaagaagauccgcggcauccucgagucccucaugugcaacgaguccuccaugcagucccuccgccagcgcaaguccgucaacgcccucaacuccccccuccaccaggaguacgaggagaaccucggcgacuccaucgucggcuacaaggagaaguccaaguuccaggacacccacaacaacgcccacuacuacgucuucuucgaggagcaggaggacgagaucaucggcuucggccaggagcucaagaacccccaggaggagacccuccaggccuucgacucccacuacgacuacaccaucugcggcgacuccgaggacauggucugcacccccaaguccgacgaguucaaccccugcgaggacaucaugggcuacaaguuccuccgcaucgucgucugguucgucucccuccucgcccuccucggcaacgucuucguccuccucauccuccucaccucccacuacaagcucaacgucccccgcuuccucaugugcaaccucgccuucgccgacuucugcaugggcauguaccuccuccucaucgccuccgucgaccucuacacccacuccgaguacuacaaccacgccaucgacuggcagaccggccccggcugcaacaccgccggcuucuucaccgucuucgccuccgagcucuccgucuacacccucaccgucaucacccucgagcgcugguacgccaucaccuucgccaugcgccucgaccgcaagauccgccuccgccacgccugcgccaucauggucggcggcugggucugcugcuuccuccucgcccuccucccccucgucggcaucuccuccuacgccaaggucuccaucugccuccccauggacaccgagaccccccucgcccucgccuacaucgucuucguccucacccucaacaucgucgccuucgucaucgucugcugcugcuacgucaagaucuacaucaccguccgcaacccccaguacaaccccggcgacaaggacaccaagaucgccaagcgcauggccguccucaucuucaccgacuucaucugcauggcccccaucuccuucuacgcccucuccgccauccucaacaagccccucaucaccgucuccaacuccaagauccuccucguccucuucuacccccucaacuccugcgccaaccccuuccucuacgccaucuucaccaaggccuuccagcgcgacgucuucauccuccucuccaaguucggcaucugcaagcgccaggcccaggccuaccgcggccagcgcgucccccccaagaacuccaccgacauccagguccagaaggucacccacgagaugcgccagggccuccacaacauggaggacgucuacgagcucaucgagaacucccaccucacccccaagaagcagggccagaucuccgaggaguacaugcagaccguccucuga

SEQ ID NO: 51233 - RNA, 3099 nt, Artificial Sequence
  derived and/or modified sequence opt2 from TSHZ1__Homo_sapiens__NP_005777
augugcaacgaggagaccgagaucaaggaggcccaguccuaccagaacucccccgucuccuccgccaccaaccaggacgccggcuacggcucccccuucuccgaguccuccgaccagcucgcccacuucaagggcuccuccucccgcgaggagaaggaggacccccagugccccgacuccgucuccuacccccaggacucccucgcccagaucaaggccgucuacgccaaccucuucuccgaguccugcugguccucccucgcccucgaccucaagaaguccggcuccaccaccuccaccaacgacgccucccagaaggaguccuccgcccccacccccaccccccccaccugccccgucuccaccaccggccccaccaccuccacccccuccaccuccugcuccuccuccaccucccacuccuccaccaccuccaccuccuccuccuccggcuacgacuggcaccaggccgcccucgccaagacccuccagcagaccuccuccuacggccuccuccccgagcccucccucuucuccaccguccagcucuaccgccagaacaacaagcucuacggcuccgucuucaccggcgccuccaaguuccgcugcaaggacugcuccgccgccuacgacacccucgucgagcucaccguccacaugaacgagaccggccacuaccgcgacgacaaccgcgacaaggacuccgagaagaccaagcgcugguccaagccccgcaagcgcucccucauggagauggagggcaaggaggacgcccagaagguccucaagugcauguacugcggccacuccuucgagucccuccaggaccucuccguccacaugaucaagaccaagcacuaccagaaggucccccucaaggagcccguccccgccaucaccaagcucguccccuccaccaagaagcgcgcccuccaggaccucgccccccccugcucccccgagcccgccggcauggccgccgaggucgcccucuccgaguccgccaaggaccagaaggccgccaaccccuacgucacccccaacaaccgcuacggcuaccagaacggcgccuccuacaccuggcaguucgaggcccgcaaggcccagauccucaagugcauggagugcggcuccucccacgacacccuccagcagcucaccgcccacaugauggucaccggccacuuccucaaggucaccaccuccgccuccaagaagggcaagcagcucguccucgaccccgucgucgaggagaagauccaguccaucccccucccccccaccacccacacccgccuccccgccuccuccaucaagaagcagcccgacucccccgccggcuccaccaccuccgaggagaagaaggagcccgagaaggagaagccccccgucgccggcgacgccgagaagaucaaggaggaguccgaggacucccucgagaaguucgagcccuccacccucuaccccuaccuccgcgaggaggaccucgacgacucccccaagggcggccucgacauccucaagucccucgagaacaccgucuccaccgccaucuccaaggcccagaacggcgcccccuccuggggcggcuaccccuccauccacgccgccuaccagcuccccggcaccgucaagccccuccccgccgccguccaguccguccagguccagcccuccuacgccggcggcgucaagucccucuccuccgccgagcacaacgcccuccuccacucccccggcucccucaccccccccccccacaaguccaacgucuccgccauggaggagcucgucgagaaggucaccggcaaggucaacaucaagaaggaggagcgcccccccgagaaggagaaguccucccucgccaaggccgccucccccaucgccaaggagaacaaggacuuccccaagaccgaggaggucuccggcaagccccagaagaagggccccgaggccgagaccggcaaggccaagaaggagggcccccucgacguccacacccccaacggcaccgagccccucaaggccaaggucaccaacggcugcaacaaccucggcaucaucauggaccacucccccgagcccuccuucaucaacccccucuccgcccuccaguccaucaugaacacccaccucggcaaggucuccaagcccgucucccccucccucgacccccucgccaugcucuacaagaucuccaacuccaugcucgacaagcccgucuaccccgccacccccgucaagcaggccgacgccaucgaccgcuacuacuacgagaacuccgaccagcccaucgaccucaccaaguccaagaacaagccccucgucuccuccgucgccgacuccgucgccuccccccuccgcgaguccgcccucauggacaucuccgacauggucaagaaccucaccggccgccucacccccaaguccuccacccccuccaccgucuccgagaaguccgacgccgacggcuccuccuucgaggaggcccucgacgagcucucccccguccacaagcgcaagggccgccaguccaacuggaacccccagcaccuccucauccuccaggcccaguucgccuccucccuccgcgagaccaccgagggcaaguacaucauguccgaccucggcccccaggagcgcguccacaucuccaaguucaccggccucuccaugaccaccaucucccacuggcucgccaacgucaaguaccagcuccgccgcaccggcggcaccaaguuccucaagaaccucgacaccggccaccccgucuucuucugcaacgacugcgccucccaguuccgcaccgccuccaccuacaucucccaccucgagacccaccucggcuucucccucaaggaccucuccaagcucccccucaaccagauccaggagcagcagaacgucuccaagguccucaccaacaagacccucggcccccucggcgccaccgaggaggaccucggcuccaccuuccagugcaagcucugcaaccgcaccuucgccuccaagcacgccgucaagcuccaccucuccaagacccacggcaagucccccgaggaccaccucaucuacgucaccgagcucgagaagcaguga

SEQ ID NO: 51234 - RNA, 3096 nt, Artificial Sequence
  derived and/or modified sequence opt2 from TSHZ2__Homo_sapiens__NP_001180350
augauggccgccgcccuccuccacuacaccggcuacgcccaggaggagcagcucaaggaggaggaggagaucaaggaggaggaggaggaggaggacuccggcuccgucgcccagcuccagggcggcaacgacaccggcaccgacgaggagcucgagaccggccccgagcagaagggcugcuucuccuaccagaacucccccggcucccaccucuccaaccaggacgccgagaacgagucccuccucuccgacgccuccgaccaggucuccgacaucaaguccgucugcggccgcgacgccuccgacaagaaggcccacacccacguccgccuccccaacgaggcccacaacugcauggacaagaugaccgccgucuacgccaacauccucuccgacuccuacugguccggccucggccucggcuucaagcucuccaacuccgagcgccgcaacugcgacacccgcaacggcuccaacaaguccgacuucgacuggcaccaggacgcccucuccaagucccuccagcagaaccuccccucccgcuccgucuccaagcccucccucuucuccuccguccagcucuaccgccaguccuccaagaugugcggcaccgucuucaccggcgccucccgcuuccgcugccgccagugcuccgccgccuacgacacccucgucgagcucaccguccacaugaacgagaccggccacuaccaggacgacaaccgcaagaaggacaagcuccgccccaccuccuacuccaagccccgcaagcgcgccuuccaggacauggacaaggaggacgcccagaagguccucaagugcauguucugcggcgacuccuucgacucccuccaggaccucuccguccacaugaucaagaccaagcacuaccagaaggucccccucaaggagcccguccccaccaucuccuccaagauggucacccccgccaagaagcgcgucuucgacgucaaccgccccugcucccccgacuccaccaccggcuccuucgccgacuccuucuccucccagaagaacgccaaccuccagcucuccuccaacaaccgcuacggcuaccagaacggcgccuccuacaccuggcaguucgaggccugcaagucccagauccucaagugcauggagugcggcuccucccacgacacccuccagcagcucaccacccacaugauggucaccggccacuuccucaaggucaccuccuccgccuccaagaagggcaagcagcucguccucgacccccucgccgucgagaagaugcagucccucuccgaggcccccaacuccgacucccucgcccccaagcccuccuccaacuccgccuccgacugcaccgccuccaccaccgagcucaagaaggaguccaagaaggagcgccccgaggagaccuccaaggacgagaaggucgucaaguccgaggacuacgaggacccccuccagaagccccucgaccccaccaucaaguaccaguaccuccgcgaggaggaccucgaggacggcuccaagggcggcggcgacauccucaagucccucgagaacaccgucaccaccgccaucaacaaggcccagaacggcgcccccuccugguccgccuaccccuccauccacgccgccuaccagcucuccgagggcaccaagcccccccuccccaugggcucccagguccuccagauccgccccaaccucaccaacaagcuccgccccaucgcccccaaguggaaggucaugccccucgucuccaugcccacccaccucgcccccuacacccaggucaagaaggaguccgaggacaaggacgaggccgucaaggagugcggcaaggaguccccccacgaggaggccuccuccuucucccacuccgagggcgacuccuuccgcaaguccgagaccccccccgaggccaagaagaccgagcucggcccccucaaggaggaggagaagcucaugaaggagggcuccgagaaggagaagccccagccccucgagcccaccuccgcccucuccaacggcugcgcccucgccaaccacgcccccgcccuccccugcaucaacccccucuccgcccuccaguccguccucaacaaccaccucggcaaggccaccgagccccuccgcucccccuccugcuccucccccuccuccuccaccaucuccauguuccacaaguccaaccucaacgucauggacaagcccguccucucccccgccuccacccgcuccgccuccgucucccgccgcuaccucuucgagaacuccgaccagcccaucgaccucaccaaguccaaguccaagaaggccgaguccucccaggcccaguccugcaugucccccccccagaagcacgcccucuccgacaucgccgacauggucaagguccuccccaaggccaccacccccaagcccgccuccuccucccgcgucccccccaugaagcucgagauggacguccgccgcuucgaggacgucuccuccgaggucuccacccuccacaagcgcaagggccgccaguccaacuggaacccccagcaccuccucauccuccaggcccaguucgccuccucccucuuccagaccuccgagggcaaguaccuccucuccgaccucggcccccaggagcgcaugcagaucuccaaguucaccggccucuccaugaccaccaucucccacuggcucgccaacgucaaguaccagcuccgcaagaccggcggcaccaaguuccucaagaacauggacaagggccaccccaucuucuacugcuccgacugcgccucccaguuccgcacccccuccaccuacaucucccaccucgagucccaccucggcuuccagaugaaggacaugacccgccucuccgucgaccagcaguccaaggucgagcaggagaucucccgcgucuccuccgcccagcgcucccccgagaccaucgccgccgaggaggacaccgacuccaaguucaagugcaagcucugcugccgcaccuucgucuccaagcacgccgucaagcuccaccucuccaagacccacuccaagucccccgagcaccacucccaguucgucaccgacgucgacgaggaguga

SEQ ID NO: 51235 - RNA, 3246 nt, Artificial Sequence
  derived and/or modified sequence opt2 from TSHZ3__Homo_sapiens__NP_065907
augccccgccgcaagcagcaggccccccgccgcgccgccgccuacgucuccgaggagcucaaggccgccgcccucgucgacgagggccucgaccccgaggagcacaccgccgacggcgagcccuccgccaaguacaugugccccgagaaggagcucgcccgcgccugccccuccuaccagaacucccccgccgccgaguucuccugccacgagauggacuccgagucccacaucuccgagaccuccgaccgcauggccgacuucgaguccggcuccaucaagaacgaggaggagaccaaggaggucaccgucccccucgaggacaccaccgucuccgacucccucgagcagaugaaggccgucuacaacaacuuccucuccaacuccuacugguccaaccucaaccucaaccuccaccagcccuccuccgagaagaacaacggcuccuccuccuccuccuccuccuccuccuccuccugcggcuccggcuccuucgacuggcaccaguccgccauggccaagacccuccagcaggucucccagucccgcaugcuccccgagcccucccucuucuccaccguccagcucuaccgccaguccuccaagcucuacggcuccaucuucaccggcgccuccaaguuccgcugcaaggacugcuccgccgccuacgacacccucgucgagcucaccguccacaugaacgagaccggccacuaccgcgacgacaaccacgagaccgacaacaacaaccccaagcgcugguccaagccccgcaagcgcucccuccucgagauggagggcaaggaggacgcccagaagguccucaagugcauguacugcggccacuccuucgagucccuccaggaccucuccguccacaugaucaagaccaagcacuaccagaaggucccccucaaggagcccgucacccccgucgccgccaagaucauccccgccacccgcaagaaggccucccucgagcucgagcuccccuccucccccgacuccaccggcggcacccccaaggccaccaucuccgacaccaacgacgcccuccagaagaacuccaaccccuacaucacccccaacaaccgcuacggccaccagaacggcgccuccuacgccuggcacuucgaggcccgcaagucccagauccucaagugcauggagugcggcuccucccacgacacccuccaggagcucaccgcccacaugauggucaccggccacuucaucaaggucaccaacuccgccaugaagaagggcaagcccaucgucgagacccccgucacccccaccaucaccacccuccucgacgagaagguccaguccgucccccucgccgccaccaccuucaccucccccuccaacacccccgccuccaucucccccaagcucaacgucgaggucaagaaggaggucgacaaggagaaggccgucaccgacgagaagcccaagcagaaggacaagcccggcgaggaggaggagaagugcgacaucuccuccaaguaccacuaccucaccgagaacgaccucgaggagucccccaagggcggccucgacauccucaagucccucgagaacaccgucaccuccgccaucaacaaggcccagaacggcacccccuccuggggcggcuaccccuccauccacgccgccuaccagcuccccaacaugaugaagcucucccucggcuccuccggcaaguccaccccccucaagcccauguucggcaacuccgagaucgucucccccaccaagaaccagacccucgucuccccccccuccucccagaccucccccaugcccaagaccaacuuccacgccauggaggagcucgucaagaaggucaccgagaaggucgccaaggucgaggagaagaugaaggagcccgacggcaagcucuccccccccaagcgcgccacccccucccccugcuccuccgaggucggcgagcccaucaagauggaggccuccuccgacggcggcuuccgcucccaggagaacucccccucccccccccgcgacggcugcaaggacggcuccccccucgccgagcccgucgagaacggcaaggagcucgucaagccccucgccuccucccucuccggcuccaccgccaucaucaccgaccacccccccgagcagcccuucgucaacccccucuccgcccuccaguccgucaugaacauccaccucggcaaggccgccaagcccucccuccccgcccucgaccccauguccaugcucuucaagauguccaacucccucgccgagaaggccgccgucgccaccccccccccccuccaguccaagaaggccgaccaccucgaccgcuacuucuaccacgucaacaacgaccagcccaucgaccucaccaagggcaaguccgacaagggcugcucccucggcuccguccuccucucccccaccuccaccgcccccgccaccuccuccuccaccgucaccaccgccaagaccuccgccgucgucuccuucauguccaacuccccccuccgcgagaacgcccucuccgacaucuccgacaugcucaagaaccucaccgagucccacaccuccaaguccuccacccccuccuccaucuccgagaaguccgacaucgacggcgccacccucgaggaggccgaggaguccacccccgcccagaagcgcaagggccgccaguccaacuggaacccccagcaccuccucauccuccaggcccaguucgccgccucccuccgccagaccuccgagggcaaguacaucauguccgaccucuccccccaggagcgcaugcacaucucccgcuucaccggccucuccaugaccaccaucucccacuggcucgccaacgucaaguaccagcuccgccgcaccggcggcaccaaguuccucaagaaccucgacaccggccaccccgucuucuucugcaacgacugcgccucccagauccgcacccccuccaccuacaucucccaccucgagucccaccucggcuuccgccuccgcgaccucuccaagcucuccaccgagcagaucaacucccagaucgcccagaccaagucccccuccgagaagauggucaccuccucccccgaggaggaccucggcaccuccuaccagugcaagcucugcaaccgcaccuucgccuccaagcacgccgucaagcuccaccucuccaagacccacggcaagucccccgaggaccaccuccucuacgucuccgagcucgagaagcaguga

SEQ ID NO: 51236 - RNA, 480 nt, Artificial Sequence
  derived and/or modified sequence opt2 from TSLP__Homo_sapiens__NP_149024
auguuccccuucgcccuccucuacguccucuccgucuccuuccgcaagaucuucauccuccagcucgucggccucguccucaccuacgacuucaccaacugcgacuucgagaagaucaaggccgccuaccucuccaccaucuccaaggaccucaucaccuacauguccggcaccaaguccaccgaguucaacaacaccgucuccugcuccaaccgcccccacugccucaccgagauccagucccucaccuucaaccccaccgccggcugcgccucccucgccaaggagauguucgccaugaagaccaaggccgcccucgccaucuggugccccggcuacuccgagacccagaucaacgccacccaggccaugaagaagcgccgcaagcgcaaggucaccaccaacaagugccucgagcaggucucccagcuccagggccucuggcgccgcuucaaccgcccccuccucaagcagcaguga

SEQ ID NO: 51237 - RNA, 873 nt, Artificial Sequence
  derived and/or modified sequence opt2 from TSNAX__Homo_sapiens__NP_005990
auguccaacaaggagggcuccggcggcuuccgcaagcgcaagcacgacaacuucccccacaaccagcgccgcgagggcaaggacgucaacuccuccucccccgucaugcucgccuucaaguccuuccagcaggagcucgacgcccgccacgacaaguacgagcgccucgucaagcucucccgcgacaucaccgucgaguccaagcgcaccaucuuccuccuccaccgcaucaccuccgcccccgacauggaggacauccucaccgaguccgagaucaagcucgacggcguccgccagaagaucuuccaggucgcccaggagcucuccggcgaggacaugcaccaguuccaccgcgccaucaccaccggccuccaggaguacgucgaggccgucuccuuccagcacuucaucaagacccgcucccucaucuccauggacgagaucaacaagcagcucaucuucaccaccgaggacaacggcaaggagaacaagacccccuccuccgacgcccaggacaagcaguucggcaccuggcgccuccgcgucacccccgucgacuaccuccucggcgucgccgaccucaccggcgagcucaugcgcaugugcaucaacuccgucggcaacggcgacaucgacacccccuucgaggucucccaguuccuccgccaggucuacgacggcuucuccuucaucggcaacaccggccccuacgaggucuccaagaagcucuacacccucaagcagucccucgccaaggucgagaacgccugcuacgcccucaagguccgcggcuccgagauccccaagcacaugcucgccgacgucuucuccgucaagaccgagaugaucgaccaggaggagggcaucuccuga

SEQ ID NO: 51238 - RNA, 447 nt, Artificial Sequence
  derived and/or modified sequence opt2 from TSN__Homo_sapiens__NP_001248330
auguccgucuccgagaucuucgucgagcuccagggcuuccucgccgccgagcaggacauccgcgaggagauccgcaaggucguccagucccucgagcagaccgcccgcgagauccucacccuccuccagggcguccaccagggcgccggcuuccaggacauccccaagcgcugccucaaggcccgcgagcacuucggcaccgucaagacccaccucaccucccucaagaccaaguuccccgccgagcaguacuaccgcuuccacgagcacuggcgcuucguccuccagcgccucgucuuccucgccgccuucgucgucuaccucgagaccgagacccucgucacccgcgaggccgucaccgagauccucggcaucgaggccgucugccagcagcgcgacugcuggcgccuccuccccacccccccccaccuccaccuccaccaguga

SEQ ID NO: 51239 - RNA, 1182 nt, Artificial Sequence
  derived and/or modified sequence opt2 from TSPAN10__Homo_sapiens__NP_001277141
augcaccgccucgcccagggccgcucccaggaccagcccuccucccccgccaccgaggagcccgccaaccucucccgccgccucugcuggggccucuccguccccgccucccgcauggaggagggcgagcgcuccccccuccucucccaggagaccgccggccagaagccccucuccguccaccgcccccccaccuccggcugccucggccccgucccccgcgaggaccaggccgaggccuggggcugcuccugcugcccccccgagaccaagcaccaggcccucuccggcacccccaagaagggccccgcccccucccucucccccggcuccuccugcgucaaguaccucaucuuccucuccaacuuccccuucucccuccucggccuccucgcccucgccaucggccucuggggccucgccgucaagggcucccucggcuccgaccucggcggcccccuccccgccgaccccaugcucggccucgcccucggcggccucgucgucuccgccgucucccucgccggcuaccucggcgcccucugcgagaacaccugccuccuccgcggcuucuccggcggcauccucgccuuccucguccucgaggccgucgccggcgcccucgucgucgcccucuggggcccccuccaggacucccucgagcacacccuccgcgucgccaucgcccacuaccaggacgaccccgaccuccgcuuccuccucgaccagguccagcucggccuccgcugcugcggcgccgccuccuaccaggacuggcagcagaaccucuacuucaacugcuccucccccggcguccaggccugcucccuccccgccuccugcugcaucgacccccgcgaggacggcgccuccgucaacgaccagugcggcuucggcguccuccgccucgacgccgacgccgcccagcgcgucgucuaccucgagggcugcggccccccccuccgccgcuggcuccgcgccaaccucgccgccuccggcggcuacgccaucgccgucguccuccuccagggcgccgagcuccuccucgccgcccgccuccucggcgcccucgccgcccgccgcggcgccgccuacggccccggcgcccgcggcgaggaccgcgccggcccccagucccccucccccggcgccccccccgccgccaagcccgcccgcggcuga

SEQ ID NO: 51240 - RNA, 762 nt, Artificial Sequence
  derived and/or modified sequence opt2 from TSPAN11__Homo_sapiens__XP_011518982
auggcccacuacaagaccgagcaggacgacuggcucaucaucuaccucaaguaccuccucuucgucuucaacuucuucuucugggucggcggcgccgccguccucgccgucggcaucuggacccucgucgagaaguccggcuaccucuccguccucgccuccuccaccuucgccgccuccgccuacauccucaucuucgccggcguccucgucauggucaccggcuuccucggcuucggcgccauccucugggagcgcaagggcugccucuccaccuacuucugccuccuccucgucaucuuccucgucgagcucgucgccggcguccucgcccacgucuacuaccagcgccucuccgacgagcucaagcagcaccucaaccgcacccucgccgagaacuacggccagcccggcgccacccagaucaccgccuccgucgaccgccuccagcaggacuucaagugcugcggcuccaacuccuccgccgacuggcagcacuccaccuacauccuccuccgcgaggccgagggccgccagguccccgacuccugcugcaagaccgucgucguccgcugcggccagcgcgcccaccccuccaacaucuacaaggucgagggcggcugccucaccaagcucgagcaguuccucgccgaccaccuccuccucaugggcgccgucggcaucggcgucgccugccuccagaucugcggcaugguccucaccugcugccuccaccagcgccuccagcgccacuucuacuga

SEQ ID NO: 51241 - RNA, 918 nt, Artificial Sequence
  derived and/or modified sequence opt2 from TSPAN12__Homo_sapiens__XP_011514296
auggcccgcgaggacuccgucaagugccuccgcugccuccucuacgcccucaaccuccucuucuggcucauguccaucuccguccucgccgucuccgccuggaugcgcgacuaccucaacaacguccucacccucaccgccgagacccgcgucgaggaggccgucauccucaccuacuuccccgucguccaccccgucaugaucgccgucugcugcuuccucaucaucgucggcaugcucggcuacugcggcaccgucaagcgcaaccuccuccuccucgccugguacuucggcucccuccucgucaucuucugcgucgagcucgccugcggcgucuggaccuacgagcaggagcucaugguccccguccagugguccgacauggucacccucaaggcccgcaugaccaacuacggccucccccgcuaccgcuggcucacccacgccuggaacuucuuccagcgcgaguucaagugcugcggcgucgucuacuucaccgacuggcucgagaugaccgagauggacuggccccccgacuccugcugcguccgcgaguuccccggcugcuccaagcaggcccaccaggaggaccucuccgaccucuaccaggagggcugcggcaagaagauguacuccuuccuccgcggcaccaagcagcuccagguccuccgcuuccucggcaucuccaucggcgucacccagauccucgccaugauccucaccaucacccuccucugggcccucuacuacgaccgccgcgagcccggcaccgaccagaugaugucccucaagaacgacaacucccagcaccucuccugccccuccgucgagcuccucaagcccucccucucccgcaucuucgagcacaccuccauggccaacuccuucaacacccacuucgagauggaggagcucuga

SEQ ID NO: 51242 - RNA, 615 nt, Artificial Sequence
  derived and/or modified sequence opt2 from TSPAN13__Homo_sapiens__NP_055214
auggucugcggcggcuucgccugcuccaagaacugccucugcgcccucaaccuccucuacacccucgucucccuccuccucaucggcaucgccgccuggggcaucggcuucggccucaucuccucccuccgcgucgucggcgucgucaucgccgucggcaucuuccucuuccucaucgcccucgucggccucaucggcgccgucaagcaccaccagguccuccucuucuucuacaugaucauccuccuccucgucuucaucguccaguucuccgucuccugcgccugccucgcccucaaccaggagcagcagggccagcuccucgaggucggcuggaacaacaccgccuccgcccgcaacgacauccagcgcaaccucaacugcugcggcuuccgcuccgucaaccccaacgacaccugccucgccuccugcgucaaguccgaccacuccugcucccccugcgcccccaucaucggcgaguacgccggcgagguccuccgcuucgucggcggcaucggccucuucuucuccuucaccgagauccucggcgucuggcucaccuaccgcuaccgcaaccagaaggacccccgcgccaaccccuccgccuuccucuga

SEQ ID NO: 51243 - RNA, 444 nt, Artificial Sequence
  derived and/or modified sequence opt2 from TSPAN14__Homo_sapiens__NP_001121781
augcacuacuaccgcuacuccaacgccaaggucuccugcugguacaaguaccuccucuucuccuacaacaucaucuucuggaaccagugcugcggcgccuacggccccgaggacugggaccucaacgucuacuucaacugcuccggcgccuccuacucccgcgagaagugcggcguccccuucuccugcugcguccccgaccccgcccagaaggucgucaacacccagugcggcuacgacguccgcauccagcucaaguccaagugggacgaguccaucuucaccaagggcugcauccaggcccucgaguccuggcucccccgcaacaucuacaucgucgccggcgucuucaucgccaucucccuccuccagaucuucggcaucuuccucgcccgcacccucaucuccgacaucgaggccgucaaggccggccaccacuucuga

SEQ ID NO: 51244 - RNA, 735 nt, Artificial Sequence
  derived and/or modified sequence opt2 from TSPAN16__Homo_sapiens__NP_001269438
auggccgagauccacacccccuacuccucccucaagaagcuccucucccuccucaacggcuucgucgccgucuccggcaucauccucgucggccucggcaucggcggcaagugcggcggcgccucccucaccaacguccucggccucuccuccgccuaccuccuccacgucggcaaccucugccucgucaugggcugcaucaccguccuccucggcugcgccggcugguacggcgccaccaaggagucccgcggcacccuccucuucugcauccucuccauggucaucguccucaucauggaggucaccgccgccaccgucguccuccucuucuuccccaucgucggcgacgucgcccucgagcacaccuucgucacccuccgcaagaacuaccgcggcuacaacgagcccgacgacuacuccacccaguggaaccucgucauggagaagcucaagugcugcggcgucaacaacuacaccgacuucuccggcuccuccuucgagaugaccaccggccacaccuacccccgcuccugcugcaaguccaucggcuccgucuccugcgacggccgcgacgucucccccaacgucauccaccagaagggcugcuuccacaagcuccucaagaucaccaagacccaguccuucacccucuccggcuccucccucggcgccgccgucauccagcuccccggcauccucgccacccuccuccucuucaucaagcucggcuga

SEQ ID NO: 51245 - RNA, 777 nt, Artificial Sequence
  derived and/or modified sequence opt2 from TSPAN18__Homo_sapiens__XP_006718435
augcccgaggagcucccccgcugguccaccauggagggcgacugccucuccugcaugaaguaccucauguucgucuucaacuucuucaucuuccucggcggcgccugccuccucgccaucggcaucugggucauggucgaccccaccggcuuccgcgagaucgucgccgccaacccccuccuccucaccggcgccuacauccuccucgccaugggcggccuccucuuccuccucggcuuccucggcugcugcggcgccguccgcgagaacaagugccuccuccucuucuucuuccucuucauccucaucaucuuccucgccgagcucuccgccgccauccucgccuucaucuuccgcgagaaccucacccgcgaguucuucaccaaggagcucaccaagcacuaccagggcaacaacgacaccgacgucuucuccgccaccuggaacuccgucaugaucaccuucggcugcugcggcgucaacggccccgaggacuucaaguucgccuccgucuuccgccuccucacccucgacuccgaggagguccccgaggccugcugccgccgcgagccccagucccgcgacggcguccuccucucccgcgaggagugccuccucggccgcucccucuuccucaacaagcagggcugcuacaccgucauccucaacaccuucgagaccuacgucuaccucgccggcgcccucgccaucggcguccucgccaucgagcucuucgccaugaucuucgccaugugccucuuccgcggcauccaguga

SEQ ID NO: 51246 - RNA, 633 nt, Artificial Sequence
  derived and/or modified sequence opt2 from TSPAN31__Homo_sapiens__NP_005972
auggucugcggcggcuucgccugcuccaagaacgcccucugcgcccucaacgucgucuacaugcucgucucccuccuccucaucggcgucgccgccuggggcaagggccucggccucgucuccuccauccacaucaucggcggcgucaucgccgucggcgucuuccuccuccucaucgccgucgccggccucgucggcgccgucaaccaccaccagguccuccucuucuucuacaugaucauccucggccucgucuucaucuuccaguucgucaucuccugcuccugccucgccaucaaccgcuccaagcagaccgacgucaucaacgccuccuggugggucauguccaacaagacccgcgacgagcucgagcgcuccuucgacugcugcggccucuucaaccucaccacccucuaccagcaggacuacgacuucugcaccgccaucugcaagucccagucccccaccugccagaugugcggcgagaaguuccucaagcacuccgacgaggcccucaagauccucggcggcgucggccucuucuucuccuucaccgagauccucggcgucuggcucgccaugcgcuuccgcaaccagaaggacccccgcgccaaccccuccgccuuccucuga

SEQ ID NO: 51247 - RNA, 963 nt, Artificial Sequence
  derived and/or modified sequence opt2 from TSPAN32__Homo_sapiens__NP_620591
augggccccuggucccgcguccgcgucgccaagugccagaugcucgucaccugcuucuucauccuccuccucggccucuccgucgccaccauggucacccucaccuacuucggcgcccacuucgccgucauccgccgcgccucccucgagaagaaccccuaccaggccguccaccagugggccuucuccgccggccucucccucgucggccuccucacccucggcgccguccucuccgccgccgccaccguccgcgaggcccagggccucauggccggcggcuuccucugcuucucccucgccuucugcgcccagguccaggucgucuucuggcgccuccacucccccacccaggucgaggacgccaugcucgacaccuacgaccucgucuacgagcaggccaugaagggcaccucccacguccgccgccaggagcucgccgccauccaggacgucuuccucugcugcggcaagaagucccccuucucccgccucggcuccaccgaggccgaccucugccagggcgaggaggccgcccgcgaggacugccuccagggcauccgcuccuuccuccgcacccaccagcaggucgccuccucccucaccuccaucggccucgcccucaccgucuccgcccuccucuucuccuccuuccucugguucgccauccgcugcggcugcucccucgaccgcaagggcaaguacacccucaccccccgcgccugcggccgccagccccaggagcccucccuccuccgcugcucccagggcggccccacccacugccuccacuccgaggccgucgccaucggcccccgcggcugcuccggcucccuccgcuggcuccaggaguccgacgccgccccccucccccucuccugccaccucgccgcccaccgcgcccuccagggccgcucccgcggcggccucuccggcugccccgagcgcggccucuccgacuga

SEQ ID NO: 51248 - RNA, 852 nt, Artificial Sequence
  derived and/or modified sequence opt2 from TSPAN33__Homo_sapiens__NP_848657
auggcccgccgcccccgcgcccccgccgccuccggcgaggaguucuccuucgucuccccccucgucaaguaccuccucuucuucuucaacaugcucuucugggucaucuccauggucauggucgccgucggcgucuacgcccgccucaugaagcacgccgaggccgcccucgccugccucgccgucgaccccgccauccuccucaucgucgucggcguccucauguuccuccucaccuucugcggcugcaucggcucccuccgcgagaacaucugccuccuccagaccuucucccucugccucaccgccgucuuccuccuccagcucgccgccggcauccucggcuucgucuucuccgacaaggcccgcggcaaggucuccgagaucaucaacaacgccaucguccacuaccgcgacgaccucgaccuccagaaccucaucgacuucggccagaagaaguucuccugcugcggcggcaucuccuacaaggacuggucccagaacauguacuucaacugcuccgaggacaaccccucccgcgagcgcugcuccguccccuacuccugcugccuccccacccccgaccaggccgucaucaacaccaugugcggccagggcaugcaggccuucgacuaccucgaggccuccaaggucaucuacaccaacggcugcaucgacaagcucgucaacuggauccacuccaaccucuuccuccucggcggcgucgcccucggccucgccaucccccagcucgucggcauccuccucucccagauccucgucaaccagaucaaggaccagaucaagcuccagcucuacaaccagcagcaccgcgccgaccccugguacuga

SEQ ID NO: 51249 - RNA, 717 nt, Artificial Sequence
  derived and/or modified sequence opt2 from TSPAN4__Homo_sapiens__XP_005253159
auggcccgcgccugccuccaggccgucaaguaccucauguucgccuucaaccuccucuucuggcucggcggcugcggcguccucggcgucggcaucuggcucgccgccacccagggcuccuucgccacccucuccuccuccuuccccucccucuccgccgccaaccuccucaucaucaccggcgccuucgucauggccaucggcuucgucggcugccucggcgccaucaaggagaacaagugccuccuccucaccuucuuccuccuccuccuccucgucuuccuccucgaggccaccaucgccauccucuucuucgccuacaccgacaagaucgaccgcuacgcccagcaggaccucaagaagggccuccaccucuacggcacccagggcaacgucggccucaccaacgccugguccaucauccagaccgacuuccgcugcugcggcgucuccaacuacaccgacugguucgaggucuacaacgccacccgcguccccgacuccugcugccucgaguucuccgaguccugcggccuccacgcccccggcaccugguggaaggcccccugcuacgagaccgucaaggucuggcuccaggagaaccuccucgccgucggcaucuucggccucugcaccgcccucguccagauccucggccucaccuucgccaugaccauguacugccaggucgucaaggccgacaccuacugcgccuga

SEQ ID NO: 51250 - RNA, 738 nt, Artificial Sequence
  derived and/or modified sequence opt2 from TSPAN6__Homo_sapiens__NP_003261
auggccucccccucccgccgccuccagaccaagcccgucaucaccugcuucaaguccguccuccucaucuacaccuucaucuucuggaucaccggcgucauccuccucgccgucggcaucuggggcaaggucucccucgagaacuacuucucccuccucaacgagaaggccaccaacguccccuucguccucaucgccaccggcaccgucaucauccuccucggcaccuucggcugcuucgccaccugccgcgccuccgccuggaugcucaagcucuacgccauguuccucacccucgucuuccucgucgagcucgucgccgccaucgucggcuucgucuuccgccacgagaucaagaacuccuucaagaacaacuacgagaaggcccucaagcaguacaacuccaccggcgacuaccgcucccacgccgucgacaagauccagaacacccuccacugcugcggcgucaccgacuaccgcgacuggaccgacaccaacuacuacuccgagaagggcuuccccaaguccugcugcaagcucgaggacugcaccccccagcgcgacgccgacaaggucaacaacgagggcugcuucaucaaggucaugaccaucaucgaguccgagaugggcgucgucgccggcaucuccuucggcgucgccugcuuccagcucaucggcaucuuccucgccuacugccucucccgcgccaucaccaacaaccaguacgagaucgucuga

SEQ ID NO: 51251 - RNA, 750 nt, Artificial Sequence
  derived and/or modified sequence opt2 from TSPAN7__Homo_sapiens__NP_004606
auggccucccgccgcauggagaccaagcccgucaucaccugccucaagacccuccucaucaucuacuccuucgucuucuggaucaccggcgucauccuccucgccgucggcgucuggggcaagcucacccucggcaccuacaucucccucaucgccgagaacuccaccaacgcccccuacguccucaucggcaccggcaccaccaucgucgucuucggccucuucggcugcuucgccaccugccgcggcucccccuggaugcucaagcucuacgccauguuccucucccucgucuuccucgccgagcucgucgccggcaucuccggcuucgucuuccgccacgagaucaaggacaccuuccuccgcaccuacaccgacgccaugcagaccuacaacggcaacgacgagcgcucccgcgccgucgaccacguccagcgcucccucuccugcugcggcguccagaacuacaccaacugguccaccucccccuacuuccucgagcacggcaucccccccuccugcugcaugaacgagaccgacugcaacccccaggaccuccacaaccucaccgucgccgccaccaaggucaaccagaagggcugcuacgaccucgucaccuccuucauggagaccaacaugggcaucaucgccggcgucgccuucggcaucgccuucucccagcucaucggcaugcuccucgccugcugccucucccgcuucaucaccgccaaccaguacgagauggucuga

SEQ ID NO: 51252 - RNA, 714 nt, Artificial Sequence
  derived and/or modified sequence opt2 from TSPAN8__Homo_sapiens__XP_006719646
auggccggcgucuccgccugcaucaaguacuccauguucaccuucaacuuccucuucuggcucugcggcauccucauccucgcccucgccaucuggguccgcgucuccaacgacucccaggccaucuucggcuccgaggacgucggcuccuccuccuacgucgccgucgacauccucaucgccgucggcgccaucaucaugauccucggcuuccucggcugcugcggcgccaucaaggagucccgcugcaugcuccuccucuucuucaucggccuccuccucauccuccuccuccaggucgccaccggcauccucggcgccgucuucaaguccaaguccgaccgcaucgucaacgagacccucuacgagaacaccaagcuccucuccgccaccggcgaguccgagaagcaguuccaggaggccaucaucgucuuccaggaggaguucaagugcugcggccucgucaacggcgccgccgacuggggcaacaacuuccagcacuaccccgagcucugcgccugccucgacaagcagcgccccugccaguccuacaacggcaagcaggucuacaaggagaccugcaucuccuucaucaaggacuuccucgccaagaaccucaucaucgucaucggcaucuccuucggccucgccgucaucgagauccucggccucgucuucuccaugguccucuacugccagaucggcaacaaguga

SEQ ID NO: 51253 - RNA, 720 nt, Artificial Sequence
  derived and/or modified sequence opt2 from TSPAN9__Homo_sapiens__NP_001161792
auggcccgcggcugccucugcugccucaaguacaugauguuccucuucaaccucaucuucuggcucugcggcugcggccuccucggcgucggcaucuggcucuccgucucccagggcaacuucgccaccuucucccccuccuuccccucccucuccgccgccaaccucgucaucgccaucggcaccaucgucauggucaccggcuuccucggcugccucggcgccaucaaggagaacaagugccuccuccucuccuucuucaucguccuccucgucauccuccucgccgagcucauccuccucauccucuucuucgucuacauggacaaggucaacgagaacgccaagaaggaccucaaggagggccuccuccucuaccacaccgagaacaacgucggccucaagaacgccuggaacaucauccaggccgagaugcgcugcugcggcgucaccgacuacaccgacugguaccccguccucggcgagaacaccguccccgaccgcugcugcauggagaacucccagggcugcggccgcaacgccaccaccccccucuggcgcaccggcugcuacgagaaggucaagaugugguucgacgacaacaagcacguccucggcaccgucggcaugugcauccucaucaugcagauccucggcauggccuucuccaugacccucuuccagcacauccaccgcaccggcaagaaguacgacgccuga

SEQ ID NO: 51254 - RNA, 1806 nt, Artificial Sequence
  derived and/or modified sequence opt2 from TSPEAR__Homo_sapiens__NP_001258966
auguccuuccccgccucccgcaucuucucccagugcgaccucuuccccgaggaguucuccaucgucgucacccuccgcguccccaaccucccccccaagcgcaacgaguaccuccucaccgucgucgccgaggaguccgaccuccuccuccucggccuccgccucucccccgcccagcuccacuuccucuuccuccgcgaggacaccgccggcgccuggcagacccgcgucuccuuccgcucccccgcccucgucgacggccgcuggcacacccucguccucgccgucuccgccggcgucuucucccucaccaccgacugcggccuccccgucgacaucauggccgacguccccuuccccgccacccucuccgucaagggcgcccgcuucuucgucggcucccgccgccgcgccaagggccucuucaugggccucguccgccagcucguccuccuccccggcuccgacgccaccccccgccucugccccucccgcaacgccccccucgccguccucuccaucccccgcguccuccaggcccucaccggcaagcccgaggacaacgagguccucaaguaccccuacgagaccaacauccgcgucacccucggcccccagccccccugcaccgaggucgaggacgcccaguucugguucgacgccucccgcaagggccucuaccucugcgucggcaacgagugggucuccguccucgccgccaaggagcgccucgacuacgucgaggagcaccagaaccucuccaccaacuccgagacccucggcaucgaggucuuccgcaucccccaggucggccucuucgucgccaccgccaaccgcaaggccaccuccgccgucuacaaguggaccgaggagaaguucgucuccuaccagaacauccccacccaccaggcccaggccuggcgccacuucaccaucggcaagaagaucuuccucgccgucgccaacuucgagcccgacgagaagggccaggaguucuccgucaucuacaaguggucccaccgcaagcucaaguucacccccuaccaguccaucgccacccacuccgcccgcgacugggaggccuucgaggucgacggcgagcacuuccucgccgucgccaaccaccgcgagggcgacaaccacaacaucgacuccgucaucuacaaguggaaccccgccacccgccucuucgaggccaaccagaccaucgccaccuccggcgccuacgacugggaguucuucuccgucggccccuacuccuuccucgucgucgccaacaccuucaacggcaccuccaccaagguccacucccaccucuacauccgccuccucggcuccuuccagcucuuccaguccuuccccaccuucggcgccgccgacugggaggucuuccagaucggcgagcgcaucuuccucgccgucgccaacucccacuccuacgacgucgagaugcagguccagaacgacuccuacgucaucaacuccgucaucuacgagcucaacgucaccgcccaggccuucgucaaguuccaggacauccucaccugcuccgcccucgacugggaguucuucuccgucggcgaggacuacuuccucgucgucgccaacuccuucgacggccgcaccuucuccgucaacuccaucaucuaccgcuggcagggcuacgagggcuucgucgccguccacucccuccccaccgucggcugccgcgacugggaggccuucuccaccaccgccggcgccuaccucaucuacuccuccgccaaggagccccucucccgcguccuccgccuccgcacccgcuga

SEQ ID NO: 51255 - RNA, 513 nt, Artificial Sequence
  derived and/or modified sequence opt2 from TSPO2__Homo_sapiens__XP_011512699
augcgccuccagggcgccaucuucguccuccucccccaccucggccccauccucgucuggcucuucacccgcgaccacauguccggcuggugcgagggcccccgcaugcucuccuggugccccuucuacaagguccuccuccucguccagaccgccaucuacuccgucgucggcuacgccuccuaccucgucuggaaggaccucggcggcggccucggcuggccccucgcccucccccucggccucuacgccguccagcucaccaucuccuggaccguccucguccucuucuucaccguccacaaccccggccucgcccuccuccaccuccuccuccucuacggccucgucgucuccaccgcccucaucuggcaccccaucaacaagcucgccgcccuccuccuccuccccuaccucgccuggcucaccgucaccuccgcccucaccuaccaccucuggcgcgacucccucugccccguccaccagccccagcccaccgagaaguccgacuga

SEQ ID NO: 51256 - RNA, 510 nt, Artificial Sequence
  derived and/or modified sequence opt2 from TSPO__Homo_sapiens__NP_001243459
auggccccccccuggguccccgccaugggcuucacccucgcccccucccucggcugcuucgucggcucccgcuucguccacggcgagggccuccgcugguacgccggccuccagaagcccuccuggcaccccccccacuggguccucggccccgucuggggcacccucuacuccgccaugggcuacggcuccuaccucgucuggaaggagcucggcggcuucaccgagaaggccgucgucccccucggccucuacaccggccagcucgcccucaacugggccuggccccccaucuucuucggcgcccgccagaugggcugggcccucgucgaccuccuccucgucuccggcgccgccgccgccaccaccgucgccugguaccaggucuccccccucgccgcccgccuccucuaccccuaccucgccuggcucgccuucaccaccacccucaacuacugcgucuggcgcgacaaccacggcuggcgcggcggccgccgccuccccgaguga

SEQ ID NO: 51257 - RNA, 927 nt, Artificial Sequence
  derived and/or modified sequence opt2 from TSPY10__Homo_sapiens__NP_001269398
augcgccccgagggcucccucaccuaccgcguccccgagcgccuccgccagggcuucugcggcgucggccgcgccgcccaggcccucgucugcgccuccgccaaggagggcaccgccuuccgcauggaggccguccaggagggcgccgccggcgucgaguccgagcaggccgcccucggcgaggaggccguccuccuccucgacgacaucauggccgaggucgaggucgucgccgaggaggagggccucgucgagcgccgcgaggaggcccagcgcgcccagcaggccguccccggccccggccccaugacccccgaguccgcccucgaggagcuccucgccguccaggucgagcucgagcccgucaacgcccaggcccgcaaggccuucucccgccagcgcgagaagauggagcgccgccgcaagccccaccucgaccgccgcggcgccgucauccaguccguccccggcuucugggccaacgucaucgccaaccacccccagauguccgcccucaucaccgacgaggacgaggacaugcucuccuacauggucucccucgaggucgaggaggagaagcaccccguccaccucugcaagaucaugcucuucuuccgcuccaaccccuacuuccagaacaaggucaucaccaaggaguaccucgucaacaucaccgaguaccgcgccucccacuccacccccaucgagugguaccccgacuacgaggucgaggccuaccgccgccgccaccacaacuccucccucaacuucuucaacugguucuccgaccacaacuucgccggcuccaacaagaucgccgagauccucugcaaggaccucuggcgcaacccccuccaguacuacaagcgcaugaagccccccgaggagggcaccgagaccuccggcgacucccagcuccucuccuga

SEQ ID NO: 51258 - RNA, 927 nt, Artificial Sequence
  derived and/or modified sequence opt2 from TSPY1__Homo_sapiens__NP_003299
augcgccccgagggcucccucaccuaccgcguccccgagcgccuccgccagggcuucugcggcgucggccgcgccgcccaggcccucgucugcgccuccgccaaggagggcaccgccuuccgcauggaggccguccaggagggcgccgccggcgucgaguccgagcaggccgcccucggcgaggaggccguccuccuccucgacgacaucauggccgaggucgaggucgucgccgaggaggagggccucgucgagcgccgcgaggaggcccagcgcgcccagcaggccguccccggccccggccccaugacccccgaguccgcccccgaggagcuccucgccguccaggucgagcucgagcccgucaacgcccaggcccgcaaggccuucucccgccagcgcgagaagauggagcgccgccgcaagccccaccucgaccgccgcggcgccgucauccaguccguccccggcuucugggccaacgucaucgccaaccacccccagauguccgcccucaucaccgacgaggacgaggacaugcucuccuacauggucucccucgaggucggcgaggagaagcaccccguccaccucugcaagaucaugcucuucuuccgcuccaaccccuacuuccagaacaaggucaucaccaaggaguaccucgucaacaucaccgaguaccgcgccucccacuccacccccaucgagugguaccccgacuacgaggucgaggccuaccgccgccgccaccacaacuccucccucaacuucuucaacugguucuccgaccacaacuucgccggcuccaacaagaucgccgagauccucugcaaggaccucuggcgcaacccccuccaguacuacaagcgcaugaagccccccgaggagggcaccgagaccuccggcgacucccagcuccucuccuga

SEQ ID NO: 51259 - RNA, 867 nt, Artificial Sequence
  derived and/or modified sequence opt2 from TSPY3__Homo_sapiens__XP_011542306
augcgccccgagggcucccucaccuaccgcguccccgagcgccuccgccagggcuucugcggcgucggccgcgccgcccaggcccucgucugcgccuccgccaaggagggcaccgccuuccgcauggaggccguccaggagggcgccgccggcgucgaguccgagcaggccgcccucggcgaggaggccguccuccuccucgacgacaucauggccgaggucgaggucgucgccgaggaggagggccucgucgagcgccgcgaggaggcccagcgcgcccagcaggccguccccggccccggccccaugacccccgaguccgcccucgaggagcuccucgccguccaggucgagcucgagcccgucaacgcccaggcccgcaaggccuucucccgccagcgcgagaagauggagcgccgccgcaagccccaccucgaccgccgcggcgccgucauccaguccguccccggcuucugggccaacgucaucgccaaccacccccagauguccgcccucaucaccgacgaggacgaggacaugcucuccuacauggucucccucgaggucgaggaggagaagcaccccguccaccucugcaagaucaugcucuucuuccgcuccaaccccuacuuccagaacaaggucaucaccaaggaguaccucgucaacaucaccggccuccucaucccccuccagcucuccggcauccgcaucaugaaguggcgccgcaucgccgccgacaccaccaccgccgcccucaccuccuccaccggcucccucaccaccaccucccaggaccucacccgccuccuccgcuccuacguccgcaccugcggcgccauccccugcaacaccacccgcggcuga

SEQ ID NO: 51260 - RNA, 945 nt, Artificial Sequence
  derived and/or modified sequence opt2 from TSPY4__Homo_sapiens__NP_001157943
augcgccccgagggcucccucaccuaccgcguccccgagcgccuccgccagggcuucugcggcgucggccgcgccgcccaggcccucgucugcgccuccgccaaggagggcaccgccuuccgcauggaggccguccaggagggcgccgccggcgucgaguccgagcaggccgcccucggcgaggaggccguccuccuccucgacgacaucauggccgaggucgaggucgucgccgaggucgaggucgucgccgaggaggagggccucgucgagcgccgcgaggaggcccagcgcgcccagcaggccguccccggccccggccccaugacccccgaguccgcccucgaggagcuccucgccguccaggucgagcucgagcccgucaacgcccaggcccgcaaggccuucucccgccagcgcgagaagauggagcgccgccgcaagccccaccucgaccgccgcggcgccgucauccaguccguccccggcuucugggccaacgucaucgccaaccacccccagauguccgcccucaucaccgacgaggacgaggacaugcucuccuacauggucucccucgaggucgaggaggagaagcaccccguccaccucugcaagaucaugcucuucuuccgcuccaaccccuacuuccagaacaaggucaucaccaaggaguaccucgucaacaucaccgaguaccgcgccucccacuccacccccaucgagugguaccccgacuacgaggucgaggccuaccgccgccgccaccacaacuccucccucaacuucuucaacugguucuccgaccacaacuucgccggcuccaacaagaucgccgagauccucugcaaggaccucuggcgcaacccccuccaguacuacaagcgcaugaagccccccgaggagggcaccgagaccuccggcgacucccagcuccucuccuga

SEQ ID NO: 51261 - RNA, 1314 nt, Artificial Sequence
  derived and/or modified sequence opt2 from TSPYL1__Homo_sapiens__NP_003300
auguccggccucgacggcgucaagcgcaccaccccccuccagacccacuccaucaucaucuccgaccagguccccuccgaccaggacgcccaccaguaccuccgccuccgcgaccaguccgaggccacccaggucauggccgagcccggcgagggcggcuccgagaccgucgcccuccccccccccccccccuccgaggagggcggcgucccccaggacgccgccggccgcggcggcaccccccagauccgcgucgucggcggccgcggccacgucgccaucaaggccggccaggaggagggccagccccccgccgagggccucgccgccgccuccgucgucauggccgccgaccgcucccucaagaagggcguccagggcggcgagaaggcccucgagaucugcggcgcccagcgcuccgccuccgagcucaccgccggcgccgaggccgaggccgaggaggucaagaccggcaagugcgccaccgucuccgccgccgucgccgagcgcgaguccgccgaggucgucaaggagggccucgccgagaaggaggucauggaggagcagauggaggucgaggagcagccccccgagggcgaggagaucgaggucgccgaggaggaccgccucgaggaggaggcccgcgaggaggagggccccuggccccuccacgaggcccuccgcauggacccccucgaggccauccagcucgagcucgacaccgucaacgcccaggccgaccgcgccuuccagcagcucgagcacaaguucggccgcaugcgccgccacuaccucgagcgccgcaacuacaucauccagaacauccccggcuucuggaugaccgccuuccgcaaccacccccagcucuccgccaugauccgcggccaggacgccgagaugcuccgcuacaucaccaaccucgaggucaaggagcuccgccacccccgcaccggcugcaaguucaaguucuucuuccgccgcaaccccuacuuccgcaacaagcucaucgucaaggaguacgagguccgcuccuccggccgcgucgucucccucuccacccccaucaucuggcgccgcggccacgagccccaguccuucauccgccgcaaccaggaccucaucugcuccuucuucaccugguucuccgaccacucccuccccgaguccgacaagaucgccgagaucaucaaggaggaccucuggcccaacccccuccaguacuaccuccuccgcgagggcguccgccgcgcccgccgccgcccccuccgcgagcccgucgagaucccccgccccuucggcuuccaguccggcuga

SEQ ID NO: 51262 - RNA, 2082 nt, Artificial Sequence
  derived and/or modified sequence opt2 from TSPYL2__Homo_sapiens__NP_071400
auggaccgccccgacgagggcccccccgccaagacccgccgccucuccuccuccgaguccccccagcgcgacccccccccccccccccccccccccccccuccuccgccucccccucccccccccccagcagcgcccccgccuccaggaggagaccgaggccgcccagguccucgccgacaugcgcggcgucggccucggccccgcccuccccccccccccccccuacgucauccucgaggagggcggcauccgcgccuacuucacccucggcgccgagugccccggcugggacuccaccaucgaguccggcuacggcgaggcccccccccccaccgagucccucgaggcccuccccacccccgaggccuccggcggcucccucgagaucgacuuccaggucguccaguccuccuccuucggcggcgagggcgcccucgagaccugcuccgccgucggcugggccccccagcgccucgucgaccccaaguccaaggaggaggccaucaucaucgucgaggacgaggacgaggacgagcgcgaguccaugcgcuccucccgccgccgccgccgccgccgccgccgcaagcagcgcaaggucaagcgcgagucccgcgagcgcaacgccgagcgcauggaguccauccuccaggcccucgaggacauccagcucgaccucgaggccgucaacaucaaggccggcaaggccuuccuccgccucaagcgcaaguucauccagaugcgccgccccuuccucgagcgccgcgaccucaucauccagcacauccccggcuucugggucaaggccuuccucaaccacccccgcaucuccauccucaucaaccgccgcgacgaggacaucuuccgcuaccucaccaaccuccagguccaggaccuccgccacaucuccaugggcuacaagaugaagcucuacuuccagaccaaccccuacuucaccaacauggucaucgucaaggaguuccagcgcaaccgcuccggccgccucgucucccacuccacccccauccgcuggcaccgcggccaggagccccaggcccgccgccacggcaaccaggacgccucccacuccuucuucuccugguucuccaaccacucccuccccgaggccgaccgcaucgccgagaucaucaagaacgaccucugggucaacccccuccgcuacuaccuccgcgagcgcggcucccgcaucaagcgcaagaagcaggagaugaagaagcgcaagacccgcggccgcugcgaggucgucaucauggaggacgcccccgacuacuacgccgucgaggacaucuucuccgagaucuccgacaucgacgagaccauccacgacaucaagaucuccgacuucauggagaccaccgacuacuucgagaccaccgacaacgagaucaccgacaucaacgagaacaucugcgacuccgagaaccccgaccacaacgagguccccaacaacgagaccaccgacaacaacgaguccgccgacgaccacgagaccaccgacaacaacgaguccgccgacgacaacaacgagaaccccgaggacaacaacaagaacaccgacgacaacgaggagaaccccaacaacaacgagaacaccuacggcaacaacuucuucaagggcggcuucuggggcucccacggcaacaaccaggacuccuccgacuccgacaacgaggccgacgaggccuccgacgacgaggacaacgacggcaacgagggcgacaacgagggcuccgacgacgacggcaacgagggcgacaacgagggcuccgacgacgacgaccgcgacaucgaguacuacgagaaggucaucgaggacuucgacaaggaccaggccgacuacgaggacgucaucgagaucaucuccgacgaguccgucgaggaggagggcaucgaggagggcauccagcaggacgaggacaucuacgaggagggcaacuacgaggaggagggcuccgaggacgucugggaggagggcgaggacuccgacgacuccgaccucgaggacguccuccagguccccaacggcugggccaaccccggcaagcgcggcaagaccggcuga

SEQ ID NO: 51263 - RNA, 1245 nt, Artificial Sequence
  derived and/or modified sequence opt2 from TSPYL4__Homo_sapiens__NP_067680
auguccggccucgacggcggcaacaagcucccccucgcccagaccggcggccucgccgcccccgaccacgccuccggcgaccccgaccgcgaccagugccagggccuccgcgaggagaccgaggccacccaggucauggccaacaccggcggcggcucccucgagaccgucgccgagggcggcgccucccaggaccccgucgacugcggccccgcccuccgcguccccgucgccggcucccgcggcggcgccgccaccaaggccggccaggaggacgccccccccuccaccaagggccucgaggccgccuccgccgccgaggccgccgacuccucccagaagaacggcugccagcucggcgagccccgcggccccgccggccagaaggcccucgaggccugcggcgccggcggccucggcucccagaugauccccggcaagaaggccaaggaggucaccaccaagaagcgcgccaucuccgccgccgucgagaaggagggcgaggccggcgccgccauggaggagaagaaggucguccagaaggagaagaaggucgccggcggcgucaaggaggagacccgcccccgcgcccccaagaucaacaacugcauggacucccucgaggccaucgaccaggagcucuccaacgucaacgcccaggccgaccgcgccuuccuccagcucgagcgcaaguucggccgcaugcgccgccuccacaugcagcgccgcuccuucaucauccagaacauccccggcuucugggucaccgccuuccgcaaccacccccagcucucccccaugaucuccggccaggacgaggacaugcuccgcuacaugaucaaccucgaggucgaggagcucaagcacccccgcgccggcugcaaguucaaguucaucuuccagggcaaccccuacuuccgcaacgagggccucgucaaggaguacgagcgccgcuccuccggccgcgucgucucccucuccacccccauccgcuggcaccgcggccaggacccccaggcccacauccaccgcaaccgcgagggcaacaccauccccuccuucuucaacugguucuccgaccacucccuccucgaguucgaccgcaucgccgagaucaucaagggcgagcucuggcccaacccccuccaguacuaccucaugggcgagggcccccgccgcggcauccgcggccccccccgccagcccgucgaguccgcccgcuccuuccgcuuccaguccggcuga

SEQ ID NO: 51264 - RNA, 1254 nt, Artificial Sequence
  derived and/or modified sequence opt2 from TSPYL5__Homo_sapiens__NP_277047
auguccggccgcucccgcggccgcaaguccucccgcgccaagaaccgcggcaagggccgcgccaaggcccgcguccgccccgcccccgacgacgccccccgcgaccccgaccccucccaguaccagucccucggcgaggacacccaggccgcccagguccaggccggcgccggcuggggcggccucgaggccgccgccuccgcccagcuccuccgccucggcgaggaggccgccugccgccucccccucgacugcggccucgcccuccgcgcccgcgccgccggcgaccacggccaggccgccgcccgccccggccccggcaaggccgccucccucuccgagcgccucgccgccgacaccgucuucgucggcaccgccggcaccgucggccgccccaagaacgccccccgcgucggcaaccgccgcggccccgccggcaagaaggcccccgagaccugcuccaccgccggccgcggcccccaggucaucgccggcggccgccagaagaagggcgccgccggcgagaacaccuccgucuccgccggcgaggagaagaaggaggagcgcgacgccggcuccggcccccccgccaccgagggcuccauggacacccucgagaacguccagcucaagcucgagaacaugaacgcccaggccgaccgcgccuaccuccgccucucccgcaaguucggccagcuccgccuccagcaccucgagcgccgcaaccaccucauccagaacauccccggcuucuggggccaggccuuccagaaccacccccagcucgccuccuuccucaacucccaggagaaggagguccucuccuaccucaacucccucgaggucgaggagcucggccucgcccgccucggcuacaagaucaaguucuacuucgaccgcaaccccuacuuccagaacaagguccucaucaaggaguacggcugcggccccuccggccaggucgucucccgcuccacccccauccaguggcuccccggccacgaccuccagucccucucccagggcaaccccgagaacaaccgcuccuucuucggcugguucuccaaccacuccuccaucgaguccgacaagaucgucgagaucaucaacgaggagcucuggcccaacccccuccaguucuaccuccucuccgagggcgcccgcgucgagaagggcaaggagaaggagggccgccagggccccggcaagcagcccauggagaccacccagcccggcgucucccaguccaacuga

SEQ ID NO: 51265 - RNA, 2415 nt, Artificial Sequence
  derived and/or modified sequence opt2 from TSR1__Homo_sapiens__NP_060598
auggccgcccaccgccccggcccccucaagcagcagaacaaggcccacaagggcggccgccaccgcggccgcggcuccgcccagcgcgacggcaagggccgccucgcccucaagacccucuccaagaagguccgcaaggagcucucccgcgucgaccagcgccaccgcgccucccagcuccgcaagcagaagaaggaggccguccucgccgagaagcgccagcucggcggcaaggacggccccccccaccagguccucgucgucccccuccacucccgcaucucccuccccgaggccaugcagcuccuccaggaccgcgacaccggcaccguccaccucaacgagcucggcaacacccagaacuucaugcuccucugcccccgccucaagcaccgcugguucuucaccuccgcccgccccggcgaccuccacgucguccucgacauggccaaggucgccgacaccauccucuuccuccucgacccccucgagggcugggacuccaccggcgacuacugccucuccugccucuucgcccagggccuccccaccuacacccucgccguccagggcaucuccggccucccccucaagaagcagaucgacacccgcaagaagcucuccaaggccgucgagaagcgcuucccccacgacaagcuccuccuccucgacacccagcaggaggccggcaugcuccuccgccagcucgccaaccagaagcagcagcaccucgccuuccgcgaccgccgcgccuaccucuucgcccacgccgucgacuucguccccuccgaggagaacaaccucgucggcacccucaagaucuccggcuacguccgcggccagacccucaacgucaaccgccuccuccacaucgucggcuacggcgacuuccagaugaagcagaucgacgcccccggcgaccccuucccccucaacccccgcggcaucaagccccagaaggaccccgacauggccauggagaucugcgccaccgacgccgucgacgacauggaggagggccucaagguccucaugaaggccgaccccggccgccaggagucccuccaggccgaggucauccccgaccccauggagggcgagcagaccuggcccaccgaggaggagcucuccgaggccaaggacuuccucaaggaguccuccaaggucgucaagaagguccccaagggcaccuccuccuaccaggccgaguggauccucgacggcggcucccaguccggcggcgagggcgacgaguacgaguacgacgacauggagcacgaggacuucauggaggaggagucccaggacgaguccuccgaggaggaggaggaguacgagaccaugaccaucggcgaguccguccacgacgaccucuacgacaagaaggucgacgaggaggccgaggccaagaugcucgagaaguacaagcaggagcgccucgaggagauguuccccgacgaggucgacaccccccgcgacgucgccgcccgcauccgcuuccagaaguaccgcggccucaaguccuuccgcaccucccccugggaccccaaggagaaccucccccaggacuacgcccgcaucuuccaguuccagaacuucaccaacacccgcaaguccaucuucaaggaggucgaggagaaggaggucgagggcgccgaggucggcugguacgucacccuccacgucuccgagguccccgucuccgucgucgagugcuuccgccagggcaccccccucaucgccuucucccuccucccccacgagcagaagauguccguccucaacauggucguccgccgcgaccccggcaacaccgagcccgucaaggccaaggaggagcucaucuuccacugcggcuuccgccgcuuccgcgccuccccccucuucucccagcacaccgccgccgacaagcacaagcuccagcgcuuccucaccgccgacauggcccucgucgccaccgucuacgcccccaucaccuucccccccgccuccguccuccucuucaagcagaaguccaacggcaugcacucccucaucgccaccggccaccucauguccgucgaccccgaccgcauggucaucaagcgcgucguccucuccggccaccccuucaagaucuucaccaagauggccgucguccgcuacauguucuucaaccgcgaggacguccucugguucaagcccgucgagcuccgcaccaaguggggccgccgcggccacaucaaggagccccucggcacccacggccacaugaagugcuccuucgacggcaagcucaagucccaggacaccguccucaugaaccucuacaagcgcgucuuccccaaguggaccuacgaccccuacguccccgagcccguccccuggcucaaguccgagaucuccuccaccgucccccagggcggcauggaguga

SEQ ID NO: 51266 - RNA, 1164 nt, Artificial Sequence
  derived and/or modified sequence opt2 from TSSC1__Homo_sapiens__NP_003301
auggaggacgacgcccccgucaucuacggccucgaguuccaggcccgcgcccucaccccccagaccgccgagaccgacgccauccgcuuccucgucggcacccagucccucaaguacgacaaccagauccacaucaucgacuucgacgacgagaacaacaucaucaacaagaacguccuccuccaccaggccggcgagaucuggcacaucuccgccucccccgccgaccgcggcguccucaccaccugcuacaaccgcaccuccgacuccaagguccucaccugcgccgccgucuggcgcaugcccaaggagcucgaguccggcucccacgagucccccgacgacuccuccuccaccgcccagacccucgagcuccucugccaccucgacaacaccgcccacggcaacauggccugcgucgucugggagcccaugggcgacggcaagaagaucaucucccucgccgacaaccacauccuccucugggaccuccaggaguccuccucccaggccguccucgccuccuccgccucccucgagggcaagggccagcucaaguucaccuccggccgcugguccccccaccacaacugcacccaggucgccaccgccaacgacaccacccuccgcggcugggacacccgcuccaugucccagaucuacugcaucgagaacgcccacggccagcucguccgcgaccucgacuucaaccccaacaagcaguacuaccucgccuccugcggcgacgacugcaaggucaaguucugggacacccgcaacgucaccgagcccgucaagacccucgaggagcacucccacugggucuggaacguccgcuacaaccacucccacgaccagcucguccucaccggcuccuccgacucccgcgucauccucuccaacauggucuccaucuccuccgagcccuucggccaccucgucgacgacgacgacaucuccgaccaggaggaccaccgcuccgaggagaaguccaaggagccccuccaggacaacgucaucgccaccuacgaggagcacgaggacuccgucuacgccgucgacugguccuccgccgaccccuggcucuucgccucccucuccuacgacggccgccucgucaucaaccgcgucccccgcgcccucaaguaccacauccuccucuga

SEQ ID NO: 51267 - RNA, 1104 nt, Artificial Sequence
  derived and/or modified sequence opt2 from TSSK1B__Homo_sapiens__NP_114417
auggacgacgccgccguccucaagcgccgcggcuaccuccucggcaucaaccucggcgagggcuccuacgccaaggucaaguccgccuacuccgagcgccucaaguucaacgucgccaucaagaucaucgaccgcaagaaggcccccgccgacuuccucgagaaguuccucccccgcgagaucgagauccucgccaugcucaaccacugcuccaucaucaagaccuacgagaucuucgagaccucccacggcaaggucuacaucgucauggagcucgccguccagggcgaccuccucgagcucaucaagacccgcggcgcccuccacgaggacgaggcccgcaagaaguuccaccagcucucccucgccaucaaguacugccacgaccucgacgucguccaccgcgaccucaagugcgacaaccuccuccucgacaaggacuucaacaucaagcucuccgacuucuccuucuccaagcgcugccuccgcgacgacuccggccgcauggcccucuccaagaccuucugcggcucccccgccuacgccgcccccgagguccuccagggcauccccuaccagcccaaggucuacgacaucuggucccucggcgucauccucuacaucauggucugcggcuccaugcccuacgacgacuccaacaucaagaagaugcuccgcauccagaaggagcaccgcgucaacuucccccgcuccaagcaccucaccggcgagugcaaggaccucaucuaccacaugcuccagcccgacgucaaccgccgccuccacaucgacgagauccucucccacugcuggaugcagcccaaggcccgcggcucccccuccgucgccaucaacaaggagggcgaguccucccgcggcaccgagccccucuggacccccgagcccggcuccgacaagaaguccgccaccaagcucgagcccgagggcgaggcccagccccaggcccagcccgagaccaagcccgagggcaccgccaugcagaugucccgccaguccgagauccucggcuuccccuccaagcccuccaccauggagaccgaggagggccccccccagcagccccccgagacccgcgcccaguga

SEQ ID NO: 51268 - RNA, 1077 nt, Artificial Sequence
  derived and/or modified sequence opt2 from TSSK2__Homo_sapiens__NP_443732
auggacgacgccaccguccuccgcaagaagggcuacaucgucggcaucaaccucggcaagggcuccuacgccaaggucaaguccgccuacuccgagcgccucaaguucaacgucgccgucaagaucaucgaccgcaagaagacccccaccgacuucgucgagcgcuuccucccccgcgagauggacauccucgccaccgucaaccacggcuccaucaucaagaccuacgagaucuucgagaccuccgacggccgcaucuacaucaucauggagcucggcguccagggcgaccuccucgaguucaucaagugccagggcgcccuccacgaggacgucgcccgcaagauguuccgccagcucuccuccgccgucaaguacugccacgaccucgacaucguccaccgcgaccucaagugcgagaaccuccuccucgacaaggacuucaacaucaagcucuccgacuucggcuucuccaagcgcugccuccgcgacuccaacggccgcaucauccucuccaagaccuucugcggcuccgccgccuacgccgcccccgagguccuccaguccauccccuaccagcccaaggucuacgacaucuggucccucggcgucauccucuacaucauggucugcggcuccaugcccuacgacgacuccgacauccgcaagaugcuccgcauccagaaggagcaccgcgucgacuucccccgcuccaagaaccucaccugcgagugcaaggaccucaucuaccgcaugcuccagcccgacgucucccagcgccuccacaucgacgagauccucucccacuccuggcuccagccccccaagcccaaggccaccuccuccgccuccuucaagcgcgagggcgagggcaaguaccgcgccgagugcaagcucgacaccaagaccggccuccgccccgaccaccgccccgaccacaagcucggcgccaagacccagcaccgccuccucgucguccccgagaacgagaaccgcauggaggaccgccucgccgagaccucccgcgccaaggaccaccacaucuccggcgccgaggucggcaaggccuccaccuga

SEQ ID NO: 51269 - RNA, 1017 nt, Artificial Sequence
  derived and/or modified sequence opt2 from TSSK4__Homo_sapiens__NP_001171668
augggcaagggcgacguccucgaggccgcccccaccaccaccgccuaccacucccucauggacgaguacggcuacgaggucggcaaggccaucggccacggcuccuacggcuccgucuacgaggccuucuacaccaagcagaaggucauggucgccgucaagaucaucuccaagaagaaggccuccgacgacuaccucaacaaguuccucccccgcgagauccaggucaugaagguccuccgccacaaguaccucaucaacuucuaccgcgccaucgaguccaccucccgcgucuacaucauccucgagcucgcccagggcggcgacguccucgaguggauccagcgcuacggcgccugcuccgagccccucgccggcaagugguucucccagcucacccucggcaucgccuaccuccacuccaaguccaucguccaccgccucaugcccucccucuccgccgccggccgcgaccucaagcucgagaaccuccuccucgacaagugggagaacgucaagaucuccgacuucggcuucgccaagaugguccccuccaaccagcccgucggcugcucccccuccuaccgccaggucaacugcuucucccaccucucccagaccuacugcggcuccuucgccuacgccugccccgagauccuccgcggccuccccuacaaccccuuccucuccgacaccugguccaugggcgucauccucuacacccucgucgucgcccaccuccccuucgacgacaccaaccucaagaagcuccuccgcgagacccagaaggaggucaccuuccccgccaaccacaccaucucccaggagugcaagaaccucauccuccagaugcuccgccaggccaccaagcgcgccaccauccucgacaucaucaaggacuccuggguccucaaguuccagcccgagcagcccacccacgagauccgccuccucgaggccaugugccagcuccacaacaccaccaagcagcaccagucccuccagaucaccaccuga

SEQ ID NO: 51270 - RNA, 966 nt, Artificial Sequence
  derived and/or modified sequence opt2 from TSTA3__Homo_sapiens__NP_003304
augggcgagccccagggcuccaugcgcauccucgucaccggcggcuccggccucgucggcaaggccauccagaaggucgucgccgacggcgccggccuccccggcgaggacugggucuucgucuccuccaaggacgccgaccucaccgacaccgcccagacccgcgcccucuucgagaagguccagcccacccacgucauccaccucgccgccauggucggcggccucuuccgcaacaucaaguacaaccucgacuucuggcgcaagaacguccacaugaacgacaacguccuccacuccgccuucgaggucggcgcccgcaaggucgucuccugccucuccaccugcaucuuccccgacaagaccaccuaccccaucgacgagaccaugauccacaacggccccccccacaacuccaacuucggcuacuccuacgccaagcgcaugaucgacguccagaaccgcgccuacuuccagcaguacggcugcaccuucaccgccgucauccccaccaacgucuucggcccccacgacaacuucaacaucgaggacggccacguccuccccggccucauccacaagguccaccucgccaaguccuccggcuccgcccucaccgucuggggcaccggcaacccccgccgccaguucaucuacucccucgaccucgcccagcucuucaucuggguccuccgcgaguacaacgaggucgagcccaucauccucuccgucggcgaggaggacgaggucuccaucaaggaggccgccgaggccgucgucgaggccauggacuuccacggcgaggucaccuucgacaccaccaaguccgacggccaguucaagaagaccgccuccaacuccaagcuccgcaccuaccuccccgacuuccgcuucacccccuucaagcaggccgucaaggagaccugcgccugguucaccgacaacuacgagcaggcccgcaaguga

SEQ ID NO: 51271 - RNA, 330 nt, Artificial Sequence
  derived and/or modified sequence opt2 from TSTD1__Homo_sapiens__NP_001106676
auggccggcgcccccaccgucucccuccccgagcuccgcucccuccucgccuccggccgcgcccgccucuucgacguccgcucccgcgaggaggccgccgccggcaccauccccggcgcccucaacauccccgucuccgagcucgaguccgcccuccagauggagcccgccgccuuccaggcccucuacuccgccgagaagcccaagcucgaggacgagcaccucgucuucuucugccagaugggcaagcgcggccuccaggccacccagcucgcccgcucccucggcuacaccggcuacggcgaggucuggcuccucgccggccgcuga

SEQ ID NO: 51272 - RNA, 894 nt, Artificial Sequence
  derived and/or modified sequence opt2 from TST__Homo_sapiens__NP_003303
augguccaccagguccucuaccgcgcccucgucuccaccaaguggcucgccgaguccauccgcaccggcaagcucggccccggccuccgcguccucgacgccuccugguacucccccggcacccgcgaggcccgcaaggaguaccucgagcgccacguccccggcgccuccuucuucgacaucgaggagugccgcgacaccgccucccccuacgagaugaugcuccccuccgaggccggcuucgccgaguacgucggccgccucggcaucuccaaccacacccacgucgucgucuacgacggcgagcaccucggcuccuucuacgccccccgcgucugguggauguuccgcgucuucggccaccgcaccgucuccguccucaacggcggcuuccgcaacuggcucaaggagggccaccccgucaccuccgagcccucccgccccgagcccgccgucuucaaggccacccucgaccgcucccuccucaagaccuacgagcagguccucgagaaccucgaguccaagcgcuuccagcucgucgacucccgcucccagggccgcuuccucggcaccgagcccgagcccgacgccgucggccucgacuccggccacauccgcggcgccgucaacaugcccuucauggacuuccucaccgaggacggcuucgagaagggccccgaggagcuccgcgcccucuuccagaccaagaaggucgaccucucccagccccucaucgccaccugccgcaagggcgucaccgccugccacgucgcccucgccgccuaccucugcggcaagcccgacgucgccgucuacgacggcuccugguccgagugguuccgccgcgccccccccgagucccgcgucucccagggcaaguccgagaaggccuga

SEQ ID NO: 51273 - RNA, 3966 nt, Artificial Sequence
  derived and/or modified sequence opt2 from TTBK1__Homo_sapiens__NP_115927
augcagugccucgccgccgcccucaaggacgagaccaacauguccggcggcggcgagcaggccgacauccuccccgccaacuacgucgucaaggaccgcuggaagguccucaagaagaucggcggcggcggcuucggcgagaucuacgaggccauggaccuccucacccgcgagaacgucgcccucaaggucgaguccgcccagcagcccaagcagguccucaagauggaggucgccguccucaagaagcuccagggcaaggaccacgucugccgcuucaucggcugcggccgcaacgagaaguucaacuacgucgucaugcagcuccagggccgcaaccucgccgaccuccgccgcucccagccccgcggcaccuucacccucuccaccacccuccgccucggcaagcagauccucgaguccaucgaggccauccacuccgucggcuuccuccaccgcgacaucaagcccuccaacuucgccaugggccgccuccccuccaccuaccgcaagugcuacaugcucgacuucggccucgcccgccaguacaccaacaccaccggcgacguccgccccccccgcaacgucgccggcuuccgcggcaccguccgcuacgccuccgucaacgcccacaagaaccgcgagaugggccgccacgacgaccucuggucccucuucuacaugcucgucgaguucgccgucggccagcuccccuggcgcaagaucaaggacaaggagcaggucggcaugaucaaggagaaguacgagcaccgcaugcuccucaagcacaugcccuccgaguuccaccucuuccucgaccacaucgccucccucgacuacuucaccaagcccgacuaccagcucaucauguccgucuucgagaacuccaugaaggagcgcggcaucgccgagaacgaggccuucgacugggagaaggccggcaccgacgcccuccucuccaccuccaccuccacccccccccagcagaacacccgccagaccgccgccauguucggcgucgucaacgucacccccguccccggcgaccuccuccgcgagaacaccgaggacguccuccagggcgagcaccucuccgaccaggagaacgccccccccauccuccccggccgccccuccgagggccucggccccuccccccaccucgucccccaccccggcggccccgaggccgaggucugggaggagaccgacgucaaccgcaacaagcuccgcaucaacaucggcaagucccccugcgucgaggaggagcagucccgcggcaugggcguccccuccucccccguccgcgccccccccgacucccccaccacccccguccgcucccuccgcuaccgccgcgucaacucccccgaguccgagcgccucuccaccgccgacggccgcgucgagcuccccgagcgccgcucccgcauggaccuccccggcucccccucccgccaggccugcuccucccagcccgcccagaugcucuccgucgacaccggccacgccgaccgccaggccuccggccgcauggacgucuccgccuccgucgagcaggaggcccucuccaacgccuuccgcuccgucccccucgccgaggaggaggacuucgacuccaaggagugggucaucaucgacaaggagaccgagcucaaggacuucccccccggcgccgagcccuccaccuccggcaccaccgacgaggagcccgaggagcuccgcccccuccccgaggagggcgaggagcgccgccgccucggcgccgagcccaccguccgcccccgcggccgcuccaugcaggcccucgccgaggaggaccuccagcaccuccccccccagccccuccccccccagcucucccagggcgacggccgcuccgagaccucccagccccccacccccggcucccccucccacuccccccuccacuccggcccccgcccccgccgccgcgaguccgaccccaccggcccccagcgccaggucuucuccgucgccccccccuucgaggucaacggccucccccgcgccgucccccucucccuccccuaccaggacuucaagcgcgaccucuccgacuaccgcgagcgcgcccgccuccucaaccgcguccgccgcgucggcuucucccacaugcuccucaccaccccccaggucccccucgcccccguccagccccaggccaacggcaaggaggaggaggaggaggaggaggaggacgaggaggaggaggaggaggacgaggaggaggaggaggaggaggaggaggaggaggaggaggaggaggaggaggaggaggaggaggaggaggccgccgccgccgucgcccucggcgagguccucggcccccgcuccggcuccuccuccgagggcuccgagcgcuccaccgaccgcucccaggagggcgcccccuccacccuccucgccgacgaccagaaggagucccgcggccgcgccuccauggccgacggcgaccucgagcccgaggagggcuccaagacccucguccucgucucccccggcgacaugaagaagucccccgucaccgccgagcucgcccccgaccccgaccucggcacccucgccgcccucaccccccagcacgagcgcccccagcccaccggcucccagcucgacgucuccgagcccggcacccucuccuccguccucaaguccgagcccaagccccccggccccggcgccggccucggcgccggcaccgucaccaccggcgucggcggcgucgccgucaccuccucccccuucaccaaggucgagcgcaccuucguccacaucgccgagaagacccaccucaacgucauguccuccggcggccaggcccuccgcuccgaggaguucuccgccggcggcgagcucggccucgagcucgccuccgacggcggcgccgucgaggagggcgcccgcgccccccucgagaacggccucgcccucuccggccucaacggcgccgagaucgagggcuccgcccucuccggcgccccccgcgagacccccuccgagauggccaccaacucccuccccaacggccccgcccucgccgacggccccgcccccgucuccccccucgagcccucccccgagaaggucgccaccaucuccccccgccgccacgccaugcccggcucccgcccccgcucccgcauccccguccuccucuccgaggaggacaccggcuccgagcccuccggcucccucuccgccaaggagcgcugguccaagcgcgcccgcccccagcaggaccucgcccgccucgucauggagaagcgccagggccgccuccuccuccgccucgccuccggcgccuccuccuccuccuccgaggagcagcgccgcgccuccgagacccucuccggcaccggcuccgaggaggacacccccgccuccgagcccgccgccgcccucccccgcaaguccggccgcgccgccgccacccgcucccgcaucccccgccccaucggccuccgcaugcccaugcccgucgccgcccagcagcccgccucccgcucccacggcgccgcccccgcccucgacaccgccaucaccucccgccuccagcuccagaccccccccggcuccgccaccgccgccgaccuccgccccaagcagccccccggccgcggccucggccccggccgcgcccaggccggcgcccgcccccccgccccccgcuccccccgccuccccgccuccaccuccgccgcccgcaacgccuccgccuccccccgcucccagucccucucccgccgcgagucccccucccccucccaccaggcccgccccggcgucccccccccccgcggcgucccccccgcccgcgcccagcccgacggcacccccucccccggcggcuccaagaagggcccccgcggcaagcuccaggcccagcgcgccaccaccaagggccgcgccggcggcgccgagggccgcgccggcgcccgcuga

SEQ ID NO: 51274 - RNA, 3735 nt, Artificial Sequence
  derived and/or modified sequence opt2 from TTBK2__Homo_sapiens__NP_775771
auguccggcggcggcgagcagcucgacauccucuccgucggcauccucgucaaggagcgcuggaagguccuccgcaagaucggcggcggcggcuucggcgagaucuacgacgcccucgacaugcucacccgcgagaacgucgcccucaaggucgaguccgcccagcagcccaagcagguccucaagauggaggucgccguccucaagaagcuccagggcaaggaccacgucugccgcuucaucggcugcggccgcaacgaccgcuucaacuacgucgucaugcagcuccagggccgcaaccucgccgaccuccgccgcucccagucccgcggcaccuucaccaucuccaccacccuccgccucggccgccagauccucgaguccaucgaguccauccacuccgucggcuuccuccaccgcgacaucaagcccuccaacuucgccaugggccgcuuccccuccaccugccgcaagugcuacaugcucgacuucggccucgcccgccaguucaccaacuccugcggcgacguccgccccccccgcgccgucgccggcuuccgcggcaccguccgcuacgccuccaucaacgcccaccgcaaccgcgagaugggccgccacgacgaccucuggucccucuucuacaugcucgucgaguucgucgucggccagcuccccuggcgcaagaucaaggacaaggagcaggucggcuccaucaaggagcgcuacgaccaccgccucaugcucaagcaccucccccccgaguucuccaucuuccucgaccacaucuccucccucgacuacuucaccaagcccgacuaccagcuccucaccuccgucuucgacaacuccaucaagaccuucggcgucaucgaguccgaccccuucgacugggagaagaccggcaacgacggcucccucaccaccaccaccaccuccaccaccccccagcuccacacccgccucacccccgccgccaucggcaucgccaacgccacccccauccccggcgaccuccuccgcgagaacaccgacgaggucuuccccgacgagcagcucuccgacggcgagaacggcauccccgucggcgucucccccgacaagcuccccggcucccucggccacccccgcccccaggagaaggacgucugggaggagauggacgccaacaagaacaagaucaagcucggcaucugcaaggccgccaccgaggaggagaacucccacggccaggccaacggccuccucaacgcccccucccucggcucccccauccgcguccgcuccgagaucacccagcccgaccgcgacaucccccucguccgcaagcuccgcuccauccacuccuucgagcucgagaagcgccucacccucgagcccaagcccgacaccgacaaguuccucgagaccugccucgagaagaugcagaaggacaccuccgccggcaaggaguccauccuccccgcccuccuccacaagcccugcguccccgccgucucccgcaccgaccacaucuggcacuacgacgaggaguaccuccccgacgccuccaagcccgccuccgccaacacccccgagcaggccgacggcggcggcuccaacggcuucaucgccgucaaccucuccuccugcaagcaggagaucgacuccaaggagugggucaucgucgacaaggagcaggaccuccaggacuuccgcaccaacgaggccgucggccacaagaccaccggcucccccuccgacgaggagcccgagguccuccagguccucgaggccuccccccaggacgagaagcuccagcucggccccugggccgagaacgaccaccucaagaaggagaccuccggcgucguccucgcccucuccgccgagggcccccccaccgccgccuccgagcaguacaccgaccgccucgagcuccagcccggcgccgccucccaguucaucgccgccacccccaccucccucauggaggcccaggccgagggcccccucaccgccaucaccaucccccgccccuccgucgccuccacccaguccaccuccggcuccuuccacugcggccagcagcccgagaagaaggaccuccagcccauggagcccaccgucgagcucuacuccccccgcgagaacuucuccggccucgucgucaccgagggcgagccccccuccggcggcucccgcaccgaccucggccuccagaucgaccacaucggccacgacaugcuccccaacauccgcgaguccaacaagucccaggaccucggccccaaggagcuccccgaccacaaccgccucgucguccgcgaguucgagaaccuccccggcgagaccgaggagaaguccauccuccucgaguccgacaacgaggacgagaagcucucccgcggccagcacugcaucgagaucuccucccuccccggcgaccucgucaucgucgagaaggaccacuccgccaccaccgagccccucgacgucaccaagacccagaccuucuccgucguccccaaccaggacaagaacaacgagaucaugaagcuccucaccgucggcaccuccgagaucuccucccgcgacaucgacccccacgucgagggccagaucggccaggucgccgagaugcagaagaacaagaucuccaaggacgacgacaucauguccgaggaccuccccggccaccagggcgaccucuccaccuuccuccaccaggagggcaagcgcgagaagaucaccccccgcaacggcgagcucuuccacugcgucuccgagaacgagcacggcgcccccacccgcaaggacaugguccgcuccuccuucgucacccgccacucccgcauccccguccucgcccaggagaucgacuccacccucgaguccuccucccccgucuccgccaaggagaagcuccuccagaagaaggccuaccagcccgaccucgucaagcuccucgucgagaagcgccaguucaaguccuuccucggcgaccucuccuccgccuccgacaagcuccucgaggagaagcucgccaccguccccgcccccuucugcgaggaggagguccucacccccuucucccgccucaccgucgacucccaccucucccgcuccgccgaggacuccuuccucucccccaucaucucccagucccgcaaguccaagaucccccgccccgucuccugggucaacaccgaccaggucaacuccuccaccuccucccaguucuucccccgccccccccccggcaagccccccacccgccccggcgucgaggcccgccuccgccgcuacaagguccucggcuccuccaacuccgacuccgaccucuucucccgccucgcccagauccuccagaacggcucccagaagccccgcuccaccacccagugcaagucccccggcuccccccacaaccccaagaccccccccaagucccccgucgucccccgccgcucccccuccgccuccccccgcuccuccucccucccccgcaccuccuccuccucccccucccgcgccggccgcccccaccacgaccagcgcuccuccuccccccaccucggccgcuccaaguccccccccucccacuccggcuccuccuccucccgccgcuccugccagcaggagcacugcaagcccuccaagaacggccucaagggcuccggcucccuccaccaccacuccgccuccaccaagaccccccagggcaaguccaagcccgccuccaagcucucccgcuga

SEQ ID NO: 51275 - RNA, 2118 nt, Artificial Sequence
  derived and/or modified sequence opt2 from TTC12__Homo_sapiens__NP_060338
auggacgccgacaaggagaaggaccuccagaaguuccucaagaacgucgacgagaucuccaaccucauccaggagaugaacuccgacgaccccgucguccagcagaaggccguccucgagaccgagaagcgccuccuccucauggaggaggaccaggaggaggacgagugccgcaccacccucaacaagaccaugaucucccccccccagaccgccaugaaguccgccgaggagaucaacuccgaggccuuccucgccuccgucgagaaggacgccaaggagcgcgccaagcgccgccgcgagaacaagguccucgccgacgcccucaaggagaagggcaacgaggccuucgccgagggcaacuacgagaccgccauccuccgcuacuccgagggccucgagaagcucaaggacaugaagguccucuacaccaaccgcgcccaggccuacaugaagcucgaggacuacgagaaggcccucgucgacugcgagugggcccucaagugcgacgagaagugcaccaaggccuacuuccacaugggcaaggccaaccucgcccucaagaacuacuccgucucccgcgagugcuacaagaagauccucgagaucaaccccaagcuccagacccaggucaagggcuaccucaaccaggucgaccuccaggagaaggccgaccuccaggagaaggaggcccacgagcuccucgacuccggcaagaacaccgccgucaccaccaagaaccuccucgagacccucuccaagcccgaccagaucccccucuucuacgccggcggcaucgagauccucaccgagaugaucaacgagugcaccgagcagacccucuuccgcaugcacaacggcuucuccaucaucuccgacaacgaggucauccgccgcugcuucuccaccgccggcaacgacgccgucgaggagauggucugcgucuccguccucaagcucuggcaggccgucugcucccgcaacgaggagaaccagcgcguccucgucauccaccacgaccgcgcccgccuccucgccgcccuccucuccuccaagguccucgccauccgccagcaguccuucgcccuccuccuccaccucgcccagaccgaguccggccgcucccucaucaucaaccaccucgaccucacccgccuccucgaggcccucgucuccuuccucgacuucuccgacaaggaggccaacaccgccaugggccucuucaccgaccucgcccucgaggagcgcuuccaggucugguuccaggccaaccuccccggcguccuccccgcccucaccggcguccucaagaccgaccccaaggucuccuccuccuccgcccucugccagugcaucgccaucaugggcaaccucuccgccgagcccaccacccgccgccacauggccgccugcgaggaguucggcgacggcugccucucccuccucgcccgcugcgaggaggacgucgaccucuuccgcgaggucaucuacacccuccucggccucaugaugaaccucugccuccaggcccccuucgucuccgaggucugggccgucgaggucucccgccgcugccucucccuccucaacucccaggacggcggcauccucacccgcgccgccggcguccucucccgcacccucuccuccucccucaagaucgucgaggaggcccuccgcgccggcgucgucaagaagaugaugaaguuccucaagaccggcggcgagaccgccucccgcuacgccaucaagauccucgccaucugcaccaacuccuaccacgaggcccgcgaggaggucauccgccucgacaagaagcucuccgucaugaugaagcuccucuccuccgaggacgagguccucgucggcaacgccgcccucugccucggcaacugcauggagguccccaacgucgccuccucccuccucaagaccgaccuccuccagguccuccucaagcucgccggcuccgacacccagaagaccgccguccaggucaacgccggcaucgcccucggcaagcucugcaccgccgagccccgcuucgccgcccagcuccgcaagcuccacggccucgagauccucaacuccaccaugaaguacaucuccgacuccuga

SEQ ID NO: 51276 - RNA, 3426 nt, Artificial Sequence
  derived and/or modified sequence opt2 from TTC17__Homo_sapiens__NP_060729
auggccgccgccgucggcguccgcggccgcuacgagcucccccccugcuccggccccggcuggcuccucucccucuccgcccuccucuccgucgccgcccgcggcgccuucgccaccacccacugggucgucaccgaggacggcaagauccagcagcaggucgacucccccaugaaccucaagcacccccacgaccucgucauccucaugcgccaggaggccaccgucaacuaccucaaggagcucgagaagcagcucgucgcccagaagauccacaucgaggagaacgaggaccgcgacaccggccucgagcagcgccacaacaaggaggaccccgacugcaucaaggccaaggucccccucggcgaccucgaccucuacgacggcaccuacaucacccucgaguccaaggacaucucccccgaggacuacaucgacaccgagucccccgucccccccgaccccgagcagcccgacugcaccaagauccucgagcuccccuacuccauccacgccuuccagcaccuccgcggcguccaggagcgcgucaaccucuccgccccccuccuccccaaggaggaccccaucuucaccuaccucuccaagcgccucggccgcuccaucgacgacaucggccaccucauccacgagggccuccagaagaacaccuccuccuggguccucuacaacauggccuccuucuacuggcgcaucaagaacgagcccuaccaggucgucgagugcgccaugcgcgcccuccacuucuccucccgccacaacaaggacaucgcccucgucaaccucgccaacguccuccaccgcgcccacuucuccgccgacgccgccgucgucguccacgccgcccucgacgacuccgacuucuucaccuccuacuacacccucggcaacaucuacgccaugcucggcgaguacaaccacuccguccucugcuacgaccacgcccuccaggcccgccccggcuucgagcaggccaucaagcgcaagcacgccguccucugccagcagaagcucgagcagaagcucgaggcccagcaccgcucccuccagcgcacccucaacgagcucaaggaguaccagaagcagcacgaccacuaccuccgccagcaggagauccucgagaagcacaagcucauccaggaggagcagauccuccgcaacaucauccacgagacccagauggccaaggaggcccagcucggcaaccaccagaucugccgccucgucaaccagcagcacucccuccacugccagugggaccagcccguccgcuaccaccgcggcgacaucuucgagaacgucgacuacguccaguucggcgaggacuccuccaccuccuccaugauguccgucaacuucgacguccaguccaaccaguccgacaucaacgacuccgucaaguccucccccgucgcccacuccauccucuggaucuggggccgcgacuccgacgccuaccgcgacaagcagcacauccucuggcccaagcgcgccgacugcaccgaguccuacccccgcguccccgucggcggcgagcuccccaccuacuuccucccccccgagaacaagggccuccgcauccacgagcucuccuccgacgacuacuccaccgaggaggaggcccagacccccgacugcuccaucaccgacuuccgcaagucccacacccucuccuaccucgucaaggagcucgagguccgcauggaccucaaggccaagaugcccgacgaccacgcccgcaagauccuccucucccgcaucaacaacuacaccauccccgaggaggagaucggcuccuuccucuuccacgccaucaacaagcccaacgcccccaucuggcucauccucaacgaggccggccucuacuggcgcgccgucggcaacuccaccuucgccaucgccugccuccagcgcgcccucaaccucgccccccuccaguaccaggacgucccccucgucaaccucgccaaccuccucauccacuacggccuccaccucgacgccaccaagcuccuccuccaggcccucgccaucaacuccuccgagccccucaccuuccucucccucggcaacgccuaccucgcccucaagaacaucuccggcgcccucgaggccuuccgccaggcccucaagcucaccaccaagugccccgagugcgagaacucccucaagcucauccgcugcaugcaguucuaccccuuccucuacaacaucaccuccuccgucugcuccggcaccgucgucgaggaguccaacggcuccgacgagauggagaacuccgacgagaccaagauguccgaggagauccucgcccucgucgacgaguuccagcaggccuggccccucgagggcuucggcggcgcccucgagaugaagggccgccgccucgaccuccagggcauccgcguccucaagaagggcccccaggacggcgucgcccgcuccuccugcuacggcgacugccgcuccgaggacgacgaggccaccgaguggaucaccuuccaggucaagcgcgucaagaagcccaagggcgaccacaagaagacccccggcaagaaggucgagaccggccagaucgagaacggccaccgcuaccaggccaaccucgagaucaccggccccaaggucgccucccccggcccccagggcaagaagcgcgacuaccagcgccucggcuggcccucccccgacgagugccucaagcuccgcugggucgagcucaccgccaucgucuccaccuggcucgccgucuccuccaagaacaucgacaucaccgagcacaucgacuucgccacccccauccagcagcccgccauggagccccucugcaacggcaaccuccccaccuccaugcacacccucgaccaccuccacggcgucuccaaccgcgccucccuccacuacaccggcgagucccagcucaccgagguccuccagaaccucggcaaggaccaguacccccagcagucccucgagcagaucggcacccgcaucgccaagguccucgagaagaaccagaccuccuggguccucuccuccauggccgcccucuacuggcgcgucaagggccagggcaagaaggccaucgacugccuccgccaggcccuccacuacgccccccaccagaugaaggacgucccccucaucucccucgccaacauccuccacaacgccaagcucuggaacgacgccgucaucgucgccaccauggccgucgagaucgccccccacuucgccgucaaccacuucacccucggcaacgucuacgucgccauggaggaguucgagaaggcccucgucugguacgaguccacccucaagcuccagcccgaguucguccccgccaagaaccgcauccagaccauccagugccaccucaugcucaagaagggccgccgcucccccuga

SEQ ID NO: 51277 - RNA, 1143 nt, Artificial Sequence
  derived and/or modified sequence opt2 from TTC19__Homo_sapiens__NP_060245
auguuccgccuccucuccuggucccucggccgcggcuuccuccgcgccgccggccgccgcugccgcggcugcuccgcccgccuccuccccggccucgccggcggccccggccccgagguccaggucccccccucccgcgucgccccccacggccgcggccccggccuccucccccuccucgccgcccucgccugguucucccgccccgccgccgccgaggaggaggagcagcagggcgccgacggcgccgccgccgaggacggcgccgacgaggccgaggccgagaucauccagcuccucaagcgcgccaagcucuccaucaugaaggacgagcccgaggaggccgagcucauccuccacgacgcccuccgccucgccuaccagaccgacaacaagaaggccaucaccuacaccuacgaccucauggccaaccucgccuucauccgcggccagcucgagaacgccgagcagcucuucaaggccaccauguccuaccuccucggcggcggcaugaagcaggaggacaacgccaucaucgagaucucccucaagcucgccuccaucuacgccgcccagaaccgccaggaguucgccgucgccggcuacgaguucugcaucuccacccucgaggagaagaucgagcgcgagaaggagcucgccgaggacaucauguccgucgaggagaaggccaacacccaccuccuccucggcaugugccucgacgccugcgcccgcuaccuccucuucuccaagcagcccucccaggcccagcgcauguacgagaaggcccuccagaucuccgaggagauccagggcgagcgccacccccagaccaucguccucauguccgaccucgccaccacccucgacgcccagggccgcuucgacgaggccuacaucuacaugcagcgcgccuccgaccucgcccgccagaucaaccaccccgagcuccacaugguccucuccaaccucgccgccguccucaugcaccgcgagcgcuacacccaggccaaggagaucuaccaggaggcccucaagcaggccaagcucaagaaggacgagaucuccguccagcacauccgcgaggagcucgccgagcucuccaagaagucccgcccccucaccaacuccgucaagcucuga

SEQ ID NO: 51278 - RNA, 879 nt, Artificial Sequence
  derived and/or modified sequence opt2 from TTC1__Homo_sapiens__NP_001269429
augggcgagaaguccgagaacugcggcguccccgaggaccuccucaacggccucaaggucaccgacacccaggaggccgagugcgccggcccccccguccccgaccccaagaaccagcacucccaguccaagcuccuccgcgacgacgaggcccaccuccaggaggaccagggcgaggaggagugcuuccacgacugcuccgccuccuucgaggaggagcccggcgccgacaaggucgagaacaaguccaacgaggacgucaacuccuccgagcucgacgaggaguaccucaucgagcucgagaagaacauguccgacgaggagaagcagaagcgccgcgaggaguccacccgccucaaggaggagggcaacgagcaguucaagaagggcgacuacaucgaggccgaguccuccuacucccgcgcccucgagaugugccccuccugcuuccagaaggagcgcuccauccucuucuccaaccgcgccgccgcccgcaugaagcaggacaagaaggagauggccaucaacgacugcuccaaggccauccagcucaaccccuccuacauccgcgccauccuccgccgcgccgagcucuacgagaagaccgacaagcucgacgaggcccucgaggacuacaaguccauccucgagaaggaccccuccauccaccaggcccgcgaggccugcaugcgccuccccaagcagaucgaggagcgcaacgagcgccucaaggaggagaugcucggcaagcucaaggaccucggcaaccucguccuccgccccuucggccucuccaccgagaacuuccagaucaagcaggacuccuccaccggcuccuacuccaucaacuucguccagaaccccaacaacaaccgcuga

SEQ ID NO: 51279 - RNA, 3951 nt, Artificial Sequence
  derived and/or modified sequence opt2 from TTC21B__Homo_sapiens__NP_079029
auggacucccaggagcucaagacccucaucaacuacuacugccaggagcgcuacuuccaccacguccuccucgucgccuccgagggcaucaagcgcuacggcuccgaccccgucuuccgcuucuaccacgccuacggcacccucauggagggcaagacccaggaggcccuccgcgaguucgaggccaucaagaacaagcaggacgucucccucugcucccuccucgcccucaucuacgcccacaagaugucccccaaccccgaccgcgaggccauccucgaguccgacgcccgcgucaaggagcagcgcaagggcgccggcgagaaggcccucuaccacgccggccucuuccucuggcacaucggccgccacgacaaggcccgcgaguacaucgaccgcaugaucaagaucuccgacggcuccaagcagggccacguccucaaggccuggcucgacaucacccgcggcaaggagcccuacaccaagaaggcccucaaguacuucgaggagggccuccaggacggcaacgacaccuucgcccuccucggcaaggcccagugccucgagaugcgccagaacuacuccggcgcccucgagaccgucaaccagaucaucgucaacuuccccuccuuccuccccgccuucgucaagaagaugaagcuccagcucgcccuccaggacugggaccagaccgucgagaccgcccagcgccuccuccuccaggacucccagaacgucgaggcccuccgcaugcaggcccucuacuacgucugccgcgagggcgacaucgagaaggccuccaccaagcucgagaaccucggcaacacccucgacgccauggagccccagaacgcccagcucuucuacaacaucacccucgccuucucccgcaccugcggccgcucccagcucauccuccagaagauccagacccuccucgagcgcgccuucucccucaacccccagcaguccgaguucgccaccgagcucggcuaccagaugauccuccagggccgcgucaaggaggcccucaagugguacaagaccgccaugacccucgacgagaccuccgucuccgcccucgucggcuucauccagugccagcucaucgagggccagcuccaggacgccgaccagcagcucgaguuccucaacgagauccagcaguccaucggcaaguccgccgagcucaucuaccuccacgccguccucgccaugaagaagaacaagcgccaggaggaggucaucaaccuccucaacgacguccucgacacccacuucucccagcucgagggccucccccucggcauccaguacuucgagaagcucaaccccgacuuccuccucgagaucgucauggaguaccucuccuucugccccaugcagcccgccucccccggccagccccucugcccccuccuccgccgcugcaucuccguccucgagaccgucguccgcaccguccccggccuccuccagaccgucuuccucaucgccaaggucaaguaccucuccggcgacaucgaggccgccuucaacaaccuccagcacugccucgagcacaaccccuccuacgccgacgcccaccuccuccucgcccaggucuaccucucccaggagaaggucaagcucugcucccagucccucgagcucugccucuccuacgacuucaagguccgcgacuacccccucuaccaccucaucaaggcccagucccagaagaagaugggcgagaucgccgacgccaucaagacccuccacauggccaugucccuccccggcaugaagcgcaucggcgccuccaccaaguccaaggaccgcaagaccgaggucgacaccucccaccgccucuccaucuuccucgagcucaucgacguccaccgccucaacggcgagcagcacgaggccaccaagguccuccaggacgccauccacgaguucuccggcaccuccgaggagguccgcgucaccaucgccaacgccgaccucgcccucgcccagggcgacaucgagcgcgcccucuccauccuccagaacgucaccgccgagcagcccuacuucaucgaggcccgcgagaagauggccgacaucuaccucaagcaccgcaaggacaagaugcucuacaucaccugcuuccgcgagaucgccgagcgcauggccaacccccgcuccuuccuccuccucggcgacgccuacaugaacauccucgagcccgaggaggccaucgucgccuacgagcaggcccucaaccagaaccccaaggacggcacccucgccuccaagaugggcaaggcccucaucaagacccacaacuacuccauggccaucaccuacuacgaggccgcccucaagaccggccagaagaacuaccucugcuacgaccucgccgagcuccuccucaagcucaagugguacgacaaggccgagaagguccuccagcacgcccucgcccacgagcccgucaacgagcucuccgcccucauggaggacggccgcugccagguccuccucgccaaggucuacuccaagauggagaagcucggcgacgccaucaccgcccuccagcaggcccgcgagcuccaggcccgcguccucaagcgcguccagauggagcagcccgacgccguccccgcccagaagcaccucgccgccgagaucugcgccgagaucgccaagcacuccgucgcccagcgcgacuacgagaaggccaucaaguucuaccgcgaggcccucguccacugcgagaccgacaacaagaucaugcucgagcucgcccgccucuaccucgcccaggacgaccccgacuccugccuccgccagugcgcccuccuccuccaguccgaccaggacaacgaggccgccaccaugaugauggccgaccucauguuccgcaagcaggacuacgagcaggccgucuuccaccuccagcagcuccucgagcgcaagcccgacaacuacaugacccucucccgccucaucgaccuccuccgccgcugcggcaagcucgaggacgucccccgcuucuucuccauggccgagaagcgcaacucccgcgccaagcucgagcccggcuuccaguacugcaagggccucuaccucugguacaccggcgagcccaacgacgcccuccgccacuucaacaaggcccgcaaggaccgcgacuggggccagaacgcccucuacaacaugaucgagaucugccucaaccccgacaacgagaccgucggcggcgaggucuucgagaaccucgacggcgaccucggcaacuccaccgagaagcaggaguccguccagcucgccguccgcaccgccgagaagcuccucaaggagcucaagccccagaccguccagggccacguccagcuccgcaucauggagaacuacugccucauggccaccaagcagaaguccaacgucgagcaggcccucaacaccuucaccgagaucgccgccuccgagaaggagcacauccccgcccuccucggcauggccaccgccuacaugauccucaagcagaccccccgcgcccgcaaccagcucaagcgcaucgccaagaugaacuggaacgccaucgacgccgaggaguucgagaaguccuggcuccuccucgccgacaucuacauccaguccgccaaguacgacauggccgaggaccuccucaagcgcugccuccgccacaaccgcuccugcugcaaggccuacgaguacaugggcuacaucauggagaaggagcaggccuacaccgacgccgcccucaacuacgagauggccuggaaguacuccaaccgcaccaaccccgccgucggcuacaagcucgccuucaacuaccucaaggccaagcgcuacgucgacuccaucgacaucugccaccagguccucgaggcccaccccaccuaccccaagauccgcaaggacauccucgacaaggcccgcgccucccuccgccccuga

SEQ ID NO: 51280 - RNA, 7446 nt, Artificial Sequence
  derived and/or modified sequence opt2 from TTC28__Homo_sapiens__NP_001138890
auggagcagucccccccccccgcccccgagcccacccagggccccacccccgcccgcucccgccgccgccgcgagcccgaguccccccccgccuccgcccccaucccccucuucggcgccgacaccaucggccagcgcucccccgacggccccguccucuccaaggccgaguucgucgagaagguccgccaguccaaccaggccugccacgacggcgacuuccacaccgccaucguccucuacaacgaggcccucgccgucgacccccagaacugcauccucuacuccaaccgcuccgccgccuacaugaagauccagcaguacgacaaggcccucgacgacgccaucaaggcccgccuccucaaccccaaguggcccaaggccuacuuccgccagggcgucgcccuccaguaccucggccgccacgccgacgcccucgccgccuucgccuccggccucgcccaggaccccaagucccuccagcuccucgucggcauggucgaggccgccaugaagucccccaugcgcgacucccucgagcccaccuaccagcagcuccagaagaugaagcucgacaagucccccuucgucgucgucuccgucgucggccaggagcuccucaccgccggccaccacggcgccuccgucgucguccucgaggccgcccucaagaucggcaccugcucccucaagcuccgcggcuccgucuucuccgcccucuccuccgccuacuggucccucggcaacaccgagaaguccaccggcuacaugcagcaggaccucgacgucgccaagacccucggcgaccagaccggcgagugccgcgcccacggcaaccucggcuccgccuucuucuccaagggcaacuaccgcgaggcccucaccaaccaccgccaccagcucguccucgccaugaagcucaaggaccgcgaggccgccuccuccgcccucuccucccucggccacgucuacaccgccaucggcgacuaccccaacgcccucgccucccacaagcagugcguccuccucgccaagcaguccaaggacgagcucuccgaggcccgcgagcucggcaacaugggcgccgucuacaucgccaugggcgacuucgagaacgccguccagugccacgagcagcaccucaagaucgccaaggaccucggcaacaagcgcgaggaggcccgcgccuacuccaaccucggcuccgccuaccacuaccgccgcaacuucgacaaggccauguccuaccacaacuacguccucgagcucgcccaggagcucauggagaaggccaucgagaugcgcgccuacgccggccucggccacgccgcccgcugcaugcaggaccucgagcgcgccaagcaguaccacgagcagcagcucggcaucgccgaggaccucaaggaccgcgccgccgagggccgcgccuccuccaaccucggcaucauccaccagaugaagggcgacuacgacaccgcccucaagcuccacaagacccaccucugcaucgcccaggagcucuccgacuacgccgcccagggccgcgccuacggcaacaugggcaacgccuacaacgcccucggcauguacgaccaggccgucaaguaccaccgccaggagcuccagaucuccauggaggucaacgaccgcgccucccaggccuccacccacggcaaccucgccgucgccuaccaggcccucggcgcccacgaccgcgcccuccagcacuaccagaaccaccucaacaucgcccgcgagcuccgcgacauccaguccgaggcccgcgcccucuccaaccucggcaacuuccacugcucccgcggcgaguacguccaggccgcccccuacuacgagcaguaccuccgccucgcccccgaccuccaggacauggagggcgagggcaaggucugccacaaccucggcuacgcccacuacugccucggcaacuaccaggaggccgucaaguacuacgagcaggaccucgcccucgccaaggaccuccacgacaagcucucccaggccaaggccuacugcaaccucggccucgccuucaaggcccuccucaacuucuccaaggccgaggagugccagaaguaccuccucucccucgcccagucccucaacaacucccaggccaaguuccgcgcccucggcaaccucggcgacaucuucaucugcaagaaggacaucaacggcgccaucaaguucuacgagcagcagcucggccucgcccaccaggucaaggaccgccgccucgaggccuccgccuacgccgcccucggcaccgccuaccgcaugauccagaaguacgacaaggcccucggcuaccacacccaggagcucgaggucuaccaggagcucuccgaccuccccggcgagugccgcgcccacggccaccucgccgccgucuacauggcccucggcaaguacaccauggccuucaagugcuacgaggagcagcucgaccucggccagaagcucaaggaccccucccucgaggcccaggucuacggcaacaugggcaucaccaagaugaacaugaacgucauggaggaggccaucggcuacuucgagcagcagcucgccaugcuccagcagcucuccggcaacgaguccguccucgaccgcggccgcgccuacggcaaccucggcgacugcuacgaggcccucggcgacuacgaggaggccaucaaguacuacgagcaguaccucuccgucgcccagucccucaaccgcaugcaggaccaggccaaggccuaccgcggccucggcaacggccaccgcgccaugggcucccuccagcaggcccucgucugcuucgagaagcgccucgucgucgcccacgagcucggcgaggccuucaacaaggcccaggccuacggcgagcucggcucccuccacucccagcucggcaacuacgagcaggccaucuccugccucgagcgccagcucaacaucgcccgcgacaugaaggaccgcgcccucgaguccgacgccgccugcggccucggcggcgucuaccagcagaugggcgaguacgacaccgcccuccaguaccaccagcucgaccuccagaucgccgaggagaccaacaaccccaccugccagggccgcgccuacggcaaccucggccucaccuacgagucccucggcaccuucgagcgcgccgucgucuaccaggagcagcaccucuccaucgccgcccagaugaacgaccucgccgccaagaccgucuccuacuccucccucggccgcacccaccacgcccuccagaacuacucccaggccgucauguaccuccaggagggccuccgccucgccgagcagcucggccgccgcgaggacgaggccaagauccgccacggccucggccucucccucugggccuccggcaaccucgaggaggcccagcaccagcucuaccgcgccuccgcccucuucgagaccauccgccacgaggcccagcucuccaccgacuacaagcucucccucuucgaccuccagaccuccuccuaccaggcccuccagcgcguccucgucucccucggccaccacgacgaggcccucgccgucgccgagcgcggccgcacccgcgccuucgccgaccuccucgucgagcgccagaccggccagcaggacuccgaccccuacucccccgucaccaucgaccagauccucgagauggucaacggccagcgcggccucguccucuacuacucccucgccgccggcuaccucuacuccuggcuccucgcccccggcgccggcaucgucaaguuccacgagcacuaccucggcgagaacaccgucgagaacuccuccgacuuccaggccuccuccuccgucacccuccccaccgccaccggcuccgcccucgagcagcacaucgccuccguccgcgaggcccucggcgucgagucccacuacucccgcgccugcgccuccuccgagaccgaguccgaggccggcgacaucauggaccagcaguucgaggagaugaacaacaagcucaacuccgucaccgaccccaccggcuuccuccgcaugguccgccgcaacaaccucuucaaccgcuccugccaguccaugaccucccucuucuccaacaccgucucccccacccaggacggcaccuccucccucccccgccgccaguccuccuucgccaagcccccccuccgcgcccucuacgaccuccucaucgcccccauggagggcggccucaugcacuccuccggccccgucggccgccaccgccagcucauccucguccucgagggcgagcucuaccucauccccuucgcccuccucaagggcuccuccuccaacgaguaccucuacgagcgcuucggccuccucgccguccccuccauccgcucccucuccguccaguccaagucccaccuccgcaagaacccccccaccuacuccuccuccaccuccauggccgccgucaucggcaaccccaagcuccccuccgccgucauggaccgcuggcucuggggccccaugcccuccgccgaggaggaggccuacauggucuccgagcuccucggcugccagccccucgucggcuccgucgccaccaaggagcgcgucauguccgcccucacccaggccgagugcguccacuucgccacccacaucuccuggaagcucuccgcccucguccucacccccuccauggacggcaaccccgccuccuccaaguccuccuucggccaccccuacaccauccccgagucccuccgcguccaggacgacgccuccgacggcgaguccaucuccgacugccccccccuccaggagcuccuccucaccgccgccgacguccucgaccuccagcuccccgucaagcucgucguccucggcuccucccaggaguccaacuccaaggucaccgccgacggcgucaucgcccucacccgcgccuuccucgccgccggcgcccagugcguccucgucucccucuggcccguccccgucgccgccuccaagauguucauccacgccuucuacuccucccuccucaacggccucaaggccuccgccgcccucggcgaggccaugaaggucguccaguccuccaaggccuucucccaccccuccaacugggccggcuucaugcucaucggcuccgacgucaagcucaacucccccuccucccucaucggccaggcccucaccgagauccuccagcaccccgagcgcgcccgcgacgcccuccgcguccuccuccaccucgucgagaagucccuccagcgcauccagaacggccagcgcaacgccauguacaccucccagcaguccgucgagaacaaggucggcggcauccccggcuggcaggcccuccucaccgccgucggcuuccgccucgacccccccaccuccggccuccccgccgccgucuucuuccccaccuccgaccccggcgaccgccuccagcagugcuccuccacccuccagucccuccucggccuccccaaccccgcccuccaggcccucugcaagcucaucaccgccuccgagaccggcgagcagcucaucucccgcgccgucaagaacauggucggcaugcuccaccagguccucguccagcuccaggccggcgagaaggagcaggaccucgccuccgcccccauccaggucuccaucuccguccagcucuggcgccuccccggcugccacgaguuccucgccgcccucggcuucgaccucugcgaggucggccaggaggaggucauccucaagaccggcaagcaggccaaccgccgcaccguccacuucgcccuccagucccuccucucccucuucgacuccaccgagcuccccaagcgccucucccucgacuccuccuccucccucgagucccucgccuccgcccaguccgucuccaacgcccucccccucggcuaccagcagccccccuucucccccaccggcgccgacuccaucgccuccgacgccaucuccgucuacucccucuccuccaucgccuccuccauguccuucgucuccaagcccgagggcggcuccgagggcggcggccccggcggccgccaggaccacgaccgcuccaagaacgccuaccuccagcgcuccacccucccccgcucccagcuccccccccagacccgccccgccggcaacaaggacgaggaggaguacgagggcuucuccaucaucuccaacgagccccucgccaccuaccaggagaaccgcaacaccugcuucucccccgaccacaagcagccccagcccggcaccgccggcggcaugcgcgucuccgucuccuccaagggcuccaucuccacccccaacucccccgucaagaugacccucauccccucccccaacucccccuuccagaaggucggcaagcucgccuccuccgacaccggcgaguccgaccaguccuccaccgagaccgacuccaccgucaagucccaggaggaguccaaccccaagcucgacccccaggagcucgcccagaagauccucgaggagacccagucccaccucaucgccgucgagcgccuccagcgcuccggcggccaggucuccaaguccaacaaccccgaggacggcguccaggcccccuccuccaccgccgucuuccgcgccuccgagaccuccgccuucucccgccccguccucucccaccagaagucccagcccucccccgucaccgucaagcccaagccccccgcccgcuccuccucccuccccaaggucuccuccggcuacuccucccccaccaccuccgagauguccaucaaggacucccccucccagcacuccggccgccccucccccggcugcgacucccagaccucccagcucgaccagccccucuucaagcucaaguaccccuccucccccuacuccgcccacaucuccaaguccccccgcaacaugucccccuccuccggccaccagucccccgccggcuccgcccccucccccgcccucuccuacuccuccgccggcuccgcccgcuccucccccgccgacgcccccgacaucgacaagcucaagauggccgccaucgacgagaagguccaggccguccacaaccucaagauguucuggcaguccaccccccagcacuccaccggccccaugaagaucuuccgcggcgcccccggcaccaugaccuccaagcgcgacguccucucccuccucaaccucuccccccgccacaacaagaaggaggagggcgucgacaagcucgagcucaaggagcucucccuccagcagcacgacggcgccccccccaaggccccccccaacggccacuggcgcaccgagaccaccucccucggcucccucccccuccccgccggcccccccgccaccgcccccgcccgcccccuccgccuccccuccggcaacggcuacaaguuccucucccccggccgcuucuuccccuccuccaagugcuga

SEQ ID NO: 51281 - RNA, 1506 nt, Artificial Sequence
  derived and/or modified sequence opt2 from TTC29__Homo_sapiens__NP_001287690
augauccccauguucaccgucacccucgaggacuccggcacccucuggaagucccuccacuccuccuccgaguccgagaugaccacccuccccccccuccccaugacccgccccaagcucaccgcccucgcccgccagaagcuccccugcuccucccgcaagaucccccgcucccagcucaucaaggagaaggacgacaucgaccacuaccucgaggucaacuucaagggccucuccaaggaggaggucgccgccuaccgcaacuccuacaagaagaacaucugcgucgacaugcuccgcgacggcuaccacaaguccuucaccgagcucuucgcccucauggagcgcugggacgcccuccgcgaggccgcccgcguccgcucccucuucuggcuccagaagccccucgaggagcagcccgacaagcucgacuaccucuaccacuaccucacccgcgccgaggacgccgagcgcaaggaguccuucgaggacguccacaacaaccucuacgcccucgccugcuacuucaacaacuccgaggacaaguggguccgcaaccacuucuacgagcgcugcuucaagaucgcccagcucaucaagaucgacugcggcaagaaggaggccgaggcccacaugcacaugggccuccucuacgaggaggacggccagcuccucgaggccgccgagcacuacgaggccuuccaccagcucacccagggccgcaucuggaaggacgagaccggccgcucccucaaccuccucgccugcgagucccuccuccgcaccuaccgccuccucuccgacaagaugcucgagaacaaggaguacaagcaggccaucaagauccucaucaaggccuccgagaucgccaaggagggcuccgacaagaagauggaggccgaggccuccuacuaccucggccucgcccaccucgccgccgaggaguacgagaccgcccucaccguccucgacaccuacugcaagaucuccaccgaccucgacgacgaccucucccucggccgcggcuacgaggccaucgccaagguccuccagucccagggcgagaugaccgaggccaucaaguaccucaagaaguucgucaagaucgcccgcaacaacuuccagucccucgaccucguccgcgccuccaccaugcucggcgacaucuacaacgagaagggcuacuacaacaaggccuccgagugcuuccagcaggccuucgacaccaccgucgagcucauguccaugccccucauggacgagaccaagguccacuacggcaucgccaaggcccaccagaugaugcucaccgucaacaacuacaucgaguccgccgaccucaccucccucaacuaccuccucuccuggaaggagucccgcggcaacaucgagcccgaccccgucaccgaggaguuccgcggcuccaccgucgaggccgucucccagaacuccgagcgccucgaggagcucucccgcuuccccggcgaccagaagaacgagaccuga

SEQ ID NO: 51282 - RNA, 4695 nt, Artificial Sequence
  derived and/or modified sequence opt2 from TTC37__Homo_sapiens__NP_055454
auguccuccaaggaggucaagaccgcccucaaguccgcccgcgacgccauccgcaacaaggaguacaaggaggcccucaagcacugcaagaccguccucaagcaggagaagaacaacuacaacgccugggucuucaucggcgucgccgccgccgagcucgagcagcccgaccaggcccaguccgccuacaagaaggccgccgagcucgagcccgaccagcuccucgccuggcagggccucgccaaccucuacgagaaguacaaccacaucaacgccaaggacgaccuccccggcgucuaccagaagcuccucgaccucuacgaguccgucgacaagcagaaguggugcgacgucugcaagaagcucgucgaccucuacuaccaggagaagaagcaccucgaggucgcccgcaccuggcacaagcucaucaagacccgccaggagcagggcgccgagaacgaggagcuccaccagcucuggcgcaagcucacccaguuccucgccgaguccaccgaggaccagaacaacgagacccagcagcuccucuucaccgccuucgagaacgcccucggccucuccgacaagauccccuccgaggaccaccagguccucuaccgccacuucauccagucccucuccaaguucccccacgaguccgcccgccucaagaaggccugcgagggcaugaucaacaucuaccccaccguccaguacccccucgagguccucugccuccaccucaucgaguccggcaaccucaccgacgagggccagcaguacugcugccgccucgucgagauggacuccaaguccggccccggccucaucggccucggcaucaaggcccuccaggacaagaaguacgaggacgccguccgcaaccucaccgagggccucaaggagucccccgucugcaccuccggcugguaccaccucgccgaggcccaggucaagaugcaccgccccaaggaggccguccucuccugcucccaggcccucaagaucgucgacaaccucggcgccuccggcaacucccucuaccagcgcaaccucugccuccaccucaaggccgaggcccucaucaagcucuccgacuacgacuccuccgaggaggccauccgcacccucgaccagaucuccgacgccgacaacauccccggccuccucguccucaagucccucgccuaccgcaacaagggcuccuucgacgaggccgccaagaucauggaggaccuccucuccuccuaccccgaccucgccgagguccacgcccucgaggcccucauccacuucaccaagaaggacuaccuccaggccgagaagugcuuccagcgcgcccucgagaaggacaccgaggucgccgaguaccacuaccagcucggccucaccuacugguucaugggcgaggagacccgcaaggacaagaccaaggcccucacccacuuccucaaggccgcccgccucgacaccuacaugggcaaggucuucugcuaccucggccacuacuaccgcgacgucgucggcgacaagaaccgcgcccgcggcugcuaccgcaaggccuucgagcucgacgacaccgacgccgaguccggcgccgccgccgucgaccucuccgucgagcucgaggacauggagauggcccucgccauccucaccaccgucacccagaaggccuccgccggcaccgccaagugggccuggcuccgccgcggccucuacuaccucaaggccggccagcacucccaggccgucgccgaccuccaggccgcccuccgcgccgaccccaaggacuucaacugcugggagucccucggcgaggccuaccucucccgcggcggcuacaccaccgcccucaaguccuucaccaaggccuccgagcucaaccccgaguccaucuacuccgucuucaaggucgccgccauccagcagauccucggcaaguacaaggaggccgucgcccaguaccagaugaucaucaagaagaaggaggacuacguccccgcccucaagggccucggcgagugccaccucaugauggccaaggccgcccucgucgacuaccucgacggcaaggccgucgacuacaucgagaaggcccucgaguacuucaccugcgcccuccagcaccgcgccgacgucuccugccucuggaagcucgccggcgacgccugcaccugccucuacgccgucgcccccuccaaggucaacguccacguccucggcguccuccucggccagaaggagggcaagcagguccucaagaagaacgagcuccuccaccucggcggccgcugcuacggccgcgcccucaagcucauguccaccuccaacaccuggugcgaccucggcaucaacuacuaccgccaggcccagcaccucgccgagaccggcuccaacaugaacgaccucaaggagcuccucgagaagucccuccacugccucaagaaggccguccgccucgacuccaacaaccaccucuacuggaacgcccucggcgucgucgccugcuacuccggcaucggcaacuacgcccucgcccagcacugcuucaucaaguccauccaguccgagcagaucaacgccgucgccuggaccaaccucggcguccucuaccucaccaacgagaacaucgagcaggcccacgaggccuucaagauggcccagucccucgaccccuccuaccucaugugcuggaucggccaggcccucaucgccgaggccgucggcuccuacgacaccauggaccucuuccgccacaccaccgagcucaacaugcacaccgagggcgcccucggcuacgccuacugggucugcaccacccuccaggacaaguccaaccgcgagaccgagcucuaccaguacaacauccuccagaugaacgccauccccgccgcccaggucauccucaacaaguacgucgagcgcauccagaacuacgcccccgccuucaccaugcucggcuaccucaacgagcaccuccagcucaagaaggaggccgccaacgccuaccagcgcgccauccuccuccuccagaccgccgaggaccaggacaccuacaacgucgccauccgcaacuacggccgccuccucugcuccaccggcgaguacgacaaggccauccaggccuucaaguccaccccccucgagguccucgaggacaucaucggcuucgcccucgcccucuucaugaagggccucuacaaggaguccuccaaggccuacgagcgcgcccucuccaucgucgaguccgagcaggacaaggcccacauccucaccgcccucgccaucaccgaguacaagcagggcaagaccgacgucgccaagacccuccucuucaagugcuccauccucaaggagcccaccaccgagucccuccaggcccucugcgcccucggccucgccaugcaggacgccacccucuccaaggccgcccucaacgagcuccucaagcacaucaagcacaaggacuccaacuaccagcgcugccuccucaccuccgccaucuacgcccuccagggccgcuccgucgccguccagaagcagaucuccaaggccguccacuccaaccccggcgaccccgcccucuggucccuccucucccgcgucgucgcccaguacgcccagcgcaacgccaagggcggcgucgucgccggcaacgucgcccacauccucgacuccaaccacggcaagaaggcccuccucuacaccgccgucaaccagcucgccaugggcuccuccuccgccgaggacgagaagaacaccgcccucaagaccauccagaaggccgcccuccucucccccggcgaccccgccaucugggccggccucauggccgccugccacgccgacgacaagcucgcccucgucaacaacacccagcccaagcgcaucgaccucuaccucgcccuccucuccgccgucuccgccuccaucaaggacgagaaguucuucgagaacuacaaccagucccucgagaaguggucccucucccaggccgucaccggccucaucgacaccggccgcaucuccgaggccgagacccucugcaccaagaaccucaaguccaaccccgaccagcccgccgucauccuccuccuccgccagguccagugcaagccccuccucgagucccagaagccccuccccgacgccguccucgaggagcuccagaagaccgucauguccaacuccaccuccguccccgccuggcaguggcucgcccacgucuaccagucccagggcaugaugcgcgccgccgagaugugcuaccgcaagucccuccagcucgccucccagcgcggcuccugguccggcaagcucuccucccuccuccgccucgcccuccucgcccucaaggucugcauggccaacaucuccaacgaccacuggcccucccucguccaggaggccaccaccgaggcccucaagcucugcuucugcccccucgccguccuccuccaggcccuccuccaguucaagcgcaagaugggcgcccgcgagacccgccgccuccucgagcgcgucgucuaccagcccggcuaccccaaguccaucgccuccaccgcccgcugguaccuccuccgccaccucuacgccaaggacgacuacgagcucaucgacguccucgucaacaacgccaagacccacggcgacacccgcgcccucgagcucaaccagcgccucuccucccaguga

SEQ ID NO: 51283 - RNA, 1734 nt, Artificial Sequence
  derived and/or modified sequence opt2 from TTC39A__Homo_sapiens__NP_001284592
augaccuccgccggcggcgcccccggcgcccuccccgccggcacccccgaguccucccuccacgaggcccucgaccagugcaugaccgcccucgaccucuuccucaccaaccaguucuccgaggcccucuccuaccucaagccccgcaccaaggaguccauguaccacucccucaccuacgccaccauccucgagaugcaggccaugaugaccuucgacccccaggacauccuccucgccggcaacaugaugaaggaggcccagaugcucugccagcgccaccgccgcaaguccuccgucaccgacuccuucuccucccucgucaaccgccccacccucggccaguucaccgaggaggagauccacgccgaggucugcuacgccgagugccuccuccagcgcgccgcccucaccuuccuccaggacgagaacauggucuccuucaucaagggcggcaucaagguccgcaacuccuaccagaccuacaaggagcucgacucccucguccaguccucccaguacugcaagggcgagaaccacccccacuucgagggcggcgucaagcucggcgucggcgccuucaaccucacccucuccaugcuccccacccgcauccuccgccuccucgaguucgucggcuucuccggcaacaaggacuacggccuccuccagcucgaggagggcgccuccggccacuccuuccgcuccguccucugcgucaugcuccuccucugcuaccacaccuuccucaccuucguccucggcaccggcaacgucaacaucgaggaggccgagaagcuccucaagcccuaccucaaccgcuaccccaagggcgccaucuuccucuucuucgccggccgcaucgaggucaucaagggcaacaucgacgccgccauccgccgcuucgaggagugcugcgaggcccagcagcacuggaagcaguuccaccacaugugcuacugggagcucauguggugcuucaccuacaagggccaguggaagauguccuacuucuacgccgaccuccucuccaaggagaacugcugguccaaggccaccuacaucuacaugaaggccgccuaccucuccauguucggcaaggaggaccacaagcccuucggcgacgacgaggucgagcucuuccgcgccguccccggccucaagcucaagaucgccggcaagucccuccccaccgagaaguucgccauccgcaagucccgccgcuacuucuccuccaaccccaucucccuccccguccccgcccucgagaugauguacaucuggaacggcuacgccgucaucggcaagcagcccaagcucaccgacggcauccucgagaucaucaccaaggccgaggagaugcucgagaagggccccgagaacgaguacuccgucgacgacgagugccucgucaagcuccucaagggccucugccucaaguaccucggccgcguccaggaggccgaggagaacuuccgcuccaucuccgccaacgagaagaagaucaaguacgaccacuaccucauccccaacgcccuccucgagcucgcccuccuccucauggagcaggaccgcaacgaggaggccaucaagcuccucgaguccgccaagcagaacuacaagaacuacuccauggagucccgcacccacuuccgcauccaggccgccacccuccaggccaaguccucccucgagaacuccucccgcuccauggucuccuccgucucccucuga

SEQ ID NO: 51284 - RNA, 2010 nt, Artificial Sequence
  derived and/or modified sequence opt2 from TTC39B__Homo_sapiens__NP_001161812
auggacgccguccucgccugccgccuccgcggccgcggcaaccgcgucgccgcccuccgcccccgcccccgccccggcggcuccgccggccccucccccuucgcccuccucugcgccggccucucccccgagccccgcgccggcgucggcuccgaguuccccgccugguuccucggcggcuccucccagcgccgcaacauggcccuccucggcucccgcgccgagcucgaggccgacgaggacgucuucgaggacgcccucgagaccaucuccaucuccucccacuccgacauggccaccuccucccuccacuucgccuccugcgacacccagcaggccccccgccagcgcggcgccuccaccgucuccuccuccuccuccaccaaggucgaccucaaguccggccucgaggagugcgccgucgcccucaaccucuuccucuccaacaaguucaccgacgcccucgagcuccuccgccccugggccaaggaguccauguaccacgcccucggcuacuccaccaucgucguccuccaggccguccucaccuucgagcagcaggacauccagaacggcaucuccgccaugaaggacgcccuccagaccugccagaaguaccgcaagaaguacaccgucgucgaguccuucuccucccuccucucccgcggcucccucgagcagcucuccgaggaggagaugcacgccgagaucugcuacgccgagugccuccuccagaaggccgcccucaccuucguccaggacgagaacaugaucaacuucaucaagggcggccucaagauccgcaccuccuaccagaucuacaaggagugccucuccauccuccacgagauccagaagaacaagcuccagcaggaguucuucuacgaguucgagggcggcgucaagcucggcuccggcgccuucaaccucaugcucucccuccuccccgcccgcaucauccgccuccucgaguucaucggcuucuccggcaaccgcgagcucggccuccuccagcuccgcgagggcgccuccggccgcuccaugcgcuccgcccucugcugccucaccauccucgccuuccacaccuacaucucccucauccucggcaccggcgaggucaacgucgccgaggccgagcgccuccucgcccccuuccuccagcaguuccccaacguccgcuccgucuuccaguccgcccaggaggucuuccagaagugcaucuccguccaggaggaguggaagcaguuccaccaccucugcuacugggagcucauguggaucaacgucuuccagcagaacuggaugcaggccuacuacuacuccgaccuccucugcaaggaguccaagugguccaaggccaccuacgucuuccucaaggccgccauccucuccaugcuccccgaggaggacgucgucgccaccaacgagaacgucgucacccucuuccgccaggucgacucccucaagcagcgcaucgccggcaaguccauccccaccgagaaguucgccguccgcaaggcccgccgcuacuccgccucccuccccgcccccgucaagcucauccuccccgcccucgagaugauguacgucuggaacggcuucuccaucgucuccaagcgcaaggaccucuccgagaaccuccucgucaccgucgagaaggccgaggccgcccuccagucccagaacuucaacuccuucuccgucgacgacgagugccucgucaagcuccucaagggcugcugccucaagaaccuccagcgcccccuccaggccgagcucugcuacaaccacgucgucgaguccgagaagcuccucaaguacgaccacuaccucguccccuucacccucuucgagcucgccucccucuacaagucccagggcgagaucgacaaggccaucaaguuccucgagaccgcccgcaacaacuacaaggacuacucccucgagucccgccuccacuuccgcauccaggccgcccuccaccucuggcgcaagcccuccuccgacuga

SEQ ID NO: 51285 - RNA, 6078 nt, Artificial Sequence
  derived and/or modified sequence opt2 from TTC3__Homo_sapiens__NP_001001894
auggacaacuucgccgagggcgacuucaccgucgccgacuacgcccuccucgaggacugcccccacgucgacgacugcgucuucgccgccgaguucauguccaacgacuacguccgcgucacccagcucuacugcgacggcgucggcguccaguacaaggacuacauccaguccgagcgcaaccucgaguucgacaucugcuccaucuggugcuccaagcccaucuccguccuccaggacuacugcgacgccaucaagaucaacaucuucuggccccuccucuuccagcaccagaacuccuccgucaucucccgccuccaccccugcgucgacgccaacaacucccgcgccuccgagaucaaccucaagaagcuccagcaccucgagcucauggaggacaucgucgaccucgccaagaaggucgccaacgacuccuuccucaucggcggccuccuccgcaucggcugcaagaucgagaacaagauccucgccauggaggaggcccucaacuggaucaaguacgccggcgacgucaccauccucaccaagcucggcuccaucgacaacugcuggcccaugcucuccaucuucuucaccgaguacaaguaccacaucaccaagaucgucauggaggacugcaaccuccucgaggagcucaagacccaguccugcauggacugcaucgaggagggcgagcucaugaagaugaagggcaacgaggaguucuccaaggagcgcuucgacaucgccaucaucuacuacacccgcgccaucgaguaccgccccgagaacuaccuccucuacggcaaccgcgcccucugcuuccuccgcaccggccaguuccgcaacgcccucggcgacggcaagcgcgccaccauccucaagaacaccuggcccaagggccacuaccgcuacugcgacgcccucuccaugcucggcgaguacgacugggcccuccaggccaacaucaaggcccagaagcucugcaagaacgaccccgagggcaucaaggaccucauccagcagcacgucaagcuccagaagcagaucgaggaccuccagggccgcaccgccaacaaggaccccaucaaggccuucuacgagaaccgcgccuacaccccccgcucccucuccgcccccaucuucaccaccucccucaacuucgucgagaaggagcgcgacuuccgcaagaucaaccacgagauggccaacggcggcaaccagaaccucaaggucgccgacgaggcccucaaggucgacgacugcgacugccaccccgaguucuccccccccuccucccagccccccaagcacaagggcaagcagaagucccgcaacaacgaguccgagaaguucuccuccuccuccccccucacccuccccgccgaccucaagaacauccucgagaagcaguucuccaaguccucccgcgccgcccaccaggacuucgccaacaucaugaagaugcuccgcucccucauccaggacggcuacauggcccuccucgagcagcgcugccgcuccgccgcccaggccuucaccgagcuccucaacggccucgacccccagaagaucaagcagcucaaccucgccaugaucaacuacguccucgucgucuacggccucgccaucucccuccucggcaucggccagcccgaggagcucuccgaggccgagaaccaguucaagcgcaucaucgagcacuaccccuccgagggccucgacugccucgccuacugcggcaucggcaaggucuaccucaagaagaaccgcuuccucgaggcccucaaccacuucgagaaggcccgcacccucaucuaccgccuccccggcguccucaccuggcccaccuccaacgucaucaucgaggagucccagccccagaagaucaagaugcuccucgagaaguucgucgaggagugcaaguucccccccguccccgacgccaucugcugcuaccagaagugccacggcuacuccaagauccagaucuacaucaccgaccccgacuucaagggcuucauccgcaucuccugcugccaguacugcaagaucgaguuccacaugaacugcuggaagaagcucaagaccaccaccuucaacgacaagaucgacaaggacuuccuccagggcaucugccucacccccgacugcgagggcgucaucuccaagaucaucaucuucuccuccggcggcgaggucaagugcgaguucgagcacaaggucaucaaggagaagguccccccccgccccauccucaagcagaagugcuccucccucgagaagcuccgccucaaggaggacaagaagcucaagcgcaagauccagaagaaggaggccaagaagcucgcccaggagcgcauggaggaggaccuccgcgaguccaacccccccaagaacgaggagcagaaggagaccgucgacaacguccagcgcugccaguuccucgacgaccgcauccuccagugcaucaagcaguacgccgacaagaucaaguccggcauccagaacaccgccaugcuccucaaggagcuccucuccuggaagguccucuccaccgaggacuacaccaccugcuucuccucccgcaacuuccucaacgaggccgucgacuacgucauccgccaccucauccaggagaacaaccgcgucaagacccgcaucuuccuccacguccucuccgagcucaaggaggucgagcccaagcucgccgccuggauccagaagcucaacuccuucggccucgacgccaccggcaccuucuucucccgcuacggcgccucccucaagcuccucgacuucuccaucaugaccuuccucuggaacgagaaguacggccacaagcucgacuccaucgagggcaagcagcucgacuacuucuccgagcccgccucccucaaggaggcccgcugccucaucuggcuccucgaggagcaccgcgacaaguuccccgcccuccacuccgcccucgacgaguucuucgacaucauggacucccgcugcaccguccuccgcaagcaggacuccggcgaggcccccuucuccuccaccaaggucaagaacaaguccaagaagaagaagcccaaggacuccaagcccaugcucgucggcuccggcaccaccuccgucaccuccaacaacgagaucaucaccuccuccgaggaccacuccaaccgcaacuccgacuccgccggccccuucgccguccccgaccaccuccgccaggacgucgaggaguucgaggcccucuacgaccagcacuccaacgaguacgucguccgcaacaagaagcucugggacaugaaccccaagcagaagugcuccacccucuacgacuacuucucccaguuccucgaggagcacggcccccucgacauguccaacaagauguucuccgccgaguacgaguucuuccccgaggagacccgccagauccucgagaaggccggcggccucaagcccuuccuccucggcugcccccgcuucgucgucaucgacaacugcaucgcccucaagaaggucgccucccgccucaagaagaagcgcaagaagaagaacaucaagaccaaggucgaggagaucuccaaggccggcgaguacguccgcgucaagcuccagcucaaccccgccgcccgcgaguucaagcccgacgucaaguccaagcccgucuccgacuccuccuccgcccccgccuucgagaacgucaagcccaagcccgucuccgccaacucccccaagcccgccugcgaggacgucaaggccaagcccgucuccgacaacuccucccgccaggucuccgaggacggccagcccaagggcgucuccuccaacucccccaagcccggcuccgaggacgccaacuacaagcgcgucuccugcaacucccccaagcccguccucgaggacgucaagcccaccuacugggcccagucccaccucgucaccggcuacugcaccuaccuccccuuccagcgcuucgacaucacccagaccccccccgccuacaucaacguccuccccggccucccccaguacaccuccaucuacaccccccucgccucccucucccccgaguaccagcucccccgcuccguccccgucguccccuccuucgucgccaacgaccgcgccgacaagaacgccgccgccuacuucgagggccaccaccucaacgccgagaacgucgccggccaccagaucgccuccgagacccagauccucgagggcucccucggcaucuccgucaagucccacugcuccaccggcgacgcccacaccguccucuccgaguccaaccgcaacgacgagcacugcggcaacuccaacaacaagugcgaggucauccccgaguccaccuccgccgucaccaacaucccccacguccagauggucgccauccaggucuccuggaacaucauccaccaggaggucaacaccgagcccuacaaccccuucgaggagcgccagggcgagaucucccgcaucgagaaggagcaccagguccuccaggaccagcuccaggaggucuacgagaacuacgagcagaucaagcucaagggccucgaggagacccgcgaccucgaggagaagcucaagcgccaccucgaggagaacaagaucuccaagaccgagcucgacugguuccuccaggaccucgagcgcgagaucaagaaguggcagcaggagaagaaggagauccaggagcgccucaagucccucaagaagaagaucaagaaggucuccaacgccuccgagauguacacccagaagaacgacggcaaggagaaggagcacgagcuccaccucgaccagucccucgagaucuccaacacccucaccaacgagaagaugaagaucgaggaguacaucaagaagggcaaggaggacuacgaggagucccaccagcgcgccgucgccgccgaggucuccguccucgagaacuggaaggaguccgaggucuacaagcuccagaucauggagucccaggccgaggccuuccucaagaagcucggccucaucucccgcgaccccgccgccuaccccgacauggaguccgacauccgcuccugggagcucuuccucuccaacgucaccaaggagaucgagaaggccaagucccaguucgaggagcagaucaaggccaucaagaacggcucccgccucuccgagcucuccaagguccagaucuccgagcucuccuuccccgccugcaacaccguccaccccgagcuccuccccgaguccuccggcgacgacggccagggccucgucaccuccgccuccgacgucaccggcaaccacgccgcccuccaccgcgaccccuccgucuucuccgccggcgacucccccggcgaggcccccuccgcccuccuccccggccccccccccggccagcccgaggccacccagcucaccggccccaagcgcgccggccaggccgcccucuccgagcgcucccccgucgccgaccgcaagcagcccgucccccccggccgcgccgcccgcuccucccagucccccaagaagcccuucaacuccaucaucgagcaccucuccgucgucuuccccugcuacaacuccaccgagcucgccggcuucaucaagaagguccgcuccaagaacaagaacucccucuccggccucuccaucgacgagaucguccagcgcgucaccgagcacauccucgacgagcagaagaagaagaagcccaaccccggcaaggacaagcgcaccuacgagcccuccuccgccacccccgucacccgcuccucccagggcucccccuccgucgucgucgcccccucccccaagaccaagggccagaaggccgaggacguccccguccgcaucgcccucggcgccuccuccugcgagaucugccacgaggucuucaaguccaagaacguccgcguccucaagugcggccacaaguaccacaagggcugcuucaagcaguggcucaagggccaguccgccugccccgccugccagggccgcgaccuccucaccgaggagucccccuccggccgcggcuggcccucccagaaccaggagcuccccuccugcuccucccgcuga

SEQ ID NO: 51286 - RNA, 1323 nt, Artificial Sequence
  derived and/or modified sequence opt2 from TTC5__Homo_sapiens__NP_612385
augauggccgacgaggaggaggaggucaagcccauccuccagaagcuccaggagcucgucgaccagcucuacuccuuccgcgacugcuacuucgagacccacuccgucgaggacgccggccgcaagcagcaggacguccagaaggagauggagaagacccuccagcagauggaggaggucgucggcuccguccagggcaaggcccagguccucaugcucaccggcaaggcccucaacgucacccccgacuacucccccaaggccgaggagcuccucuccaaggccgucaagcucgagcccgagcucgucgaggccuggaaccagcucggcgaggucuacuggaagaagggcgacgucgccgccgcccacaccugcuucuccggcgcccucacccacugccgcaacaaggucucccuccagaaccucuccaugguccuccgccagcuccgcaccgacaccgaggacgagcacucccaccacgucauggacuccguccgccaggccaagcucgccguccagauggacguccacgacggccgcuccugguacauccucggcaacuccuaccucucccucuacuucuccaccggccagaaccccaagaucucccagcaggcccucuccgccuacgcccaggccgagaaggucgaccgcaaggccuccuccaaccccgaccuccaccucaaccgcgccacccuccacaaguacgaggaguccuacggcgaggcccucgagggcuucucccgcgccgccgcccucgaccccgccuggcccgagccccgccagcgcgagcagcagcuccucgaguuccucgaccgccucaccucccuccucgaguccaagggcaaggucaagaccaagaagcuccaguccaugcucggcucccuccgccccgcccaccucggccccugcuccgacggccacuaccaguccgccuccggccagaaggucacccucgagcucaagccccucuccacccuccagcccggcgucaacuccggcgccgucauccucggcaaggucgucuucucccucaccaccgaggagaagguccccuucaccuucggccucgucgacuccgacggccccugcuacgccgucauggucuacaacaucguccaguccuggggcguccucaucggcgacuccgucgccauccccgagcccaaccuccgccuccaccgcauccagcacaagggcaaggacuacuccuucuccuccguccgcgucgagaccccccuccuccucgucgucaacggcaagccccagggcuccuccucccaggccgucgccaccgucgccucccgcccccagugcgaguga

SEQ ID NO: 51287 - RNA, 3972 nt, Artificial Sequence
  derived and/or modified sequence opt2 from TTC6__Homo_sapiens__XP_011535733
auguacgccuaccccgaguucaccaagcucuucuggaacaccgccgcccccaaguucuccguccccgaguccgucaugaaggagacccucuaccccaaguacgaguccguccaggccucccgccuccucaccgacaagcucuccuacaaguccuccgucaucacccuccaccagcacucccgcaccaacuucuggugcuuccucccccgcaaguccgccuccuucgaguccauccagaagugguucuccgcccagcccacccagcuccgccgcgucaaguccuccgucgaccuccgcaaggagaagaucaucgccccccucgagaucaagaacgacaugcaguccuccaucaaggaggucauguuccagaaggccaaggagcucaagcgccagcuccagcucaccaagcagaacaagaccgaggagcccaacuacgucaaggaguccaucgacgacaucuucgacaacaugugcgagaagcacucccuccgcaaccucucccucacccucaucgaggccuccaagaaggccggcaucuccuacaucgucuaccccaagaagaagaagaugcgcuggaagaagcgccucaagcagcagaagcucaucuucguccacgaggagcucuccaagccccccaagucccucgagcgcuccgccucccacggcauccuccccggccagaagaaguaccucuucaaggucccccucuacgagcgccagauccgcugccccucccucccccucuaccucaacuucgagaaguucguccaggccaagggcggcauccccgagaacaucgacccccgcaccugggcccucgaccgccucaucgaguacaaggacgccuccauccccgucaaggagaaggacgacaagaucuccguccccgaggacccccccgagcgcgucaaggagccccccaagcucaagcucaacgacuacgucgaguccgaccucccccaggaggucaucaaguacuacgaguccgaggucaagauccucaccgaggagaucaacgacaagaccaaguaccccgccuucgccuacugccgccgcggcgccaucuaccgcaagcucggcaagcuccaguccgccaugaacgaccuccagcgcgucauccuccucgagccccucuuccucaacgccuacuggcaccgccaccucaucuaccucuuccaggacaagaucaacgaggcccucgacgaccucaacuacauccacaaguacaacaagaacaacaccgaggccuaccucuccaaggccgagaucuaccgcggcaagaaggacaucacccucgccauccucaacuacacccaggccaucaaguccacccccaccgacgccgacaucuacuuccgccgcggcgagauguacgagaucaccaacaagguccucgccaucgacgacuucuccaagugcaucuucuacgaccccaagcgcaccgacgcccuccucaagcgcggccucuucuacugcgagaacgagaacugguucgccgccaucgaggacuucaccgcccuccucaacaucgaccaccagaacucccaggcccgcaccuaccgcggcaucgccuacgucaaguggaaguucuacaaggaggccacccaggacuucuccgccgccauccaccucgaccccaacaacuggcucgcccucuacuaccgcggcugccucuuccgcaaguccaaccccuuccgcgcccuccaggacuacuccgucuccgcccucaucaacgacggcuacgagaaccucggcugcuuccuccaccgcggcaucgucuacgcccaccucaagcucuggcuccucgccaucugcgacuucgagaccgucaucucccucgagcgcaccaucacccucgccuacgucaacaucggccucauccaccuccuccaccucgacaacuacaccgaggccaucuggcaguucuccgaggccauccgcaucgacccccucugcauccaguccuaccucugccgcgccgagaccuacuucaagcuccacaagcucaagaaggccgucaacgagcucucccgcgccauccaccuccagcccgacggcauccagcucuacauccgccgcggccaguaccuccucaugaugaaguacuacgaccucgccaaguucaccaucuaccagaucgccgagauggacaagggccucuccgagcucucccccaugcagcaggcccucaucuacuccuucugcgagaaccacgacaaggccaucgagguccucgacggcaucuccuggaaccgcgccgagaugaccaugugcgcccuccucgccaagguccagaugaaggccaagcgcaccaaggaggccgucgagguccucaagaaggcccucgacgccaucucccacuccgacaagggccccgacgccaccgccaucuccgccgacugccucuacaaccucggccucugcuacauggaggagggcaaccuccagauggccuucgacuccuucaccaaggccgucaaggccaaccccgacuucgccgaguccuucuaccagcgcggccucugcaaggucaagcuccacaaggacuccuccauccucgacuucaaccgcgccaucacccucaaccccaagcacuaccaggagaugcacaccggcggccucggcgccuaccucucccgcgucgccuucuacggccucaagggccgcuacuccaaggccauccucaacugcaacaaggccaucaagaucuaccccgaguccguccgcgccuaccucuaccgcggcguccucaaguacuacaacaagaccuacaagcucgccaucaccgaccucaccaccgccaucuccauggacaagaacuccuacaccgccuucuacaaccgcgcccucugcuacaccaagauccgcgagcuccagauggcccucaccgacuacggcaucguccuccuccucgacgccaccgagaccgucaagcucaacaccuuccucaaccgcggccucaucuacgucgagcucggccaguacggcuucgcccucgaggacuucaagcaggccgcccucaucucccgcaccaacggcucccucugccacgccaccgccaugugccaccaccgcaucaacgaguucgaggaggccgucaacuucuucaccugggcccucaagaucaaccccugcuuccucgacgccuacgucggccgcggcaacuccuacauggaguacggccacgacgaggccaccaagcaggcccagaaggacuuccucaaggcccuccacaucaaccccgccuacaucaaggcccgcaucuccuucggcuacaaccuccaggcccagggcaaguuccagaaggccuggaaccacuucaccaucgccaucgacaccgaccccaagaacuaccucgccuacgagggccgcgccgucgucugccuccagaugggcaacaacuucgccgccaugcaggacaucaacgccgccaugaagaucuccaccaccgccgaguuccucaccaaccgcggcgucauccacgaguucaugggccacaagcagaacgccaugaaggacuaccaggacgccaucacccucaaccccaaguacucccucgccuacuucaacgccggcaacaucuacuuccaccaccgccaguucucccaggccuccgacuacuucuccaaggcccucaaguucgaccccgagaacgaguacguccucaugaaccgcgccaucaccaacaccauccucaagaaguacgaggaggccaaggaggacuucgccaacgucaucgaguccugccccuucugggccgccgucuacuucaaccgcgcccacuucuacuacugccucaagcaguacgagcucgccgaggaggaccucaacaaggcccucucccucaagcccaacgacgcccucgucuacaacuuccgcgccaagguccgcggcaagaucggccucaucgaggaggccauggccgacuacaaccaggcccucgaccucgaggacuacgccuccgucaucuga

SEQ ID NO: 51288 - RNA, 2475 nt, Artificial Sequence
  derived and/or modified sequence opt2 from TTC7A__Homo_sapiens__NP_001275882
augguccccuccuccucccgcacccccggcuucaagcaguccucccaccaccuccgccuccccaagugcugggacuaccgcgacgacuucggcaagcuccuccucgccgaggcccuccucgagcagugccucaaggagaaccacgccaagaucaaggacuccaugccccuccucgagaagaacgagcccaagauguccgaggccaagaacuaccucuccuccauccucaaccacggccgccucuccccccaguacaugugcgaggccaugcucauccucggcaagcuccacuacgucgagggcuccuaccgcgacgccaucuccauguacgcccgcgccggcaucgacgacauguccauggagaacaagccccucuaccagaugcgccuccucuccgaggccuucgucaucaagggccucucccucgagcgccuccccaacuccaucgccucccgcuuccgccucaccgagcgcgaggaggaggucaucaccugcuucgagcgcgccuccuggaucgcccaggucuuccuccaggagcucgagaagaccaccaacaacuccaccucccgccaccucaagggcugccacccccucgacuacgagcucaccuacuuccucgaggccgcccuccaguccgccuacgucaagaaccucaagaagggcaacaucgucaagggcaugcgcgagcuccgcgagguccuccgcaccgucgagaccaaggccacccagaacuucaaggucauggccgccaagcaccucgccggcguccuccuccacucccucuccgaggagugcuacugguccccccucucccacccccuccccgaguucaugggcaaggaggaguccuccuucgccacccaggcccuccgcaagccccaccucuacgagggcgacaaccucuacugccccaaggacaacaucgaggaggcccuccuccuccuccucaucuccgaguccauggccacccgcgacgucguccucucccgcguccccgagcaggaggaggaccgcaccgucucccuccagaacgccgccgccaucuacgaccuccucuccaucacccucggccgccgcggccaguacgucaugcucuccgagugccucgagcgcgccaugaaguucgccuucggcgaguuccaccucugguaccaggucgcccucuccauggucgccugcggcaaguccgccuacgccgucucccuccuccgcgagugcgucaagcuccgccccuccgaccccaccgucccccucauggccgccaaggucugcaucggcucccuccgcuggcucgaggaggccgagcacuucgccaugauggucaucucccucggcgaggaggccggcgaguuccuccccaagggcuaccucgcccucggccucaccuacucccuccaggccaccgacgccacccucaaguccaagcaggacgagcuccaccgcaaggcccuccagacccucgagcgcgcccagcagcucgcccccuccgacccccaggucauccucuacgucucccuccagcucgcccucguccgccagaucuccuccgccauggagcagcuccaggaggcccucaagguccgcaaggacgacgcccacgcccuccaccuccucgcccuccucuucuccgcccagaagcaccaccagcacgcccucgacgucgucaacauggccaucaccgagcaccccgagaacuucaaccucauguucaccaaggucaagcucgagcagguccucaagggccccgaggaggcccucgucaccugccgccagguccuccgccucuggcagacccucuacuccuucucccagcucggcggccucgagaaggacggcuccuucggcgagggccucaccaugaagaagcaguccggcaugcaccucacccuccccgacgcccacgacgccgacuccggcucccgccgcgccuccuccaucgccgccucccgccucgaggaggccauguccgagcucaccaugcccuccuccguccucaagcagggccccaugcagcucuggaccacccucgagcagaucuggcuccaggccgccgagcucuucauggagcagcagcaccucaaggaggccggcuucugcauccaggaggccgccggccucuuccccaccucccacuccguccucuacaugcgcggccgccucgccgaggucaagggcaaccucgaggaggccaagcagcucuacaaggaggcccucaccgucaaccccgacggcguccgcaucaugcacucccucggccucaugcucucccgccucggccacaagucccucgcccagaagguccuccgcgacgccgucgagcgccaguccaccugccacgaggccuggcagggccucggcgagguccuccaggcccagggccagaacgaggccgccgucgacugcuuccucaccgcccucgagcucgaggccuccucccccguccuccccuucuccaucaucccccgcgagcucuga

SEQ ID NO: 51289 - RNA, 2532 nt, Artificial Sequence
  derived and/or modified sequence opt2 from TTC7B__Homo_sapiens__NP_001010854
auggccaccaagaaggccggcucccgccucgagaccgagaucgagcgcugccgcuccgagugccagugggagcgcauccccgagcucgucaagcagcucuccgccaagcucaucgccaacgacgacauggccgagcuccuccucggcgaguccaagcucgagcaguaccucaaggagcacccccuccgccagggcgccuccccccgcggccccaagccccagcucaccgagguccgcaagcaccucaccgccgcccucgaccgcggcaaccucaaguccgaguuccuccaggaguccaaccucaucauggccaagcucaacuacgucgagggcgacuacaaggaggcccucaacaucuacgcccgcgucggccucgacgaccucccccucaccgccgucccccccuaccgccuccgcgucaucgccgaggccuacgccaccaagggccucugccucgagaagcuccccaucuccuccuccaccuccaaccuccacgucgaccgcgagcaggacgucaucaccugcuacgagaaggccggcgacaucgcccuccucuaccuccaggagaucgagcgcgucauccucuccaacauccagaaccgcucccccaagcccggccccgccccccacgaccaggagcucggcuucuuccucgagaccggccuccagcgcgcccacguccucuacuucaagaacggcaaccucacccgcggcgucggccgcuuccgcgagcuccuccgcgccgucgagacccgcaccacccagaaccuccgcaugaccaucgcccgccagcucgccgagauccuccuccgcggcaugugcgagcaguccuacuggaacccccucgaggacccccccugccaguccccccucgacgacccccuccgcaagggcgccaacaccaagaccuacacccucacccgccgcgcccgcgucuacuccggcgagaacaucuucugcccccaggagaacaccgaggaggcccuccuccuccuccucaucuccgaguccauggccaaccgcgacgccguccucucccgcauccccgagcacaaguccgaccgccucaucucccuccaguccgccuccgucgucuacgaccuccucaccaucgcccucggccgccgcggccaguacgagaugcucuccgagugccucgagcgcgccaugaaguucgccuucgaggaguuccaccucugguaccaguucgcccucucccucauggccgccggcaaguccgcccgcgccgucaagguccucaaggagugcauccgccucaagcccgacgacgccaccaucccccuccucgccgccaagcucugcaugggcucccuccacuggcucgaggaggccgagaaguucgccaagaccgucgucgacgucggcgagaagaccuccgaguucaaggccaagggcuaccucgcccucggccucaccuacucccuccaggccaccgacgccucccuccgcggcaugcaggagguccuccagcgcaaggcccuccucgccuuccagcgcgcccacucccucucccccaccgaccaccaggccgccuucuaccucgcccuccagcucgccaucucccgccagauccccgaggcccucggcuacguccgccaggcccuccagcuccagggcgacgacgccaacucccuccaccuccucgcccuccuccucuccgcccagaagcacuaccacgacgcccucaacaucaucgacauggcccucuccgaguaccccgagaacuucauccuccucuucuccaaggucaagcuccagucccucugccgcggccccgacgaggcccuccucaccugcaagcacaugcuccagaucuggaaguccugcuacaaccucaccaaccccuccgacuccggccgcggcuccucccuccucgaccgcaccaucgccgaccgccgccagcucaacaccaucacccuccccgacuucuccgaccccgagaccggcuccguccacgccaccuccgucgccgccucccgcgucgagcaggcccucuccgaggucgccuccucccuccaguccuccgcccccaagcagggcccccuccaccccuggaugacccucgcccagaucuggcuccacgccgccgaggucuacaucggcaucggcaagcccgccgaggccaccgccugcacccaggaggccgccaaccucuuccccaugucccacaacguccucuacaugcgcggccagaucgccgagcuccgcggcuccauggacgaggcccgccgcugguacgaggaggcccucgccaucucccccacccacgucaaguccaugcagcgccucgcccucauccuccaccagcucggccgcuacucccucgccgagaagauccuccgcgacgccguccaggucaacuccaccgcccacgaggucuggaacggccucggcgagguccuccaggcccagggcaacgacgccgccgccaccgagugcuuccucaccgcccucgagcucgaggccuccucccccgccguccccuucaccaucaucccccgcguccucuga

SEQ ID NO: 51290 - RNA, 1596 nt, Artificial Sequence
  derived and/or modified sequence opt2 from TTC8__Homo_sapiens__NP_001275710
auguccuccgagauggagccccuccuccucgccugguccuacuuccgccgccgcaaguuccagcucugcgccgaccucugcacccagaugcucgagaagucccccuacgaccaggccgccuggauccucaaggcccgcgcccucaccgagauggucuacaucgacgagaucgacgucgaccaggagggcaucgccgagaugaugcucgacgagaacgccaucgcccaggucccccgccccggcaccucccucaagcuccccggcaccaaccagaccggcggccccucccaggccguccgccccaucacccaggccggccgccccaucaccggcuuccuccgccccuccacccaguccggccgccccggcaccauggagcaggccauccgcaccccccgcaccgccuacaccgcccgccccaucaccuccuccuccggccgcuucguccgccucggcaccgccuccaugcucaccucccccgacggccccuucaucaaccucucccgccucaaccucaccaaguacucccagaagcccaagcucgccaaggcccucuucgaguacaucuuccaccacgagaacgacgucaagaccauccaccucgaggacgucguccuccaccucggcaucuaccccuuccuccuccgcaacaagaaccacaucgagaagaacgcccucgaccucgccgcccucuccaccgagcacucccaguacaaggacuggugguggaagguccagaucggcaagugcuacuaccgccucggcauguaccgcgaggccgagaagcaguucaaguccgcccucaagcagcaggagauggucgacaccuuccucuaccucgccaaggucuacgucucccucgaccagcccgucaccgcccucaaccucuucaagcagggccucgacaaguuccccggcgaggucacccuccucugcggcaucgcccgcaucuacgaggagaugaacaacauguccuccgccgccgaguacuacaaggagguccucaagcaggacaacacccacgucgaggccaucgccugcaucggcuccaaccacuucuacuccgaccagcccgagaucgcccuccgcuucuaccgccgccuccuccagaugggcaucuacaacggccagcucuucaacaaccucggccucugcugcuucuacgcccagcaguacgacaugacccucaccuccuucgagcgcgcccucucccucgccgagaacgaggaggaggccgccgacgucugguacaaccucggccacgucgccgucggcaucggcgacaccaaccucgcccaccagugcuuccgccucgcccucgucaacaacaacaaccacgccgaggccuacaacaaccucgccguccucgagaugcgcaagggccacgucgagcaggcccgcgcccuccuccagaccgccuccucccucgccccccacauguacgagccccacuucaacuucgccaccaucuccgacaagaucggcgaccuccagcgcuccuacgucgccgcccagaaguccgaggccgccuuccccgaccacgucgacacccagcaccucaucaagcagcuccgccagcacuucgccaugcucuga

SEQ ID NO: 51291 - RNA, 720 nt, Artificial Sequence
  derived and/or modified sequence opt2 from TTC9B__Homo_sapiens__NP_689692
augcagcgcggcgcccucucccccguccucaugcucuccgccgcccccgagccccccccccgccccccccccgcccucuccccccccggcuccggccccggcuccggcucccgccacggcuccgcccgccccggccccacccccgagcccuccggcucccucggcgccgcccucgacuccucccuccgcgccgccgucgccuucaaggccgagggccagcgcugcuaccgcgagaagaaguuccgcgaggccaucggcaaguaccaccgcgcccuccuccagcucaaggccgcccagggcgcccgccccuccggccuccccgcccccgcccccggccccaccuccucccccggccccgcccgccucuccgaggagcagcgccgccucgucgaguccaccgaggucgagugcuacgacucccucaccgccugccuccuccaguccgagcucgucaacuacgagcgcguccgcgaguacugccucaagguccucgagaagcagcagggcaacuucaaggccaccuaccgcgccggcaucgccuucuaccaccucggcgacuacgcccgcgcccuccgcuaccuccaggaggcccgcucccgcgagcccaccgacaccaacguccuccgcuacauccagcucacccagcucaagaugaaccgcugcucccuccagcgcgaggacuccggcgccggcucccagacccgcgacgucaucggcuga

SEQ ID NO: 51292 - RNA, 516 nt, Artificial Sequence
  derived and/or modified sequence opt2 from TTC9C__Homo_sapiens__NP_776171
auggagaagcgccuccaggaggcccagcucuacaaggaggagggcaaccagcgcuaccgcgagggcaaguaccgcgacgccgucucccgcuaccaccgcgcccuccuccagcuccgcggccucgaccccucccuccccuccccccuccccaaccucggcccccagggccccgcccucacccccgagcaggagaacauccuccacaccacccagaccgacugcuacaacaaccucgccgccugccuccuccagauggagcccgucaacuacgagcgcguccgcgaguacucccagaagguccucgagcgccagcccgacaacgccaaggcccucuaccgcgccggcgucgccuucuuccaccuccaggacuacgaccaggcccgccacuaccuccucgccgccgucaaccgccagcccaaggacgccaacguccgccgcuaccuccagcucacccaguccgagcucuccuccuaccaccgcaaggagaagcagcucuaccucggcauguucggcuga

SEQ ID NO: 51293 - RNA, 669 nt, Artificial Sequence
  derived and/or modified sequence opt2 from TTC9__Homo_sapiens__NP_056166
auggagcgcaagggcuccgccgccggcgccaagggcaaccccuccccccccgccgccggcgagggccagcgccccccccccccccucugcguccccggcggcggcggcggcgcccccgcccgcggccaggucggcgccgccgccgagcccgccgagcucauccgccgcgcccacgaguucaagucccagggcgcccagugcuacaaggacaagaaguuccgcgaggccaucggcaaguaccaccgcgcccuccucgagcucaagggccuccuccccccccccggcgagcgcgagcgcgacucccgccccgccucccccgccggcgcccucaagcccggccgccucuccgaggagcaguccaagaccgucgaggccaucgagaucgacugcuacaacucccucgccgccugccuccuccaggccgagcucgucaacuacgagcgcgucaaggaguacugccucaagguccucaagaaggagggcgagaacuucaaggcccucuaccgcuccggcgucgccuucuaccaccucggcgacuacgacaaggcccucuacuaccucaaggaggcccgcacccagcagcccaccgacaccaacgucauccgcuacauccagcucaccgagaugaagcucucccgcugcucccagcgcgagaaggaggccauguga

SEQ ID NO: 51294 - RNA, 2718 nt, Artificial Sequence
  derived and/or modified sequence opt2 from TTF1__Homo_sapiens__XP_006717336
auggagggcgaguccucccgcuucgagauccacacccccgucuccgacaagaagaagaagaagugcuccauccacaaggagcgcccccagaagcacucccacgagaucuuccgcgacuccucccucgucaacgagcagucccagaucacccgccgcaagaagcgcaagaaggacuuccagcaccucaucuccuccccccucaagaagucccgcaucugcgacgagaccgccaacgccaccuccacccucaagaagcgcaagaagcgccgcuacuccgcccucgaggucgacgaggaggccggcgucaccgucguccucgucgacaaggagaacaucaacaacacccccaagcacuuccgcaaggacgucgacgucgucugcgucgacauguccaucgagcagaagcucccccgcaagcccaagaccgacaaguuccagguccucgccaagucccacgcccacaaguccgaggcccuccacuccaagguccgcgagaagaagaacaagaagcaccagcgcaaggccgccuccugggagucccagcgcgcccgcgacacccucccccaguccgagucccaccaggaggaguccuggcucuccgucggccccggcggcgagaucaccgagcuccccgccuccgcccacaagaacaaguccaagaagaagaagaagaaguccuccaaccgcgaguacgagacccucgccaugcccgagggcucccaggccggccgcgaggccggcaccgacaugcaggagucccagcccaccgucggccucgacgacgagaccccccagcuccucggccccacccacaagaagaaguccaagaagaagaagaagaagaaguccaaccaccaggaguucgaggcccucgccaugcccgagggcucccaggucggcuccgaggucggcgccgacaugcaggagucccgccccgccgucggccuccacggcgagaccgccggcauccccgcccccgccuacaagaacaaguccaagaagaagaagaagaaguccaaccaccaggaguucgaggccgucgccaugcccgagucccucgaguccgccuaccccgagggcucccaggucggcuccgaggucggcaccgucgagggcuccaccgcccucaagggcuucaaggaguccaacuccaccaagaagaaguccaagaagcgcaagcucaccuccgucaagcgcgcccgcgucuccggcgacgacuucuccguccccuccaagaacuccgaguccacccucuucgacuccgucgagggcgacggcgccaugauggaggagggcgucaagucccgcccccgccagaagaagacccaggccugccucgccuccaagcacguccaggaggccccccgccucgagcccgccaacgaggagcacaacgucgagaccgccgaggacuccgagauccgcuaccucuccgccgacuccggcgacgccgacgacuccgacgccgaccucggcuccgccgucaagcagcuccaggaguucauccccaacaucaaggaccgcgccaccuccaccaucaagcgcauguaccgcgacgaccucgagcgcuucaaggaguucaaggcccagggcgucgccaucaaguucggcaaguucuccgucaaggagaacaagcagcucgagaagaacgucgaggacuuccucgcccucaccggcaucgaguccgccgacaagcuccucuacaccgaccgcuaccccgaggagaaguccgucaucaccaaccucaagcgccgcuacuccuuccgccuccacaucggccgcaacaucgcccgccccuggaagcucaucuacuaccgcgccaagaagauguucgacgucaacaacuacaagggccgcuacuccgagggcgacaccgagaagcucaagauguaccacucccuccucggcaacgacuggaagaccaucggcgagauggucgcccgcuccucccucuccgucgcccucaaguucucccagaucuccucccagcgcaaccgcggcgccugguccaaguccgagacccgcaagcucaucaaggccgucgaggaggucauccucaagaagauguccccccaggagcucaaggaggucgacuccaagcuccaggagaaccccgaguccugccucuccaucguccgcgagaagcucuacaagggcaucuccugggucgaggucgaggccaagguccagacccgcaacuggaugcagugcaaguccaaguggaccgagauccucaccaagcgcaugaccaacggccgccgcaucuacuacggcaugaacgcccuccgcgccaaggucucccucaucgagcgccucuacgagaucaacgucgaggacaccaacgagaucgacugggaggaccucgccuccgccaucggcgacgucccccccuccuacguccagaccaaguucucccgccucaaggccgucuacguccccuucuggcagaagaagaccuuccccgagaucaucgacuaccucuacgagaccacccucccccuccucaaggagaagcucgagaagaugauggagaagaagggcaccaagauccagacccccgccgcccccaagcaggucuuccccuuccgcgacaucuucuacuacgaggacgacuccgagggcgaggacaucgagaaggaguccgagggccaggcccccugcauggcccacgccugcaacuccuccacccucggcggccagggccgcuggaucaucuga

SEQ ID NO: 51295 - RNA, 3453 nt, Artificial Sequence
  derived and/or modified sequence opt2 from TTF2__Homo_sapiens__XP_011540606
auggcccgcaucaaggagcgcgccuccaccugcgccggccagacccgcgccgccuccugcggcccccccuccuccauccccgucucccacugccuccuccacgaggacuucgucgucgagcuccagggccuccuccucccccaggacaagaaggaguaccgccucuucuuccgcugcauccgcuccaaggccgagggcaagcgcuggugcggcuccauccccuggcaggaccccgacuccaaggagcacuccgucuccaacaagucccagcacgccuccgagaccuuccaccacuccuccaacuggcuccgcaaccccuucaagguccucgacaagaaccaggagcccgcccucuggaagcagcucaucaagggcgagggcgaggagaagaaggccgacaagaagcagcgcgagaagggcgaccagcucuucgaccagaagaaggagcagaagcccgagaugauggagaaggaccucuccuccggccucguccccaagaagaagcaguccgucguccaggagaagaagcaggaggagggcgccgagauccagugcgaggccgagaccggcggcacccacaagcgcgacuucuccgagaucaagucccagcagugccagggcaacgagcucacccgccccuccgccuccucccaggagaaguccuccggcaagucccaggacguccagcgcgaguccgagccccuccgcgagaaggucacccagcuccucccccagaacguccacucccacaacuccaucuccaagccccagaagggcggcccccucaacaaggaguacaccaacugggaggccaaggagaccaaggccaaggacggccccuccauccaggccacccagaagucccucccccagggccacuuccaggagcgccccgagacccacuccguccccgcccccggcggccccgccgcccaggccgcccccgccgcccccggccucucccucggcgagggccgcgaggccgccaccuccuccgacgacgaggaggaggacgacgucgucuucgucuccuccaagcccggcuccccccuccucuucgacuccacccucgaccucgagaccaaggagaaccuccaguuccccgaccgcuccguccagcgcaaggucucccccgccuccggcgucuccaagaaggucgagcccuccgaccccgucgcccgccgcgucuaccucaccacccagcucaagcagaagaaguccacccucgccuccgucaacauccaggcccuccccgacaagggccagaagcucaucaagcagauccaggagcucgaggagguccucuccggccucacccucucccccgagcagggcaccaacgagaaguccaacucccaggucccccagcagucccacuucaccaagaccaccaccggccccccccaccucguccccccccagccccucccccgccgcggcacccagcccgucggcucccucgagcucaaguccgccugccaggucaccgccggcggcuccucccagugcuaccgcggcaacaccuaccucuacgccggccacaccaaccaggaccacguccacgccgucuggaagaucaccuccgaggccaucggccagcuccaccgcucccucgaguccugccccggcgagaccgucgucgccgaggaccccgccggccucaaggucccccuccuccuccaccagaagcaggcccucgccuggcuccucuggcgcgagucccagaagccccagggcggcauccucgccgacgacaugggccucggcaagacccucaccaugaucgcccucauccucacccagaagaaccaggagaagaaggaggagaaggagaaguccaccgcccucaccuggcucuccaaggacgacuccugcgacuucaccucccacggcacccucaucaucugccccgccucccucauccaccacuggaagaacgaggucgagaagcgcgucaacuccaacaagcuccgcgucuaccucuaccacggccccaaccgcgacucccgcgcccgcguccucuccaccuacgacaucgucaucaccaccuacucccucgucgccaaggagauccccaccaacaagcaggaggccgagauccccggcgccaaccucaacgucgagggcaccuccaccccccuccuccgcaucgccugggcccgcaucauccucgacgaggcccacaacgucaagaacccccgcguccagaccuccaucgccgucugcaagcuccaggccugcgcccgcugggccgucaccggcacccccauccagaacaaccuccucgacauguacucccuccucaaguuccuccgcugcucccccuucgacgaguucaaccucuggcgcucccaggucgacaacggcuccaagaagggcggcgagcgccucuccauccucaccaagucccuccuccuccgccgcaccaaggaccagcucgacuccaccggccgcccccucgucauccucccccagcgcaaguuccagcuccaccaccucaagcucuccgaggacgaggagaccgucuacaacgucuucuucgcccgcucccgcuccgcccuccaguccuaccucaagcgccacgagucccgcggcaaccaguccggccgcucccccaacaaccccuucucccgcgucgcccucgaguucggcuccgaggagccccgccacuccgaggccgccgacuccccccgcuccuccaccguccacauccucucccagcuccuccgccuccgccagugcugcugccaccucucccuccucaaguccgcccucgaccccauggagcucaagggcgagggccucguccucucccucgaggagcagcucuccgcccucacccucuccgagcuccgcgacuccgagcccuccuccaccgucucccucaacggcaccuucuucaagauggagcucuucgagggcaugcgcgaguccaccaagaucuccucccuccucgccgagcucgaggccauccagcgcaacuccgccucccagaaguccgucaucgucucccaguggaccaacaugcucaaggucgucgcccuccaccucaagaagcacggccucaccuacgccaccaucgacggcuccgucaaccccaagcagcgcauggaccucgucgaggccuucaaccacucccgcggcccccaggucaugcucaucucccuccucgccggcggcgucggccucaaccucaccggcggcaaccaccucuuccuccucgacaugcacuggaaccccucccucgaggaccaggccugcgaccgcaucuaccgcgucggccagcagaaggacgucgucauccaccgcuucgucugcgagggcaccgucgaggagaagauccuccagcuccaggagaagaagaaggaccucgccaagcagguccucuccggcuccggcgaguccgucaccaagcucacccucgccgaccuccgcguccucuucggcaucuga

SEQ ID NO: 51296 - RNA, 3270 nt, Artificial Sequence
  derived and/or modified sequence opt2 from TTI1__Homo_sapiens__NP_001290386
auggccgucuucgacacccccgaggaggccuucggcguccuccgccccgucugcguccagcucaccaagacccagaccgucgagaacgucgagcaccuccagacccgccuccaggccgucuccgacuccgcccuccaggagcuccagcaguacauccucuucccccuccgcuucacccucaagacccccggccccaagcgcgagcgccucauccaguccgucgucgagugccucaccuucguccucuccuccaccugcgucaaggagcaggagcuccuccaggagcucuucuccgagcucuccgccugccucuacucccccuccucccagaagcccgccgccgucuccgaggagcucaagcucgccgucauccagggccucuccacccucaugcacuccgccuacggcgacaucauccucaccuucuacgagcccuccauccucccccgccucggcuucgccgucucccuccuccucggccucgccgagcaggagaaguccaagcagaucaagaucgccgcccucaagugccuccagguccuccuccuccagugcgacugccaggaccacccccgcucccucgacgagcucgagcagaagcagcucggcgaccucuucgccuccuuccuccccggcaucuccaccgcccucacccgccucaucaccggcgacuucaagcagggccacuccaucgucgucuccucccucaagaucuucuacaagaccgucuccuucaucauggccgacgagcagcucaagcgcaucuccaagguccaggccaagcccgccgucgagcaccgcgucgccgagcucauggucuaccgcgaggccgacugggucaagaagaccggcgacaagcucaccauccucaucaagaagaucaucgagugcgucuccguccacccccacuggaagguccgccucgagcucgucgagcucgucgaggaccuccuccucaagugcucccagucccucgucgagugcgccggcccccuccucaaggcccucgucggccucgucaacgacgagucccccgagauccaggcccagugcaacaagguccuccgccacuucgccgaccagaaggucgucgucggcaacaaggcccucgccgacauccucuccgagucccuccacucccucgccaccucccucccccgccucaugaacucccaggacgaccagggcaaguucuccacccucucccuccuccucggcuaccucaagcuccucggccccaagaucaacuucguccucaacuccgucgcccaccuccagcgccucuccaaggcccucauccagguccucgagcucgacgucgccgacaucaagaucgucgaggagcgccgcuggaacuccgacgaccucaacgccucccccaagaccuccgccacccagcccuggaaccgcauccagcgccgcuacuuccgcuucuucaccgacgagcgcaucuucaugcuccuccgccaggucugccagcuccucggcuacuacggcaaccucuaccuccucgucgaccacuucauggagcucuaccaccaguccgucgucuaccgcaagcaggccgccaugauccucaacgagcucgucaccggcgccgccggccucgaggucgaggaccuccacgagaagcacaucaagaccaaccccgaggagcuccgcgagaucgucaccuccauccucgaggaguacaccucccaggagaacugguaccucgucaccugccucgagaccgaggagaugggcgaggagcucaugauggagcaccccggccuccaggccaucaccuccggcgagcacaccugccaggucaccuccuuccucgccuucuccaagcccucccccaccaucugcuccaugaacuccaacaucuggcagaucugcauccagcucgagggcaucggccaguucgccuacgcccucggcaaggacuucugccuccuccucauguccgcccucuaccccguccucgagaaggccggcgaccagacccuccucaucucccaggucgccaccuccaccaugauggacgucugccgcgccugcggcuacgacucccuccagcaccucaucaaccagaacuccgacuaccucgucaacggcaucucccucaaccuccgccaccucgcccuccacccccacacccccaagguccucgaggucaugcuccgcaacuccgacgccaaccuccucccccucgucgccgacgucguccaggacguccucgccacccucgaccaguucuacgacaagcgcgccgccuccuucgucuccguccuccacgcccucauggccgcccucgcccagugguuccccgacaccggcaaccucggccaccuccaggagcagucccucggcgaggagggcucccaccucaaccagcgccccgccgcccucgagaaguccaccaccaccgccgaggacaucgagcaguuccuccucaacuaccucaaggagaaggacgucgccgacggcaacgucuccgacuucgacaacgaggaggaggagcaguccgucccccccaaggucgacgagaacgacacccgccccgacgucgagcccccccucccccuccagauccagaucgccauggacgucauggagcgcugcauccaccuccucuccgacaagaaccuccagauccgccucaagguccucgacguccucgaccucugcgucgucguccuccagucccacaagaaccagcuccucccccucgcccaccaggccuggcccucccucguccaccgccucacccgcgacgccccccucgccguccuccgcgccuucaagguccuccgcacccucggcuccaagugcggcgacuuccuccgcucccgcuucugcaaggacguccuccccaagcucgccggcucccucgucacccaggcccccaucuccgcccgcgccggccccgucuacucccacacccucgccuucaagcuccagcucgccguccuccagggccucggcccccucugcgagcgccucgaccucggcgagggcgaccucaacaaggucgccgacgccugccucaucuaccucuccgucaagcagcccgucaagcuccaggaggccgcccgcuccgucuuccuccaccucaugaaggucgaccccgacuccaccugguuccuccucaacgagcucuacugccccguccaguucacccccccccaccccucccuccaccccguccagcuccacggcgccuccggccagcagaaccccuacaccaccaacguccuccagcuccucaaggagcuccaguga

SEQ ID NO: 51297 - RNA, 1527 nt, Artificial Sequence
  derived and/or modified sequence opt2 from TTI2__Homo_sapiens__NP_079391
auggagcucgacuccgcccucgaggcccccucccaggaggacuccaaccucuccgaggagcucucccacuccgccuucggccaggccuucuccaagauccuccacugccucgcccgccccgaggcccgccgcggcaacgucaaggacgccguccucaaggaccucggcgaccucaucgaggccaccgaguucgaccgccucuucgagggcaccggcgcccgccuccgcggcaugcccgagacccucggccaggucgccaaggcccucgagaaguacgccgcccccuccaaggaggaggagggcggcggcgacggccacuccgaggccgccgagaaggccgcccaggucggccuccucuuccucaagcuccucggcaaggucgagaccgccaagaacucccucgucggccccgccuggcagaccggccuccaccaccucgccggccccgucuacaucuucgccaucacccacucccucgagcagcccuggaccaccccccgcucccgcgaggucgcccgcgagguccucaccucccuccuccaggucaccgagugcggcuccgucgccggcuuccuccacggcgagaacgaggacgagaagggccgccucuccgucauccucggccuccucaagcccgaccucuacaaggaguccuggaagaacaaccccgccaucaagcacgucuucuccuggacccuccagcaggucacccgccccuggcucucccagcaccucgagcgcguccuccccgccucccucgucaucuccgacgacuaccagaccgagaacaagauccucggcguccacugccuccaccacaucguccucaacguccccgccgccgaccuccuccaguacaaccgcgcccagguccucuaccacgccaucuccaaccaccucuacacccccgagcaccaccucauccaggccguccuccucugccuccucgaccucuuccccauccucgagaagacccuccacuggaagggcgacggcgcccgccccaccacccacugcgacgagguccuccgccucauccucacccacauggagcccgagcaccgccuccuccuccgccgcaccuacgcccgcaaccuccccgccuucgucaaccgccucggcauccucaccguccgccaccucaagcgccucgagcgcgucaucaucggcuaccucgaggucuacgacggccccgaggaggaggcccgccucaagauccucgagacccucaagcuccucaugcagcacaccuggccccgcgucuccugccgccucgucguccuccucaaggcccuccucaagcucaucugcgacgucgcccgcgaccccaaccucacccccgaguccgucaaguccgcccuccuccaggaggccaccgacugccucauccuccucgaccgcugcucccagggccgcgucaagggccuccucgccaagaucccccaguccugcgaggaccgcaaggucgucaacuacauccgcaagguccagcaggucuccgagggcgcccccuacaacggcaccuga

SEQ ID NO: 51298 - RNA, 2574 nt, Artificial Sequence
  derived and/or modified sequence opt2 from TTK__Homo_sapiens__XP_011534401
auggaguccgaggaccucuccggccgcgagcucaccaucgacuccaucaugaacaagguccgcgacaucaagaacaaguucaagaacgaggaccucaccgacgagcucucccucaacaagaucuccgccgacaccaccgacaacuccggcaccgucaaccagaucaugaugauggccaacaaccccgaggacuggcucucccuccuccucaagcucgagaagaacuccgucccccucuccgacgcccuccucaacaagcucaucggccgcuacucccaggccaucgaggcccucccccccgacaaguacggccagaacgaguccuucgcccgcauccagguccgcuucgccgagcucaaggccauccaggagcccgacgacgcccgcgacuacuuccagauggcccgcgccaacugcaagaaguucgccuucguccacaucuccuucgcccaguucgagcucucccagggcaacgucaagaaguccaagcagcuccuccagaaggccgucgagcgcggcgccgucccccucgagaugcucgagaucgcccuccgcaaccucaaccuccagaagaagcagcuccucuccgaggaggagaagaagaaccucuccgccuccaccguccucaccgcccaggaguccuucuccggcucccucggccaccuccagaaccgcaacaacuccugcgacucccgcggccagaccaccaaggcccgcuuccucuacggcgagaacaugcccccccaggacgccgagaucggcuaccgcaacucccuccgccagaccaacaagaccaagcaguccugccccuucggccgcguccccgucaaccuccucaacucccccgacugcgacgucaagaccgacgacuccgucguccccugcuucaugaagcgccagaccucccgcuccgagugccgcgaccucgucguccccggcuccaagcccuccggcaacgacuccugcgagcuccgcaaccucaaguccguccagaacucccacuucaaggagccccucgucuccgacgagaaguccuccgagcucaucaucaccgacuccaucacccucaagaacaagaccgaguccucccuccucgccaagcucgaggagaccaaggaguaccaggagcccgagguccccgaguccaaccagaagcaguggcaguccaagcgcaaguccgagugcaucaaccagaaccccgccgccuccuccaaccacuggcagauccccgagcucgcccgcaaggucaacaccgagcagaagcacaccaccuucgagcagcccgucuucuccgucuccaagcaguccccccccaucuccaccuccaagugguucgaccccaaguccaucugcaagacccccuccuccaacacccucgacgacuacauguccugcuuccgcacccccgucgucaagaacgacuucccccccgccugccagcucuccacccccuacggccagcccgccugcuuccagcagcagcagcaccagauccucgccaccccccuccagaaccuccagguccucgccuccuccuccgccaacgagugcaucuccgucaagggccgcaucuacuccauccucaagcagaucggcuccggcggcuccuccaaggucuuccagguccucaacgagaagaagcagaucuacgccaucaaguacgucaaccucgaggaggccgacaaccagacccucgacuccuaccgcaacgagaucgccuaccucaacaagcuccagcagcacuccgacaagaucauccgccucuacgacuacgagaucaccgaccaguacaucuacauggucauggagugcggcaacaucgaccucaacuccuggcucaagaagaagaaguccaucgaccccugggagcgcaaguccuacuggaagaacaugcucgaggccguccacaccauccaccagcacggcaucguccacuccgaccucaagcccgccaacuuccucaucgucgacggcaugcucaagcucaucgacuucggcaucgccaaccagaugcagcccgacaccaccuccgucgucaaggacucccaggucggcaccgucaacuacaugccccccgaggccaucaaggacauguccuccucccgcgagaacggcaaguccaaguccaagaucucccccaaguccgacgucuggucccucggcugcauccucuacuacaugaccuacggcaagacccccuuccagcagaucaucaaccagaucuccaagcuccacgccaucaucgaccccaaccacgagaucgaguuccccgacauccccgagaaggaccuccaggacguccucaagugcugccucaagcgcgaccccaagcagcgcaucuccauccccgagcuccucgcccaccccuacguccagauccagacccaccccgucaaccagauggccaagggcaccaccgaggagaugaaguacguccucggccagcucgucggccucaacucccccaacuccauccucaaggccgccaagacccucuacgagcacuacuccggcggcgagucccacaacuccuccuccuccaagaccuucgagaagaagcgcggcaagaaguga

SEQ ID NO: 51299 - RNA, 1134 nt, Artificial Sequence
  derived and/or modified sequence opt2 from TTL__Homo_sapiens__NP_714923
auguacaccuucgucguccgcgacgagaacuccuccgucuacgccgaggucucccgccuccuccucgccaccggccacuggaagcgccuccgccgcgacaacccccgcuucaaccucaugcucggcgagcgcaaccgccuccccuucggccgccucggccacgagcccggccucguccagcucgucaacuacuaccgcggcgccgacaagcucugccgcaaggccucccucgucaagcucaucaagaccucccccgagcucgccgaguccugcaccugguuccccgaguccuacgucaucuaccccaccaaccucaagacccccgucgcccccgcccagaacggcauccagccccccaucuccaacucccgcaccgacgagcgcgaguucuuccucgccuccuacaaccgcaagaaggaggacggcgagggcaacgucuggaucgccaaguccuccgccggcgccaagggcgagggcauccucaucuccuccgaggccuccgagcuccucgacuucaucgacaaccagggccagguccacgucauccagaaguaccucgagcacccccuccuccucgagcccggccaccgcaaguucgacauccgcuccuggguccucgucgaccaccaguacaacaucuaccucuaccgcgagggcguccuccgcaccgccuccgagcccuaccacgucgacaacuuccaggacaagaccugccaccucaccaaccacugcauccagaaggaguacuccaagaacuacggcaaguacgaggagggcaacgagauguucuucaaggaguucaaccaguaccucaccuccgcccucaacaucacccucgaguccuccauccuccuccagaucaagcacaucauccgcaacugccuccucuccgucgagcccgccaucuccaccaagcaccuccccuaccaguccuuccagcucuucggcuucgacuucauggucgacgaggagcucaaggucuggcucaucgaggucaacggcgcccccgccugcgcccagaagcucuacgccgagcucugccagggcaucgucgacaucgccaucuccuccgucuuccccccccccgacgucgagcagccccagacccagcccgccgccuucaucaagcucuga

SEQ ID NO: 51300 - RNA, 1578 nt, Artificial Sequence
  derived and/or modified sequence opt2 from TTLL10__Homo_sapiens__XP_011539472
auggaccacuccugcacccgcuucauccaccgccgcggcccccccacccgcacccgcgccggcuucaagcgcggcaagcgcccccgcauccagcagcgcccccgcgcccgcgucuccggcaccauccccgccucccgccuccaccccgcccccgccucccagcccggccccugccccgcccccggccacugccccgucggccccgcccacgagcgccccaugggcuccucccaggaggagggccuccgcugccagcccucccagcccgaccacgacgccgacggccacugcggccccgaccucgagggcgccgagcgcgccuccgccacccccggcccccccggccuccucaacucccaccgccccgccgacuccgacgacaccaacgccgccggccccuccgccgcccuccucgagggccuccuccucggcggcggcaagcccuccccccacuccacccgccccggccccuucuucuacaucggcggcuccaacggcgccaccaucaucuccuccuacugcaaguccaagggcuggcagcgcauccacgacucccgccgcgacgacuacacccucaaguggugcgaggucaagucccgcgacuccuacggcuccuuccgcgagggcgagcagcuccucuaccagcuccccaacaacaagcuccucaccaccaagaucggccuccucuccacccuccgcggccgcgcccgcgccauguccaaggccuccaagguccccggcggcguccaggcccgccucgagaaggacgccgccgcccccgcccucgaggaccuccccuggaccucccccggcuaccuccgcccccagcgcguccuccgcauggaggaguucuuccccgagaccuaccgccucgaccucaagcacgagcgcgaggccuucuucacccucuucgacgagacccagaucuggaucugcaagcccaccgccuccaaccagggcaagggcaucuuccuccuccgcaaccaggaggaggucgccgcccuccaggccaagacccgcuccauggaggacgaccccauccaccacaagacccccuuccgcggcccccaggcccgcgucguccagcgcugcggcggcggcugccccgagggcuacauccagaacccccuccucgucgacggccgcaaguucgacguccgcuccuaccuccucaucgccugcaccacccccuacaugaucuucuucggccacggcuacgcccgccucacccucucccucuacgacccccacuccuccgaccucggcggccaccucaccaaccaguucaugcagaagaaguccccccucuacaugcuccucaaggagcacaccgucugguccauggagcaccucaaccgcuacaucuccgacaccuucuggaaggcccgcggccucgccaaggacugggucuucaccacccucaagcgccucugcucccucuccuggcagugccucucccccgccgccuccaagggccccgacggcaagcccucccgcggcuccgucggcaccucccccgccggcucccucgccgucggcuccggcgacuccuccgccuccgucaccgccaccauguga

SEQ ID NO: 51301 - RNA, 2403 nt, Artificial Sequence
  derived and/or modified sequence opt2 from TTLL11__Homo_sapiens__NP_001132914
auggccgccgccgccuccgucaccggccgcgucaccugggccgccucccccaugcgcucccucggccucggccgccgccucucccuccccggcccccgccucgacgccgucaccgccgccgucaaccccucccucuccgaccacggcaacggccucggccgcggcacccgcggcuccggcugcuccggcggcucccucgucgccgacuggggcggcggcgccgccgccgccgccgccgucgcccucgcccucgcccccgcccucuccaccaugcgccgcggcuccuccgaguccgagcucgccgcccgcugggaggccgaggccgucgccgccgccaaggccgccgccaaggccgaggccgaggccaccgccgagaccgucgccgagcagguccgcgucgacgccggcgccgccggcgagcccgagugcaaggccggcgaggagcagcccaagguccucgcccccgcccccgcccagcccuccgccgccgaggagggcaacacccagguccuccagcgccccccccccacccucccccccuccaagcccaagcccguccagggccucugcccccacggcaagccccgcgacaagggccgcuccugcaagcgcuccuccggccacggcuccggcgagaacggcucccagcgccccgucaccgucgacuccuccaaggcccgcaccucccucgacgcccucaagaucuccauccgccagcucaaguggaaggaguuccccuucggccgccgccuccccugcgacaucuacuggcacggcgucuccuuccacgacaacgacaucuucuccggccaggucaacaaguuccccggcaugaccgagaugguccgcaagaucacccucucccgcgccguccgcaccaugcagaaccucuuccccgaggaguacaacuucuacccccgcuccuggauccuccccgacgaguuccagcucuucgucgcccagguccagauggucaaggacgacgaccccuccuggaagcccaccuucaucgucaagcccgacggcggcugccagggcgacggcaucuaccucaucaaggaccccuccgacauccgccucgccggcacccuccagucccgccccgccgucguccaggaguacaucugcaagccccuccucaucgacaagcucaaguucgacauccgccucuacguccuccucaagucccucgacccccucgagaucuacaucgccaaggacggccucucccgcuucugcaccgagcccuaccaggagcccacccccaagaaccuccaccgcaucuucaugcaccucaccaacuacucccucaacauccacuccggcaacuucauccacuccgacuccgccuccaccggcuccaagcgcaccuucuccuccauccucugccgccucuccuccaagggcgucgacaucaagaaggucugguccgacaucaucuccgucgucaucaagaccgucaucgcccucacccccgagcucaaggucuucuaccaguccgacauccccaccggccgccccggccccaccugcuuccagauccucggcuucgacauccuccucaugaagaaccucaagcccauccuccucgaggucaacgccaaccccuccaugcgcaucgagcacgagcacgagcucucccccggcgucuucgagaacguccccucccucgucgacgaggaggucaaggucgccgucauccgcgacacccuccgccucauggacccccucaagaagaagcgcgagaaccagucccagcagcucgagaagcccuucgccggcaaggaggacgcccucgacggcgagcucaccuccgcccccgacugcaacgccaaccccgaggcccaccuccccuccaucugccucaagcaggucuuccccaaguacgccaagcaguucaacuaccuccgccucgucgaccgcauggccaaccucuucauccgcuuccucggcaucaagggcaccaugaagcucggccccaccggcuuccgcaccuucauccgcuccugcaagcucuccuccuccucccucuccauggccgccgucgacauccucuacaucgacaucacccgccgcuggaacuccaugacccucgaccagcgcgacuccggcaugugccuccaggccuucgucgaggccuucuucuuccucgcccagcgcaaguucaagaugcucccccuccacgagcaggucgccucccucaucgaccucugcgaguaccaccucucccuccucgacgagaagcgccucgucugcggccgcggcguccccuccggcggccgccccccccaccgcggccccccccaggagcccucccccuccgcccagcccgccggcgacaacccccccccccgcaccuccugcgccaacaagcucucccacccccgccacacccucuccuga

SEQ ID NO: 51302 - RNA, 1935 nt, Artificial Sequence
  derived and/or modified sequence opt2 from TTLL12__Homo_sapiens__NP_055955
auggaggccgagcgcggccccgagcgccgccccgccgagcgcuccucccccggccagacccccgaggagggcgcccaggcccucgccgaguucgccgcccuccacggccccgcccuccgcgccuccggcguccccgagcgcuacuggggccgccuccuccacaagcucgagcacgaggucuucgacgccggcgaggucuucggcaucaugcaggucgaggaggucgaggaggaggaggacgaggccgcccgcgagguccgcaagcagcagcccaaccccggcaacgagcucugcuacaaggucaucgucacccgcgaguccggccuccaggccgcccaccccaacuccaucuuccucaucgaccacgccuggaccugccgcgucgagcacgcccgccagcagcuccagcagguccccggccuccuccaccgcauggccaaccucaugggcaucgaguuccacggcgagcuccccuccaccgaggccgucgcccucguccucgaggagauguggaaguucaaccagaccuaccagcucgcccacggcaccgccgaggagaagaugcccgucugguacaucauggacgaguucggcucccgcauccagcacgccgacguccccuccuucgccaccgcccccuucuucuacaugccccagcaggucgccuacacccuccucuggccccuccgcgaccucgacaccggcgaggaggucacccgcgacuucgccuacggcgagaccgacccccucauccgcaagugcaugcuccuccccugggcccccaccgacaugcucgaccucuccuccugcacccccgagccccccgccgagcacuaccaggccauccucgaggagaacaaggagaagcucccccucgacaucaaccccgucguccacccccacggccacaucuucaaggucuacaccgacguccagcaggucgccuccucccucacccacccccgcuucacccucacccaguccgaggccgacgccgacauccucuucaacuucucccacuucaaggacuaccgcaagcucucccaggagcgccccggcguccuccucaaccaguuccccugcgagaaccuccucaccgucaaggacugccucgccuccaucgcccgccgcgccggcggccccgagggcccccccuggcucccccgcaccuucaaccuccgcaccgagcucccccaguucgucuccuacuuccagcagcgcgagcgcuggggcgaggacaaccacuggaucugcaagcccuggaaccucgcccgcucccucgacacccacgucaccaagucccuccacuccaucauccgccaccgcgaguccacccccaaggucgucuccaaguacaucgagucccccguccucuuccuccgcgaggacgucggcaaggucaaguucgacauccgcuacaucguccuccuccgcuccguccgcccccuccgccucuucgucuacgacgucuucuggcuccgcuucuccaaccgcgccuucgcccucaacgaccucgacgacuacgagaagcacuucaccgucaugaacuacgaccccgacgucguccucaagcagguccacugcgaggaguucauccccgaguucgagaagcaguaccccgaguuccccuggaccgacguccaggccgagaucuuccgcgccuucaccgagcucuuccaggucgccugcgccaagccccccccccucggccucugcgacuaccccuccucccgcgccauguacgccgucgaccucaugcucaagugggacaacggccccgacggccgccgcgucaugcagccccagauccucgaggucaacuucaaccccgacugcgagcgcgccugccgcuaccaccccaccuucuucaacgacgucuucuccacccucuuccucgaccagcccggcggcugccacgucaccugccucgucuga

SEQ ID NO: 51303 - RNA, 1272 nt, Artificial Sequence
  derived and/or modified sequence opt2 from TTLL1__Homo_sapiens__NP_036395
auggccggcaaggucaagugggucaccgacaucgagaaguccguccucaucaacaacuucgagaagcgcggcuggguccaggucaccgagaacgaggacuggaacuucuacuggauguccguccagaccauccgcaacgucuucuccgucgaggccggcuaccgccucuccgacgaccagaucgucaaccacuuccccaaccacuacgagcucacccgcaaggaccucauggucaagaacaucaagcgcuaccgcaaggagcucgagaaggagggcuccccccucgccgagaaggacgagaacggcaaguaccucuaccucgacuucguccccgucaccuacaugcuccccgccgacuacaaccucuucgucgaggaguuccgcaagucccccuccuccaccuggaucaugaagcccugcggcaaggcccagggcaagggcaucuuccucaucaacaagcucucccagaucaagaaguggucccgcgacuccaagaccuccuccuucgucucccaguccaacaaggaggccuacgucaucucccucuacaucaacaacccccuccucaucggcggccgcaaguucgaccuccgccucuacguccucgucuccaccuaccgcccccuccgcugcuacauguacaagcucggcuucugccgcuucugcaccgucaaguacacccccuccaccuccgagcucgacaacauguucguccaccucaccaacgucgccauccagaagcacggcgaggacuacaaccacauccacggcggcaaguggaccgucuccaaccuccgccucuaccucgaguccacccgcggcaaggaggucaccuccaagcucuucgacgagauccacuggaucaucguccagucccucaaggccgucgcccccgucaugaacaacgacaagcacugcuucgagugcuacggcuacgacaucaucaucgacgacaagcucaagcccuggcucaucgaggucaacgccucccccucccucaccuccuccaccgccaacgaccgcauccucaaguacaaccucaucaacgacacccucaacaucgccguccccaacggcgagauccccgacugcaaguggaacaaguccccccccaaggagguccucggcaacuacgagauccucuacgacgaggagcucgcccagggcgacggcgccgaccgcgagcuccgcucccgccagggccagucccucggcccccgcgccggccgcucccgcgacuccggccgcgccguccucaccaccuggaaguga

SEQ ID NO: 51304 - RNA, 2748 nt, Artificial Sequence
  derived and/or modified sequence opt2 from TTLL3__Homo_sapiens__NP_001021100
augcagggccccgacgccccccuccuccucuccgcccgcgagcucggccccggccgccgcggcuccgccuccugguaccgccaggagggcggcgccgucugcaacuggcuccgcaagccccagccccucgagccccgcaccuccuuccccuccgcccgccgcuccgaguuccgccccccccgccgccuccccugggccggccccgccuccgcccaguccgaggagggccacgccggcggccgcugccaggccggcucccccgcccccgcccgccgccucuccggcgccuucaagacccucguccccggcacccacgcccagggcgccuccgacacccacccccucggccccccccacacccccguccucgaccccuccccccaggacggcuuccccguccucuggcgcggcuccuccaaggccucccacaugaaccgccuccgcaacgccaagaucuacgucgagcgcgccgucaagcagaagaagaucuucaccauccagggcugcuaccccgucauccgcugccuccuccgccgccgcggcugggucgagaagaagaugguccaccgcuccggccccacccuccuccccccccagaaggaccucgacuccuccgccaugggcgacuccgacaccaccgaggacgaggacgaggacgaggacgaggaguuccagcccucccagcucuucgacuucgacgaccuccucaaguucgacgaccucgacggcacccacgcccucauggucggccucugccucaaccuccgcaaccuccccugguucgacgaggucgacgccaacuccuucuucccccgcugcuacugccucggcgccgaggacgacaagaaggccuucaucgaggacuucuggcucaccgccgcccgcaacguccucaagcucgucgucaaguccgaguggaaguccuaccccauccaggccgucgaggaggaggccuccggcgacaagcagcccaagaagcaggagaagaaccccguccucgucucccccgaguucgucgacgaggcccucugcgccugcgaggaguaccucuccaaccucgcccacauggacaucgacaaggaccucgaggccccccucuaccucacccccgagggcuggucccucuuccuccagcgcuacuaccaggucguccacgagggcgccgagcuccgccaccucgacacccagguccagcgcugcgaggacauccuccagcagcuccaggccgucgucccccagaucgacauggagggcgaccgcaacaucuggaucgucaagcccggcgccaagucccgcggccgcggcaucaugugcauggaccaccucgaggagaugcucaagcucgucaacggcaaccccgucgucaugaaggacggcaagugggucguccagaaguacaucgagcgcccccuccucaucuucggcaccaaguucgaccuccgccagugguuccucgucaccgacuggaacccccucaccgucugguucuaccgcgacuccuacauccgcuucuccacccagcccuucucccucaagaaccucgacaacuccguccaccucugcaacaacuccauccagaagcaccucgagaacuccugccaccgccacccccuccucccccccgacaacaugugguccucccagcgcuuccaggcccaccuccaggagaugggcgcccccaacgccugguccaccaucaucguccccggcaugaaggacgccgucauccacgcccuccagaccucccaggacaccguccagugccgcaaggccuccuucgagcucuacggcgccgacuucgucuucggcgaggacuuccagcccuggcucaucgagaucaacgccucccccaccauggcccccuccaccgccgucaccgcccgccucugcgccggcguccaggccgacacccuccgcgucgucaucgaccgcaugcucgaccgcaacugcgacaccggcgccuucgagcucaucuacaagcagcccgccgucgaggucccccaguacgucggcauccgccuccucgucgagggcuucaccaucaagaagcccauggccaugugccaccgccgcaugggcguccgccccgccgucccccuccucacccagcgcggcuccggcgaggcccgccaccacuuccccucccuccacaccaaggcccagcuccccuccccccacguccuccgccaccagggccagguccuccgccgccagcacuccaagcucgucggcaccaaggcccucuccaccaccggcaaggcccuccgcacccuccccaccgccaaggucuucaucucccucccccccaaccucgacuucaaggucgcccccuccauccucaagccccgcaaggcccccgcccuccucugccuccgcggcccccagcucgagguccccugcugccucugcccccucaaguccgagcaguuccucgcccccgucggccgcucccgccccaaggccaacucccgccccgacugcgacaagccccgcgccgaggccugccccaugaagcgccucuccccccucaagccccucccccucgucggcaccuuccagcgccgccgcggccucggcgacaugaagcucggcaagccccuccuccgcuuccccaccgcccucguccucgaccccacccccaacaagaagaagcaggucaaguaccucggccucgacuccaucgccgucggcggcucccgcgucgacggcgcccgccccugcacccccggcuccaccgcccgcgccuga

SEQ ID NO: 51305 - RNA, 3600 nt, Artificial Sequence
  derived and/or modified sequence opt2 from TTLL4__Homo_sapiens__NP_055455
auggccuccgccggcacccagcacuacuccaucggccuccgccagaagaacuccuucaagcaguccggccccuccggcaccguccccgccaccccccccgagaagcccuccgagggccgcgucuggccccaggcccaccagcaggucaagcccaucuggaagcucgagaagaagcaggucgagacccucuccgccggccucggccccggccuccucggcguccccccccagcccgccuacuucuucugccccuccacccucugcuccuccggcaccaccgccgucaucgccggccacuccuccuccugcuaccuccacucccuccccgaccucuucaacuccacccuccucuaccgccgcuccuccuaccgccagaagcccuaccagcagcucgaguccuucugccuccgcuccucccccuccgagaagucccccuucucccucccccagaagucccuccccgucucccucaccgccaacaaggccaccuccuccauggucuucuccauggcccagcccauggccuccuccuccaccgagcccuaccucugccucgccgccgccggcgagaaccccuccggcaagucccucgccuccgccaucuccggcaagauccccuccccccucuccuccuccuacaagcccaugcucaacaacaacuccuucauguggcccaacuccacccccgucccccuccuccagaccacccagggccucaagcccgucuccccccccaagauccagcccgucuccuggcaccacuccggcggcaccggcgacugcgccccccagcccgucgaccacaagguccccaaguccaucggcaccguccccgccgacgccuccgcccacaucgcccucuccaccgccuccucccacgacaccuccaccaccuccgucgccuccuccugguacaaccgcaacaaccucgccaugcgcgccgagccccucuccugcgcccucgacgacuccuccgacucccaggaccccaccaaggagauccgcuucaccgaggccguccgcaagcucaccgcccgcggcuucgagaagaugccccgccagggcugccagcucgagcaguccuccuuccucaaccccuccuuccaguggaacguccucaaccgcucccgccgcuggaagccccccgccgucaaccagcaguucccccaggaggacgccggcuccguccgccgcguccuccccggcgccuccgacacccucggccucgacaacaccgucuucugcaccaagcgcaucuccauccaccuccucgccucccacgccuccggccucaaccacaaccccgccugcgaguccgucaucgacuccuccgccuucggcgagggcaaggcccccggcccccccuucccccagacccucggcaucgccaacgucgccacccgccucuccuccauccagcucggccaguccgagaaggagcgccccgaggaggcccgcgagcucgacuccuccgaccgcgacaucuccuccgccaccgaccuccagcccgaccaggccgagaccgaggacaccgaggaggagcucgucgacggccucgaggacugcugcucccgcgacgagaacgaggaggaggagggcgacuccgagugcuccucccucuccgccgucucccccuccgaguccgucgccaugaucucccgcuccugcauggagauccucaccaagccccucuccaaccacgagaaggucguccgccccgcccucaucuacucccucuuccccaacgucccccccaccaucuacuucggcacccgcgacgagcgcgucgagaagcuccccugggagcagcgcaagcuccuccgcuggaagauguccaccgucacccccaacaucgucaagcagaccaucggccgcucccacuucaagaucuccaagcgcaacgacgacuggcucggcugcuggggccaccacaugaagucccccuccuuccgcuccauccgcgagcaccagaagcucaaccacuuccccggcuccuuccagaucggccgcaaggaccgccucuggcgcaaccucucccgcaugcagucccgcuucggcaagaaggaguucuccuucuucccccaguccuucauccucccccaggacgccaagcuccuccgcaaggccugggaguccuccucccgccagaaguggaucgucaagccccccgccuccgcccgcggcaucggcauccaggucauccacaaguggucccagcuccccaagcgccgcccccuccucguccagcgcuaccuccacaagcccuaccucaucuccggcuccaaguucgaccuccgcaucuacgucuacgucaccuccuacgacccccuccgcaucuaccucuucuccgacggccucguccgcuucgccuccugcaaguacucccccuccaugaagucccucggcaacaaguucaugcaccucaccaacuacuccgucaacaagaagaacgccgaguaccaggccaacgccgacgagauggccugccagggccacaagugggcccucaaggcccucuggaacuaccucucccagaagggcgucaacuccgacgccaucugggagaagaucaaggacgucgucgucaagaccaucaucuccuccgagcccuacgucaccucccuccucaagauguacguccgccgccccuacuccugccacgagcucuucggcuucgacaucaugcucgacgagaaccucaagcccuggguccucgaggucaacaucucccccucccuccacuccuccuccccccucgacaucuccaucaagggccagaugauccgcgaccuccucaaccucgccggcuucguccuccccaacgccgaggacaucaucuccucccccuccuccugcuccuccuccaccaccucccuccccaccucccccggcgacaagugccgcauggcccccgagcacgucaccgcccagaagaugaagaaggccuacuaccucacccagaagauccccgaccaggacuucuacgccuccguccucgacguccucacccccgacgacguccgcauccucgucgagauggaggacgaguucucccgccgcggccaguucgagcgcaucuuccccucccacaucuccucccgcuaccuccgcuucuucgagcagccccgcuacuucaacauccucaccacccagugggagcagaaguaccacggcaacaagcucaagggcgucgaccuccuccgcuccuggugcuacaagggcuuccacaugggcgucgucuccgacuccgcccccgucuggucccuccccaccucccuccucaccaucuccaaggacgacgucauccucaacgccuucuccaaguccgagaccuccaagcucggcaagcaguccuccugcgaggucucccuccuccucuccgaggacggcaccacccccaaguccaagaagacccaggccggccucucccccuacccccagaagcccuccuccuccaaggacuccgaggacaccuccaaggagcccucccucuccacccagacccuccccgucaucaagugcuccggccagaccucccgccucuccgccuccuccaccuuccaguccaucuccgacucccuccucgccgucucccccuga

SEQ ID NO: 51306 - RNA, 3846 nt, Artificial Sequence
  derived and/or modified sequence opt2 from TTLL5__Homo_sapiens__NP_055887
augcccaucgucauggcccgcgaccucgaggagaccgccuccuccuccgaggacgaggaggucaucucccaggaggaccaccccugcaucauguggaccggcggcugccgccgcauccccguccucgucuuccacgccgacgccauccucaccaaggacaacaacauccgcgucaucggcgagcgcuaccaccucuccuacaagaucguccgcaccgacucccgccucguccgcuccauccucaccgcccacggcuuccacgagguccaccccuccuccaccgacuacaaccucauguggaccggcucccaccucaagcccuuccuccuccgcacccucuccgaggcccagaaggucaaccacuucccccgcuccuacgagcucacccgcaaggaccgccucuacaagaacaucauccgcaugcagcacacccacggcuucaaggccuuccacauccucccccagaccuuccuccuccccgccgaguacgccgaguucugcaacuccuacuccaaggaccgcggccccuggaucgucaagcccgucgccuccucccgcggccgcggcgucuaccucaucaacaaccccaaccagaucucccucgaggagaacauccucgucucccgcuacaucaacaacccccuccucaucgacgacuucaaguucgacguccgccucuacguccucgucaccuccuacgacccccucgucaucuaccucuacgaggagggccucgcccgcuucgccaccguccgcuacgaccagggcgccaagaacauccgcaaccaguucaugcaccucaccaacuacuccgucaacaagaaguccggcgacuacgucuccugcgacgaccccgaggucgaggacuacggcaacaagugguccauguccgccaugcuccgcuaccucaagcaggagggccgcgacaccaccgcccucauggcccacgucgaggaccucaucaucaagaccaucaucuccgccgagcucgccaucgccaccgccugcaagaccuucgucccccaccgcuccuccugcuucgagcucuacggcuucgacguccucaucgacuccacccucaagcccuggcuccucgaggucaaccucucccccucccucgccugcgacgccccccucgaccucaagaucaaggccuccaugaucuccgacauguucaccgucgucggcuucgucugccaggaccccgcccagcgcgccuccacccgccccaucuaccccaccuucgaguccucccgccgcaaccccuuccagaagccccagcgcugccgcccccucuccgccuccgacgccgagaugaagaaccucgucggcuccgcccgcgagaagggccccggcaagcucggcggcuccguccucggccucuccauggaggagaucaagguccuccgccgcgucaaggaggagaacgaccgccgcggcggcuucauccgcaucuuccccaccuccgagaccugggagaucuacggcuccuaccucgagcacaagaccuccaugaacuacaugcucgccacccgccucuuccaggaccgcaugaccgccgacggcgcccccgagcucaagaucgagucccucaacuccaaggccaagcuccacgccgcccucuacgagcgcaagcuccucucccucgagguccgcaagcgccgccgccgcuccucccgccuccgcgccaugcgccccaaguaccccgucaucacccagcccgccgagaugaacgucaagaccgagaccgaguccgaggaggaggaggaggucgcccucgacaacgaggacgaggagcaggaggccucccaggaggaguccgccggcuuccuccgcgagaaccaggccaaguacacccccucccucaccgcccucgucgagaacacccccaaggagaacuccaugaagguccgcgaguggaacaacaagggcggccacugcugcaagcucgagacccaggagcucgagcccaaguucaaccucaugcagauccuccaggacaacggcaaccucuccaagaugcaggcccgcaucgccuucuccgccuaccuccagcacguccagauccgccucaugaaggacuccggcggccagaccuucuccgccuccugggccgccaaggaggacgagcagauggagcucgucguccgcuuccucaagcgcgccuccaacaaccuccagcacucccuccgcaugguccuccccucccgccgccucgcccuccucgagcgccgccgcauccucgcccaccagcucggcgacuucaucaucgucuacaacaaggagaccgagcagauggccgagaagaaguccaagaagaaggucgaggaggaggaggaggacggcgucaacauggagaacuuccaggaguucauccgccaggccuccgaggccgagcucgaggagguccucaccuucuacacccagaagaacaaguccgccuccgucuuccucggcacccacuccaagaucuccaagaacaacaacaacuacuccgacuccggcgccaagggcgaccaccccgagaccaucauggaggaggucaagaucaagccccccaagcagcagcagaccaccgagauccacuccgacaagcucucccgcuucaccaccuccgccgagaaggaggccaagcucgucuacuccaacuccuccuccggccccaccgccacccuccagaagauccccaacacccaccucuccuccgucaccaccuccgaccucucccccggccccugccaccacuccucccucucccagauccccuccgccauccccuccaugccccaccagcccaccauccuccucaacaccgucuccgccuccgccucccccugccuccaccccggcgcccagaacauccccucccccaccggccucccccgcugccgcuccggcucccacaccaucggccccuucuccuccuuccaguccgccgcccacaucuacucccagaagcucucccgccccuccuccgccaaggccggcuccugcuaccucaacaagcaccacuccggcaucgccaagacccagaaggagggcgaggacgccucccucuacuccaagcgcuacaaccaguccauggucaccgccgagcuccagcgccucgccgagaagcaggccgcccgccaguacucccccuccucccacaucaaccuccucacccagcaggucaccaaccucaaccucgccaccggcaucaucaaccgcuccuccgccuccgccccccccacccuccgccccaucaucucccccuccggccccaccugguccacccaguccgacccccaggcccccgagaaccacuccuccucccccggcucccgcucccuccagaccggcggcuucgccugggagggcgaggucgagaacaacgucuacucccaggccaccggcgucgucccccagcacaaguaccaccccaccgccggcuccuaccagcuccaguucgcccuccagcagcucgagcagcagaagcuccagucccgccagcuccucgaccagucccgcgcccgccaccaggccaucuucggcucccagacccuccccaacuccaaccucuggaccaugaacaacggcgccggcugccgcaucuccuccgccaccgccuccggccagaagcccaccacccucccccagaaggucguccccccccccuccuccugcgccucccucguccccaagcccccccccaaccacgagcagguccuccgccgcgccaccucccagaaggccuccaagggcuccuccgccgagggccagcucaacggccuccaguccucccucaaccccgccgccuucguccccaucaccuccuccaccgaccccgcccacaccaagaucuga

SEQ ID NO: 51307 - RNA, 2676 nt, Artificial Sequence
  derived and/or modified sequence opt2 from TTLL6__Homo_sapiens__NP_001124390
augggcgcccuccuccuccaccccucccgccgcggccccgccggcgucgucgccuccuggaccuccucccccgccggccgcgacggcggcgucggcaucgccggcgccugguacuucccccgcgccuccucccaggcccgcgagaugccccagugccccacccucgagucccaggagggcgagaacuccgaggagaagggcgacuccuccaaggaggaccccaaggagaccgucgcccucgccuucguccgcgagaaccccggcgcccagaacggccuccagaacgcccagcagcagggcaagaagaagcgcaagaagaagcgccucgucaucaaccucuccuccugccgcuacgaguccguccgccgcgccgcccagcaguacggcuuccgcgagggcggcgaggacgacgacuggacccucuacuggaccgacuacuccgucucccucgagcgcgucauggagaugaaguccuaccagaagaucaaccacuuccccggcauguccgagaucugccgcaaggaccuccucgcccgcaacaugucccgcaugcucaagauguuccccaaggacuuccgcuucuucccccgcaccuggugccuccccgccgacuggggcgaccuccagaccuacucccgcucccgcaagaacaagaccuacaucugcaagcccgacuccggcugccagggcaagggcaucuucaucacccgcaccgucaaggagaucaagcccggcgaggacaugaucugccagcucuacaucuccaagcccuucaucaucgacggcuucaaguucgaccuccgcaucuacguccucgucaccuccugcgacccccuccgcaucuucgucuacaacgagggccucgcccgcuucgccaccaccuccuacucccgccccugcaccgacaaccucgacgacaucugcaugcaccucaccaacuacuccaucaacaagcacuccuccaacuucucccgcgacgcccacuccggcuccaagcgcaagcucuccaccuucuccgccuaccucgaggaccacuccuacaacgucgagcagaucuggcgcgacaucgaggacgucaucaucaagacccucaucuccgcccaccccaucauccgccacaacuaccacaccugcuuccccaaccacacccucaacuccgccugcuucgagauccucggcuucgacauccuccucgaccacaagcucaagcccuggcuccucgaggucaaccacucccccuccuucuccaccgacucccgccucgacaaggaggucaaggacggccuccucuacgacacccucguccucaucaaccucgaguccugcgacaagaagaagguccucgaggaggagcgccagcgcggccaguuccuccagcagugcugcucccgcgagaugcgcaucgaggaggccaagggcuuccgcgccguccagcucaagaagaccgagaccuacgagaaggagaacugcggcggcuuccgccucaucuaccccucccucaacuccgagaaguacgagaaguucuuccaggacaacaacucccucuuccagaacaccgucgccucccgcgcccgcgaggaguacgcccgccagcucauccaggagcuccgccucaagcgcgagaagaagcccuuccagaugaagaagaaggucgagaugcagggcgaguccgccggcgagcagguccgcaagaagggcaugcgcggcuggcagcagaagcagcagcagaaggacaaggccgccacccaggccuccaagcaguacauccagccccucacccucgucuccuacacccccgaccuccuccucuccguccgcggcgagcgcaagaacgagaccgacuccucccucaaccaggaggcccccaccgaggaggccuccuccgucuuccccaagcucaccuccgccaagcccuucuccucccuccccgaccuccgcaacaucaaccucuccuccuccaagcucgagcccuccaagcccaacuucuccaucaaggaggccaaguccgccuccgccgucaacgucuucaccggcaccguccaccucaccuccgucgagaccacccccgaguccaccacccagcucuccaucucccccaaguccccccccacccucgccgucaccgccuccuccgaguacuccggccccgagaccgaccgcgucgucuccuucaagugcaagaagcagcagacccccccccaccucacccagaagaagaugcucaaguccuuccuccccaccaaguccaaguccuucugggagucccccaacaccaacuggacccuccucaaguccgacaugaacaagccccaccucaucuccgagcuccucaccaagcuccagcucuccggcaagcucuccuucuuccccgcccacuacaaccccaagcucggcaugaacaaccucucccagaaccccucccuccccggcgagugccacucccgcuccgacuccuccggcgagaagcgccagcucgacgucuccucccuccuccuccaguccccccaguccuacaacgucacccuccgcgaccuccucgucaucgccacccccgcccagcucgacccccgccccugccgcucccacgccuccgccaugcgcgaccccugcaugcaggaccaggaggccuacucccacugccucaucuccggccagaagggcugcgagcgcuccuga

SEQ ID NO: 51308 - RNA, 2490 nt, Artificial Sequence
  derived and/or modified sequence opt2 from TTLL7__Homo_sapiens__XP_011540457
augcccucccucccccaggagggcgucauccagggccccuccccccucgaccucaacaccgagcuccccuaccaguccaccaugaagcgcaagguccgcaagaagaagaagaagggcaccaucaccgccaacgucgccggcaccaaguucgagaucguccgccucgucaucgacgagaugggcuucaugaagacccccgacgaggacgagaccuccaaccucaucuggugcgacuccgccguccagcaggagaagaucuccgagcuccagaacuaccagcgcaucaaccacuuccccggcaugggcgagaucugccgcaaggacuuccucgcccgcaacaugaccaagaugaucaagucccgcccccucgacuacaccuucgucccccgcaccuggaucuuccccgccgaguacacccaguuccagaacuacgucaaggagcucaagaagaagcgcaagcagaagaccuucaucgucaagcccgccaacggcgccaugggccacggcaucucccucauccgcaacggcgacaagcuccccucccaggaccaccucaucguccaggaguacaucgagaagcccuuccucauggagggcuacaaguucgaccuccgcaucuacauccucgucaccuccugcgacccccucaagaucuuccucuaccacgacggccucguccgcaugggcaccgagaaguacaucccccccaacgaguccaaccucacccagcucuacaugcaccucaccaacuacuccgucaacaagcacaacgagcacuucgagcgcgacgagaccgagaacaagggcuccaagcgcuccaucaagugguucaccgaguuccuccaggccaaccagcacgacgucgccaaguucugguccgacaucuccgagcucgucgucaagacccucaucgucgccgagccccacguccuccacgccuaccgcaugugccgccccggccagccccccggcuccgaguccgucugcuucgagguccucggcuucgacauccuccucgaccgcaagcucaagcccuggcuccucgagaucaaccgcgcccccuccuucggcaccgaccagaagaucgacuacgacgucaagcgcggcguccuccucaacgcccucaagcuccucaacauccgcaccuccgacaagcgccgcaaccucgccaagcagaaggccgaggcccagcgccgccucuacggccagaacuccaucaagcgccuccuccccggcuccuccgacugggagcagcagcgccaccagcucgagcgccgcaaggaggagcucaaggagcgccucgcccagguccgcaagcagaucucccgcgaggagcacgagaaccgccacaugggcaacuaccgccgcaucuacccccccgaggacaaggcccuccucgagaaguacgagaaccuccucgccgucgccuuccagaccuuccucuccggccgcgccgccuccuuccagcgcgagcucaacaacccccucaagcgcaugaaggaggaggacauccucgaccuccucgagcagugcgagaucgacgacgagaagcucaugggcaagaccaccaagacccgcggccccaagccccucugcuccaugcccgaguccaccgagaucaugaagcgccccaaguacugcuccuccgacuccuccuacgacuccuccuccuccuccuccgaguccgacgagaacgagaaggaggaguaccagaacaagaagcgcgagaagcaggucaccuacaaccucaagcccuccaaccacuacaagcucauccagcagcccuccuccauccgccgcuccgucuccugcccccgcuccaucuccgcccagucccccuccuccggcgacacccgccccuucuccgcccagcagaugaucuccgucucccgccccaccuccgccucccgcucccacucccucaaccgcgccuccuccuacaugcgccaccucccccacuccaacgacgccugcuccaccaacucccaggucuccgagucccuccgccagcucaagaccaaggagcaggaggacgaccucaccucccagacccucuucguccucaaggacaugaagauccgcuuccccggcaaguccgacgccgaguccgagcuccucaucgaggacaucaucgacaacuggaaguaccacaagaccaaggucgccuccuacuggcucaucaagcucgacuccgucaagcagcgcaagguccucgacaucgucaagaccuccauccgcaccguccucccccgcaucuggaagguccccgacgucgaggaggucaaccucuaccgcaucuucaaccgcgucuucaaccgccuccucuggucccgcggccagggccucuggaacugcuucugcgacuccggcuaccuccuccccggcuccacccaguucuuccuccgcacccccaccuacaaccucaaguacaacucccccggcaugacccgcuccaacguccucuucaccucccgcuacggccaccucuga

SEQ ID NO: 51309 - RNA, 2424 nt, Artificial Sequence
  derived and/or modified sequence opt2 from TTLL8__Homo_sapiens__XP_011529043
augaagaccucccgccucuggaaggucgcccgcuccgagggccccggcggcgccggcguccgcggcgccaagggcaagcucuccgaggccuccauggagcccgagcgcaagggccucucccucgccuccuccuccgacggcgacggccgcgaggagaacaagcucaagcagggcaucucccaggaccucgccuccuccucccgccucgaccgcuacaagaucgcccgccagcucaccgagaaggccaucaaggagaagaagaucuucuccaucuacggccacuaccccgucguccgcgccgcccuccgccgcaagggcugggucgagaagaaguuccacuuccuccccaaggucauccccgacgucgaggacgagggcgcccgcgucaacgacgacaccugcgccaaggucaaggagaaccaggagauggcccucgagaagaccgacaacauccacgacgucaugucccgccucgucaagaacgagaugcccuaccuccucuggaccaucaagcgcgacaucaucgacuaccacucccucaccuacgaccagaugcucaaccacuacgccaagaccgccuccuucaccaccaagaucggccucugcgucaacaugcgcucccuccccugguacguccccgccaaccccgacuccuucuucccccgcugcuacucccucugcaccgaguccgagcagcaggaguuccucgaggacuuccgccgcaccauggccuccuccauccucaagugggucgucucccaccaguccugcucccgcuccucccgcuccaagccccgcgaccagcgcgaggaggccggcuccuccgaccucuccucccgccaggacgccgagaacgccgaggccaagcuccgcggccuccccggccagcucgucgacaucgccugcaaggucugccaggccuaccucggccagcucgagcacgaggacaucgacaccuccgccgacgccgucgaggaccucaccgaggccgagugggaggaccucacccagcaguacuacucccucguccacggcgacgccuucaucuccaacucccgcaacuacuucucccagugccaggcccuccucaaccgcaucaccuccgucaacccccagaccgacaucgacggccuccgcaacaucuggaucaucaagcccgccgccaagucccgcggccgcgacaucgucugcauggaccgcgucgaggagauccucgagcucgccgccgccgaccacccccucucccgcgacaacaagugggucguccagaaguacaucgagaccccccuccucaucugcgacaccaaguucgacauccgccagugguuccucgucaccgacuggaacccccucaccaucugguucuacaaggaguccuaccuccgcuucuccacccagcgcuucucccucgacaagcucgacuccgccauccaccucugcaacaacgccguccagaaguaccucaagaacgacgucggccgcuccccccuccuccccgcccacaacauguggaccuccacccgcuuccaggaguaccuccagcgccagggccgcggcgccgucuggggcuccgucaucuaccccuccaugaagaaggccaucgcccacgccaugaaggucgcccaggaccacgucgagccccgcaagaacuccuucgagcucuacggcgccgacuucguccucggccgcgacuuccgccccuggcucaucgagaucaacuccucccccaccaugcaccccuccacccccgucaccgcccagcucugcgcccagguccaggaggacaccaucaaggucgccgucgaccgcuccugcgacaucggcaacuucgagcuccucuggcgccagcccgucgucgagcccccccccuucuccggcuccgaccucugcgucgccggcgucuccguccgccgcgcccgccgccagguccuccccgucugcaaccucaaggccuccgccucccuccucgacgcccagccccucaaggcccgcggccccuccgccaugcccgaccccgcccagggcccccccucccccgcccuccagcgcgaccucggccucaaggaggagaagggccucccccucgcccuccucgccccccuccgcggcgccgccgaguccggcggcgccgcccagcccacccgcaccaaggccgccggcaaggucgagcuccccgccugccccugccgccacgucgacucccaggcccccaacaccggcguccccgucgcccagcccgccaaguccugggaccccaaccagcucaacgcccacccccucgagcccguccuccgcggccucaagaccgccgagggcgcccuccgccccccccccggcggcaagggccaccagcgcgaggccgccggcggccucgcccagugccagaucaccaugcucaagcgcaaggaccuccucugccucuga

SEQ ID NO: 51310 - RNA, 1320 nt, Artificial Sequence
  derived and/or modified sequence opt2 from TTLL9__Homo_sapiens__NP_001008409
augguccccucccgcgaggcccuccucggccccggcaccaccgccauccgcugccccaagaagcuccagaaccagaacuacaagggccacggccucuccaagggcaaggagcgcgagcagcgcgccuccauccgcuucaagaccacccucaugaacacccucauggacguccuccgccaccgccccggcugggucgaggucaaggacgagggcgagugggacuucuacuggugcgacgucuccuggcuccgcgagaacuucgaccacaccuacauggacgagcacguccgcaucucccacuuccgcaaccacuacgagcucacccgcaagaacuacauggucaagaaccucaagcgcuuccgcaagcagcucgagcgcgaggccggcaagcucgaggccgccaagugcgacuucuuccccaagaccuucgagaugcccugcgaguaccaccucuucgucgaggaguuccgcaagaaccccggcaucaccuggaucaugaagcccgucgcccgcucccagggcaagggcaucuuccucuuccgccgccucaaggacaucgucgacuggcgcaaggacacccgcuccuccgacgaccagaaggacgacauccccgucgagaacuacgucgcccagcgcuacaucgagaaccccuaccucaucggcggccgcaaguucgaccuccgcgucuacguccucgucauguccgucuucgccgagugccuccucugguccggccaccgccgccaggacguccaccucaccaacgucgccguccagaagaccucccccgacuaccaccccaagaagggcugcaaguggacccuccagcgcuuccgccaguaccucgccuccaagcacggccccgaggccgucgagacccucuuccgcgacaucgacaacaucuucgucaagucccuccaguccguccagaaggucaucaucuccgacaagcacugcuucgagcucuacggcuacgacauccucaucgaccaggaccucaagcccuggcuccucgaggucaacgccucccccucccucaccgccuccucccaggaggacuacgagcucaagaccugccuccucgaggacacccuccacgucgucgacauggaggcccgccucaccggccgcgagaagcgcgucggcggcuucgaccucauguggaacgacggccccgucucccgcgaggagggcgcccccgaccucuccggcaugggcaacuucgucaccaacacccaccucggcugcgucaacgaccgcaagaagcagcuccgccagcucuucugcucccuccagguccagaagaaggccuccuccuga

SEQ ID NO: 51311 - RNA, 837 nt, Artificial Sequence
  derived and/or modified sequence opt2 from TTPA__Homo_sapiens__NP_000361
auggccgaggcccgcucccagcccuccgccggcccccagcucaacgcccuccccgaccacuccccccuccuccagcccggccucgccgcccuccgccgccgcgcccgcgaggccggcgucccccucgccccccucccccucaccgacuccuuccuccuccgcuuccuccgcgcccgcgacuucgaccucgaccucgccuggcgccuccucaagaacuacuacaaguggcgcgccgagugccccgagaucuccgccgaccuccacccccgcuccaucaucggccuccucaaggccggcuaccacggcguccuccgcucccgcgaccccaccggcuccaagguccucaucuaccgcaucgcccacugggaccccaaggucuucaccgccuacgacgucuuccgcgucucccucaucaccuccgagcucaucguccaggaggucgagacccagcgcaacggcaucaaggccaucuucgaccucgagggcuggcaguucucccacgccuuccagaucacccccuccgucgccaagaagaucgccgccguccucaccgacuccuucccccucaagguccgcggcauccaccucaucaacgagcccgucaucuuccacgccgucuucuccaugaucaagcccuuccucaccgagaagaucaaggagcgcauccacaugcacggcaacaacuacaagcagucccuccuccagcacuuccccgacauccucccccucgaguacggcggcgaggaguucuccauggaggacaucugccaggaguggaccaacuucaucaugaaguccgaggacuaccucuccuccaucuccgaguccauccaguga

SEQ ID NO: 51312 - RNA, 444 nt, Artificial Sequence
  derived and/or modified sequence opt2 from TTR__Homo_sapiens__NP_000362
auggccucccaccgccuccuccuccucugccucgccggccucgucuucgucuccgaggccggccccaccggcaccggcgaguccaagugcccccucauggucaagguccucgacgccguccgcggcucccccgccaucaacgucgccguccacgucuuccgcaaggccgccgacgacaccugggagcccuucgccuccggcaagaccuccgaguccggcgagcuccacggccucaccaccgaggaggaguucgucgagggcaucuacaaggucgagaucgacaccaaguccuacuggaaggcccucggcaucucccccuuccacgagcacgccgaggucgucuucaccgccaacgacuccggcccccgccgcuacaccaucgccgcccuccucucccccuacuccuacuccaccaccgccgucgucaccaaccccaaggaguga

SEQ ID NO: 51313 - RNA, 1383 nt, Artificial Sequence
  derived and/or modified sequence opt2 from TTYH1__Homo_sapiens__NP_001005367
augggcgccccccccggcuaccgccccuccgccuggguccaccuccuccaccagcucccccgcgccgacuuccagcuccgccccguccccuccgucuucgccccccaggagcaggaguaccagcaggcccuccuccucgucgccgcccucgccggccucggccucggccucucccucaucuucaucgccgucuaccucauccgcuucugcugcugccgcccccccgagccccccggcuccaagauccccucccccggcggcggcugcgucaccugguccugcaucgucgcccuccucgccggcugcaccggcaucggcaucggcuucuacggcaacuccgagaccuccgacggcgucucccagcucuccuccgcccuccuccacgccaaccacacccucuccaccaucgaccaccucguccucgagaccgucgagcgccucggcgaggccguccgcaccgagcucaccacccucgaggagguccucgagccccgcaccgagcucgucgccgccgcccgcggcgcccgccgccaggccgaggccgccgcccagcagcuccagggccucgccuucuggcagggcgucccccucuccccccuccaggucgccgagaacgucuccuucgucgaggaguaccgcuggcucgccuacguccuccuccuccuccucgagcuccucgucugccucuucacccuccucggccucgccaagcaguccaaguggcucgucaucgucaugaccgucaugucccuccucguccucguccucuccuggggcuccaugggccucgaggccgccaccgccgucggccucuccgacuucugcuccaaccccgaccccuacguccucaaccucacccaggaggagaccggccucuccuccgacauccucuccuacuaccuccucugcaaccgcgccgucuccaaccccuuccagcagcgccucacccucucccagcgcgcccucgccaacauccacucccagcuccucggccucgagcgcgaggccgucccccaguuccccuccgcccagaagccccuccucucccucgaggagacccucaacgucaccgagggcaacuuccaccagcucgucgcccuccuccacugccgcucccuccacaaggacuacggcgccgcccuccgcggccucugcgaggacgcccucgagggccuccucuuccuccuccucuucucccuccucuccgccggcgcccucgccaccgcccucugcucccucccccgcgccugggcccucuuccccccccgcaaccccuccgcccucugcuccggcucccgccucuccgagccccuccuccccgccggccucgagcccggcuccccccuccgcuccuuccccggcugccgccgccgcccccacuga

SEQ ID NO: 51314 - RNA, 1605 nt, Artificial Sequence
  derived and/or modified sequence opt2 from TTYH2__Homo_sapiens__NP_116035
augcaggccgcccgcgucgacuacaucgcccccuggugggucgucuggcuccacuccgucccccacgucggccuccgccuccagcccgucaacuccaccuucucccccggcgacgaguccuaccaggagucccuccucuuccucggccucgucgccgccgucugccucggccucaaccucaucuuccucgucgccuaccucgucugcgccugccacugccgccgcgacgacgccguccagaccaagcagcaccacuccugcugcaucaccuggaccgccgucgucgccggccucaucugcugcgccgccgucggcgucggcuucuacggcaacuccgagaccaacgacggcgccuaccagcucauguacucccucgacgacgccaaccacaccuucuccggcaucgacgcccucgucuccggcaccacccagaagaugaaggucgaccucgagcagcaccucgcccgccucuccgagaucuucgccgcccgcggcgacuaccuccagacccucaaguucauccagcagauggccggcuccgucgucguccagcucuccggccuccccgucuggcgcgaggucaccauggagcucaccaagcucuccgaccagaccggcuacgucgaguacuaccgcuggcucuccuaccuccuccucuucauccucgaccucgucaucugccucaucgccugccucggccucgccaagcgcuccaagugccuccucgccuccaugcucugcugcggcgcccucucccuccuccucuccugggccucccucgccgccgacggcuccgccgccgucgccaccuccgacuucugcgucgcccccgacaccuucauccucaacgucaccgagggccagaucuccaccgaggucacccgcuacuaccucuacugcucccaguccggcuccucccccuuccagcagacccucaccaccuuccagcgcgcccucaccaccaugcagauccaggucgccggccuccuccaguucgccgucccccucuucuccaccgccgaggaggaccuccucgccauccagcuccuccucaacuccuccgaguccucccuccaccagcucaccgccauggucgacugccgcggccuccacaaggacuaccucgacgcccucgccggcaucugcuacgacggccuccagggccuccucuaccucggccucuucuccuuccucgccgcccucgccuucuccaccaugaucugcgccggcccccgcgccuggaagcacuucaccacccgcaaccgcgacuacgacgacaucgacgacgacgaccccuucaacccccaggccuggcgcauggccgcccacucccccccccgcggccagcuccacuccuucugcuccuacuccuccggccucggcucccagaccucccuccagccccccgcccagaccaucuccaacgcccccgucuccgaguacaugaaccaggccaugcucuucggccgcaacccccgcuacgagaacgucccccucaucggccgcgccucccccccccccaccuacucccccuccaugcgcgccaccuaccucuccgucgccgacgagcaccuccgccacuacggcaaccaguuccccgccuga

SEQ ID NO: 51315 - RNA, 1356 nt, Artificial Sequence
  derived and/or modified sequence opt2 from TUBA1A__Homo_sapiens__NP_001257328
augcgcgagugcaucuccauccacgucggccaggccggcguccagaucggcaacgccugcugggagcucuacugccucgagcacggcauccagcccgacggccagaugcccuccgacaagaccaucggcggcggcgacgacuccuucaacaccuucuucuccgagaccggcgccggcaagcacgucccccgcgccgucuucgucgaccucgagcccaccgucaucgacgagguccgcaccggcaccuaccgccagcucuuccaccccgagcagcucaucaccggcaaggaggacgccgccaacaacuacgcccgcggccacuacaccaucggcaaggagaucaucgaccucguccucgaccgcauccgcaagcucgccgaccagugcaccggccuccagggcuuccucgucuuccacuccuucggcggcggcaccggcuccggcuucaccucccuccucauggagcgccucuccgucgacuacggcaagaaguccaagcucgaguucuccaucuaccccgccccccaggucuccaccgccgucgucgagcccuacaacuccauccucaccacccacaccacccucgagcacuccgacugcgccuucauggucgacaacgaggccaucuacgacaucugccgccgcaaccucgacaucgagcgccccaccuacaccaaccucaaccgccucaucggccagaucgucuccuccaucaccgccucccuccgcuucgacggcgcccucaacgucgaccucaccgaguuccagaccaaccucguccccuacccccgcauccacuucccccucgccaccuacgcccccgucaucuccgccgagaaggccuaccacgagcagcucuccgucgccgagaucaccaacgccugcuucgagcccgccaaccagauggucaagugcgacccccgccacggcaaguacauggccugcugccuccucuaccgcggcgacgucguccccaaggacgucaacgccgccaucgccaccaucaagaccaagcgcaccauccaguucgucgacuggugccccaccggcuucaaggucggcaucaacuaccagccccccaccgucguccccggcggcgaccucgccaagguccagcgcgccgucugcaugcucuccaacaccaccgccaucgccgaggccugggcccgccucgaccacaaguucgaccucauguacgccaagcgcgccuucguccacugguacgucggcgagggcauggaggagggcgaguucuccgaggcccgcgaggacauggccgcccucgagaaggacuacgaggaggucggcgucgacuccgucgagggcgagggcgaggaggagggcgaggaguacuga

SEQ ID NO: 51316 - RNA, 1356 nt, Artificial Sequence
  derived and/or modified sequence opt2 from TUBA1B__Homo_sapiens__NP_006073
augcgcgagugcaucuccauccacgucggccaggccggcguccagaucggcaacgccugcugggagcucuacugccucgagcacggcauccagcccgacggccagaugcccuccgacaagaccaucggcggcggcgacgacuccuucaacaccuucuucuccgagaccggcgccggcaagcacgucccccgcgccgucuucgucgaccucgagcccaccgucaucgacgagguccgcaccggcaccuaccgccagcucuuccaccccgagcagcucaucaccggcaaggaggacgccgccaacaacuacgcccgcggccacuacaccaucggcaaggagaucaucgaccucguccucgaccgcauccgcaagcucgccgaccagugcaccggccuccagggcuuccucgucuuccacuccuucggcggcggcaccggcuccggcuucaccucccuccucauggagcgccucuccgucgacuacggcaagaaguccaagcucgaguucuccaucuaccccgccccccaggucuccaccgccgucgucgagcccuacaacuccauccucaccacccacaccacccucgagcacuccgacugcgccuucauggucgacaacgaggccaucuacgacaucugccgccgcaaccucgacaucgagcgccccaccuacaccaaccucaaccgccucaucucccagaucgucuccuccaucaccgccucccuccgcuucgacggcgcccucaacgucgaccucaccgaguuccagaccaaccucguccccuacccccgcauccacuucccccucgccaccuacgcccccgucaucuccgccgagaaggccuaccacgagcagcucuccgucgccgagaucaccaacgccugcuucgagcccgccaaccagauggucaagugcgacccccgccacggcaaguacauggccugcugccuccucuaccgcggcgacgucguccccaaggacgucaacgccgccaucgccaccaucaagaccaagcgcuccauccaguucgucgacuggugccccaccggcuucaaggucggcaucaacuaccagccccccaccgucguccccggcggcgaccucgccaagguccagcgcgccgucugcaugcucuccaacaccaccgccaucgccgaggccugggcccgccucgaccacaaguucgaccucauguacgccaagcgcgccuucguccacugguacgucggcgagggcauggaggagggcgaguucuccgaggcccgcgaggacauggccgcccucgagaaggacuacgaggaggucggcgucgacuccgucgagggcgagggcgaggaggagggcgaggaguacuga

SEQ ID NO: 51317 - RNA, 1245 nt, Artificial Sequence
  derived and/or modified sequence opt2 from TUBA1C__Homo_sapiens__NP_001290046
augcccuccgacaagaccaucggcggcggcgacgacuccuucaacaccuucuucuccgagaccggcgccggcaagcacgucccccgcgccgucuucgucgaccucgagcccaccgucaucgacgagguccgcaccggcaccuaccgccagcucuuccaccccgagcagcucaucaccggcaaggaggacgccgccaacaacuacgcccgcggccacuacaccaucggcaaggagaucaucgaccucguccucgaccgcauccgcaagcucgccgaccagugcaccggccuccagggcuuccucgucuuccacuccuucggcggcggcaccggcuccggcuucaccucccuccucauggagcgccucuccgucgacuacggcaagaaguccaagcucgaguucuccaucuaccccgccccccaggucuccaccgccgucgucgagcccuacaacuccauccucaccacccacaccacccucgagcacuccgacugcgccuucauggucgacaacgaggccaucuacgacaucugccgccgcaaccucgacaucgagcgccccaccuacaccaaccucaaccgccucaucucccagaucgucuccuccaucaccgccucccuccgcuucgacggcgcccucaacgucgaccucaccgaguuccagaccaaccucguccccuacccccgcauccacuucccccucgccaccuacgcccccgucaucuccgccgagaaggccuaccacgagcagcucaccgucgccgagaucaccaacgccugcuucgagcccgccaaccagauggucaagugcgacccccgccacggcaaguacauggccugcugccuccucuaccgcggcgacgucguccccaaggacgucaacgccgccaucgccaccaucaagaccaagcgcaccauccaguucgucgacuggugccccaccggcuucaaggucggcaucaacuaccagccccccaccgucguccccggcggcgaccucgccaagguccagcgcgccgucugcaugcucuccaacaccaccgccgucgccgaggccugggcccgccucgaccacaaguucgaccucauguacgccaagcgcgccuucguccacugguacgucggcgagggcauggaggagggcgaguucuccgaggcccgcgaggacauggccgcccucgagaaggacuacgaggaggucggcgccgacuccgccgacggcgaggacgagggcgaggaguacuga

SEQ ID NO: 51318 - RNA, 1353 nt, Artificial Sequence
  derived and/or modified sequence opt2 from TUBA3D__Homo_sapiens__NP_525125
augcgcgagugcaucuccauccacgucggccaggccggcguccagaucggcaacgccugcugggagcucuacugccucgagcacggcauccagcccgacggccagaugcccuccgacaagaccaucggcggcggcgacgacuccuucaacaccuucuucuccgagaccggcgccggcaagcacgucccccgcgccgucuucgucgaccucgagcccaccgucgucgacgagguccgcaccggcaccuaccgccagcucuuccaccccgagcagcucaucaccggcaaggaggacgccgccaacaacuacgcccgcggccacuacaccaucggcaaggagaucgucgaccucguccucgaccgcauccgcaagcucgccgaccucugcaccggccuccagggcuuccucaucuuccacuccuucggcggcggcaccggcuccggcuucgccucccuccucauggagcgccucuccgucgacuacggcaagaaguccaagcucgaguucgccaucuaccccgccccccaggucuccaccgccgucgucgagcccuacaacuccauccucaccacccacaccacccucgagcacuccgacugcgccuucauggucgacaacgaggccaucuacgacaucugccgccgcaaccucgacaucgagcgccccaccuacaccaaccucaaccgccucaucggccagaucgucuccuccaucaccgccucccuccgcuucgacggcgcccucaacgucgaccucaccgaguuccagaccaaccucguccccuacccccgcauccacuucccccucgccaccuacgcccccgucaucuccgccgagaaggccuaccacgagcagcucuccgucgccgagaucaccaacgccugcuucgagcccgccaaccagauggucaagugcgacccccgccacggcaaguacauggccugcugcaugcucuaccgcggcgacgucguccccaaggacgucaacgccgccaucgccaccaucaagaccaagcgcaccauccaguucgucgacuggugccccaccggcuucaaggucggcaucaacuaccagccccccaccgucguccccggcggcgaccucgccaagguccagcgcgccgucugcaugcucuccaacaccaccgccaucgccgaggccugggcccgccucgaccacaaguucgaccucauguacgccaagcgcgccuucguccacugguacgucggcgagggcauggaggagggcgaguucuccgaggcccgcgaggaccucgccgcccucgagaaggacuacgaggaggucggcgucgacuccgucgaggccgaggccgaggagggcgaggaguacuga

SEQ ID NO: 51319 - RNA, 1302 nt, Artificial Sequence
  derived and/or modified sequence opt2 from TUBA4A__Homo_sapiens__NP_001265481
augggcaacgccugcugggagcucuacugccucgagcacggcauccagcccgacggccagaugcccuccgacaagaccaucggcggcggcgacgacuccuucaccaccuucuucugcgagaccggcgccggcaagcacgucccccgcgccgucuucgucgaccucgagcccaccgucaucgacgagauccgcaacggccccuaccgccagcucuuccaccccgagcagcucaucaccggcaaggaggacgccgccaacaacuacgcccgcggccacuacaccaucggcaaggagaucaucgaccccguccucgaccgcauccgcaagcucuccgaccagugcaccggccuccagggcuuccucgucuuccacuccuucggcggcggcaccggcuccggcuucaccucccuccucauggagcgccucuccgucgacuacggcaagaaguccaagcucgaguucuccaucuaccccgccccccaggucuccaccgccgucgucgagcccuacaacuccauccucaccacccacaccacccucgagcacuccgacugcgccuucauggucgacaacgaggccaucuacgacaucugccgccgcaaccucgacaucgagcgccccaccuacaccaaccucaaccgccucaucucccagaucgucuccuccaucaccgccucccuccgcuucgacggcgcccucaacgucgaccucaccgaguuccagaccaaccucguccccuacccccgcauccacuucccccucgccaccuacgcccccgucaucuccgccgagaaggccuaccacgagcagcucuccgucgccgagaucaccaacgccugcuucgagcccgccaaccagauggucaagugcgacccccgccacggcaaguacauggccugcugccuccucuaccgcggcgacgucguccccaaggacgucaacgccgccaucgccgccaucaagaccaagcgcuccauccaguucgucgacuggugccccaccggcuucaaggucggcaucaacuaccagccccccaccgucguccccggcggcgaccucgccaagguccagcgcgccgucugcaugcucuccaacaccaccgccaucgccgaggccugggcccgccucgaccacaaguucgaccucauguacgccaagcgcgccuucguccacugguacgucggcgagggcauggaggagggcgaguucuccgaggcccgcgaggacauggccgcccucgagaaggacuacgaggaggucggcaucgacuccuacgaggacgaggacgagggcgaggaguga

SEQ ID NO: 51320 - RNA, 1152 nt, Artificial Sequence
  derived and/or modified sequence opt2 from TUBA8__Homo_sapiens__NP_001180343
augaucgaccucgagcccaccgucgucgacgagguccgcgccggcaccuaccgccagcucuuccaccccgagcagcucaucaccggcaaggaggacgccgccaacaacuacgcccgcggccacuacaccgucggcaaggaguccaucgaccucguccucgaccgcauccgcaagcucaccgacgccugcuccggccuccagggcuuccucaucuuccacuccuucggcggcggcaccggcuccggcuucaccucccuccucauggagcgccucucccucgacuacggcaagaaguccaagcucgaguucgccaucuaccccgccccccaggucuccaccgccgucgucgagcccuacaacuccauccucaccacccacaccacccucgagcacuccgacugcgccuucauggucgacaacgaggccaucuacgacaucugccgccgcaaccucgacaucgagcgccccaccuacaccaaccucaaccgccucaucucccagaucgucuccuccaucaccgccucccuccgcuucgacggcgcccucaacgucgaccucaccgaguuccagaccaaccucguccccuacccccgcauccacuucccccucgucaccuacgcccccaucaucuccgccgagaaggccuaccacgagcagcucuccgucgccgagaucaccuccuccugcuucgagcccaacucccagauggucaagugcgacccccgccacggcaaguacauggccugcugcaugcucuaccgcggcgacgucguccccaaggacgucaacgucgccaucgccgccaucaagaccaagcgcaccauccaguucgucgacuggugccccaccggcuucaaggucggcaucaacuaccagccccccaccgucguccccggcggcgaccucgccaagguccagcgcgccgucugcaugcucuccaacaccaccgccaucgccgaggccugggcccgccucgaccacaaguucgaccucauguacgccaagcgcgccuucguccacugguacgucggcgagggcauggaggagggcgaguucuccgaggcccgcgaggaccucgccgcccucgagaaggacuacgaggaggucggcaccgacuccuucgaggaggagaacgagggcgaggaguucuga

SEQ ID NO: 51321 - RNA, 1356 nt, Artificial Sequence
  derived and/or modified sequence opt2 from TUBB1__Homo_sapiens__NP_110400
augcgcgagaucguccacauccagaucggccagugcggcaaccagaucggcgccaaguucugggagaugaucggcgaggagcacggcaucgaccucgccggcuccgaccgcggcgccuccgcccuccagcucgagcgcaucuccgucuacuacaacgaggccuacggccgcaaguacgucccccgcgccguccucgucgaccucgagcccggcaccauggacuccauccgcuccuccaagcucggcgcccucuuccagcccgacuccuucguccacggcaacuccggcgccggcaacaacugggccaagggccacuacaccgagggcgccgagcucaucgagaacguccucgaggucguccgccacgaguccgaguccugcgacugccuccagggcuuccagaucguccacucccucggcggcggcaccggcuccggcaugggcacccuccucaugaacaagauccgcgaggaguaccccgaccgcaucaugaacuccuucuccgucaugcccucccccaaggucuccgacaccgucgucgagcccuacaacgccguccucuccauccaccagcucaucgagaacgccgacgccugcuucugcaucgacaacgaggcccucuacgacaucugcuuccgcacccucaagcucaccacccccaccuacggcgaccucaaccaccucgucucccucaccauguccggcaucaccaccucccuccgcuuccccggccagcucaacgccgaccuccgcaagcucgccgucaacaugguccccuucccccgccuccacuucuucaugcccggcuucgccccccucaccgcccagggcucccagcaguaccgcgcccucuccgucgccgagcucacccagcagauguucgacgcccgcaacaccauggccgccugcgaccuccgccgcggccgcuaccucaccgucgccugcaucuuccgcggcaagauguccaccaaggaggucgaccagcagcuccucuccguccagacccgcaacuccuccugcuucgucgaguggauccccaacaacgucaaggucgccgucugcgacauccccccccgcggccucuccauggccgccaccuucaucggcaacaacaccgccauccaggagaucuucaaccgcgucuccgagcacuucuccgccauguucaagcgcaaggccuucguccacugguacaccuccgagggcauggacaucaacgaguucggcgaggccgagaacaacauccacgaccucgucuccgaguaccagcaguuccaggacgccaaggccguccucgaggaggacgaggaggucaccgaggaggccgagauggagcccgaggacaagggccacuga

SEQ ID NO: 51322 - RNA, 1338 nt, Artificial Sequence
  derived and/or modified sequence opt2 from TUBB2A__Homo_sapiens__NP_001060
augcgcgagaucguccacauccaggccggccagugcggcaaccagaucggcgccaaguucugggaggucaucuccgacgagcacggcaucgaccccaccggcuccuaccacggcgacuccgaccuccagcucgagcgcaucaacgucuacuacaacgaggccgccggcaacaaguacgucccccgcgccauccucgucgaccucgagcccggcaccauggacuccguccgcuccggccccuucggccagaucuuccgccccgacaacuucgucuucggccaguccggcgccggcaacaacugggccaagggccacuacaccgagggcgccgagcucgucgacuccguccucgacgucguccgcaaggaguccgaguccugcgacugccuccagggcuuccagcucacccacucccucggcggcggcaccggcuccggcaugggcacccuccucaucuccaagauccgcgaggaguaccccgaccgcaucaugaacaccuucuccgucaugcccucccccaaggucuccgacaccgucgucgagcccuacaacgccacccucuccguccaccagcucgucgagaacaccgacgagaccuacuccaucgacaacgaggcccucuacgacaucugcuuccgcacccucaagcucaccacccccaccuacggcgaccucaaccaccucgucuccgccaccauguccggcgucaccaccugccuccgcuuccccggccagcucaacgccgaccuccgcaagcucgccgucaacaugguccccuucccccgccuccacuucuucaugcccggcuucgccccccucaccucccgcggcucccagcaguaccgcgcccucaccguccccgagcucacccagcagauguucgacuccaagaacaugauggccgccugcgacccccgccacggccgcuaccucaccgucgccgccaucuuccgcggccgcauguccaugaaggaggucgacgagcagaugcucaacguccagaacaagaacuccuccuacuucgucgaguggauccccaacaacgucaagaccgccgucugcgacauccccccccgcggccucaagauguccgccaccuucaucggcaacuccaccgccauccaggagcucuucaagcgcaucuccgagcaguucaccgccauguuccgccgcaaggccuuccuccacugguacaccggcgagggcauggacgagauggaguucaccgaggccgaguccaacaugaacgaccucgucuccgaguaccagcaguaccaggacgccaccgccgacgagcagggcgaguucgaggaggaggagggcgaggacgaggccuga

SEQ ID NO: 51323 - RNA, 1338 nt, Artificial Sequence
  derived and/or modified sequence opt2 from TUBB2B__Homo_sapiens__NP_821080
augcgcgagaucguccacauccaggccggccagugcggcaaccagaucggcgccaaguucugggaggucaucuccgacgagcacggcaucgaccccaccggcuccuaccacggcgacuccgaccuccagcucgagcgcaucaacgucuacuacaacgaggccaccggcaacaaguacgucccccgcgccauccucgucgaccucgagcccggcaccauggacuccguccgcuccggccccuucggccagaucuuccgccccgacaacuucgucuucggccaguccggcgccggcaacaacugggccaagggccacuacaccgagggcgccgagcucgucgacuccguccucgacgucguccgcaaggaguccgaguccugcgacugccuccagggcuuccagcucacccacucccucggcggcggcaccggcuccggcaugggcacccuccucaucuccaagauccgcgaggaguaccccgaccgcaucaugaacaccuucuccgucaugcccucccccaaggucuccgacaccgucgucgagcccuacaacgccacccucuccguccaccagcucgucgagaacaccgacgagaccuacugcaucgacaacgaggcccucuacgacaucugcuuccgcacccucaagcucaccacccccaccuacggcgaccucaaccaccucgucuccgccaccauguccggcgucaccaccugccuccgcuuccccggccagcucaacgccgaccuccgcaagcucgccgucaacaugguccccuucccccgccuccacuucuucaugcccggcuucgccccccucaccucccgcggcucccagcaguaccgcgcccucaccguccccgagcucacccagcagauguucgacuccaagaacaugauggccgccugcgacccccgccacggccgcuaccucaccgucgccgccaucuuccgcggccgcauguccaugaaggaggucgacgagcagaugcucaacguccagaacaagaacuccuccuacuucgucgaguggauccccaacaacgucaagaccgccgucugcgacauccccccccgcggccucaagauguccgccaccuucaucggcaacuccaccgccauccaggagcucuucaagcgcaucuccgagcaguucaccgccauguuccgccgcaaggccuuccuccacugguacaccggcgagggcauggacgagauggaguucaccgaggccgaguccaacaugaacgaccucgucuccgaguaccagcaguaccaggacgccaccgccgacgagcagggcgaguucgaggaggaggagggcgaggacgaggccuga

SEQ ID NO: 51324 - RNA, 1137 nt, Artificial Sequence
  derived and/or modified sequence opt2 from TUBB3__Homo_sapiens__NP_001184110
auggacuccguccgcuccggcgccuucggccaccucuuccgccccgacaacuucaucuucggccaguccggcgccggcaacaacugggccaagggccacuacaccgagggcgccgagcucgucgacuccguccucgacgucguccgcaaggagugcgagaacugcgacugccuccagggcuuccagcucacccacucccucggcggcggcaccggcuccggcaugggcacccuccucaucuccaagguccgcgaggaguaccccgaccgcaucaugaacaccuucuccgucguccccucccccaaggucuccgacaccgucgucgagcccuacaacgccacccucuccauccaccagcucgucgagaacaccgacgagaccuacugcaucgacaacgaggcccucuacgacaucugcuuccgcacccucaagcucgccacccccaccuacggcgaccucaaccaccucgucuccgccaccauguccggcgucaccaccucccuccgcuuccccggccagcucaacgccgaccuccgcaagcucgccgucaacaugguccccuucccccgccuccacuucuucaugcccggcuucgccccccucaccgcccgcggcucccagcaguaccgcgcccucaccguccccgagcucacccagcagauguucgacgccaagaacaugauggccgccugcgacccccgccacggccgcuaccucaccgucgccaccgucuuccgcggccgcauguccaugaaggaggucgacgagcagaugcucgccauccaguccaagaacuccuccuacuucgucgaguggauccccaacaacgucaaggucgccgucugcgacauccccccccgcggccucaagauguccuccaccuucaucggcaacuccaccgccauccaggagcucuucaagcgcaucuccgagcaguucaccgccauguuccgccgcaaggccuuccuccacugguacaccggcgagggcauggacgagauggaguucaccgaggccgaguccaacaugaacgaccucgucuccgaguaccagcaguaccaggacgccaccgccgaggaggagggcgagauguacgaggacgacgaggaggaguccgaggcccagggccccaaguga

SEQ ID NO: 51325 - RNA, 1470 nt, Artificial Sequence
  derived and/or modified sequence opt2 from TUBB4A__Homo_sapiens__NP_001276056
augcgccgcggcgccgccgaccgcgagaccgagggccccugcuccgccgucuccgccgccuccuccacccucgccgccgccgccgccccccgcgcccgcgccaccgccgccgccuccacccucuccgccaccgccaugcgcgagaucguccaccuccaggccggccagugcggcaaccagaucggcgccaaguucugggaggucaucuccgacgagcacggcaucgaccccaccggcaccuaccacggcgacuccgaccuccagcucgagcgcaucaacgucuacuacaacgaggccaccggcggcaacuacgucccccgcgccguccucgucgaccucgagcccggcaccauggacuccguccgcuccggccccuucggccagaucuuccgccccgacaacuucgucuucggccaguccggcgccggcaacaacugggccaagggccacuacaccgagggcgccgagcucgucgacgccguccucgacgucguccgcaaggaggccgaguccugcgacugccuccagggcuuccagcucacccacucccucggcggcggcaccggcuccggcaugggcacccuccucaucuccaagauccgcgaggaguuccccgaccgcaucaugaacaccuucuccgucguccccucccccaaggucuccgacaccgucgucgagcccuacaacgccacccucuccguccaccagcucgucgagaacaccgacgagaccuacugcaucgacaacgaggcccucuacgacaucugcuuccgcacccucaagcucaccacccccaccuacggcgaccucaaccaccucgucuccgccaccauguccggcgucaccaccugccuccgcuuccccggccagcucaacgccgaccuccgcaagcucgccgucaacaugguccccuucccccgccuccacuucuucaugcccggcuucgccccccucaccucccgcggcucccagcaguaccgcgcccucaccguccccgagcucacccagcagauguucgacgccaagaacaugauggccgccugcgacccccgccacggccgcuaccucaccgucgccgccgucuuccgcggccgcauguccaugaaggaggucgacgagcagaugcucuccguccaguccaagaacuccuccuacuucgucgaguggauccccaacaacgucaagaccgccgucugcgacauccccccccgcggccucaagauggccgccaccuucaucggcaacuccaccgccauccaggagcucuucaagcgcaucuccgagcaguucaccgccauguuccgccgcaaggccuuccuccacugguacaccggcgagggcauggacgagauggaguucaccgaggccgaguccaacaugaacgaccucgucuccgaguaccagcaguaccaggacgccaccgccgaggagggcgaguucgaggaggaggccgaggaggaggucgccuga

SEQ ID NO: 51326 - RNA, 1338 nt, Artificial Sequence
  derived and/or modified sequence opt2 from TUBB4B__Homo_sapiens__NP_006079
augcgcgagaucguccaccuccaggccggccagugcggcaaccagaucggcgccaaguucugggaggucaucuccgacgagcacggcaucgaccccaccggcaccuaccacggcgacuccgaccuccagcucgagcgcaucaacgucuacuacaacgaggccaccggcggcaaguacgucccccgcgccguccucgucgaccucgagcccggcaccauggacuccguccgcuccggccccuucggccagaucuuccgccccgacaacuucgucuucggccaguccggcgccggcaacaacugggccaagggccacuacaccgagggcgccgagcucgucgacuccguccucgacgucguccgcaaggaggccgaguccugcgacugccuccagggcuuccagcucacccacucccucggcggcggcaccggcuccggcaugggcacccuccucaucuccaagauccgcgaggaguaccccgaccgcaucaugaacaccuucuccgucguccccucccccaaggucuccgacaccgucgucgagcccuacaacgccacccucuccguccaccagcucgucgagaacaccgacgagaccuacugcaucgacaacgaggcccucuacgacaucugcuuccgcacccucaagcucaccacccccaccuacggcgaccucaaccaccucgucuccgccaccauguccggcgucaccaccugccuccgcuuccccggccagcucaacgccgaccuccgcaagcucgccgucaacaugguccccuucccccgccuccacuucuucaugcccggcuucgccccccucaccucccgcggcucccagcaguaccgcgcccucaccguccccgagcucacccagcagauguucgacgccaagaacaugauggccgccugcgacccccgccacggccgcuaccucaccgucgccgccgucuuccgcggccgcauguccaugaaggaggucgacgagcagaugcucaacguccagaacaagaacuccuccuacuucgucgaguggauccccaacaacgucaagaccgccgucugcgacauccccccccgcggccucaagauguccgccaccuucaucggcaacuccaccgccauccaggagcucuucaagcgcaucuccgagcaguucaccgccauguuccgccgcaaggccuuccuccacugguacaccggcgagggcauggacgagauggaguucaccgaggccgaguccaacaugaacgaccucgucuccgaguaccagcaguaccaggacgccaccgccgaggaggagggcgaguucgaggaggaggccgaggaggaggucgccuga

SEQ ID NO: 51327 - RNA, 1230 nt, Artificial Sequence
  derived and/or modified sequence opt2 from TUBB6__Homo_sapiens__NP_001290455
augcgcgagaucguccacauccaggccggccagugcggcaaccagaucggcaccaaguucugggaggucaucuccgacgagcacggcaucgaccccgccggcggcuacgucggcgacuccgcccuccagcucgagcgcaucaacgucuacuacaacgaguccuccugccagaccggcgccggcaacaacugggccaagggccacuacaccgagggcgccgagcucgucgacgccguccucgacgucguccgcaaggagugcgagcacugcgacugccuccagggcuuccagcucacccacucccucggcggcggcaccggcuccggcaugggcacccuccucaucuccaagauccgcgaggaguuccccgaccgcaucaugaacaccuucuccgucaugcccucccccaaggucuccgacaccgucgucgagcccuacaacgccacccucuccguccaccagcucgucgagaacaccgacgagaccuacugcaucgacaacgaggcccucuacgacaucugcuuccgcacccucaagcucaccacccccaccuacggcgaccucaaccaccucgucuccgccaccauguccggcgucaccaccucccuccgcuuccccggccagcucaacgccgaccuccgcaagcucgccgucaacaugguccccuucccccgccuccacuucuucaugcccggcuucgccccccucaccucccgcggcucccagcaguaccgcgcccucaccguccccgagcucacccagcagauguucgacgcccgcaacaugauggccgccugcgacccccgccacggccgcuaccucaccgucgccaccgucuuccgcggccccauguccaugaaggaggucgacgagcagaugcucgccauccaguccaagaacuccuccuacuucgucgaguggauccccaacaacgucaaggucgccgucugcgacauccccccccgcggccucaagauggccuccaccuucaucggcaacuccaccgccauccaggagcucuucaagcgcaucuccgagcaguucuccgccauguuccgccgcaaggccuuccuccacugguucaccggcgagggcauggacgagauggaguucaccgaggccgaguccaacaugaacgaccucgucuccgaguaccagcaguaccaggacgccaccgccaacgacggcgaggaggccuucgaggacgaggaggaggagaucgacggcuga

SEQ ID NO: 51328 - RNA, 729 nt, Artificial Sequence
  derived and/or modified sequence opt2 from TUBB__Homo_sapiens__NP_001280142
augcgcgagaucguccacauccaggccggccagugcggcaaccagaucggcgccaaguucugggaggucaucuccgacgagcacggcaucgaccccaccggcaccuaccacggcgacuccgaccuccagcucgaccgcaucuccgucuacuacaacgaggccaccggcggcaaguacgucccccgcgccauccucgucgaccucgagcccggcaccauggacuccguccgcuccggccccuucggccagaucuuccgccccgacaacuucgucuucggccaguccggcgccggcaacaacugggccaagggccacuacaccgagggcgccgagcucgucgacuccguccucgacgucguccgcaaggaggucgacgagcagaugcucaacguccagaacaagaacuccuccuacuucgucgaguggauccccaacaacgucaagaccgccgucugcgacauccccccccgcggccucaagauggccgucaccuucaucggcaacuccaccgccauccaggagcucuucaagcgcaucuccgagcaguucaccgccauguuccgccgcaaggccuuccuccacugguacaccggcgagggcauggacgagauggaguucaccgaggccgaguccaacaugaacgaccucgucuccgaguaccagcaguaccaggacgccaccgccgaggaggaggaggacuucggcgaggaggccgaggaggaggccuga

SEQ ID NO: 51329 - RNA, 1197 nt, Artificial Sequence
  derived and/or modified sequence opt2 from TUBD1__Homo_sapiens__NP_001180538
auguccaucgucaccguccagcucggccagugcggcaaccagaucggcuucgaggucuucgacgcccuccucuccgacucccacuccucccagggccucugcuccaugcgcgagaacgaggccuaccaggccuccugcaaggagcgcuucuucuccgaggaggagaacggcguccccaucgcccgcgccguccucgucgacauggagcccaaggucaucaaccagaugcucuccaaggccgcccaguccggccaguggaaguacggccagcacgccugcuucugccagaagcagggcuccggcaacaacugggccuacggcuacuccguccacggcccccgccacgaggaguccaucaugaacaucauccgcaaggaggucgagaagugcgacuccuucuccggcuucuucaucaucauguccauggccggcggcaccggcuccggccucggcgccuucgucacccagaaccucgaggaccaguacuccaacucccucaagaugaaccagaucaucuggcccuacggcaccggcgaggucaucguccagaacuacaacuccauccucacccucucccaccucuaccgcuccuccgacgcccuccuccuccacgagaacgacgccauccacaagaucugcgccaagcucaugaacaucaagcagaucuccuucuccgacaucaaccagguccucgcccaccagcucggcuccgucuuccagcccaccuacuccgccgaguccuccuuccacuaccgccgcaacccccucggcaucgaccgccacgucuggcccccccucuccggccuccccccccucuccaagaugucccucaacaaggaccuccacuucaacaccuccaucgccaaccucgucauccuccgcggcaaggacguccaguccgccgacgucgagggcuucaaggaccccgcccucuacaccuccuggcucaagcccgucaacgccuucaacgucuggaagacccagcgcgccuucuccaaguacgagaaguccgccguccucgucuccaacucccaguuccucgucaagccccucgacaugaucgucggcaaggccuggaacauguucgccuccaaggccuacauccaccaguacaccaaguucggcaucgaggaggaggacuuccucgacuccuucaccucccucgagcaggucgucgccuccuacugcaaccucuga

SEQ ID NO: 51330 - RNA, 1428 nt, Artificial Sequence
  derived and/or modified sequence opt2 from TUBE1__Homo_sapiens__NP_057346
augacccaguccgucgucguccaggucggccagugcggcaaccagaucggcugcugcuucugggaccucgcccuccgcgagcacgccgccgucaaccagaagggcaucuacgacgaggccaucuccuccuucuuccgcaacgucgacacccgcgucgucggcgacggcggcuccaucuccaagggcaagaucugcucccucaaggcccgcgccguccucaucgacauggaggagggcgucgucaacgagauccuccagggcccccuccgcgacgucuucgacaccaagcagcucaucaccgacaucuccggcuccggcaacaacugggccgucggccacaaggucuucggcucccucuaccaggaccagauccucgagaaguuccgcaaguccgccgagcacugcgacugccuccagugcuucuucaucauccacuccaugggcggcggcaccggcuccggccucggcaccuuccuccucaagguccucgaggacgaguuccccgaggucuaccgcuucgucaccuccaucuaccccuccggcgaggacgacgucaucaccucccccuacaacuccauccucgccaugaaggagcucaacgagcacgccgacugcguccuccccaucgacaaccagucccucuucgacaucaucuccaagaucgaccucauggucaacuccggcaagcucggcaccaccgucaagcccaagucccucgucaccuccuccuccggcgcccucaagaagcagcacaagaagcccuucgacgccaugaacaacaucgucgccaaccuccuccucaaccucaccuccuccgcccgcuucgagggcucccucaacauggaccucaacgagaucuccaugaaccucguccccuucccccagcuccacuaccucgucuccucccucaccccccucuacacccucaccgacgucaacauccccccccgccgccucgaccagauguucuccgacgccuucuccaaggaccaccagcuccuccgcgccgaccccaagcacucccucuaccucgccugcgcccucaugguccgcggcaacguccagaucuccgaccuccgccgcaacaucgagcgccucaagcccucccuccaguucgucuccuggaaccaggagggcuggaagaccucccucugcuccgucccccccgucggccacucccacucccuccucgcccucgccaacaacaccugcgucaagcccaccuucauggagcucaaggagcgcuucaugcgccucuacaagaagaaggcccaccuccaccacuaccuccaggucgagggcauggaggaguccugcuucaccgaggccgucuccucccucuccgcccucauccaggaguacgaccagcucgacgccaccaagaacaugcccguccaggaccucccccgccucuccaucgccauguga

SEQ ID NO: 51331 - RNA, 1356 nt, Artificial Sequence
  derived and/or modified sequence opt2 from TUBG1__Homo_sapiens__NP_001061
augccccgcgagaucaucacccuccagcucggccagugcggcaaccagaucggcuucgaguucuggaagcagcucugcgccgagcacggcaucucccccgagggcaucgucgaggaguucgccaccgagggcaccgaccgcaaggacgucuucuucuaccaggccgacgacgagcacuacaucccccgcgccguccuccucgaccucgagccccgcgucauccacuccauccucaacucccccuacgccaagcucuacaaccccgagaacaucuaccucuccgagcacggcggcggcgccggcaacaacugggccuccggcuucucccagggcgagaagauccacgaggacaucuucgacaucaucgaccgcgaggccgacggcuccgacucccucgagggcuucguccucugccacuccaucgccggcggcaccggcuccggccucggcuccuaccuccucgagcgccucaacgaccgcuaccccaagaagcucguccagaccuacuccgucuuccccaaccaggacgagauguccgacgucgucguccagcccuacaacucccuccucacccucaagcgccucacccagaacgccgacugcgucgucguccucgacaacaccgcccucaaccgcaucgccaccgaccgccuccacauccagaaccccuccuucucccagaucaaccagcucgucuccaccaucauguccgccuccaccaccacccuccgcuaccccggcuacaugaacaacgaccucaucggccucaucgccucccucauccccaccccccgccuccacuuccucaugaccggcuacaccccccucaccaccgaccaguccgucgccuccguccgcaagaccaccguccucgacgucaugcgccgccuccuccagcccaagaacgucauggucuccaccggccgcgaccgccagaccaaccacugcuacaucgccauccucaacaucauccagggcgaggucgaccccacccagguccacaagucccuccagcgcauccgcgagcgcaagcucgccaacuucauccccuggggccccgccuccauccaggucgcccucucccgcaagucccccuaccuccccuccgcccaccgcgucuccggccucaugauggccaaccacaccuccaucuccucccucuucgagcgcaccugccgccaguacgacaagcuccgcaagcgcgaggccuuccucgagcaguuccgcaaggaggacauguucaaggacaacuucgacgagauggacaccucccgcgagaucguccagcagcucaucgacgaguaccacgccgccacccgccccgacuacaucuccuggggcacccaggagcaguga

SEQ ID NO: 51332 - RNA, 1356 nt, Artificial Sequence
  derived and/or modified sequence opt2 from TUBG2__Homo_sapiens__NP_057521
augccccgcgagaucaucacccuccagcucggccagugcggcaaccagaucggcuucgaguucuggaagcagcucugcgccgagcacggcaucucccccgagggcaucgucgaggaguucgccaccgagggcaccgaccgcaaggacgucuucuucuaccaggccgacgacgagcacuacaucccccgcgccguccuccucgaccucgagccccgcgucauccacuccauccucaacucccccuacgccaagcucuacaaccccgagaacaucuaccucuccgagcacggcggcggcgccggcaacaacugggccuccggcuucucccagggcgagaagauccacgaggacaucuucgacaucaucgaccgcgaggccgacggcuccgacucccucgagggcuucguccucugccacuccaucgccggcggcaccggcuccggccucggcuccuaccuccucgagcgccucaacgaccgcuaccccaagaagcucguccagaccuacuccgucuuccccuaccaggacgagauguccgacgucgucguccagcccuacaacucccuccucacccucaagcgccucacccagaacgccgacugcgucgucguccucgacaacaccgcccucaaccgcaucgccaccgaccgccuccacauccagaaccccuccuucucccagaucaaccagcucgucuccaccaucauguccgccuccaccaccacccuccgcuaccccggcuacaugaacaacgaccucaucggccucaucgccucccucauccccaccccccgccuccacuuccucaugaccggcuacaccccccucaccaccgaccaguccgucgccuccguccgcaagaccaccguccucgacgucaugcgccgccuccuccagcccaagaacgucauggucuccaccggccgcgaccgccagaccaaccacugcuacaucgccauccucaacaucauccagggcgaggucgaccccacccagguccacaagucccuccagcgcauccgcgagcgcaagcucgccaacuucauccccuggggccccgccuccauccaggucgcccucucccgcaagucccccuaccuccccuccgcccaccgcgucuccggccucaugauggccaaccacaccuccaucuccucccucuucgaguccuccugccagcaguucgacaagcuccgcaagcgcgacgccuuccucgagcaguuccgcaaggaggacauguucaaggacaacuucgacgagauggaccgcucccgcgaggucguccaggagcucaucgacgaguaccacgccgccacccagcccgacuacaucuccuggggcacccaggagcaguga

SEQ ID NO: 51333 - RNA, 2793 nt, Artificial Sequence
  derived and/or modified sequence opt2 from TUBGCP2__Homo_sapiens__NP_001243546
auguccgaguuccgcauccaccacgacgucaacgagcuccucucccuccuccgcguccacggcggcgacggcgccgaggucuacaucgaccuccuccagaagaaccgcacccccuacgucaccaccaccgucuccgcccacuccgccaaggucaagaucgccgaguucucccgcacccccgaggacuuccucaagaaguacgacgagcucaaguccaagaacacccgcaaccucgacccccucgucuaccuccucuccaagcucaccgaggacaaggagacccuccaguaccuccagcagaacgccaaggagcgcgccgagcucgccgccgccgccgucggcuccuccaccaccuccaucaacguccccgccgccgccuccaagaucuccaugcaggagcucgaggagcuccgcaagcagcucggcuccgucgccaccggcuccacccuccagcagucccucgagcucaagcgcaagaugcuccgcgacaagcagaacaagaagaacuccggccagcaccuccccaucuuccccgccugggucuacgagcgccccgcccucaucggcgacuuccucaucggcgccggcaucuccaccgacaccgcccuccccaucguccuccuccgcuggaaccucgcccucuccccccgccucaagugcuccggcgucaucuccgcccacugcaaccuccaccuccccggcacccucccccucgccucccaggaguccgccgucgucgaggaccuccucuacguccucgucggcgucgacggccgcuacgucuccgcccagccccucgccggccgccagucccgcaccuuccucgucgaccccaaccucgaccucuccauccgcgagcucguccaccgcauccuccccgucgccgccuccuacuccgccgucacccgcuucaucgaggagaaguccuccuucgaguacggccaggucaaccacgcccucgccgccgccaugcgcacccucgucaaggagcaccucauccucgucucccagcucgagcagcuccaccgccagggccuccucucccuccagaagcucugguucuacauccagcccgccaugcgcaccauggacauccucgccucccucgccaccuccgucgacaagggcgagugccucggcggcuccacccucucccuccuccacgaccgcuccuucuccuacaccggcgacucccaggcccaggagcucugccucuaccucaccaaggccgccuccgcccccuacuucgagguccucgagaaguggaucuaccgcggcaucauccacgaccccuacuccgaguucauggucgaggagcacgagcuccgcaaggagcgcauccaggaggacuacaacgacaaguacugggaccagcgcuacaccaucguccagcagcagauccccuccuuccuccagaagauggccgacaagauccucuccaccggcaaguaccucaacgucguccgcgagugcggccacgacgucaccugccccgucgccaaggagaucaucuacacccucaaggagcgcgccuacgucgagcagaucgagaaggccuucaacuacgccuccaagguccuccucgacuuccucauggaggagaaggagcucgucgcccaccuccgcuccaucaagcgcuacuuccucauggaccagggcgacuucuucguccacuucauggaccucgccgaggaggagcuccgcaagcccgucgaggacaucacccccccccgccucgaggcccuccucgagcucgcccuccgcauguccaccgccaacaccgaccccuucaaggacgaccucaagaucgaccucaugccccacgaccucaucacccagcuccuccgcguccucgccaucgagaccaagcaggagaaggccauggcccacgccgaccccaccgagcucgcccucuccggccucgaggccuucuccuucgacuacaucgucaaguggccccucucccucaucaucaaccgcaaggcccucacccgcuaccagaugcucuuccgccacauguucuacugcaagcacgucgagcgccagcucugcuccgucuggaucuccaacaagaccgccaagcagcacucccuccacuccgcccagugguucgccggcgccuucacccuccgccagcgcaugcucaacuucguccagaacauccaguacuacaugauguucgaggucauggagcccaccuggcacauccucgagaagaaccucaaguccgccuccaacaucgacgacguccucggccaccacaccggcuuccucgacaccugccucaaggacugcaugcucaccaaccccgagcuccucaaggucuucuccaagcucauguccgucugcgucauguucaccaacugcaugcagaaguucacccaguccaugaagcucgacggcgagcucggcggccagacccucgagcacuccaccguccucggccuccccgccggcgccgaggagcgcgcccgcaaggagcucgcccgcaagcaccucgccgagcacgccgacaccguccagcucgucuccggcuucgaggccaccaucaacaaguucgacaagaacuucuccgcccaccuccucgaccuccucgcccgccucuccaucuacuccaccuccgacugcgagcacggcauggccuccgucaucucccgccucgacuucaacggcuucuacaccgagcgccucgagcgccucuccgccgagcgcucccagaaggccaccccccagguccccguccuccgcggcccccccgcccccgccccccgcgucgccgucaccgcccaguga

SEQ ID NO: 51334 - RNA, 2724 nt, Artificial Sequence
  derived and/or modified sequence opt2 from TUBGCP3__Homo_sapiens__NP_006313
auggccacccccgaccagaagucccccaacguccuccuccagaaccucugcugccgcauccucggccgcuccgaggccgacgucgcccagcaguuccaguacgccguccgcgucaucggcuccaacuucgcccccaccgucgagcgcgacgaguuccucgucgccgagaagaucaagaaggagcucauccgccagcgccgcgaggccgacgccgcccucuucuccgagcuccaccgcaagcuccacucccagggcguccucaagaacaagugguccauccucuaccuccuccucucccucuccgaggacccccgccgccagcccuccaaggucuccuccuacgccacccucuucgcccaggcccucccccgcgacgcccacuccacccccuacuacuacgcccgcccccagacccucccccucuccuaccaggaccgcuccgcccaguccgcccaguccuccggcuccgucggcuccuccggcaucuccuccaucggccucugcgcccucuccggccccgcccccgccccccagucccuccuccccggccaguccaaccaggcccccggcgucggcgacugccuccgccagcagcucggcucccgccucgccuggacccucaccgccaaccagcccuccucccaggccaccaccuccaagggcguccccuccgccgucucccgcaacaugacccgcucccgccgcgagggcgacaccggcggcaccauggagaucaccgaggccgcccucguccgcgacauccucuacgucuuccagggcaucgacggcaagaacaucaagaugaacaacaccgagaacugcuacaaggucgagggcaaggccaaccucucccgcucccuccgcgacaccgccguccgccucuccgagcucggcuggcuccacaacaagauccgccgcuacaccgaccagcgcucccucgaccgcuccuucggccucgucggccaguccuucugcgccgcccuccaccaggagcuccgcgaguacuaccgccuccucuccguccuccacucccagcuccagcucgaggacgaccagggcgucaaccucggccucgaguccucccucacccuccgccgccuccucgucuggaccuacgaccccaagauccgccucaagacccucgccgcccucgucgaccacugccagggccgcaagggcggcgagcucgccuccgccguccacgccuacaccaagaccggcgaccccuacaugcgcucccucguccagcacauccucucccucgucucccaccccguccucuccuuccucuaccgcuggaucuacgacggcgagcucgaggacaccuaccacgaguucuucgucgccuccgaccccaccgucaagaccgaccgccucuggcacgacaaguacacccuccgcaaguccaugauccccuccuucaugaccauggaccagucccgcaagguccuccucaucggcaaguccaucaacuuccuccaccaggucugccacgaccagacccccaccaccaagaugaucgccgucaccaaguccgccgaguccccccaggacgccgccgaccucuucaccgaccucgagaacgccuuccagggcaagaucgacgccgccuacuucgagaccuccaaguaccuccucgacguccucaacaagaaguacucccuccucgaccacaugcaggccaugcgccgcuaccuccuccucggccagggcgacuucauccgccaccucauggaccuccucaagcccgagcucguccgccccgccaccacccucuaccagcacaaccucaccggcauccucgagaccgccguccgcgccaccaacgcccaguucgacucccccgagauccuccgccgccucgacguccgccuccucgaggucucccccggcgacaccggcugggacgucuucucccucgacuaccacgucgacggccccaucgccaccgucuucacccgcgagugcaugucccacuaccuccgcgucuucaacuuccucuggcgcgccaagcgcauggaguacauccucaccgacauccgcaagggccacaugugcaacgccaagcuccuccgcaacaugcccgaguucuccggcguccuccaccagugccacauccucgccuccgagaugguccacuucauccaccagaugcaguacuacaucaccuucgagguccucgagugcuccugggacgagcucuggaacaagguccagcaggcccaggaccucgaccacaucaucgccgcccacgaggucuuccucgacaccaucaucucccgcugccuccucgacuccgacucccgcgcccuccucaaccagcuccgcgccgucuucgaccagaucaucgagcuccagaacgcccaggacgccaucuaccgcgccgcccucgaggagcuccagcgccgccuccaguucgaggagaagaagaagcagcgcgagaucgagggccaguggggcgucaccgccgccgaggaggaggaggagaacaagcgcaucggcgaguucaaggaguccauccccaagaugugcucccagcuccgcauccucacccacuucuaccagggcaucguccagcaguuccucguccuccucaccaccuccuccgacgagucccuccgcuuccucuccuuccgccucgacuucaacgagcacuacaaggcccgcgagccccgccuccgcgucucccucggcacccgcggccgccgcuccucccacaccuga

SEQ ID NO: 51335 - RNA, 2004 nt, Artificial Sequence
  derived and/or modified sequence opt2 from TUBGCP4__Homo_sapiens__NP_001273343
augauccacgagcuccuccucgcccucuccggcuaccccggcuccaucuucaccuggaacaagcgcuccggccuccaggucucccaggacuuccccuuccuccaccccuccgagaccuccguccucaaccgccucugccgccucggcaccgacuacauccgcuucaccgaguucaucgagcaguacaccggccacguccagcagcaggaccaccaccccucccagcagggccagggcggccuccacggcaucuaccuccgcgccuucugcaccggccucgacuccguccuccagcccuaccgccaggcccuccucgaccucgagcaggaguuccucggcgacccccaccucuccaucucccacgucaacuacuuccucgaccaguuccagcuccucuuccccuccgucauggucgucgucgagcagaucaagucccagaagauccacggcugccagauccucgagaccgucuacaagcacuccugcggcggccucccccccguccgcuccgcccucgagaagauccucgccgucugccacggcgucauguacaagcagcucuccgccuggaugcuccacggccuccuccucgaccagcacgaggaguucuucaucaagcagggccccuccuccggcaacgucuccgcccagcccgaggaggacgaggaggaccucggcaucggcggccucaccggcaagcagcuccgcgagcuccaggaccuccgccucaucgaggaggagaacaugcucgcccccucccucaagcaguucucccuccgcgucgagauccuccccuccuacauccccguccgcgucgccgagaagauccucuucgucggcgaguccguccagauguucgagaaccagaacgucaaccucacccgcaagggcuccauccucaagaaccaggaggacaccuucgccgccgagcuccaccgccucaagcagcagccccucuucucccucgucgacuucgagcaggucgucgaccgcauccgcuccaccgucgccgagcaccucuggaagcucauggucgaggaguccgaccuccucggccagcucaagaucaucaaggacuucuaccuccucggccgcggcgagcucuuccaggccuucaucgacaccgcccagcacaugcucaagaccccccccaccgccgucaccgagcacgacgucaacgucgccuuccagcaguccgcccacaagguccuccucgacgacgacaaccuccucccccuccuccaccucaccaucgaguaccacggcaaggagcacaaggccgacgccacccaggcccgcgagggccccucccgcgagaccuccccccgcgaggcccccgccuccggcugggccgcccucggccucuccuacaagguccaguggccccuccacauccucuucacccccgccguccucgagaaguacaacgucgucuucaaguaccuccucuccguccgccgcguccaggccgagcuccagcacugcugggcccuccagaugcagcgcaagcaccucaaguccaaccagaccgacgccaucaaguggcgccuccgcaaccacauggccuuccucgucgacaaccuccaguacuaccuccaggucgacguccucgagucccaguucucccagcuccuccaccagaucaacuccacccgcgacuucgaguccauccgccucgcccacgaccacuuccucuccaaccuccucgcccaguccuucauccuccucaagcccgucuuccacugccucaacgagauccucgaccucugccacuccuucugcucccucgucucccagaaccucggcccccucgacgagcgcggcgccgcccagcucuccauccucgucaagggcuucucccgccaguccucccuccucuucaagauccucuccuccguccgcaaccaccagaucaacuccgaccucgcccagcuccuccuccgccucgacuacaacaaguacuacacccaggccggcggcacccucggcuccuucggcauguga

SEQ ID NO: 51336 - RNA, 3075 nt, Artificial Sequence
  derived and/or modified sequence opt2 from TUBGCP5__Homo_sapiens__NP_001096080
auggcccgccacggcccccccuggucccgccucgacgcccagcaggagcgcgacguccgcgagcucguccgcggcgucgccggccuccaggacgaggccgaccccaacuuccagcucgcccucaacuucgccugguccaacuuccgcuuccaccgcuuccucgacgucaacucccacaagaucgagaagaccaucgagggcaucuacgagaaguucgucauccacuccgaccucuccaaggccgccuccuggaagcgccucaccgaggaguuccucaacgccccccuccccuccaucaaggagaucaagaccgacgcccacuacuccauccucucccuccuccucugccucuccgacucccccuccaacuccuccuacgucgagaccccccgcaacaaggaggucgagaagaaggacgacuucgacuggggcaaguaccucauggaggacgaggagauggacaucggccccuacauggacacccccaacugguccgaggaguccgaggaggagaacgaccagcagccccucucccgcgaggacuccggcauccaggucgaccgcaccccccucgaggagcaggaccagaaccgcaagcucgaccccugcaucuccuggaaggacgagcccgacgaccgcuccuggcucgagcaccacgucguccaccaguacuggaccgcccgccccucccaguucccccacucccuccaccuccacuccaaccucgccgccgucugggaccagcaccucuacuccuccgacccccucuacguccccgacgaccgcguccucgucaccgagacccaggucauccgcgagacccucuggcuccucuccggcgucaagaagcucuucaucuuccagcucaucgacggcaaggucaccguccgcaacaacaucaucgucacccaccucacccacuccugccuccgcuccguccucgagcagaucgccgccuacggccaggucgucuuccgccuccaggaguucaucgacgaggucaugggccacuccuccgaguccaugcuccccggcuccggcuccguccccaagaaguccaccgaggcccccuuccgcaccuaccaggccuucaugugggcccucuacaaguacuucaucuccuucaaggaggagcucgccgagaucgagaagugcaucaucaacaacgacaccaccaucacccucgccaucgucgucgacaagcucgccccccgccucucccagcucaagguccuccacaaggucuucuccaccggcgucgccgaggucccccccgacacccgcaacgucguccgcgccucccaccuccucaacacccucuacaaggccauccucgaguacgacaacgucggcgaggccuccgagcagaccgucucccuccucuucucccucugggucgagaccguccgccccuaccuccagaccgucgacgaguggaucguccacggccaccucugggacggcgcccgcgaguucaucauccagcgcaacaagaacguccccgucaaccaccgcgacuucugguacgccaccuacacccucuacuccgucuccgagaagaccgagaacgaggagaagauguccgacaacgccuccgccuccuccggcuccgaccagggccccuccucccgccagcacaccauggucuccuuccucaagcccguccucaagcagaucaucauggccggcaaguccaugcagcuccucaagaaccuccagugcgccgaguccaccaccugccaggccggcgcccgcgacgccgagcgcaagucccucuacacccucuuccucgaguccguccagucccgccuccgccacggcgaggacuccaccccccagguccucaccgagcagcaggccaccaaggagaaccucaugaagaugcaguccaucgccgagucccaccucgagcucgacgacguccacgacccccuccucgccaucaacuucgcccgcauguaccucgagcaguccgacuuccacgagaaguucgccggcggcgacgucugcgucgaccgcuccuccgaguccgucaccugccagaccuucgagcucacccuccgcuccugccucuacccccacaucgacaagcaguaccucgacugcugcggcaaccucaugcagacccucaagaaggacuaccgccucgucgaguaccuccaggccaugcgcaacuucuuccucauggagggcggcgacaccauguacgacuucuacaccuccaucuucgacaagauccgcgagaaggagaccuggcagaacgucuccuuccucaacguccagcuccaggaggccgucggccagcgcuaccccgaggacuccucccgccucuccaucuccuucgagaacgucgacaccgccaagaagaagcuccccguccacauccucgacggccucacccucuccuacaagguccccuggcccgucgacaucgucaucucccucgagugccagaagaucuacaaccaggucuuccuccuccuccuccagaucaagugggccaaguacucccucgacguccuccucuucggcgagcucgucuccaccgccgagaagccccgccucaaggagggccucauccacgagcaggacaccgucgcccaguucggcccccagaaggagcccguccgccagcagauccaccgcauguuccuccuccgcgucaagcucaugcacuucgucaacucccuccacaacuacaucaugacccgcauccuccacuccaccggccucgaguuccagcaccaggucgaggaggccaaggaccucgaccagcucaucaagauccacuaccgcuaccucuccaccauccacgaccgcugccuccuccgcgagaaggucuccuucgucaaggaggccaucaugaagguccucaaccucgcccucauguucgccgacggcuggcaggccggccucggcaccuggcgcauggaguccaucgagaagauggaguccgacuucaagaacugccacauguuccucgucaccauccucaacaaggccgucugccgcggcuccuucccccacugcgaguacaucaugcucaaguacuucuaccucugcaucucccucuga

SEQ ID NO: 51337 - RNA, 5460 nt, Artificial Sequence
  derived and/or modified sequence opt2 from TUBGCP6__Homo_sapiens__NP_065194
auggccuccaucacccagcucuucgacgaccucugcgaggcccuccuccccgccgccaagacccaccucggccagcgcuccgucaaccgcaagcgcgccaagcgcucccucaagaaggucgccuacaacgcccucuucaccaaccucuuccaggacgagacccagcagcuccagcccgacauguccaagcuccccgcccgcaacaagauccucaugcucuccuucgaccuccgcgucggcggccucggccccaaggccgaccgccucgaggagcucgucgaggagcucgaggccgcccccugcugcccccuccucgaggucggcuccguccucgaccuccucguccagcucgccggcuccggccccccccagguccucccccgcaagcgcgacuacuuccucaacaacaagcacgucggccgcaacguccccuacuccggcuacgacugcgacgaccucuccgucuucgagauggacguccagucccucaucucccgcgaggagugccucugccacuccaugauccaggagacccuccaggucauggaggccgcccccggcaccggccuccccaccgucggccucuucuccuucggcgaccccugcggcgaccgcuucgagcgcgacacccgcgucucccucuucggcgcccucguccacucccgcaccuacgacauggacguccgccucggccucccccccguccccgacaacgccgaccucuccggccucgccaucaaggucccccccuccgucgaccagugggaggacgagggcuuccaguccgccuccaaccucacccccgacucccaguccgagcccuccgucacccccgacgucgaccucugggaggccgcccucaccuacgaggccuccaagcgccgcugcugggagcgcgucggcugcccccccggccaccgcgaggagcccuaccucaccgaggccggccgcgacgccuucgacaaguucugccgccuccaccagggcgagcuccagcuccucgccggcggcguccuccaggccccccagcccguccucgucaaggagugcgagcucgucaaggacguccucaacguccucaucggcgucgucuccgccaccuucucccucugccagcccgcccaggccuucgucgucaagcgcggcguccacgucuccggcgccucccccgaguccaucuccucccuccucuccgaggucgccgaguacggcaccugcuacacccgccucucccacuucucccuccagcccguccucgacucccucuacuccaagggccucgucuuccaggccuucaccuccggccuccgccgcuaccuccaguacuaccgcgccugcguccucuccaccccccccacccucucccuccucaccaucggcuuccucuucaagaagcucggccgccagcuccgcuaccucgccgagcucugcggcgucggcgccguccuccccggcaccugcggcggcggcccccgcgccgccuuccccaccggcgucaagcuccucuccuaccucuaccaggaggcccuccacaacugcuccaacgagcacuaccccguccuccucucccuccucaagaccuccugcgagcccuacacccgcuucauccacgacugggucuacuccggcgucuuccgcgacgccuacggcgaguucaugauccaggucaaccacgaguaccucuccuuccgcgacaagcucuacuggacccacggcuacguccucaucuccaaggaggucgaggacugcguccccgucuuccucaagcacaucgcccacgacaucuacgucugcggcaagaccaucaaccuccucaagcucugcugcccccgccacuaccucugcugguccgacguccccgucccccgcaucuccgucaucuucucccucgaggagcucaaggagaucgagaaggacugcgccgucuacgucggccgcauggagcgcgucgcccgccacuccuccgucuccaaggaggagaaggagcuccgcauggagaucgccaagcaggagcucaucgcccacgcccgcgaggccgccucccgcguccucuccgcccucuccgaccgccagauguccgagcgcauggcccucgacgcccgcaagcgcgagcaguuccagcgccucaaggagcaguucgucaaggaccaggagcgccgccaggccgcccgccaggaggagcucgacgacgacuucuccuacgcccgcgagcuccgcgaccgcgagcgccgccucaagucccucgaggaggagcucgagcgcaaggcccgccaggcccucgucgaccacuacuccaagcucuccgccgaggccgcccgccgcgagcagaaggcccucuggcgcauccagcgccaccgccucgaguccgcccgccuccgcuuccuccucgaggacgagaagcacauccaggagaugcucaaggccgucuccgaggcccaccagccccaggagccccccgacguccuccucuccguccacccccaggucaccucccccggccccgagcaccccgagggcggccagggcugcgacuccggcuccgccgagcagcacucccccgccugggacggcuggaaccgccccggccuccucaccccccagccccucaagccccucgccgucggcgccggcggccgcggccuccagcaggccgagggcgcccgccccuucuccgacucccucuccaucggcgacuuccuccccgucggccccggcgccgagcccuccguccagaccggcauggucccccuccucgaggucgcccuccagaccaucaaccucgaccucccccccuccgcccccggcgaggcccccgccgccgccuccacccagcccucccgcccccaggaguacgacuucuccaccguccuccgccccgccgucgccaccucccccgcccccggcccccuccaggccgccgagugcucccucggcuccuccggccuccagcucugggaggacuccugcggcaagauggacgccugcggcuccgccucccgcgagacccuccuccccucccaccccccccgccgcgccgcccucgaggagggcuccucccagcccaccgagcgccucuucggccaggucuccggcggcggccuccccaccggcgacuacgccuccgagaucgcccccacccgcccccgcuggaacacccacggccacgucuccgacgccuccauccgcgucggcgagaacgucuccgacgucgcccccacccagccccgcuggaacacccacggccacgucuccaacgccuccaucucccucggcgaguccgucuccgacgucgcccccacccgcccccgcuggaacauccacggccacgucuccaacgccuccauccgcgucggcgagaacgucuccgacgucgcccccacccgcccccgcuggaacacccacggccacgucuccaacgccuccauccgcgucggcgagaacgucuccgacgucgcccccacccgcccccgcuggaacacccacggccacgucuccgacgccuccaucucccucggcgaguccgucuccgacauggcccccgcccgcccccgcuggaacacccacggccacgucuccgacgccuccaucucccucggcgaguccgucuccgacauggcccccacccgcccccgcuggaacacccacggccacgucuccgacaccuccauccgcgucggcgagaacgucuccgacgucgcccccauccgcucccgcugcaacacccacggccacgucuccgacgccuccaucucccucggcgagcccgucuccgacgucgucuccacccgcccccgcuggaacacccacguccccaucccccccccccacaugguccucggcgcccucucccccgaggccgagcccaacaccccccgcccccagcaguccccccccggccacaccucccaguccgcccucucccucggcgcccaguccaccguccucgacugcggcccccgccuccccgucgaggucggccccucccucuccucccccuccuccggcugcggcgagggcuccaucuccgucggcgagaacgucuccgacgucgcccccacccagcccugguggcccaacacccccggcgacuccgucuccgaggagcucggccccggccgcuccggcgacaccgaggaccucucccccaacuggccccucaacucccaggaggacaccgccgcccaguccucccccggccgcggcgaggaggccgaggccuccgccgccgaggcccagggcggcgagcaggccuaccucgccggccucgccggccaguaccaccucgagcgcuaccccgacuccuacgaguccauguccgagccccccaucgcccaccuccuccgccccguccucccccgcgccuucgccuuccccgucgacccccagguccaguccgccgccgacgagaccgccguccagcucuccgagcuccucacccuccccguccucaugaagcgcuccaucaccgccccccucgccgcccacaucucccucgucaacaaggccgccgucgacuacuucuucgucgagcuccaccucgaggcccacuacgaggcccuccgccacuuccuccucauggaggacggcgaguucgcccagucccucuccgaccuccucuucgagaagcucggcgccggccagacccccggcgagcuccucaacccccucguccucaacuccguccucuccaaggcccuccagugcucccuccacggcgacaccccccacgccuccaaccucucccucgcccucaaguaccuccccgaggucuucgcccccaacgcccccgacguccucuccugccucgagcuccgcuacaaggucgacuggccccucaacaucgucaucaccgagggcugccucuccaaguacuccggcgucuucuccuuccuccuccagcucaagcucaugaugugggcccucaaggacgucugcuuccaccucaagcgcaccgcccuccucucccacauggccggcuccguccaguuccgccagcuccagcucuucaagcacgagaugcagcacuucgucaaggucauccagggcuacaucgccaaccagauccuccacgucaccuggugcgaguuccgcgcccgccucgccaccgucggcgaccucgaggagauccagcgcgcccacgccgaguaccuccacaaggccgucuuccgcggccuccucaccgagaaggccgcccccgucaugaacgucauccacuccaucuucucccucguccucaaguuccgcucccagcucaucucccaggccuggggcccccccggcggcccccgcggcgccgagcaccccaacuucgcccucaugcagcaguccuacaacaccuucaaguacuacucccacuuccucuucaaggucgucaccaagcucgucaaccgcggcuaccagccccaccucgaggacuuccuccuccgcaucaacuucaacaacuacuaccaggacgccuga

SEQ ID NO: 51338 - RNA, 1686 nt, Artificial Sequence
  derived and/or modified sequence opt2 from TUB__Homo_sapiens__NP_003311
augggcgcccgcaccccccuccccuccuucugggucuccuucuucgccgagaccggcauccucuuccccggcggcacccccuggcccaugggcucccagcacuccaagcagcaccgcaagcccggcccccucaagcgcggccaccgccgcgaccgccgcaccacccgccgcaaguacuggaaggagggccgcgagaucgcccgcguccucgacgacgagggccgcaaccuccgccagcagaagcucgaccgccagcgcgcccuccucgagcagaagcagaagaagaagcgccaggagccccucaugguccaggccaacgccgacggccgcccccgcucccgccgcgcccgccaguccgaggagcaggccccccucgucgaguccuaccucuccuccuccggcuccaccuccuaccagguccaggaggccgacucccucgccuccguccagcucggcgccacccgccccaccgcccccgccuccgccaagcgcaccaaggccgccgccaccgccggcggccagggcggcgccgcccgcaaggagaagaagggcaagcacaagggcaccuccggccccgccgcccucgccgaggacaaguccgaggcccagggccccguccagauccucaccgucggccaguccgaccacgcccaggacgccggcgagaccgccgccggcggcggcgagcgccccuccggccaggaccuccgcgccaccaugcagcgcaagggcaucuccuccuccauguccuucgacgaggacgaggaggacgaggaggagaacuccuccuccuccucccagcucaacuccaacacccgccccuccuccgccaccucccgcaaguccguccgcgaggccgccuccgcccccucccccaccgcccccgagcagcccgucgacgucgagguccaggaccucgaggaguucgcccuccgccccgccccccagggcaucaccaucaagugccgcaucacccgcgacaagaagggcauggaccgcggcauguaccccaccuacuuccuccaccucgaccgcgaggacggcaagaaggucuuccuccucgccggccgcaagcgcaagaaguccaagaccuccaacuaccucaucuccgucgaccccaccgaccucucccgcggcggcgacuccuacaucggcaagcuccgcuccaaccucaugggcaccaaguucaccgucuacgacaacggcgucaacccccagaaggccuccuccuccacccucgaguccggcacccuccgccaggagcucgccgccgucugcuacgagaccaacguccucggcuucaagggcccccgcaagauguccgucaucguccccggcaugaacaugguccacgagcgcgucuccauccgcccccgcaacgagcacgagacccuccucgcccgcuggcagaacaagaacaccgaguccaucaucgagcuccagaacaagacccccgucuggaacgacgacacccaguccuacguccucaacuuccacggccgcgucacccaggccuccgucaagaacuuccagaucauccacggcaacgaccccgacuacaucgucaugcaguucggccgcgucgccgaggacgucuucaccauggacuacaacuacccccucugcgcccuccaggccuucgccaucgcccucuccuccuucgacuccaagcucgccugcgaguga

SEQ ID NO: 51339 - RNA, 1368 nt, Artificial Sequence
  derived and/or modified sequence opt2 from TUFM__Homo_sapiens__NP_003312
augaccaccauggccgccgccacccuccuccgcgccaccccccacuucuccggccucgccgccggccgcaccuuccuccuccagggccuccuccgccuccucaaggcccccgcccucccccuccucugccgcggccucgccgucgaggccaagaagaccuacguccgcgacaagccccacgucaacgucggcaccaucggccacgucgaccacggcaagaccacccucaccgccgccaucaccaagauccucgccgagggcggcggcgccaaguucaagaaguacgaggagaucgacaacgcccccgaggagcgcgcccgcggcaucaccaucaacgccgcccacgucgaguacuccaccgccgcccgccacuacgcccacaccgacugccccggccacgccgacuacgucaagaacaugaucaccggcaccgccccccucgacggcugcauccucgucgucgccgccaacgacggccccaugccccagacccgcgagcaccuccuccucgcccgccagaucggcgucgagcacgucgucgucuacgucaacaaggccgacgccguccaggacuccgagauggucgagcucgucgagcucgagauccgcgagcuccucaccgaguucggcuacaagggcgaggagacccccgucaucgucggcuccgcccucugcgcccucgagggccgcgaccccgagcucggccucaaguccguccagaagcuccucgacgccgucgacaccuacauccccguccccgcccgcgaccucgagaagcccuuccuccuccccgucgaggccgucuacuccguccccggccgcggcaccgucgucaccggcacccucgagcgcggcauccucaagaagggcgacgagugcgagcuccucggccacuccaagaacauccgcaccgucgucaccggcaucgagauguuccacaagucccucgagcgcgccgaggccggcgacaaccucggcgcccucguccgcggccucaagcgcgaggaccuccgccgcggccucgucauggucaagcccggcuccaucaagccccaccagaaggucgaggcccaggucuacauccucuccaaggaggagggcggccgccacaagcccuucgucucccacuucaugcccgucauguucucccucaccugggacauggccugccgcaucauccucccccccgagaaggagcucgccaugcccggcgaggaccucaaguucaaccucauccuccgccagcccaugauccucgagaagggccagcgcuucacccuccgcgacggcaaccgcaccaucggcaccggccucgucaccaacacccucgccaugaccgaggaggagaagaacaucaaguggggcuga

SEQ ID NO: 51340 - RNA, 1098 nt, Artificial Sequence
  derived and/or modified sequence opt2 from TUFT1__Homo_sapiens__NP_001119809
augaacggcacccgcaacuggugcacccucgucgacguccaccccgaggaccaggccgccgccggccgcaagaccuacgccauggucuccucccacuccgccggccacucccucgccuccgagcucgucgagucccacgacggccacgaggagaucaucaaggucuaccucaagggccgcuccggcgacaagaugauccacgagaagaacaucaaccagcucaaguccgagguccaguacauccaggaggcccgcaacugccuccagaagcuccgcgaggacaucuccuccaagcucgaccgcaaccucggcgacucccuccaccgccaggagauccaggucguccucgagaagcccaacggcuucucccagucccccaccgcccucuacuccuccccccccgaggucgacaccugcaucaacgaggacgucgagucccuccgcaagaccguccaggaccuccucgccaagcuccaggaggccaagcgccagcaccaguccgacugcgucgccuucgaggucacccucucccgcuaccagcgcgaggccgagcaguccaacgucgcccuccagcgcgaggaggaccgcgucgagcagaaggaggccgaggucggcgagcuccagcgccgccuccucggcauggagaccgagcaccaggcccuccucgccaagguccgcgagggcgaggucgcccucgaggagcuccgcuccaacaacgccgacugccaggccgagcgcgagaaggccgccacccucgagaaggaggucgccggccuccgcgagaagauccaccaccucgacgacaugcucaagucccagcagcgcaagguccgccagaugaucgagcagcuccagaacuccaaggccgucauccaguccaaggacgccaccauccaggagcucaaggagaagaucgccuaccucgaggccgagaaccucgagaugcacgaccgcauggagcaccucaucgagaagcagaucucccacggcaacuucuccacccaggcccgcgccaagaccgagaaccccggcuccauccgcaucuccaagccccccucccccaagcccaugcccgucauccgcgucgucgagaccuga

SEQ ID NO: 51341 - RNA, 1470 nt, Artificial Sequence
  derived and/or modified sequence opt2 from TULP1__Homo_sapiens__NP_001276324
augccccuccgcgacgagacccuccgcgaggucugggccuccgacuccggccacgaggaggagucccucucccccgaggccccccgccgccccaagcagcgccccgcccccgcccagcgccuccgcaagaagcgcaccgaggcccccgagucccccugccccaccggcuccaagccccgcaagcccggcgaggaggaggaggaggaggaggacgaggaggacgaggaggaggaggccgaggagaagaaggagaagauccuccucccccccaagaagccccuccgcgagaaguccuccgccgaccucaaggagcgccgcgccaaggcccagggcccccgcggcgaccucggcucccccgaccccccccccaagccccuccgcguccgcaacaaggaggcccccgccggcgagggcaccaagaugcgcaagaccaagaagaagggcuccggcgaggccgacaaggaccccuccggcucccccgccuccgcccgcaagucccccgccgccauguuccucgucggcgagggcucccccgacaagaaggcccucaagaagaagggcacccccaagggcgcccgcaaggaggaggaggaggaggaggaggccgccaccgucaucaagaaguccaaccagaagggcaaggccaagggcaagggcaagaagaaggccaaggaggagcgcgcccccuccccccccgucgaggucgacgagccccgcgaguucguccuccgccccgccccccagggccgcaccguccgcugccgccucacccgcgacaagaagggcauggaccgcggcauguaccccuccuacuuccuccaccucgacaccgagaagaaggucuuccuccucgccggccgcaagcgcaagcgcuccaagaccgccaacuaccucaucuccaucgaccccaccaaccucucccgcggcggcgagaacuucaucggcaagcuccgcuccaaccuccucggcaaccgcuucaccgucuucgacaacggccagaacccccagcgcggcuacuccaccaacgucgccucccuccgccaggagcucgccgccgucaucuacgagaccaacguccucggcuuccgcggcccccgccgcaugaccgucaucauccccggcauguccgccgagaacgagcgcguccccauccgcccccgcaacgccuccgacggccuccucguccgcuggcagaacaagacccucgagucccucaucgagcuccacaacaagccccccgucuggaacgacgacuccggcuccuacacccucaacuuccagggccgcgucacccaggccuccgucaagaacuuccagaucguccacgccgacgaccccgacuacaucguccuccaguucggccgcgucgccgaggacgccuucacccucgacuaccgcuacccccucugcgcccuccaggccuucgccaucgcccucuccuccuucgacggcaagcucgccugcgaguga

SEQ ID NO: 51342 - RNA, 1563 nt, Artificial Sequence
  derived and/or modified sequence opt2 from TULP2__Homo_sapiens__NP_003314
augucccaggacaacgacacccucaugcgcgacauccucggccacgagcucgccgccaugcgccuccagaagcucgagcagcagcgccgccucuucgagaagaagcagcgccagaagcgccaggagcuccucaugguccaggccaaccccgacgccucccccuggcucuggcgcuccugccuccgcgaggagcgccuccucggcgaccgcggccucggcaaccccuuccuccgcaagaaggucuccgaggcccaccuccccuccggcauccacuccgcccucggcaccgucuccugcggcggcgacggccgcggcgagcgcggccuccccaccccccgcaccgaggccgucuuccgcaaccucggccuccagucccccuuccucuccuggcuccccgacaacuccgacgccgagcucgaggaggucuccgucgagaacggcuccgucucccccccccccuucaagcaguccccccgcauccgccgcaagggcuggcaggcccaccagcgccccggcacccgcgccgagggcgaguccgacucccaggacaugggcgacgcccacaagucccccaacaugggccccaaccccggcauggacggcgacugcgucuacgagaaccucgccuuccagaaggaggaggaccucgagaagaagcgcgaggccuccgaguccaccggcaccaacuccuccgccgcccacaacgaggagcucuccaaggcccucaagggcgagggcggcaccgacuccgaccacaugcgccacgaggccucccucgccauccgcucccccugccccggccucgaggaggacauggaggccuacguccuccgccccgcccuccccggcaccaugaugcagugcuaccucacccgcgacaagcacggcgucgacaagggccucuucccccucuacuaccucuaccucgagaccuccgacucccuccagcgcuuccuccucgccggccgcaagcgccgccgcuccaagaccuccaacuaccucaucucccucgaccccacccaccucucccgcgacggcgacaacuucgucggcaagguccgcuccaacgucuucuccaccaaguucaccaucuucgacaacggcgucaaccccgaccgcgagcaccucacccgcaacaccgcccgcauccgccaggagcucggcgccgucugcuacgagcccaacguccucggcuaccucggcccccgcaagaugaccgucauccuccccggcaccaacucccagaaccagcgcaucaacguccagccccucaacgagcaggagucccuccucucccgcuaccagcgcggcgacaagcagggccuccuccuccuccacaacaagacccccuccugggacaaggagaacggcgucuacacccucaacuuccacggccgcgucacccgcgccuccgucaagaacuuccagaucgucgaccccaagcaccaggagcaccucguccuccaguucggccgcgucggccccgacaccuucaccauggacuucugcuuccccuucuccccccuccaggccuucuccaucugccucuccuccuucaacuga

SEQ ID NO: 51343 - RNA, 1506 nt, Artificial Sequence
  derived and/or modified sequence opt2 from TULP3__Homo_sapiens__NP_001153880
auggaggccucccgcugccgccucucccccuccggcgacuccgucuuccacgaggagaugaugaagaugcgccaggccaagcucgacuaccagcgccuccuccucgagaagcgccagcgcaagaagcgccucgagcccuucaugguccagcccaaccccgaggcccgccuccgccgcgccaagccccgcgccuccgacgagcagaccccccucgucaacugccacaccccccacuccaacgucauccuccacggcaucgacggccccgccgccguccucaagcccgacgagguccacgcccccuccgucuccuccuccgucgucgaggaggacgccgagaacaccgucgacaccgccuccaagcccggccuccaggagcgccuccagaagcacgacaucuccgaguccgucaacuucgacgaggagaccgacggcaucucccaguccgccugccucgagcgccccaacuccgccuccucccagaacuccaccgacaccggcaccuccggcuccgccaccgccgcccagcccgccgacaaccuccucggcgacaucgacgaccucgaggacuucgucuacucccccgccccccagggcgucaccguccgcugccgcaucauccgcgacaagcgcggcauggaccgcggccucuuccccaccuacuacauguaccucgagaaggaggagaaccagaagaucuuccuccucgccgcccgcaagcgcaagaaguccaagaccgccaacuaccucaucuccaucgaccccgucgaccucucccgcgagggcgaguccuacgucggcaagcuccgcuccaaccucaugggcaccaaguucaccgucuacgaccgcggcaucugccccaugaagggccgcggccucgucggcgccgcccacacccgccaggagcucgccgccaucuccuacgagaccaacguccucggcuucaagggcccccgcaagauguccgucaucauccccggcaugacccucaaccacaagcagauccccuaccagccccagaacaaccacgacucccuccucucccgcuggcagaaccgcaccauggagaaccucgucgagcuccacaacaaggcccccgucuggaacuccgacacccaguccuacguccucaacuuccgcggccgcgucacccaggccuccgucaagaacuuccagaucguccacaagaacgaccccgacuacaucgucaugcaguucggccgcgucgccgacgacgucuucacccucgacuacaacuacccccucugcgccguccaggccuucggcaucggccucuccuccuucgacaagugcauccagacccuccgcaugcaggagcucugcgagcuccaccgccagcaccacuccgccgccucccucguccaccgcaccgucugccagcgcugggucggccaccccuggcgccuccucccccagaccucccuccucuggaccgaccucucccccccccccgucguccccgccccccaccagaucuccauguga

SEQ ID NO: 51344 - RNA, 2037 nt, Artificial Sequence
  derived and/or modified sequence opt2 from TULP4__Homo_sapiens__NP_001007467
auguacgccgccgucgagcacggccccguccucugcuccgacuccaacauccucugccucuccuggaagggccgcguccccaaguccgagaaggagaagcccgucugccgccgccgcuacuacgaggagggcuggcucgccaccggcaacggccgcggcgucgucggcgucaccuucaccuccucccacugccgccgcgaccgcuccaccccccagcgcaucaacuucaaccuccgcggccacaacuccgaggucguccucguccgcuggaacgagcccuaccagaagcucgccaccugcgacgccgacggcggcaucuucgucuggauccaguacgagggccgcugguccgucgagcucgucaacgaccgcggcgcccaggucuccgacuucaccuggucccacgacggcacccaggcccucaucuccuaccgcgacggcuucguccucgucggcuccgucuccggccagcgccacugguccuccgagaucaaccucgagucccagaucaccugcggcaucuggacccccgacgaccagcagguccucuucggcaccgccgacggccaggucaucgucauggacugccacggccgcaugcucgcccacguccuccuccacgaguccgacggcguccucggcauguccuggaacuaccccaucuuccucgucgaggacuccuccgaguccgacaccgacuccgacgacuacgcccccccccaggacggccccgccgccuaccccauccccguccagaacaucaagccccuccucaccgucuccuucaccuccggcgacaucucccucaugaacaacuacgacgaccucucccccaccgucauccgcuccggccucaaggaggucgucgcccaguggugcacccagggcgaccuccucgccgucgccggcauggagcgccagacccagcucggcgagcuccccaacggcccccuccucaaguccgccauggucaaguucuacaacguccgcggcgagcacaucuucacccucgacacccucguccagcgccccaucaucuccaucugcuggggccaccgcgacucccgccuccucauggccuccggccccgcccucuacgucguccgcgucgagcaccgcgucuccucccuccagcuccucugccagcaggccaucgccuccacccuccgcgaggacaaggacgucuccaagcucacccuccccccccgccucugcuccuaccucuccaccgccuucauccccaccaucaagccccccauccccgaccccaacaacaugcgcgacuucgucuccuaccccuccgccggcaacgagcgccuccacugcaccaugaagcgcaccgaggacgaccccgaggucggcggccccugcuacacccucuaccucgaguaccucggcggccucguccccauccucaagggccgccgcaucuccaagcuccgccccgaguucgucaucauggacccccgcaccgacuccaagcccgacgagaucuacggcaacucccucaucuccaccgucaucgacuccugcaacugcuccgacuccuccgacaucgagcucuccgacgacugggccgccaagaagucccccaagaucucccgcgccuccaagucccccaagcucccccgcaucuccaucgaggcccgcaagucccccaagcucccccgcgccgcccaggagcucucccgcuccccccgccucccccuccgcaagcccuccgucggcucccccucccucacccgccgcgaguuccccuucgaggacaucacccagcacaacuaccucgcccaggucaccuccaacaucuggggcaccaaguucaagaucgucggccucgccgccuuccuccccaccaaccucggcgccgucaucuacaagaccucccuccuccaccuccagccccgccagaugaccaucuaccuccccgagguccgcaagaucuccauggacuacaucaaccuccccgucuucaaccccaacgucuucuccgaggacgaggacgaccuccccggcgacgccgucuggaccgacuga

SEQ ID NO: 51345 - RNA, 639 nt, Artificial Sequence
  derived and/or modified sequence opt2 from TUSC1__Homo_sapiens__NP_001004125
augggccccauguggcgcaugcgcggcggcgccacccgccgcggcuccugcugcggcggcgacggcgccgccgacggccgcggccccggccgcuccggccgcgcccgcggcggcggcucccccuccggcggcggcggcggcgucggcuggcgcggccgcgccgacggcgcccgccagcagcucgaggagcgcuucgccgaccucgccgccucccaccucgaggccauccgcgcccgcgacgagugggaccgccagaacgcccgccuccgccaggagaacgcccgccuccgccucgagaaccgccgccucaagcgcgagaaccgcucccucuuccgccaggcccuccgccuccccggcgagggcggcaacggcacccccgccgaggcccgccgcguccccgaggaggccuccaccaaccgccgcgcccgcgacuccggccgcgaggacgagcccggcuccccccgcgcccuccgcgcccgccucgagaagcucgaggccauguaccgccgcgcccuccuccagcuccaccucgagcagcgcggcccccgccccuccggcgacaaggaggagcagccccuccaggagcccgacuccggccuccgcucccgcgacuccgagcccuccggccccuggcucuga

SEQ ID NO: 51346 - RNA, 333 nt, Artificial Sequence
  derived and/or modified sequence opt2 from TUSC2__Homo_sapiens__NP_009206
augggcgccuccggcuccaaggcccgcggccucuggcccuucgccuccgccgccggcggcggcggcuccgaggccgccggcgccgagcaggcccucguccgcccccgcggccgcgccgucccccccuucgucuucacccgccgcggcuccauguucuacgacgaggacggcgaccucgcccacgaguucuacgaggagaccaucgucaccaagaacggccagaagcgcgccaagcuccgccgcguccacaagaaccucaucccccagggcaucgucaagcucgaccacccccgcauccacgucgacuuccccgucauccucuacgaggucuga

SEQ ID NO: 51347 - RNA, 1047 nt, Artificial Sequence
  derived and/or modified sequence opt2 from TUSC3__Homo_sapiens__NP_006756
augggcgcccgcggcgcccccucccgccgccgccaggccggccgccgccuccgcuaccuccccaccggcuccuuccccuuccuccuccuccuccuccuccucugcauccagcucggcggcggccagaagaagaaggagaaccuccucgccgagaaggucgagcagcucauggagugguccucccgccgcuccaucuuccgcaugaacggcgacaaguuccgcaaguucaucaaggcccccccccgcaacuacuccaugaucgucauguucaccgcccuccagccccagcgccagugcuccgucugccgccaggccaacgaggaguaccagauccucgccaacuccuggcgcuacuccuccgccuucugcaacaagcucuucuucuccauggucgacuacgacgagggcaccgacgucuuccagcagcucaacaugaacuccgcccccaccuucaugcacuucccccccaagggccgccccaagcgcgccgacaccuucgaccuccagcgcaucggcuucgccgccgagcagcucgccaaguggaucgccgaccgcaccgacguccacauccgcgucuuccgcccccccaacuacuccggcaccaucgcccucgcccuccucgucucccucgucggcggccuccucuaccuccgccgcaacaaccucgaguucaucuacaacaagaccggcugggccauggucucccucugcaucgucuucgccaugaccuccggccagauguggaaccacauccgcggcccccccuacgcccacaagaacccccacaacggccaggucuccuacauccacggcuccucccaggcccaguucgucgccgagucccacaucauccucguccucaacgccgccaucaccaugggcaugguccuccucaacgaggccgccaccuccaagggcgacgucggcaagcgccgcaucaucugccucgucggccucggccucgucgucuucuucuucuccuuccuccucuccaucuuccgcuccaaguaccacggcuaccccuacuccgaccucgacuucgaguga

SEQ ID NO: 51348 - RNA, 534 nt, Artificial Sequence
  derived and/or modified sequence opt2 from TUSC5__Homo_sapiens__NP_758955
auggcccaccccguccaguccgaguuccccuccgcccaggagcccggcuccgccgccuuccucgaccuccccgagauggagauccuccucaccaaggccgagaacaaggacgacaagacccucaaccucuccaagacccucuccggcccccucgaccucgagcagaacucccagggccuccccuucaaggccaucuccgagggccaccucgaggccccccucccccgcucccccucccgcgccuccucccgccgcgccuccuccaucgccaccaccuccuacgcccaggaccaggaggccccccgcgacuaccucauccucgccgucgucgccugcuucugccccgucuggccccucaaccucaucccccucaucaucuccaucaugucccgcuccuccaugcagcagggcaacgucgacggcgcccgccgccucggccgccucgcccgccuccucuccaucacccucaucaucaugggcaucgucaucaucauggucgccgucaccgucaacuucaccguccagaagaaguga

SEQ ID NO: 51349 - RNA, 2739 nt, Artificial Sequence
  derived and/or modified sequence opt2 from TUT1__Homo_sapiens__NP_073741
augucccuccccaucggcuccgccgaggucgccuccgagcgcgucgagcucuggcgcuccggcuuccgcugguggcagcgcugccucugcuucugccgcuaccgccgcgucgccauggccgccgucgacuccgacgucgagucccucccccgcggcggcuuccgcugcugccucugccacgucaccaccgccaaccgccccucccucgacgcccaccucggcggccgcaagcaccgccaccucgucgagcuccgcgccgcccgcaaggcccagggccuccgcuccgucuucgucuccggcuucccccgcgacgucgacuccgcccagcucuccgaguacuuccucgccuucggccccgucgccuccgucgucauggacaaggacaagggcgucuucgccaucgucgagaugggcgacgucggcgcccgcgaggccguccucucccagucccagcacucccucggcggccaccgccuccgcguccgcccccgcgagcagaaggaguuccagucccccgccuccaagucccccaagggcgccgcccccgacucccaccagcucgccaaggcccucgccgaggccgccgacgucggcgcccagaugaucaagcucgucggccuccgcgagcucuccgaggccgagcgccagcuccgcucccucgucgucgcccucaugcaggaggucuucaccgaguucuuccccggcugcgucguccaccccuucggcuccuccaucaacuccuucgacguccacggcugcgaccucgaccucuuccucgaccucggcgaccucgaggagccccagcccguccccaaggcccccgagucccccucccucgacuccgcccucgccuccccccucgacccccaggcccucgccugcacccccgccuccccccccgacucccagccccccgccuccccccaggacuccgaggcccucgacuucgagacccccuccuccucccucgccccccagacccccgacuccgcccucgccuccgagacccucgccuccccccagucccucccccccgccuccccccuccucgaggaccgcgaggagggcgaccucggcaaggccuccgagcucgccgagacccccaaggaggagaaggccgagggcgccgccaugcucgagcucgucggcuccauccuccgcggcugcguccccggcgucuaccgcguccagaccguccccuccgcccgccgccccgucgucaaguucugccaccgccccuccggccuccacggcgacgucucccucuccaaccgccucgcccuccacaacucccgcuuccucucccucugcuccgagcucgacggccgcguccgcccccucgucuacacccuccgcugcugggcccagggccgcggccucuccggcuccggcccccuccucuccaacuacgcccucacccuccucgucaucuacuuccuccagacccgcgacccccccguccuccccaccgucucccagcucacccagaaggccggcgagggcgagcaggucgaggucgacggcugggacugcuccuucccccgcgacgccucccgccucgagcccuccaucaacgucgagccccucuccucccuccucgcccaguucuucuccugcgucuccugcugggaccuccgcggcucccuccucucccuccgcgagggccaggcccuccccgucgccggcggccuccccuccaaccucugggagggccuccgccucggcccccucaaccuccaggaccccuucgaccucucccacaacgucgccgccaacgucaccucccgcgucgccggccgccuccagaacugcugccgcgccgccgccaacuacugccgcucccuccaguaccagcgccgcuccucccgcggccgcgacuggggccuccucccccuccuccagcccuccucccccuccucccuccucuccgccacccccaucccccucccccucgcccccuucacccagcucaccgccgcccucguccaggucuuccgcgaggcccucggcugccacaucgagcaggccaccaagcgcacccgcuccgagggcggcggcaccggcgaguccucccagggcggcaccuccaagcgccucaaggucgacggccagaagaacugcugcgaggagggcaaggaggagcagcagggcugcgccggcgacggcggcgaggaccgcgucgaggagauggucaucgaggucggcgagaugguccaggacugggccaugcagucccccggccagcccggcgaccucccccucaccaccggcaagcacggcgcccccggcgaggagggccagcccucccacgccgcccucgccgagcgcggccccaagggccacgaggccgcccaggaguggucccagggcgaggccggcaagggcgccucccuccccuccuccgccuccuggcgcugcgcccucuggcaccgcgucuggcagggccgccgccgcgcccgccgccgccuccagcagcagaccaaggagggcgccggcggcggcgccggcacccgcgccggcuggcucgccaccgaggcccaggucacccaggagcucaagggccucuccggcggcgaggagcgccccgagaccgagccccuccucuccuucgucgccuccgucucccccgccgaccgcaugcucaccgucaccccccuccaggacccccagggccucuuccccgaccuccaccacuuccuccaggucuuccucccccaggccauccgccaccucaaguga

SEQ ID NO: 51350 - RNA, 618 nt, Artificial Sequence
  derived and/or modified sequence opt2 from TVP23B__Homo_sapiens__NP_057162
augcuccagcaggacuccaacgacgacaccgaggacgucucccucuucgacgccgaggaggagaccaccaaccgcccccgcaaggccaagauccgccaccccgucgccuccuucuuccaccucuucuuccgcgucuccgccaucaucgucuaccuccucugcggccuccucuccuccuccuucaucaccugcauggucaccaucauccuccuccucuccugcgacuucugggccgucaagaacgucaccggccgccucauggucggccuccgcugguggaaccacaucgacgaggacggcaagucccacugggucuucgagucccgcaaggaguccucccaggagaacaagaccgucuccgaggccgagucccgcaucuucuggcucggccucaucgccugccccguccucugggucaucuucgccuucuccgcccucuucuccuuccgcgucaaguggcucgccgucgucaucaugggcgucguccuccagggcgccaaccucuacggcuacauccgcugcaagguccgcucccgcaagcaccucaccuccauggccaccuccuacuucggcaagcaguuccuccgccagaacaccggcgacgaccagaccuccuga

SEQ ID NO: 51351 - RNA, 1074 nt, Artificial Sequence
  derived and/or modified sequence opt2 from TWF1__Homo_sapiens__NP_001229326
augucccaccagaccggcauccaggccuccgaggacgucaaggagaucuucgcccgcgcccgcaacggcaaguaccgccuccucaagaucuccaucgagaacgagcagcucgucaucggcuccuacucccagcccuccgacuccugggacaaggacuacgacuccuucguccucccccuccucgaggacaagcagcccugcuacauccucuuccgccucgacucccagaacgcccagggcuacgaguggaucuucaucgccuggucccccgaccacucccacguccgccagaagaugcucuacgccgccacccgcgccacccucaagaaggaguucggcggcggccacaucaaggacgaggucuucggcaccgucaaggaggacgucucccuccacggcuacaagaaguaccuccucucccaguccucccccgccccccucaccgccgccgaggaggagcuccgccagaucaagaucaacgagucccccgaggaccacaucggcguccagaccgacgucggcgucgacaccaagcaccagacccuccagggcgucgccuuccccaucucccgcgaggccuuccaggcccucgagaagcucaacaaccgccagcucaacuacguccagcucgagaucgacaucaagaacgagaucaucauccucgccaacaccaccaacaccgagcucaaggaccuccccaagcgcauccccaaggacuccgcccgcuaccacuucuuccucuacaagcacucccacgagggcgacuaccucgaguccaucgucuucaucuacuccaugcccggcuacaccugcuccauccgcgagcgcaugcucuacuccuccugcaagucccgccuccucgagaucgucgagcgccagcuccagauggacgucauccgcaagaucgagaucgacaacggcgacgagcucaccgccgacuuccucuacgaggagguccaccccaagcagcacgcccacaagcaguccuucgccaagcccaagggccccgccggcaagcgcggcauccgccgccucauccgcggccccgccgagaccgaggccaccaccgacuga

SEQ ID NO: 51352 - RNA, 609 nt, Artificial Sequence
  derived and/or modified sequence opt2 from TWIST1__Homo_sapiens__XP_011513798
augaugcaggacgucuccuccucccccgucucccccgccgacgacucccucuccaacuccgaggaggagcccgaccgccagcagccccccuccggcaagcgcggcggccgcaagcgccgcuccucccgccgcuccgccggcggcggcgccggccccggcggcgccgccggcggcggcgucggcggcggcgacgagcccggcucccccgcccagggcaagcgcggcaagaaguccgccggcugcggcggcggcggcggcgccggcggcggcggcggcuccuccuccggcggcggcuccccccaguccuacgaggagcuccagacccagcgcgucauggccaacguccgcgagcgccagcgcacccagucccucaacgaggccuucgccgcccuccgcaagaucauccccacccuccccuccgacaagcucuccaagauccagacccucaagcucgccgcccgcuacaucgacuuccucuaccagguccuccaguccgacgagcucgacuccaagauggccuccugcuccuacgucgcccacgagcgccucuccuacgccuucuccgucuggcgcauggagggcgccugguccauguccgccucccacuga

SEQ ID NO: 51353 - RNA, 483 nt, Artificial Sequence
  derived and/or modified sequence opt2 from TWIST2__Homo_sapiens__NP_001258822
auggaggagggcuccuccucccccgucucccccgucgacucccucggcaccuccgaggaggagcucgagcgccagcccaagcgcuucggccgcaagcgccgcuacuccaagaaguccuccgaggacggcucccccacccccggcaagcgcggcaagaagggcucccccuccgcccaguccuucgaggagcuccagucccagcgcauccucgccaacguccgcgagcgccagcgcacccagucccucaacgaggccuucgccgcccuccgcaagaucauccccacccuccccuccgacaagcucuccaagauccagacccucaagcucgccgcccgcuacaucgacuuccucuaccagguccuccaguccgacgagauggacaacaagaugaccuccugcuccuacgucgcccacgagcgccucuccuacgccuucuccgucuggcgcauggagggcgccugguccauguccgccucccacuga

SEQ ID NO: 51354 - RNA, 672 nt, Artificial Sequence
  derived and/or modified sequence opt2 from TWSG1__Homo_sapiens__NP_065699
augaagcuccacuacgucgccguccucacccucgccauccucauguuccucaccuggcuccccgagucccucuccugcaacaaggcccucugcgccuccgacgucuccaagugccucauccaggagcucugccagugccgccccggcgagggcaacugcuccugcugcaaggagugcaugcucugccucggcgcccucugggacgagugcugcgacugcgucggcaugugcaacccccgcaacuacuccgacaccccccccaccuccaaguccaccgucgaggagcuccacgagcccauccccucccucuuccgcgcccucaccgagggcgacacccagcucaacuggaacaucgucuccuuccccgucgccgaggagcucucccaccacgagaaccucgucuccuuccucgagaccgucaaccagccccaccaccagaacgucuccguccccuccaacaacguccacgcccccuacuccuccgacaaggagcacaugugcaccgucgucuacuucgacgacugcauguccauccaccagugcaagaucuccugcgaguccaugggcgccuccaaguaccgcugguuccacaacgccugcugcgagugcaucggccccgagugcaucgacuacggcuccaagaccgucaagugcaugaacugcauguucuga

SEQ ID NO: 51355 - RNA, 1584 nt, Artificial Sequence
  derived and/or modified sequence opt2 from TXK__Homo_sapiens__NP_003319
augauccucuccuccuacaacaccauccaguccgucuucugcugcugcugcugcugcuccguccagaagcgccagaugcgcacccagaucucccucuccaccgacgaggagcuccccgagaaguacacccagcgccgccgccccuggcucucccagcucuccaacaagaagcaguccaacaccggccgcguccagcccuccaagcgcaagccccuccccccccucccccccuccgaggucgccgaggagaagauccaggucaaggcccucuacgacuuccucccccgcgagcccugcaaccucgcccuccgccgcgccgaggaguaccucauccucgagaaguacaacccccacugguggaaggcccgcgaccgccucggcaacgagggccucauccccuccaacuacgucaccgagaacaagaucaccaaccucgagaucuacgagugguaccaccgcaacaucacccgcaaccaggccgagcaccuccuccgccaggaguccaaggagggcgccuucaucguccgcgacucccgccaccucggcuccuacaccaucuccgucuucaugggcgcccgccgcuccaccgaggccgccaucaagcacuaccagaucaagaagaacgacuccggccagugguacgucgccgagcgccacgccuuccaguccauccccgagcucaucugguaccaccagcacaacgccgccggccucaugacccgccuccgcuaccccgucggccucaugggcuccugccuccccgccaccgccggcuucuccuacgagaagugggagaucgaccccuccgagcucgccuucaucaaggagaucggcuccggccaguucggcgucguccaccucggcgaguggcgcucccacauccaggucgccaucaaggccaucaacgagggcuccauguccgaggaggacuucaucgaggaggccaaggucaugaugaagcucucccacuccaagcucguccagcucuacggcgucugcauccagcgcaagccccucuacaucgucaccgaguucauggagaacggcugccuccucaacuaccuccgcgagaacaagggcaagcuccgcaaggagaugcuccucuccgucugccaggacaucugcgagggcauggaguaccucgagcgcaacggcuacauccaccgcgaccucgccgcccgcaacugccucgucuccuccaccugcaucgucaagaucuccgacuucggcaugacccgcuacguccucgacgacgaguacgucuccuccuucggcgccaaguuccccaucaagugguccccccccgaggucuuccucuucaacaaguacuccuccaaguccgacgucugguccuucggcguccucaugugggaggucuucaccgagggcaagaugcccuucgagaacaaguccaaccuccaggucgucgaggccaucuccgagggcuuccgccucuaccgcccccaccucgcccccauguccaucuacgaggucauguacuccugcuggcacgagaagcccgagggccgccccaccuucgccgagcuccuccgcgccgucaccgagaucgccgagaccugguga

SEQ ID NO: 51356 - RNA, 1191 nt, Artificial Sequence
  derived and/or modified sequence opt2 from TXLNG__Homo_sapiens__NP_001162154
auggccacccgcgucgaggaggccgcccgcggccgcggcggcggcgccgaggaggccaccgaggccggccgcggcggccgccgccgcuccccccgccagaagcucgaggagucccgcuccguccagaagcagaugaagauccuccagaagaagcaggcccagaucgucaaggagaagguccaccuccaguccgagcacuccaaggccauccucgcccgcuccaagcucgagucccucugccgcgagcuccagcgccacaacaagacccucaaggaggagaacaugcagcaggcccgcgaggaggaggagcgccgcaaggaggccaccgcccacuuccagaucacccucaacgagauccaggcccagcucgagcagcacgacauccacaacgccaagcuccgccaggagaacaucgagcucggcgagaagcucaagaagcucaucgagcaguacgcccuccgcgaggagcacaucgacaaggucuucaagcacaaggagcuccagcagcagcucgucgacgccaagcuccagcagaccacccagcucaucaaggaggccgacgagaagcaccagcgcgagcgcgaguuccuccucaaggaggccaccgagucccgccacaaguacgagcagaugaagcagcaggagguccagcucaagcagcagcucucccucuacauggacaaguucgaggaguuccagaccaccauggccaaguccaacgagcucuucaccaccuuccgccaggagauggagaagaugaccaagaagaucaagaagcucgagaaggagaccaucaucuggcgcaccaagugggagaacaacaacaaggcccuccuccagauggccgaggagaagaccguccgcgacaaggaguacaaggcccuccagaucaagcucgagcgccucgagaagcucugccgcgcccuccagaccgagcgcaacgagcucaacgagaaggucgagguccucaaggagcaggucuccaucaaggccgccaucaaggccgccaaccgcgaccucgccacccccgucaugcagcccugcaccgcccucgacucccacaaggagcucaacaccuccuccaagcgcgcccucggcgcccaccucgaggccgagcccaagucccagcgcuccgccguccagaagccccccuccaccggcuccgcccccgccaucgaguccgucgacuga

SEQ ID NO: 51357 - RNA, 594 nt, Artificial Sequence
  derived and/or modified sequence opt2 from TXN2__Homo_sapiens__XP_005261565
auguacguccccccccgcggcuccgacgaccgccgcgcccucgaccgccagggcggccucggcugcgccucccuccgcucccacugccgcgagauggcccagcgccuccuccuccgccgcuuccucgccuccgucaucucccgcaagcccucccagggccaguggcccccccucaccucccgcgcccuccagaccccccagugcucccccggcggccucaccgucacccccaaccccgcccgcaccaucuacaccacccgcaucucccucaccaccuucaacauccaggacggccccgacuuccaggaccgcgucgucaacuccgagacccccgucgucgucgacuuccacgcccaguggugcggccccugcaagauccucggcccccgccucgagaagauggucgccaagcagcacggcaaggucgucauggccaaggucgacaucgacgaccacaccgaccucgccaucgaguacgaggucuccgccguccccaccguccucgccaugaagaacggcgacgucgucgacaaguucgucggcaucaaggacgaggaccagcucgaggccuuccucaagaagcucaucggcuga

SEQ ID NO: 51358 - RNA, 1083 nt, Artificial Sequence
  derived and/or modified sequence opt2 from TXNDC15__Homo_sapiens__NP_078991
augguccccgccgccggccgccgccccccccgcgucaugcgccuccucggcugguggcagguccuccucuggguccucggccuccccguccgcggcgucgaggucgccgaggaguccggccgccucugguccgaggagcagcccgcccacccccuccaggucggcgccgucuaccucggcgaggaggagcuccuccacgaccccaugggccaggaccgcgccgccgaggaggccaacgccguccucggccucgacacccagggcgaccacauggucaugcucuccgucauccccggcgaggccgaggacaaggucuccuccgagcccuccggcgucaccugcggcgccggcggcgccgaggacucccgcugcaacguccgcgagucccucuucucccucgacggcgccggcgcccacuuccccgaccgcgaggaggaguacuacaccgagcccgaggucgccgaguccgacgccgcccccaccgaggacuccaacaacaccgagucccucaagucccccaaggucaacugcgaggagcgcaacaucaccggccucgagaacuucacccucaagauccucaacaugucccaggaccucauggacuuccucaaccccaacggcuccgacugcacccucguccucuucuacacccccuggugccgcuucuccgccucccucgccccccacuucaacucccucccccgcgccuuccccgcccuccacuuccucgcccucgacgccucccagcacuccucccucuccacccgcuucggcaccgucgccguccccaacauccuccucuuccagggcgccaagcccauggcccgcuucaaccacaccgaccgcacccucgagacccucaagaucuucaucuucaaccagaccggcaucgaggccaagaagaacgucgucgucacccaggccgaccagaucggcccccuccccuccacccucaucaaguccgucgacuggcuccucgucuucucccucuucuuccucaucuccuucaucauguacgccaccauccgcaccgaguccauccgcuggcucauccccggccaggagcaggagcacgucgaguga

SEQ ID NO: 51359 - RNA, 2478 nt, Artificial Sequence
  derived and/or modified sequence opt2 from TXNDC16__Homo_sapiens__NP_065835
auguucuccggcuucaacgucuuccgcgucggcaucuccuucgucaucaugugcaucuucuacaugcccaccgucaacucccuccccgagcucuccccccagaaguacuucuccacccuccagcccggcaaggccucccucgccuacuucugccaggccgacuccccccgcaccuccgucuuccucgaggagcucaacgaggccguccgcccccuccaggacuacggcaucuccgucgccaaggucaacugcgucaaggaggagaucucccgcuacugcggcaaggagaaggaccucaugaaggccuaccucuucaagggcaacauccuccuccgcgaguuccccaccgacacccucuucgacgucaacgccaucgucgcccacguccucuucgcccuccucuucuccgaggucaaguacaucaccaaccucgaggaccuccagaacaucgagaacgcccucaagggcaaggccaacaucaucuucuccuacguccgcgccaucggcauccccgagcaccgcgccgucauggaggccgccuucgucuacggcaccaccuaccaguucguccucaccaccgagaucgcccuccucgaguccaucggcuccgaggacgucgaguacgcccaccucuacuucuuccacugcaagcucguccucgaccucacccagcagugccgccgcacccucauggagcagccccucaccacccucaacauccaccucuucaucaagaccaugaaggccccccuccucaccgaggucgccgaggacccccagcaggucuccaccguccaccuccagcucggccucccccucgucuucaucgucucccagcaggccaccuacgaggccgaccgccgcaccgccgagugggucgccuggcgccuccucggcaaggccggcguccuccuccuccuccgcgacucccucgaggucaacaucccccaggacgccaacgucgucuucaagcgcgccgaggagggcguccccgucgaguuccucguccuccacgacgucgaccucaucaucucccacgucgagaacaacaugcacaucgaggagauccaggaggacgaggacaacgacauggagggccccgacaucgacguccaggacgacgaggucgccgagaccgucuuccgcgaccgcaagcgcaagcucccccucgagcucaccgucgagcucaccgaggagaccuucaacgccaccgucauggccuccgacuccaucguccucuucuacgccggcuggcaggccgucuccauggccuuccuccaguccuacaucgacgucgccgucaagcucaagggcaccuccaccaugcuccucacccgcaucaacugcgccgacugguccgacgucugcaccaagcagaacgucaccgaguuccccaucaucaagauguacaagaagggcgagaaccccgucuccuacgccggcaugcucggcaccgaggaccuccucaaguucauccagcucaaccgcaucuccuaccccgucaacaucaccuccauccaggaggccgaggaguaccucuccggcgagcucuacaaggaccucauccucuacuccuccgucuccguccucggccucuucucccccaccaugaagaccgccaaggaggacuucuccgaggccggcaacuaccucaagggcuacgucaucaccggcaucuacuccgaggaggacguccuccuccucuccaccaaguacgccgccucccuccccgcccuccuccucgcccgccacaccgagggcaagaucgaguccaucccccucgccuccacccacgcccaggacaucguccagaucaucaccgacgcccuccucgagauguuccccgagaucaccgucgagaaccuccccuccuacuuccgccuccagaagccccuccucauccucuucuccgacggcaccgucaacccccaguacaagaaggccauccucacccucgucaagcagaaguaccucgacuccuucacccccugcuggcucaaccucaagaacacccccgucggccgcggcauccuccgcgccuacuucgacccccuccccccccucccccuccucguccucgucaaccuccacuccggcggccaggucuucgccuuccccuccgaccaggccaucaucgaggagaaccucguccucuggcucaagaagcucgaggccggccucgagaaccacaucaccauccuccccgcccaggaguggaagcccccccuccccgccuacgacuuccucuccaugaucgacgccgccaccucccagcgcggcacccgcaagguccccaagugcaugaaggagaccgacguccaggagaacgacaaggagcagcacgaggacaaguccgccguccgcaaggagcccaucgagacccuccgcaucaagcacuggaaccgcuccaacugguucaaggaggccgagaaguccuuccgccgcgacaaggagcucggcugcuccaaggucaacuga

SEQ ID NO: 51360 - RNA, 372 nt, Artificial Sequence
  derived and/or modified sequence opt2 from TXNDC17__Homo_sapiens__NP_116120
auggcccgcuacgaggaggucuccgucuccggcuucgaggaguuccaccgcgccgucgagcagcacaacggcaagaccaucuucgccuacuucaccggcuccaaggacgccggcggcaaguccuggugccccgacugcguccaggccgagcccgucguccgcgagggccucaagcacaucuccgagggcugcgucuucaucuacugccaggucggcgagaagcccuacuggaaggaccccaacaacgacuuccgcaagaaccucaaggucaccgccguccccacccuccucaaguacggcaccccccagaagcucgucgaguccgagugccuccaggccaaccucgucgagaugcucuucuccgaggacuga

SEQ ID NO: 51361 - RNA, 975 nt, Artificial Sequence
  derived and/or modified sequence opt2 from TXNDC5__Homo_sapiens__NP_001139021
auggaggacgccaaggucuacgucgccaaggucgacugcaccgcccacuccgacgucugcuccgcccagggcguccgcggcuaccccacccucaagcucuucaagcccggccaggaggccgucaaguaccagggcccccgcgacuuccagacccucgagaacuggaugcuccagacccucaacgaggagcccgucacccccgagcccgaggucgagccccccuccgcccccgagcucaagcagggccucuacgagcucuccgccuccaacuucgagcuccacgucgcccagggcgaccacuucaucaaguucuucgcccccuggugcggccacugcaaggcccucgcccccaccugggagcagcucgcccucggccucgagcacuccgagaccgucaagaucggcaaggucgacugcacccagcacuacgagcucugcuccggcaaccagguccgcggcuaccccacccuccucugguuccgcgacggcaagaaggucgaccaguacaagggcaagcgcgaccucgagucccuccgcgaguacgucgagucccagcuccagcgcaccgagaccggcgccaccgagaccgucacccccuccgaggcccccguccucgccgccgagcccgaggccgacaagggcaccguccucgcccucaccgagaacaacuucgacgacaccaucgccgagggcaucaccuucaucaaguucuacgcccccuggugcggccacugcaagacccucgcccccaccugggaggagcucuccaagaaggaguuccccggccucgccggcgucaagaucgccgaggucgacugcaccgccgagcgcaacaucugcuccaaguacuccguccgcggcuaccccacccuccuccucuuccgcggcggcaagaaggucuccgagcacuccggcggccgcgaccucgacucccuccaccgcuucguccucucccaggccaaggacgagcucuga

SEQ ID NO: 51362 - RNA, 258 nt, Artificial Sequence
  derived and/or modified sequence opt2 from TXN__Homo_sapiens__NP_001231867
auggucaagcagaucgaguccaagaccgccuuccaggaggcccucgacgccgccggcgacaagcucgucgucgucgacuucuccgccaccuggugcggccccugcaagaugaucaagcccuucuuccacgacgucgccuccgagugcgaggucaagugcaugcccaccuuccaguucuucaagaagggccagaaggucggcgaguucuccggcgccaacaaggagaagcucgaggccaccaucaacgagcucgucuga

SEQ ID NO: 51363 - RNA, 870 nt, Artificial Sequence
  derived and/or modified sequence opt2 from TXNL1__Homo_sapiens__NP_004777
auggucggcgucaagcccgucggcuccgaccccgacuuccagcccgagcucuccggcgccggcucccgccucgccgucgucaaguucaccaugcgcggcugcggccccugccuccgcaucgcccccgccuucuccuccauguccaacaaguacccccaggccgucuuccucgaggucgacguccaccagugccagggcaccgccgccaccaacaacaucuccgccacccccaccuuccucuucuuccgcaacaagguccgcaucgaccaguaccagggcgccgacgccgucggccucgaggagaagaucaagcagcaccucgagaacgaccccggcuccaacgaggacaccgacauccccaagggcuacauggaccucaugcccuucaucaacaaggccggcugcgagugccucaacgaguccgacgagcacggcuucgacaacugccuccgcaaggacaccaccuuccucgaguccgacugcgacgagcagcuccucaucaccgucgccuucaaccagcccgucaagcucuacuccaugaaguuccagggccccgacaacggccagggccccaaguacgucaagaucuucaucaaccucccccgcuccauggacuucgaggaggccgagcgcuccgagcccacccaggcccucgagcucaccgaggacgacaucaaggaggacggcaucgucccccuccgcuacgucaaguuccagaacgucaacuccgucaccaucuucguccaguccaaccagggcgaggaggagaccacccgcaucuccuacuucaccuucaucggcacccccguccaggccaccaacaugaacgacuucaagcgcgucgucggcaagaagggcgagucccacuga

SEQ ID NO: 51364 - RNA, 1017 nt, Artificial Sequence
  derived and/or modified sequence opt2 from TXNRD2__Homo_sapiens__NP_001269441
auggccgccauggccgucgcccuccgcggccucggcggccgcuuccgcuggcgcacccaggccgucgccggcggcguccgcggcgccgcccgcggcgccgccgccggccagcgcgacuacgaccuccucgucgucggcggcggcuccggcggccucgccugcgccaaggaggccgcccagcucggccgcaaggucgccgucgucgacuacgucgagcccuccccccagggcacccgcuggggccucggcggcaccugcgucaacgucggcugcauccccaagaagcucaugcaccaggccgcccuccucggcggccucauccaggacgcccccaacuacggcugggaggucgcccagcccgucccccacgacuggcgcaagauggccgaggccguccagaaccacgucaagucccucaacuggggccaccgcguccagcuccaggaccgcaaggucaaguacuucaacaucaaggccuccuucgucgacgagcacaccgucugcggcgucgccaagggcggcaaggagauccuccucuccgccgaccacaucaucaucgccaccggcggccgcccccgcuaccccacccacaucgagggcgcccucgaguacggcaucaccuccgacgacaucuucuggcucaaggagucccccggcaagacccucgucgucggcgccuccuacgucgcccucgagugcgccggcuuccucaccggcaucggccucgacaccaccaucaugaugcgcuccaucccccuccgcggcuucgaccagcagauguccuccauggucaucgagcacauggccucccacggcacccgcuuccuccgcggcugcgcccccucccgcguccgccgccuccccgacggccagcuccaggucaccugggaggacuccaccaccggcaaggaggacaccggcaccuucgacaccguccucugggccaucgcccccugcaucuccgccugccuccccaccaccgucggccacgccggcaagaaccagcgccgcgacuga

SEQ ID NO: 51365 - RNA, 402 nt, Artificial Sequence
  derived and/or modified sequence opt2 from TXNRD3NB__Homo_sapiens__NP_001034872
augcgcgaccucuccgagcgccgccucggccagcccgagcucaaggccgagcagcagaugccccucgagcccguccgcgcccgccucuccgucggccucgccugcugcugcucccacaccaccgccgaggccuccucccucgagcacggcgacaaggucuucggccagggcuuccccuccccccucgaggagaucaagcgccuccucaagaucucccgcgcccuccaggcccgcuccguccccuccacccaggagaaggccaagugccucuccggcgagcccggccagcccgagggcaagggccaggagaccuaccccggccccggcaaggucgagggcaaggccgagcccgccaugcgcaaggacgacgucugccccggcaugaagugcaucuccggcuga

SEQ ID NO: 51366 - RNA, 3564 nt, Artificial Sequence
  derived and/or modified sequence opt2 from TYK2__Homo_sapiens__XP_011526547
augccccuccgccacuggggcauggcccgcggcuccaagcccgucggcgacggcgcccagcccauggccgccaugggcggccucaagguccuccuccacugggccggccccggcggcggcgagcccugggucaccuucuccgaguccucccucaccgccgaggaggucugcauccacaucgcccacaaggucggcaucaccccccccugcuucaaccucuucgcccucuucgacgcccaggcccaggucuggcucccccccaaccacauccucgagaucccccgcgacgccucccucaugcucuacuuccgcauccgcuucuacuuccgcaacuggcacggcaugaacccccgcgagcccgccgucuaccgcugcggcccccccggcaccgaggccuccuccgaccagaccgcccagggcaugcagcuccucgaccccgccuccuucgaguaccucuucgagcagggcaagcacgaguucgucaacgacgucgccucccucugggagcucuccaccgaggaggagauccaccacuucaagaacgagucccucggcauggccuuccuccaccucugccaccucgcccuccgccacggcaucccccucgaggaggucgccaagaagaccuccuucaaggacugcaucccccgcuccuuccgccgccacauccgccagcacuccgcccucacccgccuccgccuccgcaacgucuuccgccgcuuccuccgcgacuuccagcccggccgccucucccagcagauggucauggucaaguaccucgccacccucgagcgccucgccccccgcuucggcaccgagcgcguccccgucugccaccuccgccuccucgcccaggccgagggcgagcccugcuacauccgcgacuccggcgucgcccccaccgaccccggccccgaguccgccgccggcccccccacccacgagguccucgucaccggcaccggcggcauccagugguggcccgucgaggaggaggucaacaaggaggagggcuccuccggcuccuccggccgcaacccccaggccucccucuucggcaagaaggccaaggcccacaaggccgucggccagcccgccgaccgcccccgcgagccccucugggccuacuucugcgacuuccgcgacaucacccacgucguccucaaggagcacugcgucuccauccaccgccaggacaacaagugccucgagcucucccuccccucccgcgccgccgcccucuccuucgucucccucgucgacggcuacuuccgccucaccgccgacuccucccacuaccucugccacgaggucgcccccccccgccucgucauguccauccgcgacggcauccacggcccccuccucgagcccuucguccaggccaagcuccgccccgaggacggccucuaccucauccacugguccaccucccaccccuaccgccucauccucaccgucgcccagcgcucccaggcccccgacggcaugcagucccuccgccuccgcaaguuccccaucgagcagcaggacggcgccuucguccucgagggcuggggccgcuccuuccccuccguccgcgagcucggcgccgcccuccagggcugccuccuccgcgccggcgacgacugcuucucccuccgccgcugcugccucccccagcccggcgagaccuccaaccucaucaucaugcgcggcgcccgcgccuccccccgcacccucaaccucucccagcucuccuuccaccgcgucgaccagaaggagaucacccagcucucccaccucggccagggcacccgcaccaacgucuacgagggccgccuccgcgucgagggcuccggcgaccccgaggagggcaagauggacgacgaggacccccucguccccggccgcgaccgcggccaggagcuccgcgucguccucaagguccucgaccccucccaccacgacaucgcccucgccuucuacgagaccgccucccucaugucccaggucucccacacccaccucgccuucguccacggcgucugcguccgcggccccgagaacaucauggucaccgaguacgucgagcacggcccccucgacgucuggcuccgccgcgagcgcggccacguccccauggccuggaagauggucgucgcccagcagcucgccuccgcccucuccuaccucgagaacaagaaccucguccacggcaacgucugcggccgcaacauccuccucgcccgccucggccucgccgagggcaccucccccuucaucaagcucuccgaccccggcgucggccucggcgcccucucccgcgaggagcgcgucgagcgcauccccuggcucgcccccgagugccuccccggcggcgccaacucccucuccaccgccauggacaaguggggcuucggcgccacccuccucgagaucugcuucgacggcgaggccccccuccagucccgcucccccuccgagaaggagcacuucuaccagcgccagcaccgccuccccgagcccuccugcccccagcucgccacccucaccucccagugccucaccuacgagcccacccagcgccccuccuuccgcaccauccuccgcgaccucacccgccuccagccccacaaccucgccgacguccucaccgucaaccccgacucccccgccuccgaccccaccgucuuccacaagcgcuaccucaagaagauccgcgaccucggcgagggccacuucggcaaggucucccucuacugcuacgaccccaccaacgacggcaccggcgagauggucgccgucaaggcccucaaggccgacugcggcccccagcaccgcuccggcuggaagcaggagaucgacauccuccgcacccucuaccacgagcacaucaucaaguacaagggcugcugcgaggaccagggcgagaagucccuccagcucgucauggaguacgucccccucggcucccuccgcgacuaccucccccgccacuccaucggccucgcccagcuccuccucuucgcccagcagaucugcgagggcauggccuaccuccacgcccagcacuacauccaccgcgaccucgccgcccgcaacguccuccucgacaacgaccgccucgucaagaucggcgacuucggccucgccaaggccguccccgagggccacgaguacuaccgcguccgcgaggacggcgacucccccgucuucugguacgcccccgagugccucaaggaguacaaguucuacuacgccuccgacgucugguccuucggcgucacccucuacgagcuccucacccacugcgacuccucccaguccccccccaccaaguuccucgagcucaucggcaucgcccagggccagaugaccguccuccgccucaccgagcuccucgagcgcggcgagcgccucccccgccccgacaagugccccugcgaggucuaccaccucaugaagaacugcugggagaccgaggccuccuuccgccccaccuucgagaaccucauccccauccucaagaccguccacgagaaguaccagggccaggcccccuccgucuucuccgucugcuga

SEQ ID NO: 51367 - RNA, 1449 nt, Artificial Sequence
  derived and/or modified sequence opt2 from TYMP__Homo_sapiens__NP_001107227
auggccgcccucaugacccccggcaccggcgccccccccgcccccggcgacuucuccggcgagggcucccagggccuccccgaccccucccccgagcccaagcagcuccccgagcucauccgcaugaagcgcgacggcggccgccucuccgaggccgacauccgcggcuucgucgccgccgucgucaacggcuccgcccagggcgcccagaucggcgccaugcucauggccauccgccuccgcggcauggaccucgaggagaccuccguccucacccaggcccucgcccaguccggccagcagcucgaguggcccgaggccuggcgccagcagcucgucgacaagcacuccaccggcggcgucggcgacaaggucucccucguccucgcccccgcccucgccgccugcggcugcaagguccccaugaucuccggccgcggccucggccacaccggcggcacccucgacaagcucgaguccauccccggcuucaacgucauccagucccccgagcagaugcagguccuccucgaccaggccggcugcugcaucgucggccaguccgagcagcucguccccgccgacggcauccucuacgccgcccgcgacgucaccgccaccgucgacucccucccccucaucaccgccuccauccucuccaagaagcucgucgagggccucuccgcccucgucgucgacgucaaguucggcggcgccgccgucuuccccaaccaggagcaggcccgcgagcucgccaagacccucgucggcgucggcgccucccucggccuccgcgucgccgccgcccucaccgccauggacaagccccucggccgcugcgucggccacgcccucgaggucgaggaggcccuccucugcauggacggcgccggcccccccgaccuccgcgaccucgucaccacccucggcggcgcccuccucuggcucuccggccacgccggcacccaggcccagggcgccgcccgcgucgccgccgcccucgacgacggcuccgcccucggccgcuucgagcgcaugcucgccgcccagggcgucgaccccggccucgcccgcgcccucugcuccggcucccccgccgagcgccgccagcuccucccccgcgcccgcgagcaggaggagcuccucgcccccgccgacggcaccgucgagcucguccgcgcccucccccucgcccucguccuccacgagcucggcgccggccgcucccgcgccggcgagccccuccgccucggcgucggcgccgagcuccucgucgacgucggccagcgccuccgccgcggcacccccuggcuccgcguccaccgcgacggccccgcccucuccggcccccagucccgcgcccuccaggaggcccucguccucuccgaccgcgcccccuucgccgcccccucccccuucgccgagcucguccuccccccccagcaguga

SEQ ID NO: 51368 - RNA, 942 nt, Artificial Sequence
  derived and/or modified sequence opt2 from TYMS__Homo_sapiens__NP_001062
augcccgucgccggcuccgagcucccccgccgcccccucccccccgccgcccaggagcgcgacgccgagccccgccccccccacggcgagcuccaguaccucggccagauccagcacauccuccgcugcggcguccgcaaggacgaccgcaccggcaccggcacccucuccgucuucggcaugcaggcccgcuacucccuccgcgacgaguucccccuccucaccaccaagcgcgucuucuggaagggcguccucgaggagcuccucugguucaucaagggcuccaccaacgccaaggagcucuccuccaagggcgucaagaucugggacgccaacggcucccgcgacuuccucgacucccucggcuucuccacccgcgaggagggcgaccucggccccgucuacggcuuccaguggcgccacuucggcgccgaguaccgcgacauggaguccgacuacuccggccagggcgucgaccagcuccagcgcgucaucgacaccaucaagaccaaccccgacgaccgccgcaucaucaugugcgccuggaacccccgcgaccucccccucauggcccucccccccugccacgcccucugccaguucuacgucgucaacuccgagcucuccugccagcucuaccagcgcuccggcgacaugggccucggcguccccuucaacaucgccuccuacgcccuccucaccuacaugaucgcccacaucaccggccucaagcccggcgacuucauccacacccucggcgacgcccacaucuaccucaaccacaucgagccccucaagauccagcuccagcgcgagccccgccccuuccccaagcuccgcauccuccgcaaggucgagaagaucgacgacuucaaggccgaggacuuccagaucgagggcuacaacccccaccccaccaucaagauggagauggccgucuga

SEQ ID NO: 51369 - RNA, 1590 nt, Artificial Sequence
  derived and/or modified sequence opt2 from TYR__Homo_sapiens__NP_000363
augcuccucgccguccucuacugccuccucugguccuuccagaccuccgccggccacuucccccgcgccugcgucuccuccaagaaccucauggagaaggagugcugcccccccugguccggcgaccgcucccccugcggccagcucuccggccgcggcuccugccagaacauccuccucuccaacgccccccucggcccccaguuccccuucaccggcgucgacgaccgcgaguccuggcccuccgucuucuacaaccgcaccugccagugcuccggcaacuucaugggcuucaacugcggcaacugcaaguucggcuucuggggccccaacugcaccgagcgccgccuccucguccgccgcaacaucuucgaccucuccgcccccgagaaggacaaguucuucgccuaccucacccucgccaagcacaccaucuccuccgacuacgucauccccaucggcaccuacggccagaugaagaacggcuccacccccauguucaacgacaucaacaucuacgaccucuucgucuggaugcacuacuacgucuccauggacgcccuccucggcggcuccgagaucuggcgcgacaucgacuucgcccacgaggcccccgccuuccuccccuggcaccgccucuuccuccuccgcugggagcaggagauccagaagcucaccggcgacgagaacuucaccauccccuacugggacuggcgcgacgccgagaagugcgacaucugcaccgacgaguacaugggcggccagcaccccaccaaccccaaccuccucucccccgccuccuucuucuccuccuggcagaucgucugcucccgccucgaggaguacaacucccaccagucccucugcaacggcacccccgagggcccccuccgccgcaaccccggcaaccacgacaagucccgcaccccccgccuccccuccuccgccgacgucgaguucugccucucccucacccaguacgaguccggcuccauggacaaggccgccaacuucuccuuccgcaacacccucgagggcuucgccuccccccucaccggcaucgccgacgccucccaguccuccaugcacaacgcccuccacaucuacaugaacggcaccaugucccagguccagggcuccgccaacgaccccaucuuccuccuccaccacgccuucgucgacuccaucuucgagcaguggcuccgccgccaccgcccccuccaggaggucuaccccgaggccaacgcccccaucggccacaaccgcgaguccuacaugguccccuucaucccccucuaccgcaacggcgacuucuucaucuccuccaaggaccucggcuacgacuacuccuaccuccaggacuccgaccccgacuccuuccaggacuacaucaaguccuaccucgagcaggccucccgcaucugguccuggcuccucggcgccgccauggucggcgccguccucaccgcccuccucgccggccucgucucccuccucugccgccacaagcgcaagcagcuccccgaggagaagcagccccuccucauggagaaggaggacuaccacucccucuaccagucccaccucuga

SEQ ID NO: 51370 - RNA, 2673 nt, Artificial Sequence
  derived and/or modified sequence opt2 from TYRO3__Homo_sapiens__NP_006284
auggcccuccgccgcuccaugggccgccccggccuccccccccucccccuccccccccccccccgccucggccuccuccucgccgcccucgccucccuccuccuccccgaguccgccgccgccggccucaagcucaugggcgcccccgucaagcucaccgucucccagggccagcccgucaagcucaacugcuccgucgagggcauggaggagcccgacauccagugggucaaggacggcgccgucguccagaaccucgaccagcucuacauccccgucuccgagcagcacuggaucggcuuccucucccucaaguccgucgagcgcuccgacgccggccgcuacuggugccaggucgaggacggcggcgagaccgagaucucccagcccgucuggcucaccgucgagggcguccccuucuucaccgucgagcccaaggaccucgccgucccccccaacgcccccuuccagcucuccugcgaggccgucggcccccccgagcccgucaccaucgucugguggcgcggcaccaccaagaucggcggccccgcccccucccccuccguccucaacgucaccggcgucacccaguccaccauguucuccugcgaggcccacaaccucaagggccucgccuccucccgcaccgccaccguccaccuccaggcccuccccgccgcccccuucaacaucaccgucaccaagcucuccuccuccaacgccuccgucgccuggaugcccggcgccgacggccgcgcccuccuccaguccugcaccguccaggucacccaggcccccggcggcugggagguccucgccgucgucguccccgucccccccuucaccugccuccuccgcgaccucguccccgccaccaacuacucccuccgcguccgcugcgccaacgcccucggccccucccccuacgccgacuggguccccuuccagaccaagggccucgcccccgccuccgccccccagaaccuccacgccauccgcaccgacuccggccucauccucgagugggaggaggucauccccgaggccccccucgagggcccccucggccccuacaagcucuccuggguccaggacaacggcacccaggacgagcucaccgucgagggcacccgcgccaaccucaccggcugggacccccagaaggaccucaucguccgcgucugcgucuccaacgccgucggcugcggccccuggucccagccccucgucgucuccucccacgaccgcgccggccagcagggccccccccacucccgcaccuccuggguccccgucguccucggcguccucaccgcccucgucaccgccgccgcccucgcccucauccuccuccgcaagcgccgcaaggagacccgcuucggccaggccuucgacuccgucauggcccgcggcgagcccgccguccacuuccgcgccgcccgcuccuucaaccgcgagcgccccgagcgcaucgaggccacccucgacucccucggcaucuccgacgagcucaaggagaagcucgaggacguccucauccccgagcagcaguucacccucggccgcaugcucggcaagggcgaguucggcuccguccgcgaggcccagcucaagcaggaggacggcuccuucgucaaggucgccgucaagaugcucaaggccgacaucaucgccuccuccgacaucgaggaguuccuccgcgaggccgccugcaugaaggaguucgaccacccccacgucgccaagcucgucggcgucucccuccgcucccgcgccaagggccgccuccccauccccauggucauccuccccuucaugaagcacggcgaccuccacgccuuccuccucgccucccgcaucggcgagaaccccuucaaccucccccuccagacccucauccgcuucauggucgacaucgccugcggcauggaguaccucuccucccgcaacuucauccaccgcgaccucgccgcccgcaacugcaugcucgccgaggacaugaccgucugcgucgccgacuucggccucucccgcaagaucuacuccggcgacuacuaccgccagggcugcgccuccaagcuccccgucaaguggcucgcccucgagucccucgccgacaaccucuacaccguccaguccgacgucugggccuucggcgucaccaugugggagaucaugacccgcggccagacccccuacgccggcaucgagaacgccgagaucuacaacuaccucaucggcggcaaccgccucaagcagccccccgagugcauggaggacgucuacgaccucauguaccagugcugguccgccgaccccaagcagcgccccuccuucaccugccuccgcauggagcucgagaacauccucggccagcucuccguccucuccgccucccaggacccccucuacaucaacaucgagcgcgccgaggagcccaccgccggcggcucccucgagcuccccggccgcgaccagcccuacuccggcgccggcgacggcuccggcaugggcgccgucggcggcacccccuccgacugccgcuacauccucacccccggcggccucgccgagcagcccggccaggccgagcaccagcccgaguccccccucaacgagacccagcgccuccuccuccuccagcagggccuccucccccacuccuccugcuga

SEQ ID NO: 51371 - RNA, 309 nt, Artificial Sequence
  derived and/or modified sequence opt2 from TYROBP__Homo_sapiens__NP_001166985
augggcggccucgagcccugcucccgccuccuccuccucccccuccuccucgccgucuccgacugcuccugcuccaccgucucccccggcguccucgccggcaucgucaugggcgaccucguccucaccguccucaucgcccucgccgucuacuuccucggccgccucgucccccgcggccgcggcgccgccgaggccgccacccgcaagcagcgcaucaccgagaccgagucccccuaccaggagcuccagggccagcgcuccgacgucuacuccgaccucaacacccagcgccccuacuacaaguga

SEQ ID NO: 51372 - RNA, 1614 nt, Artificial Sequence
  derived and/or modified sequence opt2 from TYRP1__Homo_sapiens__NP_000541
auguccgcccccaagcuccucucccucggcugcaucuucuucccccuccuccucuuccagcaggcccgcgcccaguucccccgccagugcgccaccgucgaggcccuccgcuccggcaugugcugccccgaccucucccccgucuccggccccggcaccgaccgcugcggcuccuccuccggccgcggccgcugcgaggccgucaccgccgacucccgcccccacuccccccaguacccccacgacggccgcgacgaccgcgaggucuggccccuccgcuucuucaaccgcaccugccacugcaacggcaacuucuccggccacaacugcggcaccugccgccccggcuggcgcggcgccgccugcgaccagcgcguccucaucguccgccgcaaccuccucgaccucuccaaggaggagaagaaccacuucguccgcgcccucgacauggccaagcgcaccacccacccccucuucgucaucgccacccgccgcuccgaggagauccucggccccgacggcaacaccccccaguucgagaacaucuccaucuacaacuacuucgucuggacccacuacuacuccgucaagaagaccuuccucggcgucggccaggaguccuucggcgaggucgacuucucccacgagggccccgccuuccucaccuggcaccgcuaccaccuccuccgccucgagaaggacaugcaggagaugcuccaggagcccuccuucucccuccccuacuggaacuucgccaccggcaagaacgucugcgacaucugcaccgacgaccucaugggcucccgcuccaacuucgacuccacccucaucucccccaacuccgucuucucccaguggcgcgucgucugcgacucccucgaggacuacgacacccucggcacccucugcaacuccaccgaggacggccccauccgccgcaaccccgccggcaacgucgcccgccccaugguccagcgccuccccgagccccaggacgucgcccagugccucgaggucggccucuucgacaccccccccuucuacuccaacuccaccaacuccuuccgcaacaccgucgagggcuacuccgaccccaccggcaaguacgaccccgccguccgcucccuccacaaccucgcccaccucuuccucaacggcaccggcggccagacccaccucucccccaacgaccccaucuucguccuccuccacaccuucaccgacgccgucuucgacgaguggcuccgccgcuacaacgccgacaucuccaccuucccccucgagaacgcccccaucggccacaaccgccaguacaacaugguccccuucuggccccccgucaccaacaccgagauguucgucaccgcccccgacaaccucggcuacaccuacgagauccaguggcccucccgcgaguucuccguccccgagaucaucgccaucgccgucgucggcgcccuccuccucgucgcccucaucuucggcaccgccuccuaccucauccgcgcccgccgcuccauggacgaggccaaccagccccuccucaccgaccaguaccagugcuacgccgaggaguacgagaagcuccagaaccccaaccaguccgucgucuga

SEQ ID NO: 51373 - RNA, 1197 nt, Artificial Sequence
  derived and/or modified sequence opt2 from TYSND1__Homo_sapiens__NP_001035363
augcgccgccaguggggcuccgccaugcgcgccgccgagcaggccggcugcauggucuccgccucccgcgccggccagcccgaggccggccccugguccugcuccggcgucauccucucccgcucccccggccucguccucugccacggcggcaucuucguccccuuccuccgcgccggcuccgagguccucaccgccgccggcgccgucuuccuccccggcgacuccugccgcgacgaccuccgccuccacguccagugggcccccaccgccgccggccccggcggcggcgccgagcgcggccgccccggccucugcaccccccagugcgccucccucgagcccggcccccccgcccccucccgcggccgcccccuccagccccgccuccccgccgagcuccuccuccuccucuccugccccgccuucugggcccacuucgcccgccucuucggcgacgaggccgccgagcaguggcgcuucuccuccgccgcccgcgacgacgaggucuccgaggacgaggaggccgaccagcuccgcgcccucggcugguucgcccuccucggcguccgccucggccaggaggaggucgaggaggagcgcggccccgccauggccgucuccccccucggcgccguccccaagggcgccccccuccucgucugcggcucccccuucggcgccuucugccccgacaucuuccucaacacccucuccugcggcguccucuccaacgucgccggcccccuccuccucaccgacgcccgcugccuccccggcaccgagggcggcggcgucuucaccgcccgccccgccggcgcccucgucgcccucgucgucgccccccucugcuggaaggccggcgagugggucggcuucacccuccucugcgccgccgccccccucuuccgcgccgcccgcgacgcccuccaccgccucccccacuccaccgccgcccucgccgcccuccucccccccgaggucggcguccccuggggccucccccuccgcgacuccggcccccucugggccgccgccgccguccucgucgagugcggcaccgucuggggcuccggcgucgccgucgccccccgccucgucgucaccugccgccacgucuccccccgcgaggccgcccgcguccucguccgcuccaccacccccaagcacaaccaccagcagcaccccggccaguga

SEQ ID NO: 51374 - RNA, 1833 nt, Artificial Sequence
  derived and/or modified sequence opt2 from TYW1B__Homo_sapiens__XP_011514532
auggaccccuccgccgacaccugggaccucuccuccccccucaucucccucuggaucaaccgcuucuacaucuaccucggcuucgccgucuccaucucccucuggaucugcguccagaucgucaucgagaugcagggcuucgccaccguccucgccgaggccgucaccucccucgaccuccccgucgccaucaucaaccucaaggaguacgaccccgacgaccaccucaucgaggaggucaccuccaagaacgucugcgucuuccucgucgccaccuacaccgacggccuccccaccgaguccgccgagugguucugcaaguggcucgaggaggccuccaucgacuuccgcuucggcaagaccuaccucaagggcaugcgcgacgccgucuucggccucggcaacuccgccuacgccucccacuucaacaaggucggcaagaacgucgacaaguggcucuggaugcucggcguccaccgcgucaugucccgcggcgagggcgacugcgacgucgucaaguccaagcacggcuccaucgaggccaacuuccgcgccuggaagaccaaguucaucucccagcuccaggcccuccagaagggcgagcgcaagaaguccugcggcggccacugcaagaagggcaagugcgagucccaccagcacggcuccgaggagcgcgaggagggcucccaggagcaggacgagcuccaccaccgcgacaccaaggaggaggagcccuucgaguccuccuccgaggaggaguucggcggcgaggaccaccagucccucaacuccaucgucgacgucgaggaccucggcaagaucauggaccacgucaagaaggagaagcgcgagaaggagcagcaggaggagaaguccggccucuuccgcaacaugggccgcaacgaggacggcgagcgccgcgccaugaucacccccgcccuccgcgaggcccucaccaagcaggucgacgccccccgcgagcgcucccuccuccagacccacauccucuggaacgagucccaccgcugcauggagaccacccccucccucgccugcgccaacaagugcgucuucugcugguggcaccacaacaaccccgucggcaccgaguggcucuggaagauggaccagcccgagaugauccucaaggaggccaucgagaaccaccagaacaugaucaagcaguucaagggcguccccggcgucaaggccgagcgcuucgaggagggcaugaccgucaagcacugcgcccucucccucgucggcgagcccaucauguaccccgagaucaaccgcuuccucaagcuccuccaccagugcaagaucuccuccuuccucgucaccaacgcccaguuccccgccgagauccgcaaccucgagcccgucacccagcucuacgucuccgucgacgccuccaccaaggacucccucaagaagaucgaccgcccccucuucaaggacuucuggcagcaguuccucgacucccucaaggcccucgccgucaagcagcagcgcaccgucuaccgccucaugcucgucaaggccuggaacgucgacgagcuccaggccuacgcccagcucgucucccucggcaaccccgacuucaucgaggucaagggcgucaccuacugccgcgaguccuccgccuccucccucaccauggcccacguccccuggcacgaggaggucguccaguucguccgcgagcucgucgaccucauccccgaguacgagaucgccugcgagcacgagcacuccaacugccuccucaucgcccaccgcaaggaccucggccgccucccccgcgccgaggacgagggccacgucuccuga

SEQ ID NO: 51375 - RNA, 504 nt, Artificial Sequence
  derived and/or modified sequence opt2 from U2AF1__Homo_sapiens__NP_001020375
augcaggagcacuacgacgaguucuucgaggaggucuucaccgagauggaggagaaguacggcgaggucgaggagaugaacgucugcgacaaccucggcgaccaccucgucggcaacgucuacgucaaguuccgccgcgaggaggacgccgagaaggccgucaucgaccucaacaaccgcugguucaacggccagcccauccacgccgagcucucccccgucaccgacuuccgcgaggccugcugccgccaguacgagaugggcgagugcacccgcggcggcuucugcaacuucaugcaccucaagcccaucucccgcgagcuccgccgcgagcucuacggccgccgccgcaagaagcaccgcucccgcucccgcucccgcgagcgccgcucccgcucccgcgaccgcggccgcggcggcggcggcggcggcggcggcggcggcggcggccgcgagcgcgaccgccgccgcucccgcgaccgcgagcgcuccggccgcuucuga

SEQ ID NO: 51376 - RNA, 1416 nt, Artificial Sequence
  derived and/or modified sequence opt2 from U2AF2__Homo_sapiens__NP_001012496
auguccgacuucgacgaguucgagcgccagcucaacgagaacaagcaggagcgcgacaaggagaaccgccaccgcaagcgcucccacucccgcucccgcucccgcgaccgcaagcgccgcucccgcucccgcgaccgccgcaaccgcgaccagcgcuccgccucccgcgaccgccgccgccgcuccaagccccucacccgcggcgccaaggaggagcacggcggccucauccgcuccccccgccacgagaagaagaagaagguccgcaaguacugggacguccccccccccggcuucgagcacaucacccccaugcaguacaaggccaugcaggccgccggccagauccccgccaccgcccuccuccccaccaugacccccgacggccucgccgucacccccacccccguccccgucgucggcucccagaugacccgccaggcccgccgccucuacgucggcaacauccccuucggcaucaccgaggaggccaugauggacuucuucaacgcccagaugcgccucggcggccucacccaggcccccggcaaccccguccucgccguccagaucaaccaggacaagaacuucgccuuccucgaguuccgcuccgucgacgagaccacccaggccauggccuucgacggcaucaucuuccagggccagucccucaagauccgccgcccccacgacuaccagccccuccccggcauguccgagaaccccuccgucuacguccccggcgucgucuccaccgucguccccgacuccgcccacaagcucuucaucggcggccuccccaacuaccucaacgacgaccaggucaaggagcuccucaccuccuucggcccccucaaggccuucaaccucgucaaggacuccgccaccggccucuccaagggcuacgccuucugcgaguacgucgacaucaacgucaccgaccaggccaucgccggccucaacggcaugcagcucggcgacaagaagcuccucguccagcgcgccuccgucggcgccaagaacgccacccucuccaccaucaaccagacccccgucacccuccagguccccggccucauguccucccagguccagaugggcggccaccccaccgagguccucugccucaugaacaugguccuccccgaggagcuccucgacgacgaggaguacgaggagaucgucgaggacguccgcgacgagugcuccaaguacggccucgucaaguccaucgagaucccccgccccgucgacggcgucgagguccccggcugcggcaagaucuucgucgaguucaccuccgucuucgacugccagaaggccaugcagggccucaccggccgcaaguucgccaaccgcgucgucgucaccaaguacugcgaccccgacuccuaccaccgccgcgacuucugguga

SEQ ID NO: 51377 - RNA, 4212 nt, Artificial Sequence
  derived and/or modified sequence opt2 from UACA__Homo_sapiens__NP_001008225
augaugaacugcugguucuccugcacccccaagaaccgccacgccgccgacuggaacaaguacgacgaccgccucaugaaggccgccgagcgcggcgacgucgagaaggucaccuccauccucgccaagaagggcgucaaccccggcaagcucgacgucgagggccgcuccgucuuccacgucgucaccuccaagggcaaccucgagugccucaacgccauccucauccacggcgucgacaucaccaccuccgacaccgccggccgcaacgcccuccaccucgccgccaaguacggccacgcccucugccuccagaagcuccuccaguacaacugccccaccgagcacgccgaccuccagggccgcaccgcccuccacgacgccgccauggccgacugccccuccuccauccagcuccucugcgaccacggcgccuccgucaacgccaaggacgucgacggccgcaccccccucguccucgccacccagaugucccgccccaccaucugccagcuccucaucgaccgcggcgccgacgucaacucccgcgacaagcagaaccgcaccgcccucaugcucggcugcgaguacggcugccgcgacgccgucgagguccucaucaagaacggcgccgacaucucccuccucgacgcccucggccacgacuccuccuacuacgcccgcaucggcgacaaccucgacauccucacccuccucaagaccgccuccgagaacaccaacaagggccgcgagcucuggaagaagggccccucccuccagcagcgcaaccucacccacaugcaggacgaggucaacgucaagucccaccagcgcgagcaccagaacauccaggaccucgagaucgagaacgaggaccucaaggagcgccuccgcaagauccagcaggagcagcgcauccuccucgacaaggucaacggccuccagcuccagcucaacgaggaggucauggucgccgacgaccucgaguccgagcgcgagaagcucaagucccuccucgccgccaaggagaagcagcacgaggagucccuccgcaccaucgaggcccucaagaaccgcuucaaguacuucgaguccgaccaccucggcuccggcucccacuucuccaaccgcaaggaggacaugcuccucaagcagggccagauguacauggccgacucccagugcaccucccccggcauccccgcccacaugcagucccgcuccaugcuccgcccccucgagcucucccuccccucccagaccuccuacuccgagaacgagauccucaagaaggagcucgaggccaugcgcaccuucugcgaguccgccaagcaggaccgccucaagcuccagaacgagcucgcccacaaggucgccgagugcaaggcccucgcccucgagugcgagcgcgucaaggaggacuccgacgagcagaucaagcagcucgaggacgcccucaaggacguccagaagcgcauguacgaguccgagggcaaggucaagcagaugcagacccacuuccucgcccucaaggagcaccucaccuccgaggccgccuccggcaaccaccgccucaccgaggagcucaaggaccagcucaaggaccucaaggucaaguacgagggcgccuccgccgaggucggcaagcuccgcaaccagaucaagcagaacgagaugaucgucgaggaguucaagcgcgacgagggcaagcucaucgaggagaacaagcgccuccagaaggagcucuccaugugcgagauggagcgcgagaagaagggccgcaaggucaccgagauggagggccaggccaaggagcucuccgccaagcucgcccucuccauccccgccgagaaguucgagaacaugaaguccucccucuccaacgaggucaacgagaaggccaagaagcucgucgagauggagcgcgagcacgagaagucccucuccgagauccgccagcucaagcgcgagcucgagaacgucaaggccaagcucgcccagcacgucaagcccgaggagcacgagcaggucaagucccgccucgagcagaaguccggcgagcucggcaagaagaucaccgagcucacccucaagaaccagacccuccagaaggagaucgagaaggucuaccucgacaacaagcuccucaaggagcaggcccacaaccucaccaucgagaugaagaaccacuacgucccccucaaggucuccgaggacaugaagaagucccacgacgccaucaucgacgaccucaaccgcaagcuccucgacgucacccagaaguacaccgagaagaagcucgagauggagaagcuccuccucgagaacgacucccucuccaaggacgucucccgccucgagaccgucuucgucccccccgagaagcacgagaaggagaucaucgcccucaaguccaacaucgucgagcucaagaagcagcucuccgagcucaagaagaagugcggcgaggaccaggagaagauccacgcccucaccuccgagaacaccaaccucaagaagaugauguccaaccaguacguccccgucaagacccacgaggaggucaagaugacccucaacgacacccucgccaagaccaaccgcgagcuccucgacgucaagaagaaguucgaggacaucaaccaggaguucgucaagaucaaggacaagaacgagauccucaagcgcaaccucgagaacacccagaaccagaucaaggccgaguacaucucccucgccgagcacgaggccaagauguccucccucucccaguccaugcgcaagguccaggacuccaacgccgagauccucgccaacuaccgcaagggccaggaggagaucgucacccuccacgccgagaucaaggcccagaagaaggagcucgacaccauccaggagugcaucaaggucaaguacgcccccaucgucuccuucgaggagugcgagcgcaaguucaaggccaccgagaaggagcucaaggaccagcucuccgagcagacccagaaguacuccgucuccgaggaggaggucaagaagaacaagcaggagaacgacaagcucaagaaggagaucuucacccuccagaaggaccuccgcgacaagaccguccucaucgagaagucccacgagauggagcgcgcccucucccgcaagaccgacgagcucaacaagcagcucaaggaccucucccagaaguacaccgaggucaagaacgucaaggagaagcucgucgaggagaacgccaagcagaccuccgagauccucgccguccagaaccuccuccagaagcagcacgucccccucgagcaggucgaggcccucaagaagucccucaacggcaccaucgagaaccucaaggaggagcucaaguccaugcagcgcugcuacgagaaggagcagcagaccgucaccaagcuccaccagcuccucgagaaccagaagaacuccuccgucccccucgccgagcaccuccagaucaaggaggccuucgagaaggaggucggcaucaucaaggccucccuccgcgagaaggaggaggagucccagaacaagauggaggaggucuccaagcuccaguccgagguccagaacaccaagcaggcccucaagaagcucgagacccgcgaggucgucgaccucuccaaguacaaggccaccaaguccgaccucgagacccagaucuccucccucaacgagaagcucgccaaccucaaccgcaaguacgaggaggucugcgaggagguccuccacgccaagaagaaggagaucuccgccaaggacgagaaggagcuccuccacuucuccaucgagcaggagaucaaggaccagaaggagcgcugcgacaagucccucaccaccaucaccgagcuccagcgccgcauccaggaguccgccaagcagaucgaggccaaggacaacaagaucaccgagcuccucaacgacgucgagcgccucaagcaggcccucaacggccucucccagcucaccuacaccuccggcaaccccaccaagcgccagucccagcucaucgacacccuccagcaccaggucaagucccucgagcagcagcucgccgacgccgaccgccagcaccaggaggucaucgccaucuaccgcacccaccuccucuccgccgcccagggccacauggacgaggacguccaggaggcccuccuccagaucauccagaugcgccagggccucgucugcuga

SEQ ID NO: 51378 - RNA, 1518 nt, Artificial Sequence
  derived and/or modified sequence opt2 from UAP1__Homo_sapiens__NP_003106
augaacaucaacgaccucaagcucacccucuccaaggccggccaggagcaccuccuccgcuucuggaacgagcucgaggaggcccagcaggucgagcucuacgccgagcuccaggccaugaacuucgaggagcucaacuucuucuuccagaaggccaucgagggcuucaaccaguccucccaccagaagaacgucgacgcccgcauggagcccgucccccgcgagguccucggcuccgccacccgcgaccaggaccagcuccaggccugggaguccgagggccucuuccagaucucccagaacaaggucgccguccuccuccucgccggcggccagggcacccgccucggcgucgccuaccccaagggcauguacgacgucggccuccccucccgcaagacccucuuccagauccaggccgagcgcauccucaagcuccagcaggucgccgagaaguacuacggcaacaagugcaucauccccugguacaucaugaccuccggccgcaccauggaguccaccaaggaguucuucaccaagcacaaguacuucggccucaagaaggagaacgucaucuucuuccagcagggcaugcuccccgccauguccuucgacggcaagaucauccucgaggagaagaacaaggucuccauggcccccgacggcaacggcggccucuaccgcgcccucgccgcccagaacaucgucgaggacauggagcagcgcggcaucugguccauccacgucuacugcgucgacaacauccucgucaaggucgccgacccccgcuucaucggcuucugcauccagaagggcgccgacugcggcgccaaggucgucgagaagaccaaccccaccgagcccgucggcgucgucugccgcgucgacggcgucuaccaggucgucgaguacuccgagaucucccucgccaccgcccagaagcgcuccuccgacggccgccuccucuucaacgccggcaacaucgccaaccacuucuucaccguccccuuccuccgcgacgucgucaacgucuacgagccccagcuccagcaccacgucgcccagaagaagauccccuacgucgacacccagggccagcucaucaagcccgacaagcccaacggcaucaagauggagaaguucgucuucgacaucuuccaguucgccaagaaguucgucgucuacgagguccuccgcgaggacgaguucuccccccucaagaacgccgacucccagaacggcaaggacaaccccaccaccgcccgccacgcccucaugucccuccaccacugcuggguccucaacgccggcggccacuucaucgacgagaacggcucccgccuccccgccaucccccgccucaaggacgccaacgacguccccauccagugcgagaucuccccccucaucuccuacgccggcgagggccucgaguccuacgucgccgacaaggaguuccacgccccccucaucaucgacgagaacggcguccacgagcucgucaagaacggcaucuga

SEQ ID NO: 51379 - RNA, 3261 nt, Artificial Sequence
  derived and/or modified sequence opt2 from UBA1__Homo_sapiens__XP_011542255
augcucacccucgagaaccuccaguucggcgacuccggcuccaugcucugcgucaucuaccaccucgacaaccccgucggcaagauguccuccuccccccucuccaagaagcgccgcgucuccggccccgaccccaagcccggcuccaacugcucccccgcccaguccguccucuccgagguccccuccguccccaccaacggcauggccaagaacggcuccgaggccgacaucgacgagggccucuacucccgccagcucuacguccucggccacgaggccaugaagcgccuccagaccuccuccguccucgucuccggccuccgcggccucggcgucgagaucgccaagaacaucauccucggcggcgucaaggccgucacccuccacgaccagggcaccgcccagugggccgaccucuccucccaguucuaccuccgcgaggaggacaucggcaagaaccgcgccgaggucucccagccccgccucgccgagcucaacuccuacguccccgucaccgccuacaccggcccccucgucgaggacuuccucuccggcuuccaggucgucguccucaccaacaccccccucgaggaccagcuccgcgucggcgaguucugccacaaccgcggcaucaagcucgucgucgccgacacccgcggccucuucggccagcucuucugcgacuucggcgaggagaugauccucaccgacuccaacggcgagcagccccucuccgccauggucuccauggucaccaaggacaaccccggcgucgucaccugccucgacgaggcccgccacggcuucgaguccggcgacuucgucuccuucuccgagguccagggcauggucgagcucaacggcaaccagcccauggagaucaagguccucggccccuacaccuucuccaucugcgacaccuccaacuucuccgacuacauccgcggcggcaucgucucccaggucaagguccccaagaagaucuccuucaagucccucgucgccucccucgccgagcccgacuucgucgucaccgacuucgccaaguucucccgccccgcccagcuccacaucggcuuccaggcccuccaccaguucugcgcccagcacggccgccccccccgcccccgcaacgaggaggacgccgccgagcucgucgcccucgcccaggccgucaacgcccgcgcccuccccgccguccagcagaacaaccucgacgaggaccucauccgcaagcucgccuacgucgccgccggcgaccucgcccccaucaacgccuucaucggcggccucgccgcccaggaggucaugaaggccugcuccggcaaguucaugcccaucaugcaguggcucuacuucgacgcccucgagugccuccccgaggacaaggagguccucaccgaggacaagugccuccagcgccagaaccgcuacgacggccaggucgccgucuucggcuccgaccuccaggagaagcucggcaagcagaaguacuuccucgucggcgccggcgccaucggcugcgagcuccucaagaacuucgccaugaucggccucggcugcggcgagggcggcgagaucaucgucaccgacauggacaccaucgagaaguccaaccucaaccgccaguuccucuuccgccccugggacgucaccaagcucaaguccgacaccgccgccgccgccguccgccagaugaacccccacauccgcgucaccucccaccagaaccgcgucggccccgacaccgagcgcaucuacgacgacgacuucuuccagaaccucgacggcgucgccaacgcccucgacaacgucgacgcccgcauguacauggaccgccgcugcgucuacuaccgcaagccccuccucgaguccggcacccucggcaccaagggcaacguccaggucgucauccccuuccucaccgaguccuacuccuccucccaggacccccccgagaaguccauccccaucugcacccucaagaacuuccccaacgccaucgagcacacccuccagugggcccgcgacgaguucgagggccucuucaagcagcccgccgagaacgucaaccaguaccucaccgaccccaaguucgucgagcgcacccuccgccucgccggcacccagccccucgagguccucgaggccguccagcgcucccucguccuccagcgcccccagaccugggccgacugcgucaccugggccugccaccacuggcacacccaguacuccaacaacauccgccagcuccuccacaacuucccccccgaccagcucaccuccuccggcgcccccuucugguccggccccaagcgcugcccccacccccucaccuucgacgucaacaacccccuccaccucgacuacgucauggccgccgccaaccucuucgcccagaccuacggccucaccggcucccaggaccgcgccgccgucgccaccuuccuccaguccguccagguccccgaguucacccccaaguccggcgucaagauccacgucuccgaccaggagcuccaguccgccaacgccuccgucgacgacucccgccucgaggagcucaaggccacccuccccucccccgacaagcuccccggcuucaagauguaccccaucgacuucgagaaggacgacgacuccaacuuccacauggacuucaucgucgccgccuccaaccuccgcgccgagaacuacgacauccccuccgccgaccgccacaaguccaagcucaucgccggcaagaucauccccgccaucgccaccaccaccgccgccgucgucggccucgucugccucgagcucuacaaggucguccagggccaccgccagcucgacuccuacaagaacggcuuccucaaccucgcccuccccuucuucggcuucuccgagccccucgccgccccccgccaccaguacuacaaccaggaguggacccucugggaccgcuucgagguccagggccuccagcccaacggcgaggagaugacccucaagcaguuccucgacuacuucaagaccgagcacaagcucgagaucaccaugcucucccagggcgucuccaugcucuacuccuucuucaugcccgccgccaagcucaaggagcgccucgaccagcccaugaccgagaucgucucccgcgucuccaagcgcaagcucggccgccacguccgcgcccucguccucgagcucugcugcaacgacgaguccggcgaggacgucgagguccccuacguccgcuacaccauccgcuga

SEQ ID NO: 51380 - RNA, 1923 nt, Artificial Sequence
  derived and/or modified sequence opt2 from UBA2__Homo_sapiens__NP_005490
auggcccucucccgcggccucccccgcgagcucgccgaggccgucgccggcggccgcguccucgucgucggcgccggcggcaucggcugcgagcuccucaagaaccucguccucaccggcuucucccacaucgaccucaucgaccucgacaccaucgacgucuccaaccucaaccgccaguuccucuuccagaagaagcacgucggccgcuccaaggcccaggucgccaaggaguccguccuccaguucuaccccaaggccaacaucgucgccuaccacgacuccaucaugaaccccgacuacaacgucgaguucuuccgccaguucauccucgucaugaacgcccucgacaaccgcgccgcccgcaaccacgucaaccgcaugugccucgccgccgacgucccccucaucgaguccggcaccgccggcuaccucggccaggucaccaccaucaagaagggcgucaccgagugcuacgagugccaccccaagcccacccagcgcaccuuccccggcugcaccauccgcaacacccccuccgagcccauccacugcaucgucugggccaaguaccucuucaaccagcucuucggcgaggaggacgccgaccaggaggucucccccgaccgcgccgaccccgaggccgccugggagcccaccgaggccgaggcccgcgcccgcgccuccaacgaggacggcgacaucaagcgcaucuccaccaaggagugggccaaguccaccggcuacgaccccgucaagcucuucaccaagcucuucaaggacgacauccgcuaccuccucaccauggacaagcucuggcgcaagcgcaagccccccgucccccucgacugggccgagguccagucccagggcgaggagaccaacgccuccgaccagcagaacgagccccagcucggccucaaggaccagcagguccucgacgucaaguccuacgcccgccucuucuccaaguccaucgagacccuccgcguccaccucgccgagaagggcgacggcgccgagcucaucugggacaaggacgaccccuccgccauggacuucgucaccuccgccgccaaccuccgcaugcacaucuucuccaugaacaugaagucccgcuucgacaucaaguccauggccggcaacaucauccccgccaucgccaccaccaacgccgucaucgccggccucaucguccucgagggccucaagauccucuccggcaagaucgaccagugccgcaccaucuuccucaacaagcagcccaacccccgcaagaagcuccucguccccugcgcccucgacccccccaaccccaacugcuacgucugcgccuccaagcccgaggucaccguccgccucaacguccacaaggucaccguccucacccuccaggacaagaucgucaaggagaaguucgccauggucgcccccgacguccagaucgaggacggcaagggcaccauccucaucuccuccgaggagggcgagaccgaggccaacaaccacaagaagcucuccgaguucggcauccgcaacggcucccgccuccaggccgacgacuuccuccaggacuacacccuccucaucaacauccuccacuccgaggaccucggcaaggacgucgaguucgaggucgucggcgacgcccccgagaaggucggccccaagcaggccgaggacgccgccaaguccaucaccaacggcuccgacgacggcgcccagcccuccaccuccaccgcccaggagcaggacgacguccucaucgucgacuccgacgaggaggacuccuccaacaacgccgacgucuccgaggaggagcgcucccgcaagcgcaagcucgacgagaaggagaaccucuccgccaagcgcucccgcaucgagcagaaggaggagcucgacgacgucaucgcccucgacuga

SEQ ID NO: 51381 - RNA, 1392 nt, Artificial Sequence
  derived and/or modified sequence opt2 from UBA3__Homo_sapiens__NP_003959
auggccgacggcgaggagcccgagaagaagcgccgccgcaucgaggagcuccucgccgagaagauggccgucgacggcggcugcggcgacaccggcgacugggagggccgcuggaaccacgucaagaaguuccucgagcgcuccggccccuucacccaccccgacuucgagcccuccaccgagucccuccaguuccuccucgacaccugcaagguccucgucaucggcgccggcggccucggcugcgagcuccucaagaaccucgcccucuccggcuuccgccagauccacgucaucgacauggacaccaucgacgucuccaaccucaaccgccaguuccucuuccgccccaaggacaucggccgccccaaggccgaggucgccgccgaguuccucaacgaccgcguccccaacugcaacgucgucccccacuucaacaagauccaggacuucaacgacaccuucuaccgccaguuccacaucaucgucugcggccucgacuccaucaucgcccgccgcuggaucaacggcaugcucaucucccuccucaacuacgaggacggcguccucgaccccuccuccaucgucccccucaucgacggcggcaccgagggcuucaagggcaacgcccgcgucauccuccccggcaugaccgccugcaucgagugcacccucgagcucuaccccccccaggucaacuuccccaugugcaccaucgccuccaugccccgccuccccgagcacugcaucgaguacguccgcaugcuccaguggcccaaggagcagcccuucggcgagggcgucccccucgacggcgacgaccccgagcacauccaguggaucuuccagaagucccucgagcgcgccucccaguacaacauccgcggcgucaccuaccgccucacccagggcgucgucaagcgcaucauccccgccgucgccuccaccaacgccgucaucgccgccgucugcgccaccgaggucuucaagaucgccaccuccgccuacaucccccucaacaacuaccucgucuucaacgacgucgacggccucuacaccuacaccuucgaggccgagcgcaaggagaacugccccgccugcucccagcucccccagaacauccaguucucccccuccgccaagcuccaggagguccucgacuaccucaccaacuccgccucccuccagaugaagucccccgccaucaccgccacccucgagggcaagaaccgcacccucuaccuccaguccgucaccuccaucgaggagcgcacccgccccaaccucuccaagacccucaaggagcucggccucgucgacggccaggagcucgccgucgccgacgucaccaccccccagaccguccucuucaagcuccacuucaccuccuga

SEQ ID NO: 51382 - RNA, 3039 nt, Artificial Sequence
  derived and/or modified sequence opt2 from UBA7__Homo_sapiens__NP_003326
auggacgcccucgacgccuccaagcuccucgacgaggagcucuacucccgccagcucuacguccucggcucccccgccaugcagcgcauccagggcgcccgcguccucgucuccggccuccagggccucggcgccgaggucgccaagaaccucguccucaugggcgucggcucccucacccuccacgacccccaccccaccugcugguccgaccucgccgcccaguuccuccucuccgagcaggaccucgagcgcucccgcgccgaggccucccaggagcuccucgcccagcucaaccgcgccguccaggucgucguccacaccggcgacaucaccgaggaccuccuccucgacuuccaggucgucguccucaccgccgccaagcucgaggagcagcucaaggucggcacccucugccacaagcacggcgucugcuuccucgccgccgacacccgcggccucgucggccagcucuucugcgacuucggcgaggacuucaccguccaggaccccaccgaggccgagccccucaccgccgccauccagcacaucucccagggcucccccggcauccucacccuccgcaagggcgccaacacccacuacuuccgcgacggcgaccucgucaccuucuccggcaucgagggcauggucgagcucaacgacugcgacccccgcuccauccacguccgcgaggacggcucccucgagaucggcgacaccaccaccuucucccgcuaccuccgcggcggcgccaucaccgaggucaagcgccccaagaccguccgccacaagucccucgacaccgcccuccuccagccccacgucgucgcccaguccucccaggagguccaccacgcccacugccuccaccaggccuucugcgcccuccacaaguuccagcaccuccacggccgccccccccagcccugggaccccgucgacgccgagaccgucgucggccucgcccgcgaccucgagccccucaagcgcaccgaggaggagccccucgaggagccccucgacgaggcccucguccgcaccgucgcccucuccuccgccggcguccucucccccauggucgccaugcucggcgccgucgccgcccaggagguccucaaggccaucucccgcaaguucaugccccucgaccaguggcucuacuucgacgcccucgacugccuccccgaggacggcgagcuccuccccucccccgaggacugcgcccuccgcggcucccgcuacgacggccagaucgccgucuucggcgccggcuuccaggagaagcuccgccgccagcacuaccuccucgucggcgccggcgccaucggcugcgagcuccucaaggucuucgcccucgucggccucggcgccggcaacuccggcggccucaccgucgucgacauggaccacaucgagcgcuccaaccucucccgccaguuccucuuccgcucccaggacgucggccgccccaaggccgaggucgccgccgccgccgcccgcggccucaaccccgaccuccaggucaucccccucaccuacccccucgaccccaccaccgagcacaucuacggcgacaacuucuucucccgcgucgacggcgucgccgccgcccucgacuccuuccaggcccgccgcuacgucgccgcccgcugcacccacuaccucaagccccuccucgaggccggcaccuccggcaccuggggcuccgccaccgucuucaugccccacgucaccgaggccuaccgcgcccccgccuccgccgccgccuccgaggacgcccccuaccccgucugcaccguccgcuacuuccccuccaccgccgagcacacccuccagugggcccgccacgaguucgaggagcucuuccgccucuccgccgagaccaucaaccaccaccagcaggcccacaccucccucgccgacauggacgagccccagacccucacccuccucaagcccguccucggcguccuccgcguccgcccccagaacuggcaggacugcgucgccugggcccucggccacuggaagcucugcuuccacuacggcaucaagcagcuccuccgccacuucccccccaacaagguccucgaggacggcacccccuucugguccggccccaagcagugcccccagccccucgaguucgacaccaaccaggacacccaccuccucuacguccucgccgccgccaaccucuacgcccagaugcacggccuccccggcucccaggacuggaccgcccuccgcgagcuccucaagcuccucccccagcccgacccccagcagauggcccccaucuucgccuccaaccucgagcucgccuccgccuccgccgaguucggccccgagcagcagaaggagcucaacaaggcccucgaggucugguccgucggccccccccucaagccccucauguucgagaaggacgacgacuccaacuuccacgucgacuucgucgucgccgccgccucccuccgcugccagaacuacggcaucccccccgucaaccgcgcccaguccaagcgcaucgucggccagaucauccccgccaucgccaccaccaccgccgccgucgccggccuccucggccucgagcucuacaaggucgucuccggcccccgcccccgcuccgccuuccgccacuccuaccuccaccucgccgagaacuaccucauccgcuacaugcccuucgcccccgccauccagaccuuccaccaccucaaguggaccuccugggaccgccucaagguccccgccggccagcccgagcgcacccucgagucccuccucgcccaccuccaggagcagcacggccuccgcguccgcauccuccuccacggcuccgcccuccucuacgccgccggcuggucccccgagaagcaggcccagcaccucccccuccgcgucaccgagcucguccagcagcucaccggccaggcccccgcccccggccagcgcguccucguccucgagcucuccugcgagggcgacgacgaggacaccgccuuccccccccuccacuacgagcucuga

SEQ ID NO: 51383 - RNA, 1218 nt, Artificial Sequence
  derived and/or modified sequence opt2 from UBAC1__Homo_sapiens__NP_057256
auguucguccaggaggagaagaucuucgccggcaagguccuccgccuccacaucugcgccuccgacggcgccgaguggcucgaggaggccaccgaggacaccuccgucgagaagcucaaggagcgcugccucaagcacugcgcccacggcucccucgaggaccccaaguccaucacccaccacaagcucauccacgccgccuccgagcgcguccucuccgacgcccgcaccauccucgaggagaacauccaggaccaggacguccuccuccucaucaagaagcgcgcccccuccccccuccccaagauggccgacgucuccgccgaggagaagaagaagcaggaccagaaggcccccgacaaggaggccauccuccgcgccaccgccaaccuccccuccuacaacauggaccgcgccgccguccagaccaacaugcgcgacuuccagaccgagcuccgcaagauccucgucucccucaucgaggucgcccagaagcuccucgcccucaaccccgacgccgucgagcucuucaagaaggccaacgccaugcucgacgaggacgaggacgagcgcgucgacgaggccgcccuccgccagcucaccgagaugggcuuccccgagaaccgcgccaccaaggcccuccagcucaaccacauguccgucccccaggccauggaguggcucaucgagcacgccgaggaccccaccaucgacaccccccuccccggccaggccccccccgaggccgagggcgccaccgccgccgccuccgaggccgccgccggcgccuccgccaccgacgaggaggcccgcgacgagcucaccgagaucuucaagaagauccgccgcaagcgcgaguuccgcgccgacgcccgcgccgucaucucccucauggagaugggcuucgacgagaaggaggucaucgacgcccuccgcgucaacaacaaccagcagaacgccgccugcgaguggcuccucggcgaccgcaagcccucccccgaggagcucgacaagggcaucgaccccgacuccccccucuuccaggccauccucgacaaccccgucguccagcucggccucaccaaccccaagacccuccucgccuucgaggacaugcucgagaacccccucaacuccacccaguggaugaacgaccccgagaccggccccgucaugcuccagaucucccgcaucuuccagacccucaaccgcaccuga

SEQ ID NO: 51384 - RNA, 1035 nt, Artificial Sequence
  derived and/or modified sequence opt2 from UBAC2__Homo_sapiens__NP_001137544
auguucaccuccaccggcuccuccggccucuacaaggccccccucuccaagucccuccuccucguccccuccgcccucucccuccuccucgcccuccuccucccccacugccagaagcucuucgucuacgaccuccacgccgucaagaacgacuuccagaucuggcgccucaucugcggccgcaucaucugccucgaccucaaggacaccuucugcuccucccuccucaucuacaacuuccgcaucuucgagcgccgcuacggcucccgcaaguucgccuccuuccuccucggcuccuggguccucuccgcccucuucgacuuccuccucaucgaggccaugcaguacuucuucggcaucaccgccgccuccaaccuccccuccggcuuccucgcccccgucuucgcccucuucguccccuucuacugcuccaucccccgcguccaggucgcccagauccucggcccccucuccaucaccaacaagacccucaucuacauccucggccuccagcucuucaccuccggcuccuacaucuggaucgucgccaucuccggccucauguccggccucugcuacgacuccaagauguuccagguccaccagguccucugcauccccuccuggauggccaaguucuucuccuggacccucgagcccaucuucuccuccuccgagcccaccuccgaggcccgcaucggcaugggcgccacccucgacauccagcgccagcagcgcauggagcuccucgaccgccagcucauguucucccaguucgcccagggccgccgccagcgccagcagcagggcggcaugaucaacuggaaccgccucuuccccccccuccgccagcgccagaacgucaacuaccagggcggccgccaguccgagcccgccgcccccccccucgaggucuccgaggagcaggucgcccgccucauggagaugggcuucucccgcggcgacgcccucgaggcccuccgcgccuccaacaacgaccucaacgucgccaccaacuuccuccuccagcacuga

SEQ ID NO: 51385 - RNA, 1701 nt, Artificial Sequence
  derived and/or modified sequence opt2 from UBAP1__Homo_sapiens__NP_001164672
auguccggcgccguccgcggccgccgccgcgaggucggccuccagcacggcggcugcggcaccggcggcggcuacggcgacggccucgcccgcuccggccaguccuggcgcugguggcgcucccucucccucggcgccgucggcuccuccgccggcaccgagcccggccgccccgccggcgccuccaccuuccgccuccuccgccgccgccagcagcgccacuccggcaccuucuccuaccucgacgacguccccuucaagaccggcgacaaguucaagacccccgccaaggucggccuccccaucggcuucucccuccccgacugccuccaggucguccgcgagguccaguacgacuucucccucgagaagaagaccaucgagugggccgaggagaucaagaagaucgaggaggccgagcgcgaggccgagugcaagaucgccgaggccgaggccaaggucaacuccaaguccggccccgagggcgacuccaagauguccuucuccaagacccacuccaccgccaccaugcccccccccaucaaccccauccucgccucccuccagcacaacuccauccucacccccacccgcgucuccuccuccgccaccaagcagaagguccucucccccccccacaucaaggccgacuucaaccucgccgacuucgagugcgaggaggaccccuucgacaaccucgagcucaagaccaucgacgagaaggaggagcuccgcaacauccucgucggcaccaccggccccaucauggcccagcuccucgacaacaaccucccccgcggcggcuccggcuccguccuccaggacgaggagguccucgccucccucgagcgcgccacccucgacuucaagccccuccacaagcccaacggcuucaucacccucccccagcucggcaacugcgagaagaugucccucuccuccaaggucucccucccccccauccccgccgucuccaacaucaagucccucuccuuccccaagcucgacuccgacgacuccaaccagaagaccgccaagcucgccuccaccuuccacuccaccuccugccuccgcaacggcaccuuccagaacucccucaagcccuccacccaguccuccgccuccgagcucaacggccaccacacccucggccucuccgcccucaaccucgacuccggcaccgagaugcccgcccucaccuccucccagaugcccucccucuccguccucuccgucugcaccgaggaguccuccccccccaacaccggccccaccgucaccccccccaacuucuccgucucccagguccccaacaugcccuccugcccccaggccuacuccgagcuccagaugcucucccccuccgagcgccagugcgucgagaccgucgucaacaugggcuacuccuacgagugcguccuccgcgccaugaagaagaagggcgagaacaucgagcagauccucgacuaccucuucgcccacggccagcucugcgagaagggcuucgacccccuccucgucgaggaggcccucgagaugcaccagugcuccgaggagaagaugauggaguuccuccagcucauguccaaguucaaggagaugggcuucgagcucaaggacaucaaggagguccuccuccuccacaacaacgaccaggacaacgcccucgaggaccucauggcccgcgccggcgccuccuga

SEQ ID NO: 51386 - RNA, 2559 nt, Artificial Sequence
  derived and/or modified sequence opt2 from UBAP2__Homo_sapiens__NP_001269458
auggacuccaagggccucggccgcauccucuggaaguccggccagcagaagaccggccucaagaucaucgaccucgucgcccuccuccagaagcccgucccccacucccaggccuccgaggccaacuccuucgagaccucccagcagcagggcuucggccaggcccucgucuucaccaacucccagcacaacaaccagauggcccccggcaccggcuccuccaccgccgucaacuccugcuccccccagucccucuccuccguccucggcuccggcuucggcgagcucgccccccccaagauggccaacaucaccuccucccagauccucgaccagcucaaggcccccucccucggccaguucaccaccacccccuccacccagcagaacuccaccucccaccccaccaccaccaccuccugggaccucaagccccccaccucccaguccuccguccucucccaccucgacuucaagucccagcccgagcccucccccguccucucccagcucucccagcgccagcagcaccagucccaggccgucaccguccccccccccggccucgaguccuuccccucccaggccaagcuccgcgaguccacccccggcgacucccccuccaccgucaacaagcuccuccagcuccccuccaccaccaucgagaacaucuccgucuccguccaccagccccagcccaagcacaucaagcucgccaagcgccgcaucccccccgccuccaagauccccgccuccgccgucgagaugcccggcuccgccgacgucaccggccucaacguccaguucggcgcccucgaguucggcuccgagcccucccucuccgaguucggcuccgcccccuccuccgagaacuccaaccagauccccaucucccucuacuccaagucccucuccgagccccucaacaccucccucuccaugaccuccgccguccagaacuccaccuacaccaccuccgucaucaccuccugcucccucaccuccuccucccucaacuccgccucccccgucgccauguccuccuccuacgaccaguccuccguccacaaccgcauccccuaccagucccccgucuccuccuccgaguccgcccccggcaccaucaugaacggccacggcggcggccgcucccagcagacccucgacacccccaagaccaccggcccccccuccgcccuccccuccgucuccucccuccccuccaccaccuccugcaccgcccuccuccccuccaccucccagcacaccggcgaccucaccuccuccccccucucccagcucuccuccucccucuccucccaccaguccucccucuccgcccacgccgcccucuccuccuccaccucccacacccacgccuccgucgaguccgccuccucccaccaguccuccgccaccuucuccaccgccgccaccuccgucuccuccuccgccuccuccggcgucucccucuccuccuccaugaacaccgccaacucccucugccucggcggcacccccgccuccgccuccuccuccuccucccgcgccgccccccucgucaccuccggcaaggccccccccaaccucccccagggcguccccccccuccuccacaaccaguaccucgucggccccggcggccuccuccccgccuaccccaucuacggcuacgacgagcuccagaugcuccagucccgccuccccgucgacuacuacggcauccccuucgccgcccccaccgcccucgccucccgcgacggcucccucgccaacaaccccuaccccggcgacgucaccaaguucggccgcggcgacuccgccucccccgcccccgccaccacccccgcccagccccagcagucccagucccagacccaccacaccgcccagcagcccuucgucaaccccgcccucccccccggcuacuccuacaccggccuccccuacuacaccggcaugcccuccgccuuccaguacggccccaccauguucgucccccccgccuccgccaagcagcacggcgucaaccucuccacccccaccccccccuuccagcaggccuccggcuacggccagcacggcuacuccaccggcuacgacgaccucacccagggcaccgccgccggcgacuacuccaagggcggcuacgccggcuccucccaggcccccaacaaguccgccggcuccggccccggcaagggcgucuccgucuccuccuccaccaccggccuccccgacaugaccggcuccgucuacaacaagacccagaccuucgacaagcagggcuuccacgccggcacccccccccccuucucccuccccuccguccucggcuccaccggcccccucgccuccggcgccgcccccggcuacgcccccccccccuuccuccacauccuccccgcccaccagcagccccacucccagcuccuccaccaccaccucccccaggacgcccaguccggcuccggccagcgcucccagcccuccucccuccagcccaagucccaggccuccaagcccgccuacggcaacucccccuacuggaccaacuga

SEQ ID NO: 51387 - RNA, 1872 nt, Artificial Sequence
  derived and/or modified sequence opt2 from UBASH3A__Homo_sapiens__NP_001001895
auggccgccggcgagacccagcucuacgccaaggucuccaacaagcucaagucccgcuccucccccucccuccucgagccccuccucgccaugggcuuccccguccacaccgcccucaaggcccucgccgccaccggccgcaagaccgccgaggaggcccucgccuggcuccacgaccacugcaacgaccccucccucgacgaccccaucccccaggaguacgcccucuuccucugccccaccggcccccuccucgagaagcuccaggaguucuggcgcgaguccaagcgccagugcgccaagaaccgcgcccacgaggucuucccccacgucacccucugcgacuucuucaccugcgaggaccagaaggucgagugccucuacgaggcccucaagcgcgccggcgaccgccuccucggcuccuuccccaccgccgucccccucgcccuccacuccuccaucuccuaccucggcuucuucgucuccggcucccccgccgacgucauccgcgaguucgccaugaccuucgccaccgaggccucccuccucgccgacugcuccgucaagcccugcaccaagcagcuccaccucacccucgcccacaaguucuacccccaccaccagcgcacccucgagcagcucgcccgcgccaucccccucggccacuccugccaguggaccgccgcccucuacucccgcgacaugcgcuucguccacuaccagacccuccgcgcccucuuccaguacaagccccagaacgucgacgagcucacccucucccccggcgacuacaucuucgucgaccccacccagcaggacgaggccuccgagggcugggucaucggcaucucccagcgcaccggcugccgcggcuuccuccccgagaacuacaccgaccgcgccuccgaguccgacaccugggucaagcaccgcauguacaccuucucccucgccaccgaccucaacucccgcaaggacggcgaggccuccucccgcugcuccggcgaguuccucccccagaccgcccgcucccucuccucccuccaggcccuccaggccaccgucgcccgcaaguccguccucgucguccgccacggcgagcgcgucgaccagaucuucggcaaggccuggcuccagcagugcuccacccccgacggcaaguacuaccgccccgaccucaacuuccccugcucccucccccgccgcucccgcggcaucaaggacuucgagaacgaccccccccucuccuccugcggcaucuuccagucccgcaucgccggcgacgcccuccucgacuccggcauccgcaucuccuccgucuucgccucccccgcccuccgcugcguccagaccgccaagcucauccucgaggagcucaagcucgagaagaagaucaagauccgcgucgagcccggcaucuucgaguggaccaagugggaggccggcaagaccacccccacccucaugucccucgaggagcucaaggaggccaacuucaacaucgacaccgacuaccgccccgccuucccccucuccgcccucaugcccgccgaguccuaccaggaguacauggaccgcugcaccgccuccaugguccagaucgucaacaccugcccccaggacaccggcgucauccucaucgucucccacggcuccacccucgacuccugcacccgcccccuccucggccuccccccccgcgagugcggcgacuucgcccagcucguccgcaagauccccucccucggcaugugcuucugcgaggagaacaaggaggagggcaagugggagcucgucaacccccccgucaagacccucacccacggcgccaacgccgccuucaacuggcgcaacuggaucuccggcaacuga

SEQ ID NO: 51388 - RNA, 1950 nt, Artificial Sequence
  derived and/or modified sequence opt2 from UBASH3B__Homo_sapiens__NP_116262
auggcccaguacggccaccccuccccccucggcauggccgcccgcgaggagcucuacuccaaggucaccccccgccgcaaccgccagcagcgccccggcaccaucaagcacggcuccgcccucgacguccuccucuccaugggcuucccccgcgcccgcgcccagaaggcccucgccuccaccggcggccgcuccguccaggccgccugcgacuggcucuucucccacgucggcgaccccuuccucgacgacccccucccccgcgaguacguccucuaccuccgccccaccggcccccucgcccagaagcucuccgacuucuggcagcaguccaagcagaucugcggcaagaacaaggcccacaacaucuucccccacaucacccucugccaguucuucaugugcgaggacuccaaggucgacgcccucggcgaggcccuccagaccaccgucucccgcuggaagugcaaguucuccgccccccucccccucgagcucuacaccuccuccaacuucaucggccucuucgucaaggaggacuccgccgagguccucaagaaguucgccgccgacuucgccgccgaggccgccuccaagaccgagguccacgucgagccccacaagaagcagcuccacgucacccucgccuaccacuuccaggccucccaccuccccacccucgagaagcucgcccagaacaucgacgucaagcucggcugcgacugggucgccaccaucuucucccgcgacauccgcuucgccaaccacgagacccuccaggucaucuaccccuacaccccccagaacgacgacgagcucgagcucguccccggcgacuucaucuucaugucccccauggagcagaccuccaccuccgagggcuggaucuacggcaccucccucaccaccggcugcuccggccuccuccccgagaacuacaucaccaaggccgacgagugcuccaccuggaucuuccacggcuccuacuccauccucaacaccuccuccuccaacucccucaccuucggcgacggcguccucgagcgccgccccuacgaggaccagggccucggcgagaccaccccccucaccaucaucugccagcccaugcagccccuccgcgucaacucccagcccggcccccagaagcgcugccucuucgucugccgccacggcgagcgcauggacgucgucuucggcaaguacuggcucucccagugcuucgacgccaagggccgcuacauccgcaccaaccucaacaugccccacucccucccccagcgcuccggcggcuuccgcgacuacgagaaggacgcccccaucaccgucuucggcugcaugcaggcccgccucgucggcgaggcccuccucgaguccaacaccaucaucgaccacgucuacugcucccccucccuccgcugcguccagaccgcccacaacauccucaagggccuccagcaggagaaccaccucaagauccgcgucgagcccggccucuucgaguggaccaagugggucgccggcuccacccuccccgccuggaucccccccuccgagcucgccgccgccaaccucuccgucgacaccaccuaccgcccccacauccccaucuccaagcucgucgucuccgaguccuacgacaccuacaucucccgcuccuuccaggucaccaaggagaucaucuccgagugcaaguccaagggcaacaacauccucaucgucgcccacgccuccucccucgaggccugcaccugccagcuccagggccucuccccccagaacuccaaggacuucguccagaugguccgcaagauccccuaccucggcuucugcuccugcgaggagcucggcgagaccggcaucuggcagcucaccgacccccccauccucccccucacccacggccccaccggcggcuucaacuggcgcgagacccuccuccaggaguga

SEQ ID NO: 51389 - RNA, 690 nt, Artificial Sequence
  derived and/or modified sequence opt2 from UBB__Homo_sapiens__NP_001268647
augcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcaugcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcaugcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcugcuga

SEQ ID NO: 51390 - RNA, 2058 nt, Artificial Sequence
  derived and/or modified sequence opt2 from UBC__Homo_sapiens__NP_066289
augcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcaugcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcaugcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcaugcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcaugcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcaugcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcaugcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcaugcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcaugcagaucuucgucaagacccucaccggcaagaccaucacccucgaggucgagcccuccgacaccaucgagaacgucaaggccaagauccaggacaaggagggcaucccccccgaccagcagcgccucaucuucgccggcaagcagcucgaggacggccgcacccucuccgacuacaacauccagaaggaguccacccuccaccucguccuccgccuccgcggcggcgucuga

SEQ ID NO: 51391 - RNA, 498 nt, Artificial Sequence
  derived and/or modified sequence opt2 from UBD__Homo_sapiens__NP_006389
auggcccccaacgccuccugccucugcguccacguccgcuccgaggagugggaccucaugaccuucgacgccaaccccuacgacuccgucaagaagaucaaggagcacguccgcuccaagaccaagguccccguccaggaccagguccuccuccucggcuccaagauccucaagccccgccgcucccucuccuccuacggcaucgacaaggagaagaccauccaccucacccucaaggucgucaagcccuccgacgaggagcucccccucuuccucgucgaguccggcgacgaggccaagcgccaccuccuccagguccgccgcuccuccuccgucgcccaggucaaggccaugaucgagaccaagaccggcaucauccccgagacccagaucgucaccugcaacggcaagcgccucgaggacggcaagaugauggccgacuacggcauccgcaagggcaaccuccucuuccucgccugcuacugcaucggcggcuga

SEQ ID NO: 51392 - RNA, 360 nt, Artificial Sequence
  derived and/or modified sequence opt2 from UBE2A__Homo_sapiens__NP_001269090
auggucuggaacgccgucaucuucggccccgagggcacccccuucgaggacggcaccuucaagcucaccaucgaguucaccgaggaguaccccaacaagccccccaccguccgcuucgucuccaagauguuccaccccaacgucuacgccgacggcuccaucugccucgacauccuccagaaccgcuggucccccaccuacgacgucuccuccauccucaccuccauccagucccuccucgacgagcccaaccccaacucccccgccaacucccaggccgcccagcucuaccaggagaacaagcgcgaguacgagaagcgcgucuccgccaucgucgagcaguccuggcgcgacugcuga

SEQ ID NO: 51393 - RNA, 459 nt, Artificial Sequence
  derived and/or modified sequence opt2 from UBE2B__Homo_sapiens__NP_003328
auguccacccccgcccgccgccgccucaugcgcgacuucaagcgccuccaggaggacccccccgucggcgucuccggcgcccccuccgagaacaacaucaugcaguggaacgccgucaucuucggccccgagggcacccccuucgaggacggcaccuucaagcucgucaucgaguucuccgaggaguaccccaacaagccccccaccguccgcuuccucuccaagauguuccaccccaacgucuacgccgacggcuccaucugccucgacauccuccagaaccgcuggucccccaccuacgacgucuccuccauccucaccuccauccagucccuccucgacgagcccaaccccaacucccccgccaacucccaggccgcccagcucuaccaggagaacaagcgcgaguacgagaagcgcgucuccgccaucgucgagcaguccuggaacgacuccuga

SEQ ID NO: 51394 - RNA, 240 nt, Artificial Sequence
  derived and/or modified sequence opt2 from UBE2C__Homo_sapiens__NP_001268671
auggccucccagaaccgcgaccccgccgccaccuccgucgccgccgcccgcaagggcgccgagcccuccggcggcgccgcccgcggccccgucggcaagcgccuccagcaggagcucaugacccucaugauguccggcgacaagggcaucuccgccuuccccgaguccgacaaccucuucaagugggucggcaccauccacggcgccgccggcaccaaccccacccucaucguccccuga

SEQ ID NO: 51395 - RNA, 444 nt, Artificial Sequence
  derived and/or modified sequence opt2 from UBE2D1__Homo_sapiens__NP_003329
auggcccucaagcgcauccagaaggagcucuccgaccuccagcgcgacccccccgcccacugcuccgccggccccgucggcgacgaccucuuccacuggcaggccaccaucaugggcccccccgacuccgccuaccagggcggcgucuucuuccucaccguccacuuccccaccgacuaccccuucaagccccccaagaucgccuucaccaccaagaucuaccaccccaacaucaacuccaacggcuccaucugccucgacauccuccgcucccaguggucccccgcccucaccgucuccaagguccuccucuccaucugcucccuccucugcgaccccaaccccgacgacccccucguccccgacaucgcccagaucuacaaguccgacaaggagaaguacaaccgccacgcccgcgaguggacccagaaguacgccauguga

SEQ ID NO: 51396 - RNA, 444 nt, Artificial Sequence
  derived and/or modified sequence opt2 from UBE2D2__Homo_sapiens__NP_003330
auggcccucaagcgcauccacaaggagcucaacgaccucgcccgcgacccccccgcccagugcuccgccggccccgucggcgacgacauguuccacuggcaggccaccaucaugggccccaacgacucccccuaccagggcggcgucuucuuccucaccauccacuuccccaccgacuaccccuucaagccccccaaggucgccuucaccacccgcaucuaccaccccaacaucaacuccaacggcuccaucugccucgacauccuccgcucccaguggucccccgcccucaccaucuccaagguccuccucuccaucugcucccuccucugcgaccccaaccccgacgacccccucguccccgagaucgcccgcaucuacaagaccgaccgcgagaaguacaaccgcaucgcccgcgaguggacccagaaguacgccauguga

SEQ ID NO: 51397 - RNA, 444 nt, Artificial Sequence
  derived and/or modified sequence opt2 from UBE2D3__Homo_sapiens__NP_003331
auggcccucaagcgcaucaacaaggagcucuccgaccucgcccgcgacccccccgcccagugcuccgccggccccgucggcgacgacauguuccacuggcaggccaccaucaugggccccaacgacucccccuaccagggcggcgucuucuuccucaccauccacuuccccaccgacuaccccuucaagccccccaaggucgccuucaccacccgcaucuaccaccccaacaucaacuccaacggcuccaucugccucgacauccuccgcucccaguggucccccgcccucaccaucuccaagguccuccucuccaucugcucccuccucugcgaccccaaccccgacgacccccucguccccgagaucgcccgcaucuacaagaccgaccgcgacaaguacaaccgcaucucccgcgaguggacccagaaguacgccauguga

SEQ ID NO: 51398 - RNA, 483 nt, Artificial Sequence
  derived and/or modified sequence opt2 from UBE2E1__Homo_sapiens__NP_001189405
augaaggaggucggccgcccccgcgagguccgcggccgccccggcaagucccgcauccagaaggagcucgccgacaucacccucgaccccccccccaacugcuccgccggccccaagggcgacaacaucuacgaguggcgcuccaccauccucggcccccccggcuccgucuacgagggcggcgucuucuuccucgacaucaccuucacccccgaguaccccuucaagccccccaaggucaccuuccgcacccgcaucuaccacugcaacaucaacucccagggcgucaucugccucgacauccucaaggacaacuggucccccgcccucaccaucuccaagguccuccucuccaucugcucccuccucaccgacugcaaccccgccgacccccucgucggcuccaucgccacccaguacaugaccaaccgcgccgagcacgaccgcauggcccgccaguggaccaagcgcuacgccaccuga

SEQ ID NO: 51399 - RNA, 606 nt, Artificial Sequence
  derived and/or modified sequence opt2 from UBE2E2__Homo_sapiens__NP_689866
auguccaccgaggcccagcgcgucgacgacucccccuccaccuccggcggcuccuccgacggcgaccagcgcgaguccguccagcaggagcccgagcgcgagcagguccagcccaagaagaaggagggcaagaucuccuccaagaccgccgccaagcucuccaccuccgccaagcgcauccagaaggagcucgccgagaucacccucgaccccccccccaacugcuccgccggccccaagggcgacaacaucuacgaguggcgcuccaccauccucggcccccccggcuccgucuacgagggcggcgucuucuuccucgacaucaccuucucccccgacuaccccuucaagccccccaaggucaccuuccgcacccgcaucuaccacugcaacaucaacucccagggcgucaucugccucgacauccucaaggacaacuggucccccgcccucaccaucuccaagguccuccucuccaucugcucccuccucaccgacugcaaccccgccgacccccucgucggcuccaucgccacccaguacaugaccaaccgcgccgagcacgaccgcauggcccgccaguggaccaagcgcuacgccaccuga

SEQ ID NO: 51400 - RNA, 624 nt, Artificial Sequence
  derived and/or modified sequence opt2 from UBE2E3__Homo_sapiens__NP_006348
auguccuccgaccgccagcgcuccgacgacgagucccccuccaccuccuccggcuccuccgacgccgaccagcgcgaccccgccgcccccgagcccgaggagcaggaggagcgcaagcccuccgccacccagcagaagaagaacaccaagcucuccuccaagaccaccgccaagcucuccaccuccgccaagcgcauccagaaggagcucgccgagaucacccucgaccccccccccaacugcuccgccggccccaagggcgacaacaucuacgaguggcgcuccaccauccucggcccccccggcuccgucuacgagggcggcgucuucuuccucgacaucaccuucuccuccgacuaccccuucaagccccccaaggucaccuuccgcacccgcaucuaccacugcaacaucaacucccagggcgucaucugccucgacauccucaaggacaacuggucccccgcccucaccaucuccaagguccuccucuccaucugcucccuccucaccgacugcaaccccgccgacccccucgucggcuccaucgccacccaguaccucaccaaccgcgccgagcacgaccgcaucgcccgccaguggaccaagcgcuacgccaccuga

SEQ ID NO: 51401 - RNA, 513 nt, Artificial Sequence
  derived and/or modified sequence opt2 from UBE2G1__Homo_sapiens__NP_003333
augaccgagcuccaguccgcccuccuccuccgccgccagcucgccgagcucaacaagaaccccgucgagggcuucuccgccggccucaucgacgacaacgaccucuaccgcugggagguccucaucaucggcccccccgacacccucuacgagggcggcgucuucaaggcccaccucaccuuccccaaggacuacccccuccgcccccccaagaugaaguucaucaccgagaucuggcaccccaacgucgacaagaacggcgacgucugcaucuccauccuccacgagcccggcgaggacaaguacggcuacgagaagcccgaggagcgcuggcuccccauccacaccgucgagaccaucaugaucuccgucaucuccaugcucgccgaccccaacggcgacucccccgccaacgucgacgccgccaaggaguggcgcgaggaccgcaacggcgaguucaagcgcaaggucgcccgcugcguccgcaagucccaggagaccgccuucgaguga

SEQ ID NO: 51402 - RNA, 498 nt, Artificial Sequence
  derived and/or modified sequence opt2 from UBE2G2__Homo_sapiens__NP_003334
auggccggcaccgcccucaagcgccucauggccgaguacaagcagcucacccucaacccccccgagggcaucgucgccggccccaugaacgaggagaacuucuucgagugggaggcccucaucaugggccccgaggacaccugcuucgaguucggcgucuuccccgccauccucuccuucccccucgacuacccccucuccccccccaagaugcgcuucaccugcgagauguuccaccccaacaucuaccccgacggccgcgucugcaucuccauccuccacgcccccggcgacgaccccaugggcuacgaguccuccgccgagcgcuggucccccguccaguccgucgagaagauccuccucuccgucgucuccaugcucgccgagcccaacgacgaguccggcgccaacgucgacgccuccaagauguggcgcgacgaccgcgagcaguucuacaagaucgccaagcagaucguccagaagucccucggccucuga

SEQ ID NO: 51403 - RNA, 552 nt, Artificial Sequence
  derived and/or modified sequence opt2 from UBE2H__Homo_sapiens__NP_003335
auguccucccccucccccggcaagcgccgcauggacaccgacgucgucaagcucaucgaguccaagcacgaggucaccauccucggcggccucaacgaguucgucgucaaguucuacggcccccagggcacccccuacgagggcggcgucuggaagguccgcgucgaccuccccgacaaguaccccuucaagucccccuccaucggcuucaugaacaagaucuuccaccccaacaucgacgaggccuccggcaccgucugccucgacgucaucaaccagaccuggaccgcccucuacgaccucaccaacaucuucgaguccuuccucccccagcuccucgccuaccccaaccccaucgacccccucaacggcgacgccgccgccauguaccuccaccgccccgaggaguacaagcagaagaucaaggaguacauccagaaguacgccaccgaggaggcccucaaggagcaggaggagggcaccggcgacuccuccuccgaguccuccauguccgacuucuccgaggacgaggcccaggacauggagcucuga

SEQ ID NO: 51404 - RNA, 477 nt, Artificial Sequence
  derived and/or modified sequence opt2 from UBE2I__Homo_sapiens__NP_003336
auguccggcaucgcccucucccgccucgcccaggagcgcaaggccuggcgcaaggaccaccccuucggcuucgucgccguccccaccaagaaccccgacggcaccaugaaccucaugaacugggagugcgccauccccggcaagaagggcacccccugggagggcggccucuucaagcuccgcaugcucuucaaggacgacuaccccuccuccccccccaagugcaaguucgagcccccccucuuccaccccaacgucuaccccuccggcaccgucugccucuccauccucgaggaggacaaggacuggcgccccgccaucaccaucaagcagauccuccucggcauccaggagcuccucaacgagcccaacauccaggaccccgcccaggccgaggccuacaccaucuacugccagaaccgcgucgaguacgagaagcgcguccgcgcccaggccaagaaguucgcccccuccuga

SEQ ID NO: 51405 - RNA, 957 nt, Artificial Sequence
  derived and/or modified sequence opt2 from UBE2J1__Homo_sapiens__NP_057105
auggagacccgcuacaaccucaagucccccgccgucaagcgccucaugaaggaggccgccgagcucaaggaccccaccgaccacuaccacgcccagccccucgaggacaaccucuucgaguggcacuucaccguccgcggcccccccgacuccgacuucgacggcggcgucuaccacggccgcaucguccucccccccgaguaccccaugaagccccccuccaucauccuccucaccgccaacggccgcuucgaggucggcaagaagaucugccucuccaucuccggccaccaccccgagaccuggcagcccuccugguccauccgcaccgcccuccucgccaucaucggcuucaugcccaccaagggcgagggcgccaucggcucccucgacuacacccccgaggagcgccgcgcccucgccaagaagucccaggacuucugcugcgagggcugcggcuccgccaugaaggacguccuccucccccucaaguccggcuccgacuccucccaggccgaccaggaggccaaggagcucgcccgccagaucuccuucaaggccgaggucaacuccuccggcaagaccaucuccgaguccgaccucaaccacuccuucucccucaccgaccuccaggacgacauccccaccaccuuccagggcgccaccgccuccaccuccuacggccuccagaacuccuccgccgccuccuuccaccagcccacccagcccgucgccaagaacaccuccauguccccccgccagcgccgcgcccagcagcagucccagcgccgccucuccaccucccccgacgucauccagggccaccagccccgcgacaaccacaccgaccacggcggcuccgccguccucaucgucauccucacccucgcccucgccgcccucaucuuccgccgcaucuaccucgccaacgaguacaucuucgacuucgagcucuga

SEQ ID NO: 51406 - RNA, 474 nt, Artificial Sequence
  derived and/or modified sequence opt2 from UBE2K__Homo_sapiens__NP_001104582
auggccaacaucgccguccagcgcaucaagcgcgaguucaaggagguccucaaguccgaggagaccuccaagaaccagaucaaggucgaccucgucgacgagaacuucaccgagcuccgcggcgagaucgccggcccccccgacacccccuacgagggcggccgcuaccagcucgagaucaagauccccgagaccuaccccuucaacccccccaagguccgcuucaucaccaagaucuggcaccccaacaucuccuccgucaccggcgccaucugccucgacauccucaaggaccagugggccgccgccaugacccuccgcaccguccuccucucccuccaggcccuccucgccgccgccgagcccgacgacccccaggacgccgucgucgccaaccagaacgccgucaucgucgcccucuccuccaaguccugggacgucgagaccgccaccgagcuccuccucuccaacuga

SEQ ID NO: 51407 - RNA, 639 nt, Artificial Sequence
  derived and/or modified sequence opt2 from UBE2L3__Homo_sapiens__NP_001243284
augcaggucgccgccggcacccgcggcgacacccgccuccaggaggucgcccuccucccccagcucuucgaccuccucguccucggccagcgccgcgcccgccuccuccgccagguccccuccgcccucgccggcaaggaccucgcccagcuccaggccggcgccacccucgccggcuaccgccgcgcccacggccccgaggagcucgaggagauccgcaagugcggcaugaagaacuuccgcaacauccaggucgacgaggccaaccuccucaccuggcagggccucaucguccccgacaacccccccuacgacaagggcgccuuccgcaucgagaucaacuuccccgccgaguaccccuucaagccccccaagaucaccuucaagaccaagaucuaccaccccaacaucgacgagaagggccaggucugccuccccgucaucuccgccgagaacuggaagcccgccaccaagaccgaccaggucauccagucccucaucgcccucgucaacgacccccagcccgagcacccccuccgcgccgaccucgccgaggaguacuccaaggaccgcaagaaguucugcaagaacgccgaggaguucaccaagaaguacggcgagaagcgccccgucgacuga

SEQ ID NO: 51408 - RNA, 462 nt, Artificial Sequence
  derived and/or modified sequence opt2 from UBE2L6__Homo_sapiens__NP_004214
augauggccuccaugcgcgucgucaaggagcucgaggaccuccagaagaagcccccccccuaccuccgcaaccucuccuccgacgacgccaacguccucgucuggcacgcccuccuccuccccgaccagccccccuaccaccucaaggccuucaaccuccgcaucuccuucccccccgaguaccccuucaagccccccaugaucaaguucaccaccaagaucuaccaccccaacgucgacgagaacggccagaucugccuccccaucaucuccuccgagaacuggaagcccugcaccaagaccugccagguccucgaggcccucaacguccucgucaaccgccccaacauccgcgagccccuccgcauggaccucgccgaccuccucacccagaaccccgagcucuuccgcaagaacgccgaggaguucacccuccgcuucggcgucgaccgccccuccuga

SEQ ID NO: 51409 - RNA, 552 nt, Artificial Sequence
  derived and/or modified sequence opt2 from UBE2M__Homo_sapiens__NP_003960
augaucaagcucuucucccucaagcagcagaagaaggaggaggaguccgccggcggcaccaagggcuccuccaagaaggccuccgccgcccagcuccgcauccagaaggacaucaacgagcucaaccuccccaagaccugcgacaucuccuucuccgaccccgacgaccuccucaacuucaagcucgucaucugccccgacgagggcuucuacaaguccggcaaguucgucuucuccuucaaggucggccagggcuacccccacgacccccccaaggucaagugcgagaccauggucuaccaccccaacaucgaccucgagggcaacgucugccucaacauccuccgcgaggacuggaagcccguccucaccaucaacuccaucaucuacggccuccaguaccucuuccucgagcccaaccccgaggacccccucaacaaggaggccgccgagguccuccagaacaaccgccgccucuucgagcagaacguccagcgcuccaugcgcggcggcuacaucggcuccaccuacuucgagcgcugccucaaguga

SEQ ID NO: 51410 - RNA, 459 nt, Artificial Sequence
  derived and/or modified sequence opt2 from UBE2N__Homo_sapiens__NP_003339
auggccggccucccccgccgcaucaucaaggagacccagcgccuccucgccgagcccguccccggcaucaaggccgagcccgacgaguccaacgcccgcuacuuccacgucgucaucgccggcccccaggacucccccuucgagggcggcaccuucaagcucgagcucuuccuccccgaggaguaccccauggccgcccccaagguccgcuucaugaccaagaucuaccaccccaacgucgacaagcucggccgcaucugccucgacauccucaaggacaaguggucccccgcccuccagauccgcaccguccuccucuccauccaggcccuccucuccgcccccaaccccgacgacccccucgccaacgacgucgccgagcaguggaagaccaacgaggcccaggccaucgagaccgcccgcgccuggacccgccucuacgccaugaacaacaucuga

SEQ ID NO: 51411 - RNA, 1080 nt, Artificial Sequence
  derived and/or modified sequence opt2 from UBE2Q2__Homo_sapiens__NP_001138807
augcgcauggacucccucaccgaggagaagcucgagugccgccucuggugcugccucuccgaccccuccccccccggccucgccgcccgcugcugcguccucgagcgcuccaucguccccucccuccgccaggaguccuaccccuccuccucccccaucugguucgucgacuccgaggaccccaaccucaccuccguccucgagcgccucgaggacaccaagaacaacaaccuccuccgccagcagcucaaguggcucaucugcgagcucugcucccucuacaaccuccccaagcaccucgacgucgagaugcucgaccagccccuccccaccggccagaacggcaccaccgaggaggucaccuccgaggaggaggaggaggaggaggagauggccgaggacaucgaggaccucgaccacuacgagaugaaggaggaggagcccaucuccggcaagaaguccgaggacgagggcaucgagaaggagaaccucgccauccucgagaagauccgcaagacccagcgccaggaccaccucaacggcgccgucuccggcuccguccaggccuccgaccgccucaugaaggagcuccgcgacaucuaccgcucccaguccuacaagaccggcaucuacuccgucgagcucaucaacgacucccucuacgacuggcacgucaagcuccagaaggucgaccccgacuccccccuccacuccgaccuccagauccucaaggagaaggagggcaucgaguacauccuccucaacuucuccuucaaggacaacuuccccuucgacccccccuucguccgcgucguccuccccguccucuccggcggcuacguccucggcggcggcgcccucugcauggagcuccucaccaagcagggcugguccuccgccuacuccaucgaguccgucaucaugcagaucaacgccacccucgucaagggcaaggcccgcguccaguucggcgccaacaagaaccaguacaaccucgcccgcgcccagcaguccuacaacuccaucguccagauccacgagaagaacggcugguacaccccccccaaggaggacggcuga

SEQ ID NO: 51412 - RNA, 486 nt, Artificial Sequence
  derived and/or modified sequence opt2 from UBE2QL1__Homo_sapiens__NP_001138633
augaaggagcuccaggacaucgcccgccucuccgaccgcuucaucuccgucgagcucgucgacgagucccucuucgacuggaacgucaagcuccaccaggucgacaaggacuccguccucuggcaggacaugaaggagaccaacaccgaguucauccuccucaaccucaccuuccccgacaacuuccccuucuccccccccuucaugcgcguccucuccccccgccucgagaacggcuacguccucgacggcggcgccaucugcauggagcuccucaccccccgcggcugguccuccgccuacaccgucgaggccgucaugcgccaguucgccgccucccucgucaagggccagggccgcaucugccgcaaggccggcaaguccaagaaguccuucucccgcaaggaggccgaggccaccuucaagucccucgucaagacccacgagaaguacggcugggucaccccccccgucuccgacggcuga

SEQ ID NO: 51413 - RNA, 717 nt, Artificial Sequence
  derived and/or modified sequence opt2 from UBE2R2__Homo_sapiens__NP_060281
auggcccagcagcagaugaccuccucccagaaggcccucaugcucgagcucaagucccuccaggaggagcccgucgagggcuuccgcaucacccucgucgacgaguccgaccucuacaacugggaggucgccaucuucggcccccccaacacccucuacgagggcggcuacuucaaggcccacaucaaguuccccaucgacuaccccuacuccccccccaccuuccgcuuccucaccaagauguggcaccccaacaucuacgagaacggcgacgucugcaucuccauccuccacccccccgucgacgacccccaguccggcgagcuccccuccgagcgcuggaaccccacccagaacguccgcaccauccuccucuccgucaucucccuccucaacgagcccaacaccuucucccccgccaacgucgacgccuccgucauguuccgcaaguggcgcgacuccaagggcaaggacaaggaguacgccgagaucauccgcaagcaggucuccgccaccaaggccgaggccgagaaggacggcgucaagguccccaccacccucgccgaguacugcaucaagaccaagguccccuccaacgacaacuccuccgaccuccucuacgacgaccucuacgacgacgacaucgacgacgaggacgaggaggaggaggacgccgacugcuacgacgacgacgacuccggcaacgaggaguccuga

SEQ ID NO: 51414 - RNA, 669 nt, Artificial Sequence
  derived and/or modified sequence opt2 from UBE2S__Homo_sapiens__NP_055316
augaacuccaacgucgagaaccuccccccccacaucauccgccucgucuacaaggaggucaccacccucaccgccgacccccccgacggcaucaaggucuuccccaacgaggaggaccucaccgaccuccaggucaccaucgagggccccgagggcacccccuacgccggcggccucuuccgcaugaagcuccuccucggcaaggacuuccccgccuccccccccaagggcuacuuccucaccaagaucuuccaccccaacgucggcgccaacggcgagaucugcgucaacguccucaagcgcgacuggaccgccgagcucggcauccgccacguccuccucaccaucaagugccuccucauccaccccaaccccgaguccgcccucaacgaggaggccggccgccuccuccucgagaacuacgaggaguacgccgcccgcgcccgccuccucaccgagauccacggcggcgccggcggccccuccggccgcgccgaggccggccgcgcccucgccuccggcaccgaggccuccuccaccgaccccggcgcccccggcggccccggcggcgccgagggccccauggccaagaagcacgccggcgagcgcgacaagaagcucgccgccaagaagaagaccgacaagaagcgcgcccuccgccgccucuga

SEQ ID NO: 51415 - RNA, 594 nt, Artificial Sequence
  derived and/or modified sequence opt2 from UBE2T__Homo_sapiens__NP_054895
augcagcgcgccucccgccucaagcgcgagcuccacaugcucgccaccgagcccccccccggcaucaccugcuggcaggacaaggaccagauggacgaccuccgcgcccagauccucggcggcgccaacacccccuacgagaagggcgucuucaagcucgaggucaucauccccgagcgcuaccccuucgagcccccccagauccgcuuccucacccccaucuaccaccccaacaucgacuccgccggccgcaucugccucgacguccucaagcucccccccaagggcgccuggcgccccucccucaacaucgccaccguccucaccuccauccagcuccucauguccgagcccaaccccgacgacccccucauggccgacaucuccuccgaguucaaguacaacaagcccgccuuccucaagaacgcccgccaguggaccgagaagcacgcccgccagaagcagaaggccgacgaggaggagaugcucgacaaccuccccgaggccggcgacucccgcguccacaacuccacccagaagcgcaaggccucccagcucgucggcaucgagaagaaguuccaccccgacgucuga

SEQ ID NO: 51416 - RNA, 954 nt, Artificial Sequence
  derived and/or modified sequence opt2 from UBE2U__Homo_sapiens__XP_011539067
augcacggccgcgccuaccuccuccuccaccgcgacuucugcgaccucaaggagaacaacuacaagggcaucaccgccaagcccgucuccgaggacaugauggagugggaggucgagaucgagggccuccagaacuccgucuggcagggccucgucuuccagcucaccauccacuucaccuccgaguacaacuacgccccccccgucgucaaguucaucaccauccccuuccaccccaacgucgacccccacaccggccagcccugcaucgacuuccucgacaaccccgagaaguggaacaccaacuacacccucuccuccauccuccucgcccuccaggucaugcucuccaaccccguccucgagaaccccgucaaccucgaggccgcccgcauccucgucaaggacgagucccucuaccgcaccauccuccgccucuucaaccgcccccuccagaugaaggacgacucccaggagcuccccaaggacccccgcaagugcauccgccccaucaagaccaccuccuucuccgacuacuaccagaccuggucccgcaucgccaccuccaaggccaccgaguacuaccgcaccccccuccucaagguccccaacuucaucggccaguacuacaaguggaagaagauggaccuccagcaccagaaggaguggaaccucaaguacuccgucaucaagugcuggcucgcccgcaagcgcaugccccacgaggucacccacuccauggaggagaucaagcucugccccacccucaacgagaucuuccucgagucccccaccgccaucaacuccaucaccgacaucuacgagaccgaggaggagggcuggaaguccgacaccucccucuacgagaacgacaccgacgagccccgcgaggaggaggucgaggaccucaucuccuggaccaacacccucaacaccaacaccuccgaggacuga

SEQ ID NO: 51417 - RNA, 444 nt, Artificial Sequence
  derived and/or modified sequence opt2 from UBE2V1__Homo_sapiens__NP_001027459
auggccgccaccaccggcuccggcgucaaggucccccgcaacuuccgccuccucgaggagcucgaggagggccagaagggcgucggcgacggcaccgucuccuggggccucgaggacgacgaggacaugacccucacccgcuggaccggcaugaucaucggccccccccgcaccaucuacgagaaccgcaucuacucccucaagaucgagugcggccccaaguaccccgaggccccccccuucguccgcuucgucaccaagaucaacaugaacggcgucaacuccuccaacggcgucgucgacccccgcgccaucuccguccucgccaaguggcagaacuccuacuccaucaaggucguccuccaggagcuccgccgccucaugauguccaaggagaacaugaagcucccccagccccccgagggccagugcuacuccaacuga

SEQ ID NO: 51418 - RNA, 438 nt, Artificial Sequence
  derived and/or modified sequence opt2 from UBE2V2__Homo_sapiens__NP_003341
auggccgucuccaccggcgucaaggucccccgcaacuuccgccuccucgaggagcucgaggagggccagaagggcgucggcgacggcaccgucuccuggggccucgaggacgacgaggacaugacccucacccgcuggaccggcaugaucaucggccccccccgcaccaacuacgagaaccgcaucuacucccucaaggucgagugcggccccaaguaccccgaggccccccccuccguccgcuucgucaccaagaucaacaugaacggcaucaacaacuccuccggcauggucgacgcccgcuccauccccguccucgccaaguggcagaacuccuacuccaucaaggucguccuccaggagcuccgccgccucaugauguccaaggagaacaugaagcucccccagccccccgagggccagaccuacaacaacuga

SEQ ID NO: 51419 - RNA, 1065 nt, Artificial Sequence
  derived and/or modified sequence opt2 from UBE2Z__Homo_sapiens__NP_075567
auggccgagucccccaccgaggaggccgccaccgccggcgccggcgccgccggccccggcgccuccuccgucgccggcgucgucggcgucuccggcuccggcggcggcuucggcccccccuuccuccccgacgucugggccgccgccgccgccgccggcggcgccggcggccccggcuccggccucgccccccuccccggccucccccccuccgccgccgcccacggcgccgcccuccucucccacugggaccccacccucuccuccgacugggacggcgagcgcaccgccccccagugccuccuccgcaucaagcgcgacaucauguccaucuacaaggagcccccccccggcauguucgucguccccgacaccgucgacaugaccaagauccacgcccucaucaccggccccuucgacacccccuacgagggcggcuucuuccucuucgucuuccgcugcccccccgacuaccccauccaccccccccgcgucaagcucaugaccaccggcaacaacaccguccgcuucaaccccaacuucuaccgcaacggcaaggucugccucuccauccucggcaccuggaccggccccgccuggucccccgcccaguccaucuccuccguccucaucuccauccagucccucaugaccgagaaccccuaccacaacgagcccggcuucgagcaggagcgccaccccggcgacuccaagaacuacaacgagugcauccgccacgagaccauccgcgucgccgucugcgacaugauggagggcaagugccccugccccgagccccuccgcggcgucauggagaaguccuuccucgaguacuacgacuucuacgaggucgccugcaaggaccgccuccaccuccagggccagaccaugcaggaccccuucggcgagaagcgcggccacuucgacuaccagucccuccucaugcgccucggccucauccgccagaagguccucgagcgccuccacaacgagaacgccgagauggacuccgacuccuccuccuccggcaccgagaccgaccuccacggcucccuccgcgucuga

SEQ ID NO: 51420 - RNA, 2559 nt, Artificial Sequence
  derived and/or modified sequence opt2 from UBE3A__Homo_sapiens__XP_005268328
augaagcgcgccgccgccaagcaccucaucgagcgcuacuaccaccagcucaccgagggcugcggcaacgaggccugcaccaacgaguucugcgccuccugccccaccuuccuccgcauggacaacaacgccgccgccaucaaggcccucgagcucuacaagaucaacgccaagcucugcgacccccaccccuccaagaagggcgccuccuccgccuaccucgagaacuccaagggcgcccccaacaacuccugcuccgagaucaagaugaacaagaagggcgcccgcaucgacuucaaggacgucaccuaccucaccgaggagaaggucuacgagauccucgagcucugccgcgagcgcgaggacuacuccccccucauccgcgucaucggccgcgucuucuccuccgccgaggcccucguccaguccuuccgcaaggucaagcagcacaccaaggaggagcucaagucccuccaggccaaggacgaggacaaggacgaggacgagaaggagaaggccgccugcuccgccgccgccauggaggaggacuccgaggccuccuccucccgcaucggcgacuccucccagggcgacaacaaccuccagaagcucggccccgacgacgucuccgucgacaucgacgccauccgccgcgucuacacccgccuccucuccaacgagaagaucgagaccgccuuccucaacgcccucgucuaccucucccccaacgucgagugcgaccucaccuaccacaacgucuacucccgcgaccccaacuaccucaaccucuucaucaucgucauggagaaccgcaaccuccacucccccgaguaccucgagauggcccucccccucuucugcaaggccauguccaagcucccccucgccgcccagggcaagcucauccgccucugguccaaguacaacgccgaccagauccgccgcaugauggagaccuuccagcagcucaucaccuacaaggucaucuccaacgaguucaacucccgcaaccucgucaacgacgacgacgccaucgucgccgccuccaagugccucaagauggucuacuacgccaacgucgucggcggcgaggucgacaccaaccacaacgaggaggacgacgaggagcccauccccgaguccuccgagcucacccuccaggagcuccucggcgaggagcgccgcaacaagaagggcccccgcgucgacccccucgagaccgagcucggcgucaagacccucgacugccgcaagccccucauccccuucgaggaguucaucaacgagccccucaacgagguccucgagauggacaaggacuacaccuucuucaaggucgagaccgagaacaaguucuccuucaugaccugccccuucauccucaacgccgucaccaagaaccucggccucuacuacgacaaccgcauccgcauguacuccgagcgccgcaucaccguccucuacucccucguccagggccagcagcucaaccccuaccuccgccucaagguccgccgcgaccacaucaucgacgacgcccucguccgccucgagaugaucgccauggagaaccccgccgaccucaagaagcagcucuacgucgaguucgagggcgagcagggcgucgacgagggcggcgucuccaaggaguucuuccagcucgucgucgaggagaucuucaaccccgacaucggcauguucaccuacgacgaguccaccaagcucuucugguucaaccccuccuccuucgagaccgagggccaguucacccucaucggcaucguccucggccucgccaucuacaacaacugcauccucgacguccacuuccccauggucgucuaccgcaagcucaugggcaagaagggcaccuuccgcgaccucggcgacucccaccccguccucuaccagucccucaaggaccuccucgaguacgagggcaacgucgaggacgacaugaugaucaccuuccagaucucccagaccgaccucuucggcaaccccaugauguacgaccucaaggagaacggcgacaagauccccaucaccaacgagaaccgcaaggaguucgucaaccucuacuccgacuacauccucaacaaguccgucgagaagcaguucaaggccuuccgccgcggcuuccacauggucaccaacgaguccccccucaaguaccucuuccgccccgaggagaucgagcuccucaucugcggcucccgcaaccucgacuuccaggcccucgaggagaccaccgaguacgacggcggcuacacccgcgacuccguccucauccgcgaguucugggagaucguccacuccuucaccgacgagcagaagcgccucuuccuccaguucaccaccggcaccgaccgcgcccccgucggcggccucggcaagcucaagaugaucaucgccaagaacggccccgacaccgagcgccuccccaccucccacaccugcuucaacguccuccuccuccccgaguacuccuccaaggagaagcucaaggagcgccuccucaaggccaucaccuacgccaagggcuucggcaugcucuga

SEQ ID NO: 51421 - RNA, 735 nt, Artificial Sequence
  derived and/or modified sequence opt2 from UBE3B__Homo_sapiens__NP_001257380
auguucacccucucccagaccucccgcgccugguucaucgaccgcgcccgccaggcccgcgaggagcgccucguccagaaggagcgcgagcgcgccgccgucgucauccaggcccacguccgcuccuuccucugccgcucccgccuccagcgcgacauccgccgcgagaucgacgacuucuucaaggccgacgaccccgaguccaccaagcgcuccgcccucugcaucuucaagaucgcccgcaagcuccucuuccucuuccgcaucaaggaggacaacgagcgcuucgagaagcucugccgcuccauccucuccuccauggacgccgagaacgagcccaaggucugguacgucucccucgccugcuccaaggaccucacccuccucuggauccagcagaucaagaacauccucugguacugcugcgacuuccucaagcagcucaagcccgagauccuccaggacucccgccucaucacccucuaccucaccaugcucgucaccuucaccgacaccuccaccuggaagauccuccgcggcaagggcgagucccuccgccccgccaugaaccacaucugcgccaacaucaugggccaccucaaccagcacggcuucuacuccguccuccagugcugcgacggccucuuccccgaccucgucuccuacgccccccacaacaaccccguccgcugguccgucggccgcuccugguacgacuggcagcucucccgcuga

SEQ ID NO: 51422 - RNA, 3252 nt, Artificial Sequence
  derived and/or modified sequence opt2 from UBE3C__Homo_sapiens__NP_055486
auguucuccuucgagggcgacuucaagacccgccccaaggucucccucggcggcgccucccgcaaggaggagaaggccucccuccuccaccgcacccaggaggagcgccgcaagcgcgaggaggagcgccgccgccucaagaacgccaucaucauccaguccuucauccgcggcuaccgcgaccgcaagcagcaguacuccauccagcgcuccgccuucgaccgcugcgccacccucucccaguccggcggcgccuuccccaucgccaacggccccaaccucacccuccucguccgccagcuccucuucuucuacaagcagaacgaggacuccaagcgccucaucuggcucuaccagaaccucaucaagcacuccucccucuucgucaagcagcucgacggcuccgagcgccucaccugccucuuccagaucaagcgccucaugucccucugcugccgccuccuccagaacugcaacgacgacucccucaacgucgcccuccccaugcgcaugcucgaggucuucuccuccgagaacaccuaccuccccguccuccaggacgccuccuacgucgucuccgucaucgagcagauccuccacuacaugauccacaacggcuacuaccgcucccucuaccuccucaucaacuccaagcuccccuccuccaucgaguacuccgaccucucccgcguccccaucgccaagauccuccucgagaacguccucaagccccuccacuucaccuacaacuccugccccgagggcgcccgccagcaggucuucaccgccuucaccgaggaguuccucgccgcccccuucaccgaccagaucuuccacuucaucauccccgcccucgccgacgcccagaccgucuuccccuacgagcccuuccucaacgcccuccuccucaucgagucccgcugcucccgcaaguccggcggcgcccccuggcucuucuacuucguccucaccgucggcgagaacuaccucggcgcccucuccgaggagggccuccucgucuaccuccgcguccuccagaccuuccucucccagcuccccgucucccccgccuccgccuccugccacgacuccgccuccgacuccgaggaggaguccgaggaggccgacaagcccuccucccccgaggacggccgccucuccgucuccuacaucaccgaggagugccucaagaagcucgacaccaagcagcagaccaacacccuccucaaccucgucuggcgcgacuccgccuccgaggaggucuucaccaccauggccuccgucugccacacccucaugguccagcaccgcaugaugguccccaagguccgccuccucuacucccucgccuucaacgcccgcuuccuccgccaccucugguuccucaucuccuccauguccacccgcaugaucaccggcuccauggucccccuccuccaggucaucucccgcggcucccccauguccuucgaggacuccucccgcaucaucccccucuucuaccucuucuccucccucuucucccacucccucaucuccauccacgacaacgaguucuucggcgaccccaucgaggucgucggccagcgccaguccuccaugaugcccuucacccucgaggagcucaucaugcucucccgcugccuccgcgacgccugccucggcaucaucaagcucgccuaccccgagaccaagcccgagguccgcgaggaguacaucaccgccuuccaguccaucggcgucaccaccuccuccgagaugcagcagugcauccagauggagcagaagcgcuggauccagcucuucaaggucaucaccaaccucgucaagaugcucaagucccgcgacacccgccgcaacuucugcccccccaaccacuggcucuccgagcaggaggacaucaaggccgacaaggucacccagcucuacguccccgccucccgccacgucuggcgcuuccgccgcaugggccgcaucggcccccuccaguccacccucgacgucggccucgagucccccccccucuccgucuccgaggagcgccagcucgccguccucaccgagcuccccuucgucguccccuucgaggagcgcgucaagaucuuccagcgccucaucuacgccgacaagcaggagguccagggcgacggccccuuccucgacggcaucaacgucaccauccgccgcaacuacaucuacgaggacgccuacgacaagcucucccccgagaacgagcccgaccucaagaagcgcauccgcguccaccuccucaacgcccacggccucgacgaggccggcaucgacggcggcggcaucuuccgcgaguuccucaacgagcuccucaaguccggcuucaaccccaaccagggcuucuucaagaccaccaacgagggccuccucuaccccaaccccgccgcccagaugcucgucggcgacuccuucgcccgccacuacuacuuccucggccgcaugcucggcaaggcccucuacgagaacaugcucgucgagcuccccuucgccggcuucuuccucuccaagcuccucggcaccuccgccgacgucgacauccaccaccucgccucccucgaccccgaggucuacaagaaccuccucuuccucaaguccuacgaggacgacgucgaggagcucggccucaacuucaccgucgucaacaacgaccucggcgaggcccaggucgucgagcucaaguucggcggcaaggacauccccgucaccuccgccaaccgcaucgccuacauccaccucgucgccgacuaccgccucaaccgccagauccgccagcacugccucgccuuccgccagggccucgccaacgucgucucccucgaguggcuccgcauguucgaccagcaggagauccagguccucaucuccggcgcccagguccccaucucccucgaggaccucaaguccuucaccaacuacuccggcggcuacuccgccgaccaccccgucaucaaggucuucuggcgcgucgucgagggcuucaccgacgaggagaagcgcaagcuccucaaguucgucaccuccugcucccgccccccccuccucggcuucaaggagcucuaccccgccuucugcauccacaacggcggcuccgaccucgagcgccuccccaccgccuccaccugcaugaaccuccucaagcuccccgaguucuacgacgagacccuccuccgcuccaagcuccucuacgccaucgagugcgccgccggcuucgagcucuccuga

SEQ ID NO: 51423 - RNA, 3201 nt, Artificial Sequence
  derived and/or modified sequence opt2 from UBE4A__Homo_sapiens__NP_001191006
augaccgaccaggagaacaacaacaacaucuccuccaaccccuucgccgcccucuucggcucccucgccgacgccaagcaguucgccgccauccagaaggagcagcucaagcagcaguccgacgagcuccccgccucccccgacgacuccgacaacuccgucuccgagucccucgacgaguucgacuacuccgucgccgagaucucccgcuccuuccgcucccagcaggagaucugcgagcagcucaacaucaaccacaugauccagcgcaucuuccucaucacccucgacaacuccgaccccucccucaaguccggcaacggcauccccucccgcugcgucuaccucgaggagauggccgucgagcucgaggaccaggacuggcucgacauguccaacgucgagcaggcccucuucgcccgccuccuccuccaggaccccggcaaccaccucaucaacaugaccuccuccaccacccucaaccucuccgccgaccgcgacgccggcgagcgccacaucuucugcuaccucuacuccugcuuccagcgcgccaaggaggagaucaccaagguccccgagaaccuccuccccuucgccguccagugccgcaaccucaccgucuccaacacccgcaccguccuccucacccccgagaucuacgucgaccagaacauccacgagcagcucgucgaccucaugcucgaggccauccagggcgcccacuucgaggacgucaccgaguuccucgaggaggucaucgaggcccucauccucgacgaggagguccgcaccuuccccgaggucaugauccccgucuucgacauccuccucggccgcaucaaggaccucgagcucugccagauccuccucuacgccuaccucgacauccuccucuacuucacccgccagaaggacauggccaaggucuucgucgaguacauccagcccaaggaccccaccaacggccagauguaccagaagacccuccucggcgucauccucuccaucuccugccuccucaagacccccggcgucgucgagaaccacggcuacuuccucaaccccucccgcuccuccccccaggagaucaagguccaggaggccaacauccaccaguucauggcccaguuccacgagaagaucuaccagaugcucaagaaccuccuccagcucucccccgagaccaagcacugcauccucuccuggcucggcaacugccuccacgccaacgccggccgcaccaagaucugggccaaccagaugcccgagaucuucuuccagauguacgccuccgacgccuucuuccucaaccucggcgccgcccuccucaagcucugccagcccuucugcaagccccgcuccucccgccuccucaccuucaaccccaccuacugcgcccucaaggagcucaacgacgaggagcgcaagaucaagaacguccacaugcgcggccucgacaaggagaccugccucauccccgccguccaggagcccaaguucccccagaacuacaaccucgucaccgagaaccucgcccucaccgaguacacccucuaccucggcuuccaccgccuccacgaccagauggucaagaucaaccagaaccuccaccgccuccaggucgccuggcgcgacgcccagcaguccuccucccccgccgccgacaaccuccgcgagcaguucgagcgccucaugaccaucuaccucuccaccaagaccgccaugaccgagccccagaugcuccagaacugccucaaccuccaggucuccauggccguccuccucguccagcucgccaucggcaacgagggcucccagcccaucgagcucaccuucccccuccccgacggcuacuccucccucgccuacguccccgaguucuucgccgacaaccucggcgacuuccucaucuuccuccgccgcuucgccgacgacauccucgagaccuccgccgacucccucgagcacguccuccacuucaucaccaucuucaccggcuccaucgagcgcaugaagaacccccaccuccgcgccaagcucgccgagguccucgaggccgucaugccccaccucgaccagacccccaacccccucgucuccuccgucuuccaccgcaagcgcgucuucugcaacuuccaguacgccccccagcucgccgaggcccucaucaaggucuucgucgacaucgaguucaccggcgacccccaccaguucgagcagaaguucaacuaccgccgccccauguaccccauccuccgcuacauguggggcaccgacaccuaccgcgaguccaucaaggaccucgccgacuacgccuccaagaaccucgaggccaugaaccccccccucuuccuccgcuuccucaaccuccucaugaacgacgccaucuuccuccucgacgaggccauccaguaccucuccaagaucaagauccagcagaucgagaaggaccgcggcgagugggacucccucacccccgaggcccgccgcgagaaggaggccggccuccagauguucggccagcucgcccgcuuccacaacaucauguccaacgagaccaucggcacccucgccuuccucaccuccgagaucaagucccucuucguccaccccuuccucgccgagcgcaucaucuccaugcucaacuacuuccuccagcaccucgucggccccaagaugggcgcccucaaggucaaggacuucuccgaguucgacuucaagccccagcagcucgucuccgacaucugcaccaucuaccucaaccucggcgacgaggagaacuucugcgccaccguccccaaggacggccgcuccuacucccccacccucuucgcccagaccguccgcguccucaagaagaucaacaagcccggcaacaugaucauggccuucuccaaccucgccgagcgcaucaagucccucgccgaccuccagcagcaggaggaggagaccuacgccgacgccugcgacgaguuccucgaccccaucauguccacccucaugugcgaccccgucguccuccccuccucccgcgucaccgucgaccgcuccaccaucgcccgccaccuccucuccgaccagaccgaccccuucaaccgcuccccccucaccauggaccagauccgccccaacaccgagcucaaggagaagauccagcgcuggcucgccgagcgcaagcagcagaaggagcagcucgaguga

SEQ ID NO: 51424 - RNA, 3519 nt, Artificial Sequence
  derived and/or modified sequence opt2 from UBE4B__Homo_sapiens__XP_011538792
auggaggagcucuccgccgacgagauccgccgccgccgccucgcccgccucgccggcggccagaccucccagcccaccaccccccucaccuccccccagcgcgagaacccccccggcccccccaucgccgccuccgcccccggccccucccagucccucggccucaacguccacaacaugacccccgccaccucccccaucggcgccuccggcgucgcccaccgcucccaguccuccgagggcgucuccucccucuccuccucccccuccaacucccucgagacccagucccagucccucucccgcucccaguccauggacaucgacggcgucuccugcgagaaguccaugucccaggucgacgucgacuccggcaucgagaacauggaggucgacgagaacgaccgccgcgagaagcgcucccucuccgacaaggagcccuccuccggccccgaggucuccgaggagcaggcccuccagcucgucugcaagaucuuccgcgucuccuggaaggaccgcgaccgcgacgucaucuuccucuccucccucuccgcccaguucaagcagaaccccaaggaggucuucuccgacuucaaggaccucaucggccagauccucauggagguccucaugauguccacccagacccgcgacgagaaccccuucgccucccucaccgccaccucccagcccaucgccgccgccgcccgcucccccgaccgcaaccuccuccucaacaccggcuccaaccccggcaccucccccauguucugcuccgucgccuccuucggcgccuccucccucuccucccucuacgaguccucccccgcccccacccccuccuucugguccuccguccccgucaugggccccucccucgccucccccucccgcgccgccucccagcucgccguccccuccaccccccucuccccccacuccgccgccuccggcaccgccgccggcucccagcccuccuccccccgcuaccgccccuacaccgucacccaccccugggccuccuccggcgucuccauccucuccuccucccccuccccccccgcccucgccuccuccccccaggccguccccgccuccuccucccgccagcgccccuccuccaccggccccccccucccccccgccucccccuccgccaccucccgccgccccuccucccuccgcaucucccccuccauguacgacaaccccuucuccuuccucuuccucgcccucuccggcgacuccuccgacgaggaggacgaggaggaggacgacgacgacggcgacggcgacgacgagggcggcggcggcggcgacgacuucuccugcguccaguucggcuccucccucggcgccuccggcggcgccuccaacugggacuccuacuccgaccacuucaccaucgagaccugcaaggagaccgacaugcucaacuaccucaucgagugcuucgaccgcgucggcaucgaggagaagaaggcccccaagaugugcucccagcccgccgucucccagcuccucuccaacauccgcucccagugcaucucccacaccgcccucguccuccagggcucccucacccagccccgcucccuccagcagcccuccuuccucguccccuacaugcucugccgcaaccuccccuacggcuucauccaggagcucguccgcaccacccaccaggacgaggaggucuucaagcagaucuucauccccauccuccagggccucgcccucgccgccaaggagugcucccucgacuccgacuacuucaaguacccccucauggcccucggcgagcucugcgagaccaaguucggcaagacccaccccgucugcaaccucgucgccucccuccgccucuggcuccccaagucccucucccccggcugcggccgcgagcuccagcgccucuccuaccucggcgccuucuucuccuucuccgucuucgccgaggacgacgucaaggucgucgagaaguacuucuccggccccgccaucacccucgagaacacccgcgucgucucccagucccuccagcacuaccucgagcucggccgccaggagcucuucaagauccuccacuccauccuccucaacggcgagacccgcgaggccgcccucuccuacauggccgccgucgucaacgccaacaugaagaaggcccagaugcagaccgacgaccgccucgucuccaccgacggcuucaugcucaacuuccucuggguccuccagcagcucuccaccaagaucaagcucgagaccgucgaccccaccuacaucuuccacccccgcugccgcaucacccuccccaacgacgagacccgcgucaacgccaccauggaggacgucaacgacuggcucaccgagcucuacggcgaccagccccccuucuccgagcccaaguuccccaccgagugcuucuuccucacccuccacgcccaccaccucuccauccuccccuccugccgccgcuacauccgccgccuccgcgccauccgcgagcucaaccgcaccgucgaggaccucaagaacaacgagucccaguggaaggacuccccccucgccacccgccaccgcgagaugcucaagcgcugcaagacccagcucaagaagcucguccgcugcaaggccugcgccgacgccggccuccucgacgaguccuuccuccgccgcugccucaacuucuacggccuccucauccagcuccuccuccgcauccucgaccccgccuaccccgacaucacccucccccucaacuccgacguccccaaggucuucgccgcccuccccgaguucuacgucgaggacgucgccgaguuccucuucuucaucguccaguacuccccccaggcccucuacgagcccugcacccaggacaucgucauguuccucgucgucaugcucugcaaccagaacuacauccgcaaccccuaccucgucgccaagcucgucgaggucauguucaugaccaaccccgccguccagccccgcacccagaaguucuucgagaugaucgagaaccacccccucuccaccaagcuccucguccccucccucaugaaguucuacaccgacgucgagcacaccggcgccaccuccgaguucuacgacaaguucaccauccgcuaccacaucuccaccaucuucaagucccucuggcagaacaucgcccaccacggcaccuucauggaggaguucaacuccggcaagcaguucguccgcuacaucaacaugcucaucaacgacaccaccuuccuccucgacgagucccucgagucccucaagcgcauccacgagguccaggaggagaugaagaacaaggagcagugggaccagcucccccgcgaccagcagcaggcccgccagucccagcucgcccaggacgagcgcgucucccgcuccuaccucgcccucgccaccgagaccgucgacauguuccacauccucaccaagcagguccagaagcccuuccuccgcccccacgagcucuccuacuaccccgucaucuccuga

SEQ ID NO: 51425 - RNA, 540 nt, Artificial Sequence
  derived and/or modified sequence opt2 from UBIAD1__Homo_sapiens__XP_011539606
auggccgccucccagguccucggcgagaagaucaacauccucuccggcgagaccgucaaggccggcgaccgcgacccccucggcaacgacugccccgagcaggaccgccucccccagcgcuccuggcgccagaagugcgccuccuacguccucgcccuccgccccugguccuucuccgccucccucacccccgucgcccucggcuccgcccucgccuaccgcucccacggcguccucgacccccgccuccucgucggcugcgccgucgccguccucgccguccacggcgccggcaaccucgucaacaccuacuacgacuucuccaagggcaucgaccacaagaaguccgacgaccgcacccucgucgaccgcauccucgagccccaggacgucguccgcuucggcgucuuccucuacacccucggcugcgucugcgccgccugccucuacuaccucuccccccucaagcucgagcaccucgcccucaucuacuucggcggccucuccggcuccuuccucuacaccggcguccucaucuga

SEQ ID NO: 51426 - RNA, 354 nt, Artificial Sequence
  derived and/or modified sequence opt2 from UBL3__Homo_sapiens__NP_009037
auguccuccaacguccccgccgacaugaucaaccuccgccucauccucgucuccggcaagaccaaggaguuccucuucucccccaacgacuccgccuccgacaucgccaagcacgucuacgacaacuggcccauggacugggaggaggagcaggucuccucccccaacauccuccgccucaucuaccagggccgcuuccuccacggcaacgucacccucggcgcccucaagcuccccuucggcaagaccaccgucaugcaccucgucgcccgcgagacccuccccgagcccaacucccagggccagcgcaaccgcgagaagaccggcgaguccaacugcugcgucauccucuga

SEQ ID NO: 51427 - RNA, 474 nt, Artificial Sequence
  derived and/or modified sequence opt2 from UBL4A__Homo_sapiens__NP_055050
augcagcucaccgucaaggcccuccagggccgcgagugcucccuccagguccccgaggacgagcucgucuccacccucaagcagcucgucuccgagaagcucaacguccccguccgccagcagcgccuccucuucaagggcaaggcccucgccgacggcaagcgccucuccgacuacuccaucggccccaacuccaagcucaaccucgucgucaagccccucgagaagguccuccucgaggagggcgaggcccagcgccucgccgacuccccccccccccaggucuggcagcucaucuccaagguccucgcccgccacuucuccgccgccgacgccucccgcguccucgagcagcuccagcgcgacuacgagcgcucccucucccgccucacccucgacgacaucgagcgccucgccucccgcuuccuccaccccgaggucaccgagaccauggagaagggcuucuccaaguga

SEQ ID NO: 51428 - RNA, 222 nt, Artificial Sequence
  derived and/or modified sequence opt2 from UBL5__Homo_sapiens__NP_001041706
augaucgaggucgucugcaacgaccgccucggcaagaagguccgcgucaagugcaacaccgacgacaccaucggcgaccucaagaagcucaucgccgcccagaccggcacccgcuggaacaagaucguccucaagaagugguacaccaucuucaaggaccacgucucccucggcgacuacgagauccacgacggcaugaaccucgagcucuacuaccaguga

SEQ ID NO: 51429 - RNA, 1143 nt, Artificial Sequence
  derived and/or modified sequence opt2 from UBL7__Homo_sapiens__NP_001273669
augucccucuccgacuggcaccucgccgucaagcucgccgaccagccccucacccccaaguccauccuccgccuccccgagaccgagcucggcgaguacucccucggcggcuacuccaucuccuuccucaagcagcucaucgccggcaagcuccaggaguccguccccgaccccgagcucaucgaccucaucuacugcggccgcaagcucaaggacgaccagacccucgacuucuacggcauccagcccggcuccaccguccacguccuccgcaaguccuggcccgagcccgaccagaagcccgagcccgucgacaaggucgccgccaugcgcgaguuccgcguccuccacaccgcccuccacuccuccuccuccuaccgcgaggccgucuucaagaugcucuccaacaaggagucccucgaccagaucaucgucgccacccccggccucuccuccgaccccaucgcccucggcguccuccaggacaaggaccucuucuccgucuucgccgaccccaacaugcucgacacccucguccccgcccaccccgcccucgucaacgccaucguccucguccuccacuccgucgccggcuccgcccccaugcccggcaccgacuccuccucccgcuccaugcccuccuccuccuaccgcgacaugcccggcggcuuccucuucgagggccucuccgacgacgaggacgacuuccaccccaacacccgcuccacccccuccuccuccacccccuccucccgccccgccucccucggcuacuccggcgccgccggcccccgccccaucacccaguccgagcucgccaccgcccucgcccucgccuccacccccgaguccuccucccacacccccacccccggcacccagggccacuccuccggcaccucccccauguccuccggcguccaguccggcacccccaucaccaacgaccucuucucccaggcccuccagcacgcccuccaggccuccggccagcccucccuccagucccaguggcagccccagcuccagcagcuccgcgacaugggcauccaggacgacgagcucucccuccgcgcccuccaggccaccggcggcgacauccaggccgcccucgagcucaucuucgccggcggcgcccccuga

SEQ ID NO: 51430 - RNA, 957 nt, Artificial Sequence
  derived and/or modified sequence opt2 from UBLCP1__Homo_sapiens__NP_659486
auggcccuccccaucaucgucaaguggggcggccaggaguacuccgucaccacccucuccgaggacgacaccguccucgaccucaagcaguuccucaagacccucaccggcguccuccccgagcgccagaagcuccucggccucaaggucaagggcaagcccgccgagaacgacgucaagcucggcgcccucaagcucaagcccaacaccaagaucaugaugaugggcacccgcgaggagucccucgaggacguccucggccccccccccgacaacgacgacgucgucaacgacuucgacaucgaggacgaggucgucgaggucgagaaccgcgaggagaaccuccucaagaucucccgccgcgucaaggaguacaaggucgagauccucaaccccccccgcgagggcaagaagcuccucguccucgacgucgacuacacccucuucgaccaccgcuccugcgccgagaccggcgucgagcucaugcgccccuaccuccacgaguuccucaccuccgccuacgaggacuacgacaucgucaucugguccgccaccaacaugaaguggaucgaggccaagaugaaggagcucggcgucuccaccaacgccaacuacaagaucaccuucaugcucgacuccgccgccaugaucaccguccacaccccccgccgcggccucaucgacgucaagccccucggcgucaucuggggcaaguucuccgaguucuacuccaagaagaacaccaucauguucgacgacaucggccgcaacuuccucaugaacccccagaacggccucaagauccgccccuucaugaaggcccaccucaaccgcgacaaggacaaggagcuccucaagcucacccaguaccucaaggagaucgccaagcucgacgacuuccucgaccucaaccacaaguacugggagcgcuaccucuccaagaagcagggccaguga

SEQ ID NO: 51431 - RNA, 3405 nt, Artificial Sequence
  derived and/or modified sequence opt2 from UBN1__Homo_sapiens__NP_001072982
auguccgagccccaccgcguccaguucaccucccuccccggcucccucaaccccgccuuccucaagaagucccgcaaggaggaggccggcgccggcgagcagcaccaggacugcgagcccgccgccgccgccguccgcaucacccucacccucuucgagcccgaccacaagcgcugccccgaguucuucuaccccgagcucgucaagaacauccgcggcaaggucaagggccuccagcccggcgacaagaagaaggaccucuccgaccccuucaacgacgaggagaaggagcgccacaaggucgaggcccucgcccgcaaguucgaggagaaguacggcggcaagaagcgccgcaaggaccgcauccaggaccucaucgacaugggcuacggcuacgacgaguccgacuccuucaucgacaacuccgaggccuacgacgagcucguccccgccucccucaccaccaaguacggcggcuucuacaucaacuccggcacccuccaguuccgccaggccuccgaguccgaggacgacuucaucaaggagaagaagaagaagucccccaagaagcgcaagcucaaggagggcggcgagaagaucaagaagaagaagaaggacgacaccuacgacaaggagaagaaguccaagaaguccaaguucuccaaggccggcuucaccgcccucaacgccuccaaggagaagaagaagaagaaguacuccggcgcccucuccgucaaggagaugcucaagaaguuccagaaggagaaggaggcccagaagaagcgcgaggaggagcacaagcccgucgccguccccuccgccgaggcccagggccuccgcgagcucgagggcgccuccgacccccuccucucccucuucggcuccaccuccgacaacgaccuccuccaggccgccaccgccauggacucccucaccgaccucgaccucgagcaccuccucuccgagucccccgagggcucccccuuccgcgacauggacgacggcuccgacucccucggcgucggccucgaccaggaguuccgccagcccuccucccuccccgagggccuccccgccccccucgagaagcgcgucaaggagcucgcccaggccgcccgcgccgccgagggcgagucccgccagaaguucuucacccaggacaucaacggcauccuccucgacaucgaggcccagacccgcgagcucuccucccagguccgcuccggcgucuacgccuaccucgccuccuuccuccccugcuccaaggacgcccuccucaagcgcgcccgcaagcuccaccucuacgagcagggcggccgccucaaggagccccuccagaagcucaaggaggccaucggccgcgccaugcccgagcagauggccaaguaccaggacgagugccaggcccacacccaggccaaggucgccaagaugcucgaggaggagaaggacaaggagcagcgcgaccgcaucugcuccgacgaggaggaggacgaggagaagggcggccgccgcaucaugggcccccgcaagaaguuccaguggaacgacgagauccgcgagcuccucugccaggucgucaagaucaagcucgagucccaggaccucgagcgcaacaacaaggcccaggccugggaggacugcgucaagggcuuccucgacgccgaggucaagccccucuggcccaagggcuggaugcaggcccgcacccucuucaaggagucccgccgcggccacggccaccucaccuccauccucgccaagaagaaggucauggcccccuccaagaucaaggucaaggaguccuccaccaagcccgacaagaaggucuccguccccuccggccagaucggcggccccaucgcccuccccuccgaccaccagaccggcggccucuccaucggcgccuccucccgcgagcuccccucccaggccuccggcggccucgccaaccccccccccgucaaccucgaggacucccucgacgaggaccucauccgcaaccccgccuccuccgucgaggccgucuccaaggagcucgccgcccucaacucccgcgccgccggcaacuccgaguucacccuccccgcccccuccaaggcccccgccgagaaggucggcggcguccucugcaccgaggagaagcgcaacuucgccaagcccucccccuccgcccccccccccgccuccucccuccaguccccccucaacuuccucgccgagcaggcccucgcccucggccaguccucccaggagaagaagcccgaguccuccggcuacaaggagcucuccugccaggccccccucaacaagggccuccccgagguccaccaguccaaggccaagcaccacucccucccccgcaccucccacggcccccaggucgccguccccguccccggcccccaggucaaggucuuccacgccggcacccagcagcagaagaacuucaccccccccucccccuucgccaacaagcuccagggccccaaggccucccccacccagugccaccgcucccuccuccagcucgucaagaccgccgccaagggccagggcuuccaccccuccgcccccgccaccuccggcggccucuccgccuccuccuccuccucccacaagacccccgccuccuccuccuccgcccucucccaccccgccaagccccacuccgucuccuccgccggcuccuccuacaagaacaaccccuucgccuccuccaucuccaagcacggcgucuccuccggcuccuccuccuccggcggcacccccguccaguccuccgucuccggcucccucguccccggcauccagccccccuccgucggccaggccaccucccgccccguccccuccuccgccggcaagaagaugcccgucucccagaagcucacccucgucgccccccccggcggccccaacggcgacuccuccggcggcacccagggcgucgccaagcuccucaccucccccucccucaagcccuccgccgucuccuccgucaccuccuccaccucccucuccaagggcgccuccggcaccguccuccucgccggcuccucccucauggccucccccuacaaguccuccucccccaagcucuccggcgccauguccuccaacucccucggcaucaucacccccguccccauccccguccacguccucuccuucuccgccgacuccuccgccaaggccggcgucuccaaggacgccaucgucaccggccccgcccccggcuccuuccaccacggccucggccacucccuccucgccggccuccacuccucccccccccacgccgccccccucccccacgccgccguccccacccacaucccccagucccuccccggcgccucccagcuccacggcaagggccccgccgucccccgcaagcucuga

SEQ ID NO: 51432 - RNA, 1539 nt, Artificial Sequence
  derived and/or modified sequence opt2 from UBOX5__Homo_sapiens__NP_001254513
auggucaucaaccucugccucccccaguuccgcccccgcauccacugcaacaagaucuccgccgacggcuacgaggucgagaaccucaucuccgaggaccucaccaagcgcucccacggcuuccgcaccgaguacuucaucaagccccccgucuacgucaccgucuccuuccccuucaacgucgagaucugccgcaucaacaucgaccucaccgccggcggcggccagaacgucaccggccucgagauguacaccuccgccuccuccucccgcgucuccuggaacaccccccagugccgcacccucggccccgccgagcccuccguccccgacaaggaggccuucacccucgucggcaagguccuccucaagaaccagucccaggucgucuucucccaccgcggcuucaaggcccgcccccccuucggcgccauggaggccacccuccccucccccgccgucgucgcccaggagcucuggaacaagggcgcccucucccucucccacgucgcccaccuccgcaucugcaucacccacgucaccggcggcggcauccccugcaucaagcgccucgaggucuggggccagcccgccaagaccugcucccaggaggucaucgacuccauccuccucgucaccuccgagaaccucccccaggacgucgcccuccaggcccccgcccuccccauggaguccgacugcgaccccggcgaccagcccgagucccagcaggcccccuccucccuccagaagcucgccgagaucauccaggacguccccgaggaguuccucgaccccaucacccucgagaucaugcccugccccaugcuccuccccuccggcaaggucaucgaccaguccacccucgagaagugcaaccgcuccgaggccaccuggggccgcguccccuccgaccccuucaccggcgucgccuucaccccccacucccagccccucccccaccccucccucaaggcccgcaucgaccacuuccuccuccagcacuccauccccggcugccaccuccucggccgcgcccagaccgcccucgccgucauccccuccuccaucguccuccccucccagaagcgcaagaucgagcaggccgagcacguccccgacuccaacuucggcgucaacgccuccugcuucuccgccaccuccccccucguccuccccaccaccuccgagcacaccgccaagaagaugaaggccaccaacgagcccucccucacccacauggacugcuccaccggcccccucucccacgagcagaagcucucccagucccucgagaucgcccucgccuccacccucggcuccaugcccuccuucaccgcccgccucacccgcggccagcuccagcaccucggcacccgcggcuccaacaccuccuggcgccccggcaccggcuccgccugggagcaccccggcccccgcaugugccuccuccagaaguccaucuucucccuccuccagaagggcgccggcguccccgccgcccuccgccccccccccguccccacccuccccggcuga

SEQ ID NO: 51433 - RNA, 1515 nt, Artificial Sequence
  derived and/or modified sequence opt2 from UBP1__Homo_sapiens__NP_001121632
auggccuggguccucaagauggacgaggucaucgaguccggccucguccacgacuucgacgccucccucuccggcaucggccaggagcucggcgccggcgccuacuccauguccgacguccucgcccuccccaucuucaagcaggaggacuccucccucccccucgacggcgagaccgagcacccccccuuccaguacgucaugugcgccgccaccucccccgccgucaagcuccacgacgagacccucaccuaccucaaccagggccaguccuacgagauccgcaugcucgacaaccgcaagaugggcgacaugcccgagaucaacggcaagcucgucaaguccaucauccgcgucgucuuccacgaccgccgccuccaguacaccgagcaccagcagcucgagggcuggaaguggaaccgccccggcgaccgccuccucgaccucgacauccccauguccgucggcaucaucgacacccgcaccaaccccucccagcucaacgccgucgaguuccucugggaccccgccaagcgcaccuccgccuucauccagguccacugcaucuccaccgaguucaccccccgcaagcacggcggcgagaagggcguccccuuccgcauccaggucgacaccuucaagcagaacgagaacggcgaguacaccgaccaccuccacuccgccuccugccagaucaaggucuucaagcccaagggcgccgaccgcaagcagaagaccgaccgcgagaagauggagaagcgcaccgcccacgagaaggagaaguaccagcccuccuacgacaccaccauccucaccgagugcucccccuggcccgacgcccccaccgccuacgucaacaacucccccucccccgcccccaccuucaccuccccccagcaguccaccugcuccguccccgacuccaacuccuccucccccaaccaccagggcgacggcgccucccagaccuccggcgagcagauccagcccuccgccaccauccaggagacccagcaguggcuccucaagaaccgcuucuccuccuacacccgccucuucuccaacuucuccggcgccgaccuccucaagcucaccaaggaggaccucguccagaucugcggcgccgccgacggcauccgccucuacaacucccucaagucccgcuccguccgcccccgccucaccaucuacgucugccgcgagcagcccuccuccaccguccuccagggccagcagcaggccgccuccuccgccuccgagaacggcuccggcgcccccuacgucuaccacgccaucuaccucgaggagaugaucgccuccgaggucgcccgcaagcucgcccucgucuucaacaucccccuccaccagaucaaccaggucuaccgccagggccccaccggcauccacauccucgucuccgaccagaugguccagaacuuccaggacgaguccugcuuccucuucuccaccgucaaggccgaguccuccgacggcauccacaucauccucaaguga

SEQ ID NO: 51434 - RNA, 1770 nt, Artificial Sequence
  derived and/or modified sequence opt2 from UBQLN1__Homo_sapiens__NP_038466
auggccgaguccggcgaguccggcggcccccccggcucccaggacuccgccgccggcgccgagggcgccggcgcccccgccgccgccgccuccgccgagcccaagaucaugaaggucaccgucaagacccccaaggagaaggaggaguucgccguccccgagaacuccuccguccagcaguucaaggaggagaucuccaagcgcuucaagucccacaccgaccagcucguccucaucuucgccggcaagauccucaaggaccaggacacccucucccagcacggcauccacgacggccucaccguccaccucgucaucaagacccagaaccgcccccaggaccacuccgcccagcagaccaacaccgccggcuccaacgucaccaccuccuccacccccaacuccaacuccaccuccggcuccgccaccuccaaccccuucggccucggcggccucggcggccucgccggccucuccucccucggccucaacaccaccaacuucuccgagcuccagucccagaugcagcgccagcuccucuccaaccccgagaugaugguccagaucauggagaaccccuucguccaguccaugcucuccaaccccgaccucaugcgccagcucaucauggccaacccccagaugcagcagcucauccagcgcaaccccgagaucucccacaugcucaacaaccccgacaucaugcgccagacccucgagcucgcccgcaaccccgccaugaugcaggagaugaugcgcaaccaggaccgcgcccucuccaaccucgaguccauccccggcggcuacaacgcccuccgccgcauguacaccgacauccaggagcccaugcucuccgccgcccaggagcaguucggcggcaaccccuucgccucccucgucuccaacaccuccuccggcgagggcucccagcccucccgcaccgagaaccgcgacccccuccccaaccccugggccccccagaccucccaguccuccuccgccuccuccggcaccgccuccaccgucggcggcaccaccggcuccaccgccuccggcaccuccggccaguccaccaccgcccccaaccucguccccggcgucggcgccuccauguucaacacccccggcaugcagucccuccuccagcagaucaccgagaacccccagcucaugcagaacaugcucuccgcccccuacaugcgcuccaugaugcagucccucucccagaaccccgaccucgccgcccagaugaugcucaacaacccccucuucgccggcaacccccagcuccaggagcagaugcgccagcagcuccccaccuuccuccagcagaugcagaaccccgacacccucuccgccauguccaacccccgcgccaugcaggcccuccuccagauccagcagggccuccagacccucgccaccgaggcccccggccucauccccggcuucacccccggccucggcgcccucggcuccaccggcggcuccuccggcaccaacggcuccaacgccacccccuccgagaacaccucccccaccgccggcaccaccgagcccggccaccagcaguucauccagcagaugcuccaggcccucgccggcgucaacccccagcuccagaaccccgagguccgcuuccagcagcagcucgagcagcucuccgccaugggcuuccucaaccgcgaggccaaccuccaggcccucaucgccaccggcggcgacaucaacgccgccaucgagcgccuccucggcucccagcccuccuga

SEQ ID NO: 51435 - RNA, 1875 nt, Artificial Sequence
  derived and/or modified sequence opt2 from UBQLN2__Homo_sapiens__NP_038472
auggccgagaacggcgaguccuccggccccccccgccccucccgcggccccgccgccgcccagggcuccgccgccgcccccgccgagcccaagaucaucaaggucaccgucaagacccccaaggagaaggaggaguucgccguccccgagaacuccuccguccagcaguucaaggaggccaucuccaagcgcuucaagucccagaccgaccagcucguccucaucuucgccggcaagauccucaaggaccaggacacccucauccagcacggcauccacgacggccucaccguccaccucgucaucaagucccagaaccgcccccagggccaguccacccagcccuccaacgccgccggcaccaacaccaccuccgccuccaccccccgcuccaacuccacccccaucuccaccaacuccaaccccuucggccucggcucccucggcggccucgccggccucuccucccucggccucuccuccaccaacuucuccgagcuccagucccagaugcagcagcagcucauggccucccccgagaugaugauccagaucauggagaaccccuucguccaguccaugcucuccaaccccgaccucaugcgccagcucaucauggccaacccccagaugcagcagcucauccagcgcaaccccgagaucucccaccuccucaacaaccccgacaucaugcgccagacccucgagaucgcccgcaaccccgccaugaugcaggagaugaugcgcaaccaggaccucgcccucuccaaccucgaguccauccccggcggcuacaacgcccuccgccgcauguacaccgacauccaggagcccaugcucaacgccgcccaggagcaguucggcggcaaccccuucgccuccgucggcuccuccuccuccuccggcgagggcacccagcccucccgcaccgagaaccgcgacccccuccccaaccccugggcccccccccccgccacccaguccuccgccaccaccuccaccaccaccuccaccggcuccggcuccggcaacuccuccuccaacgccaccggcaacaccgucgccgccgccaacuacgucgccuccaucuucuccacccccggcaugcagucccuccuccagcagaucaccgagaacccccagcucauccagaacaugcucuccgcccccuacaugcgcuccaugaugcagucccucucccagaaccccgaccucgccgcccagaugaugcucaacuccccccucuucaccgccaacccccagcuccaggagcagaugcgcccccagcuccccgccuuccuccagcagaugcagaaccccgacacccucuccgccauguccaacccccgcgccaugcaggcccucaugcagauccagcagggccuccagacccucgccaccgaggcccccggccucauccccuccuucacccccggcgucggcgucggcguccucggcaccgccaucggccccgucggccccgucacccccaucggccccaucggccccaucguccccuucacccccaucggccccaucggccccaucggccccaccggccccgccgccccccccggcuccaccggcuccggcggccccaccggccccaccgucuccuccgccgcccccuccgagaccaccucccccaccuccgaguccggccccaaccagcaguucauccagcagaugguccaggcccucgccggcgccaacgccccccagcuccccaaccccgagguccgcuuccagcagcagcucgagcagcucaacgccaugggcuuccucaaccgcgaggccaaccuccaggcccucaucgccaccggcggcgacaucaacgccgccaucgagcgccuccucggcucccagcccuccuga

SEQ ID NO: 51436 - RNA, 1428 nt, Artificial Sequence
  derived and/or modified sequence opt2 from UBQLNL__Homo_sapiens__NP_659490
auguggcacgccaucucccgcaccucccgcaugucccaguccggcugccccuccggccuccucgccgacaagaacaucuccuccuccgccacccgcgucaucgucaagaccgccggcaaccagaaggacuucauggucgccgacgacaucuccguccgccaguucaaggagaugcuccucgcccacuuccagugccagauggaccagcucguccucgucuucaugggcugccuccucaaggaccacgacacccucucccagcgcggcaucauggacggccacaccaucuaccucgucaucaaguccaagcagggcucccgcucccucgcccacuccuuccgcgaccuccccaccaacgaccccugccaccgcgaccgcaacaccaagggcaacuccucccgcguccaccagcccaccggcaugaaccaggcccccgucgagcucgcccacuucgucggcuccgacgcccccaagguccacacccagaaccucgaggucucccaccccgagugcaaggcccagaugcucgagaaccccuccauccagcgccuccucuccaacauggaguucauguggcaguucaucuccgagcaccucgacacccagcagcucaugcagcagaaccccgaggucucccgccuccuccucgacaacuccgagauccuccuccagacccucgagcucgcccgcaaccucgccaugauccaggagaucaugcagauccagcagcccucccagaaccucgaguacccccucaacccccagcccuaccucggccucgagaccaugcccggcggcaacaacgcccucggccagaacuacgccgacaucaacgaccagaugcucaacuccaugcaggaccccuucggcggcaaccccuucaccgcccuccucgccggccagguccucgagcagguccaguccuccccccccccccccccccccucccaggagcagcaggaccagcucacccagcaccccgccacccgcgucaucuacaacuccuccggcggcuucuccuccaacaccuccgccaacgacacccucaacaaggucaaccacaccuccaaggccaacaccgccaugaucuccaccaagggccagucccacaucugcgccacccgccagcccgccuggauccccgcccuccccuccaucgagcucacccagcagcuccaggaggaguacaaggacgccaccgucucccucuccuccucccgccagacccucaagggcgaccuccagcucuccgacgagcaguccuccucccagaucaccggcggcaugaugcagcuccucaugaacaaccccuaccucgccgcccagaucaugcucuucaccuccaugccccagcucuccgagcaguggcgccagcagcuccccaccuuccuccagcagacccagaucuccgaccuccucuccgccuga

SEQ ID NO: 51437 - RNA, 5250 nt, Artificial Sequence
  derived and/or modified sequence opt2 from UBR1__Homo_sapiens__NP_777576
auggccgacgaggaggccggcggcaccgagcgcauggagaucuccgccgagcucccccagaccccccagcgccucgccuccuggugggaccagcaggucgacuucuacaccgccuuccuccaccaccucgcccagcucguccccgagaucuacuucgccgagauggaccccgaccucgagaagcaggaggaguccguccagauguccaucuucaccccccucgagugguaccucuucggcgaggaccccgacaucugccucgagaagcucaagcacuccggcgccuuccagcucugcggccgcgucuucaaguccggcgagaccaccuacuccugccgcgacugcgccaucgaccccaccugcguccucugcauggacugcuuccaggacuccguccacaagaaccaccgcuacaagaugcacaccuccaccggcggcggcuucugcgacugcggcgacaccgaggccuggaagaccggccccuucugcgucaaccacgagcccggccgcgccggcaccaucaaggagaacucccgcugcccccucaacgaggaggucaucguccaggcccgcaagaucuuccccuccgucaucaaguacgucgucgagaugaccaucugggaggaggagaaggagcucccccccgagcuccagauccgcgagaagaacgagcgcuacuacugcguccucuucaacgacgagcaccacuccuacgaccacgucaucuacucccuccagcgcgcccucgacugcgagcucgccgaggcccagcuccacaccaccgccaucgacaaggagggccgccgcgccgucaaggccggcgccuacgccgccugccaggaggccaaggaggacaucaagucccacuccgagaacgucucccagcacccccuccacgucgagguccuccacuccgagaucauggcccaccagaaguucgcccuccgccucggcuccuggaugaacaagaucauguccuacuccuccgacuuccgccagaucuucugccaggccugccuccgcgaggagcccgacuccgagaaccccugccucaucucccgccucaugcucugggacgccaagcucuacaagggcgcccgcaagauccuccacgagcucaucuucuccuccuucuucauggagauggaguacaagaagcucuucgccauggaguucgucaaguacuacaagcagcuccagaaggaguacaucuccgacgaccacgaccgcuccaucuccaucaccgcccucuccguccagauguucaccguccccacccucgcccgccaccucaucgaggagcagaacgucaucuccgucaucaccgagacccuccucgagguccuccccgaguaccucgaccgcaacaacaaguucaacuuccagggcuacucccaggacaagcucggccgcgucuacgccgucaucugcgaccucaaguacauccucaucuccaagcccaccaucuggaccgagcgccuccgcaugcaguuccucgagggcuuccgcuccuuccucaagauccucaccugcaugcagggcauggaggagauccgccgccaggucggccagcacaucgaggucgaccccgacugggaggccgccaucgccauccagaugcagcucaagaacauccuccucauguuccaggaguggugcgccugcgacgaggagcuccuccucgucgccuacaaggagugccacaaggccgucaugcgcugcuccaccuccuucaucuccuccuccaagaccgucguccaguccugcggccacucccucgagaccaaguccuaccgcgucuccgaggaccucgucuccauccaccucccccucucccgcacccucgccggccuccacguccgccucucccgccucggcgccgucucccgccuccacgaguucgucuccuucgaggacuuccaggucgagguccucgucgaguacccccuccgcugccucguccucgucgcccaggucgucgccgagauguggcgccgcaacggccucucccucaucucccaggucuucuacuaccaggacgucaagugccgcgaggagauguacgacaaggacaucaucaugcuccagaucggcgccucccucauggaccccaacaaguuccuccuccucguccuccagcgcuacgagcucgccgaggccuucaacaagaccaucuccaccaaggaccaggaccucaucaagcaguacaacacccucaucgaggagaugcuccagguccucaucuacaucgucggcgagcgcuacguccccggcgucggcaacgucaccaaggaggaggucaccaugcgcgagaucauccaccuccucugcaucgagcccaugccccacuccgccaucgccaagaaccuccccgagaacgagaacaacgagaccggccucgagaacgucaucaacaaggucgccaccuucaagaagcccggcgucuccggccacggcgucuacgagcucaaggacgagucccucaaggacuucaacauguacuucuaccacuacuccaagacccagcacuccaaggccgagcacaugcagaagaagcgccgcaagcaggagaacaaggacgaggcccucccccccccccccccccccgaguucugccccgccuucuccaaggucaucaaccuccucaacugcgacaucaugauguacauccuccgcaccgucuucgagcgcgccaucgacaccgacuccaaccucuggaccgagggcaugcuccagauggccuuccacauccucgcccucggccuccucgaggagaagcagcagcuccagaaggcccccgaggaggaggucaccuucgacuucuaccacaaggccucccgccucggcuccuccgccaugaacauccagaugcuccucgagaagcucaagggcaucccccagcucgagggccagaaggacaugaucaccuggauccuccagauguucgacaccgucaagcgccuccgcgagaaguccugccucaucgucgccaccaccuccggcuccgaguccaucaagaacgacgagaucacccacgacaaggagaaggccgagcgcaagcgcaaggccgaggccgcccgccuccaccgccagaagaucauggcccagauguccgcccuccagaagaacuucaucgagacccacaagcucauguacgacaacaccuccgagaugcccggcaaggaggacuccaucauggaggaggaguccacccccgccgucuccgacuacucccgcaucgcccucggccccaagcgcggccccuccgucaccgagaaggagguccucaccugcauccucugccaggaggagcaggaggucaagaucgagaacaacgccaugguccucuccgccugcguccagaaguccaccgcccucacccagcaccgcggcaagcccaucgagcucuccggcgaggcccucgacccccucuucauggaccccgaccucgccuacggcaccuacaccggcuccugcggccacgucaugcacgccgucugcuggcagaaguacuucgaggccguccagcucuccucccagcagcgcauccacgucgaccucuucgaccucgaguccggcgaguaccucugcccccucugcaagucccucugcaacaccgucauccccaucaucccccuccagccccagaagaucaacuccgagaacgccgacgcccucgcccagcuccucacccucgcccgcuggauccagaccguccucgcccgcaucuccggcuacaacauccgccacgccaagggcgagaaccccauccccaucuucuucaaccagggcaugggcgacuccacccucgaguuccacuccauccucuccuucggcgucgaguccuccaucaaguacuccaacuccaucaaggagauggucauccucuucgccaccaccaucuaccgcaucggccucaaggucccccccgacgagcgcgacccccgcguccccaugcucaccugguccaccugcgccuucaccauccaggccaucgagaaccuccucggcgacgagggcaagccccucuucggcgcccuccagaaccgccagcacaacggccucaaggcccucaugcaguucgccgucgcccagcgcaucaccugcccccagguccucauccagaagcaccucguccgccuccucuccgucguccuccccaacaucaaguccgaggacacccccugccuccucuccaucgaccucuuccacguccucgucggcgccguccucgccuuccccucccucuacugggacgaccccgucgaccuccagcccuccuccgucuccuccuccuacaaccaccucuaccucuuccaccucaucaccauggcccacaugcuccagauccuccucaccgucgacaccggccucccccucgcccagguccaggaggacuccgaggaggcccacuccgccuccuccuucuucgccgagaucucccaguacaccuccggcuccaucggcugcgacauccccggcugguaccucugggucucccucaagaacggcaucacccccuaccuccgcugcgccgcccucuucuuccacuaccuccucggcgucaccccccccgaggagcuccacaccaacuccgccgagggcgaguacuccgcccucugcuccuaccucucccuccccaccaaccucuuccuccucuuccaggaguacugggacaccguccgcccccuccuccagcgcuggugcgccgaccccgcccuccucaacugccucaagcagaagaacaccgucguccgcuacccccgcaagcgcaacucccucaucgagcuccccgacgacuacuccugccuccucaaccaggccucccacuuccgcugcccccgcuccgccgacgacgagcgcaagcaccccguccucugccucuucugcggcgccauccucugcucccagaacaucugcugccaggagaucgucaacggcgaggaggucggcgccugcaucuuccacgcccuccacugcggcgccggcgucugcaucuuccucaagauccgcgagugccgcgucguccucgucgagggcaaggcccgcggcugcgccuaccccgcccccuaccucgacgaguacggcgagaccgaccccggccucaagcgcggcaacccccuccaccucucccgcgagcgcuaccgcaagcuccaccucgucuggcagcagcacugcaucaucgaggagaucgcccgcucccaggagaccaaccagaugcucuucggcuucaacuggcagcuccucuga

SEQ ID NO: 51438 - RNA, 5667 nt, Artificial Sequence
  derived and/or modified sequence opt2 from UBR3__Homo_sapiens__NP_742067
auggccgccgccgccgccgccgccgucggcggccagcagcccucccagcccgagcuccccgcccccggccucgcccucgacaaggccgccaccgccgcccaccucaaggccgcccucucccgccccgacaaccgcgccggcgccgaggagcuccaggcccuccucgagcgcguccucuccgccgagcgcccccucgccgccgccgccggcggcgaggacgccgccgccgccggcggcggcggcggccccggcgccgccgaggaggaggcccucgaguggugcaagugccuccucgccggcggcggcggcuacgacgaguucugcgccgccguccgcgccuacgaccccgccgcccucugcggccucgucuggaccgccaacuucgucgccuaccgcugccgcaccugcggcaucucccccugcaugucccucugcgccgagugcuuccaccagggcgaccacaccggccacgacuucaacauguuccgcucccaggccggcggcgccugcgacugcggcgacuccaacgucaugcgcgaguccggcuucugcaagcgccaccagaucaaguccuccuccaacauccccugcguccccaaggaccuccucaugauguccgaguucguccucccccgcuucaucuucugccucauccaguaccuccgcgagggcuacaacgagcccgccgccgacggccccuccgagaaggaccucaacaagguccuccagcuccucgagccccagaucuccuuccucgaggaccucaccaagaugggcggcgccaugcgcuccguccucacccagguccucaccaaccagcagaacuacaaggaccucaccuccggccucggcgagaacgccugcgucaagaagucccacgagaaguaccucaucgcccucaaguccuccggccucaccuaccccgaggacaagcucgucuacggcguccaggagcccuccgccggcaccuccucccucgccguccagggcuucaucggcgccaccggcacccucggccaggucgacuccuccgacgaggacgaccaggacggcucccagggccucggcaagcgcaagcgcgucaagcucuccuccggcaccaaggaccaguccaucauggacguccucaagcacaaguccuuccucgaggagcuccucuucuggaccaucaaguacgaguucccccagaagauggucaccuuccuccucaacaugcuccccgaccaggaguacaaggucgccuucaccaagaccuucguccagcacuacgccuucaucaugaagacccucaagaagucccacgaguccgacaccauguccaaccgcaucguccacaucuccguccagcucuucuccaacgaggagcucgcccgccaggucaccgaggagugccagcuccucgacaucauggucaccguccuccucuacaugauggaguccugccucaucaaguccgagcuccaggacgaggagaacucccuccacgucgucgucaacugcggcgaggcccuccucaagaacaacaccuacuggccccucgucuccgacuucaucaacauccucucccaccaguccgucgccaagcgcuuccucgaggaccacggccuccucgucaccuggaugaacuucgucuccuucuuccagggcaugaaccucaacaagcgcgagcucaacgagcacgucgaguucgagucccagaccuacuacgccgccuucgccgccgagcucgaggccugcgcccagcccauguggggccuccucucccacugcaagguccgcgagacccaggaguacacccgcaacgucguccgcuacugccucgaggcccuccaggacugguucgacgccaucaacuucgucgacgagcccgcccccaaccaggucaccuuccaccucccccuccaccgcuacuacgccauguuccucuccaaggccgucaagugccaggagcucgaccucgacuccguccuccccgaccaggagaugcucaugaagcucaugauccacccccuccagauccaggccucccucgccgagauccacuccaacauguggguccgcaacggccuccagaucaagggccaggccaugaccuacguccagucccacuucugcaacuccaugaucgaccccgacaucuaccuccuccaggucugcgccucccgccucgaccccgacuacuucaucuccuccgucuucgagcgcuucaaggucgucgaccuccucaccauggccucccagcaccagaacaccguccucgacgccgagcacgagcgcuccaugcucgagggcgcccucaccuuccucgucauccuccucucccuccgccuccaccucggcauguccgacgacgagauccuccgcgccgagauggucgcccagcucugcaugaacgaccgcacccacuccucccuccucgaccucauccccgagaaccccaaccccaaguccggcaucauccccggcuccuacuccuucgaguccguccucuccgccgucgccgacuucaaggcccccgucuucgagcccggcggcuccaugcagcagggcauguacacccccaaggccgaggucugggaccaggaguucgaccccgucauggucauccuccgcaccgucuaccgccgcgacguccaguccgccauggaccgcuacaccgccuuccucaagcaguccggcaaguuccccggcaaccccuggccccccuacaagaagcgcaccucccuccaccccuccuacaagggccucaugcgccuccuccacugcaagacccuccacaucguccucuucacccuccucuacaagauccucauggaccaccagaaccucuccgagcacguccucugcaugguccucuaccucaucgagcucggccucgagaacuccgccgaggaggaguccgacgaggaggccuccgucggcggccccgagcgcugccacgacuccugguuccccggcuccaaccucgucuccaacaugcgccacuucaucaacuacguccgcguccgcguccccgagaccgcccccgaggucaagcgcgacucccccgccuccaccuccuccgacaaccucggcucccuccagaacuccggcaccgcccaggucuucucccucgucgccgagcgccgcaagaaguuccaggagaucaucaaccgcuccuccuccgaggccaaccaggucguccgccccaagaccuccuccaagugguccgcccccggcuccgccccccagcucaccaccgccauccucgagaucaaggaguccauccucucccuccucaucaagcuccaccacaagcucuccggcaagcagaacuccuacuacccccccuggcucgacgacaucgagauccucauccagcccgagauccccaaguacucccacggcgacggcaucaccgccgucgagcgcauccuccucaaggccgccucccagucccgcaugaacaagcgcaucaucgaggagaucugccgcaaggucaccccccccgucccccccaagaaggucaccgccgccgagaagaagacccucgacaaggaggagcgccgccagaaggcccgcgagcgccagcagaagcuccucgccgaguucgccucccgccagaaguccuucauggagaccgccauggacgucgacucccccgagaacgacauccccauggagaucaccaccgccgagccccaggucuccgaggccgucuacgacugcgucaucugcggccaguccggccccuccuccgaggaccgccccaccggccucgucguccuccuccaggccuccuccguccucggccagugccgcgacaacgucgagcccaagaagcuccccaucuccgaggaggagcagaucuaccccugggacaccugcgccgccguccacgacguccgccucucccuccuccagcgcuacuucaaggacuccuccugccuccucgccgucuccaucggcugggagggcggcgucuacguccagaccugcggccacacccuccacaucgacugccacaaguccuacauggagucccuccgcaacgaccagguccuccagggcuucuccgucgacaagggcgaguucaccugcccccucugccgccaguucgccaacuccguccuccccugcuaccccggcuccaacgucgagaacaaccccuggcagcgccccuccaacaaguccauccaggaccucaucaaggaggucgaggagcuccagggccgccccggcgccuuccccuccgagaccaaccucuccaaggagauggaguccgucaugaaggacaucaagaacaccacccagaagaaguaccgcgacuacuccaagacccccggcucccccgacaacgacuuccucuucauguacuccgucgcccgcaccaaccucgagcucgagcucauccaccgcggcggcaaccucugcuccggcggcgccuccaccgccggcaagcgcuccugccucaaccagcucuuccacguccucgcccuccacaugcgccucuacuccaucgacuccgaguacaaccccuggcgcaagcucacccagcucgaggagaugaacccccagcucggcuacgaggagcagcagcccgagguccccauccucuaccacgacgucaccucccuccuccucauccagauccucaugaugccccagccccuccgcaaggaccacuucaccugcaucgucaagguccucuucacccuccucuacacccaggcccucgccgcccucuccgucaagugcuccgaggaggaccgcuccgccuggaagcacgccggcgcccucaagaaguccaccugcgacgccgagaaguccuacgagguccuccucuccuucgucaucuccgagcucuucaagggcaagcucuaccacgaggagggcacccaggagugcgccauggucaaccccaucgccuggucccccgaguccauggagaagugccuccaggacuucugccuccccuuccuccgcaucaccucccuccuccagcaccaccucuucggcgaggaccuccccuccugccaggaggaggaggaguucuccguccucgccuccugccucggccuccuccccaccuucuaccagaccgagcaccccuucaucuccgccuccugccucgacuggcccguccccgccuucgacaucaucacccaguggugcuucgagaucaaguccuucaccgagcgccacgccgagcagggcaaggcccuccucauccaggaguccaaguggaagcucccccaccuccuccagcuccccgagaacuacaacaccaucuuccaguacuaccaccgcaagaccugcuccgucugcaccaagguccccaaggaccccgccgucugccucgucugcggcaccuucgucugccucaagggccucugcugcaagcagcaguccuacugcgagugcguccuccacucccagaacugcggcgccggcaccggcaucuuccuccucaucaacgccuccgucaucaucaucauccgcggccaccgcuucugccucuggggcuccgucuaccucgacgcccacggcgaggaggaccgcgaccuccgccgcggcaagccccucuacaucugcaaggagcgcuacaagguccucgagcagcaguggaucucccacaccuucgaccacaucaacaagcgcuggggcccccacuacaacggccucuga

SEQ ID NO: 51439 - RNA, 15705 nt, Artificial Sequence
  derived and/or modified sequence opt2 from UBR4__Homo_sapiens__XP_011539410
auggccaccuccggcggcgaggaggccgccgccgccgcccccgcccccggcacccccgccaccggcgccgacaccacccccggcugggaggucgccguccgcccccuccucuccgccuccuacuccgccuucgagaugaaggagcucccccagcucgucgccuccgucaucgaguccgaguccgagauccuccaccacgagaagcaguacgagcccuucuacuccuccuucgucgcccucuccacccacuacaucaccaccgucugcucccucaucccccgcaaccagcuccaguccgucgccgccgccugcaagguccucaucgaguucucccuccuccgccucgagaaccccgacgaggccugcgccgucucccagaagcaccucauccuccucaucaagggccucugcaccggcugcucccgccucgaccgcaccgagaucaucaccuucaccgccaugaugaaguccgccaagcucccccagaccgucaagacccucuccgacgucgaggaccagaaggagcucgccucccccgucucccccgagcuccgccagaaggagguccagaugaacuuccucaaccagcucaccuccgucuucaacccccgcaccgucgccucccagcccaucuccacccagacccucgucgagggcgagaacgacgagcaguccuccaccgaccaggccuccgccaucaagaccaagaacgucuucaucgcccagaacgucgccucccuccaggagcucggcggcuccgagaagcuccuccgcgucugccucaaccuccccuacuuccuccgcuacaucaaccgcuuccaggacgccguccucgccaacuccuucuucaucaugcccgccaccgucgccgacgccaccgccguccgcaacggcuuccacucccucgucaucgacgucaccauggcccucgacacccucucccuccccguccucgagccccucaaccccucccgccuccaggacgucaccguccucucccucuccugccucuacgccggcgucuccgucgccaccugcauggccauccuccacgucggcuccgcccagcagguccgcaccggcuccaccuccuccaaggaggacgacuacgaguccgacgccgccaccaucguccagaagugccucgagaucuacgacaugaucggccaggccaucuccuccucccgccgcgccggcggcgagcacuaccagaacuuccagcuccucggcgccuggugccuccucaacucccucuuccucauccucaaccucucccccaccgcccucgccgacaagggcaaggagaaggacccccucgccgcccuccgcguccgcgacauccucucccgcaccaaggagggcgucggcucccccaagcucggccccggcaagggccaccagggcuucggcguccucuccgucauccucgccaaccacgccaucaagcuccucaccucccucuuccaggaccuccaggucgaggcccuccacaagggcugggagaccgacggcccccccgccgcccucuccaucauggcccaguccaccuccauccagcgcauccagcgccucaucgacuccgucccccucaugaaccuccuccucacccuccucuccaccuccuaccgcaaggccugcguccuccagcgccagcgcaagggcuccauguccuccgacgccuccgccuccaccgacuccaacaccuacuacgaggacgacuucuccuccaccgaggaggacuccucccaggacgacgacuccgagcccauccucggccagugguucgaggagaccaucucccccuccaaggagaaggccgccccccccccccccccccccccccccccccucgaguccuccccccgcgucaagucccccuccaagcaggcccccggcgagaagggcaacauccucgccucccgcaaggaccccgagcucuuccucggccucgccuccaacauccucaacuucaucaccuccuccaugcucaacucccgcaacaacuucauccgcaacuaccucuccgucucccucuccgagcaccacauggccacccucgccuccaucaucaaggaggucgacaaggacggccucaagggcuccuccgacgaggaguucgccgccgcccucuaccacuucaaccacucccucgucaccuccgaccuccagucccccaaccuccagaacacccuccuccagcagcucggcgucgcccccuucuccgagggccccuggccccucuacauccacccccagucccucuccguccucucccgccuccuccucaucuggcagcacaaggccuccgcccagggcgaccccgacguccccgagugccucaaggucugggaccgcuuccucuccaccaugaagcagaacgcccuccagggcgucguccccuccgagaccgaggaccucaacgucgagcaccuccagaugcuccuccucaucuuccacaacuucaccgagaccggccgccgcgccauccucucccucuucguccagaucauccaggagcucuccgucaacauggacgcccagaugcgcuucgucccccucauccucgcccgccuccuccucaucuucgacuaccuccuccaccaguacuccaaggcccccgucuaccucuucgagcagguccagcacaaccuccucuccccccccuucggcugggccuccggcucccaggacuccaacucccgccgcgccaccaccccccucuaccacggcuucaaggaggucgaggagaacugguccaagcacuucuccuccgacgccgucccccacccccgcuucuacugcguccucucccccgaggccuccgaggacgaccucaaccgccucgacuccgucgccugcgacguccucuucuccaagcucgucaaguacgacgagcucuacgccgcccucaccgcccuccucgccgccggcucccagcucgacaccguccgccgcaaggagaacaagaacgucaccgcccucgaggccugcgcccuccaguacuacuuccucauccucuggcgcauccucggcauccucccccccuccaagaccuacaucaaccagcucuccaugaacucccccgagauguccgagugcgacauccuccacacccuccgcugguccucccgccuccgcaucuccuccuacgucaacuggaucaaggaccaccucaucaagcagggcaugaaggccgagcacgccuccucccuccucgagcucgccuccaccaccaagugcuccuccgucaaguacgacgucgagaucgucgaggaguacuucgcccgccagaucuccuccuucugcuccaucgacugcaccaccauccuccagcuccacgagauccccucccuccaguccaucuacacccucgacgccgccaucuccaagguccaggucucccucgacgagcacuucuccaagauggccgccgagaccgacccccacaaguccuccgagaucaccaagaaccuccuccccgccacccuccagcucaucgacaccuacgccuccuucacccgcgccuaccuccuccagaacuucaacgaggagggcaccaccgagaagcccuccaaggagaagcuccagggcuucgccgccguccucgccaucggcuccucccgcugcaaggccaacacccucggccccacccucguccagaaccuccccuccuccguccagaccgucugcgaguccuggaacaacaucaacaccaacgaguuccccaacaucggcuccuggcgcaacgccuucgccaacgacaccauccccuccgaguccuacaucuccgccguccaggccgcccaccucggcacccucugcucccagucccucccccucgccgccucccucaagcacacccuccucucccucguccgccucaccggcgaccucaucgucugguccgacgagaugaaccccccccaggucauccgcacccuccucccccuccuccucgaguccuccaccgaguccgucgccgagaucuccuccaacucccucgagcgcauccucggccccgccgaguccgacgaguuccucgcccgcgucuacgagaagcucaucaccggcugcuacaacauccucgccaaccacgccgaccccaacuccggccucgacgaguccauccucgaggagugccuccaguaccucgagaagcagcucgaguccucccaggcccgcaaggccauggaggaguucuucuccgacuccggcgagcucguccagaucaugauggccaccgccaacgagaaccucuccgccaaguucugcaaccgcguccucaaguucuucaccaagcucuuccagcucaccgagaagucccccaaccccucccuccuccaccucugcggcucccucgcccagcucgccugcgucgagcccguccgccuccaggccuggcucacccgcaugaccaccuccccccccaaggacuccgaccagcucgacgucauccaggagaaccgccagcuccuccagcuccucaccaccuacaucguccgcgagaacucccaggucggcgagggcgucugcgccguccuccucggcacccucacccccauggccaccgagaugcucgccaacggcgacggcaccggcuuccccgagcucauggucgucauggccacccucgccuccgccggccagggcgccggccaccuccagcuccacaacgccgccgucgacuggcucucccgcugcaagaaguaccucucccagaagaacgucgucgagaagcucaacgccaacgucaugcacggcaagcacgucaugauccucgagugcaccugccacaucauguccuaccucgccgacgucaccaacgcccucucccaguccaacggccagggccccucccaccucuccgucgacggcgaggagcgcgccaucgaggucgacuccgacugggucgaggagcucgccgucgaggaggaggacucccaggccgaggacuccgacgaggacucccucugcaacaagcucugcaccuucaccaucacccagaaggaguucaugaaccagcacugguaccacugccacaccugcaagauggucgacggcgucggcgucugcaccgucugcgccaaggucugccacaaggaccacgagaucuccuacgccaaguacggcuccuucuucugcgacugcggcgccaaggaggacggcuccugccucgcccucgucaagcgcacccccuccuccggcauguccuccaccaugaaggaguccgccuuccaguccgagccccgcaucuccgagucccucguccgccacgccuccaccuccucccccgccgacaaggccaaggucaccaucuccgacggcaaggucgccgacgaggagaagcccaagaaguccucccucugccgcaccgucgagggcugccgcgaggagcuccagaaccaggccaacuucuccuucgccccccucguccucgacaugcucaacuuccucauggacgccauccagaccaacuuccagcaggccuccgccgucggcuccuccucccgcgcccagcaggcccucuccgagcuccacaccgucgagaaggccgucgagaugaccgaccagcucaugguccccacccucggcucccaggagggcgccuucgagaacguccgcaugaacuacuccggcgaccagggccagaccauccgccagcucaucuccgcccacguccuccgccgcgucgccaugugcguccucuccuccccccacggccgccgccagcaccucgccgucucccacgagaagggcaagaucaccguccuccagcucuccgcccuccucaagcaggccgacuccuccaagcgcaagcucacccucacccgccucgccuccgcccccguccccuucaccguccucucccucaccggcaaccccugcaaggaggacuaccucgccgucugcggccucaaggacugccacguccucaccuucuccuccuccggcuccgucuccgaccaccucguccuccacccccagcucgccaccggcaacuucaucaucaaggccgucuggcuccccggcucccagaccgagcucgccaucgucaccgccgacuucgucaagaucuacgaccucugcgucgacgcccucucccccaccuucuacuuccuccuccccuccuccaagauccgcgacgucaccuuccucuucaacgaggagggcaagaacaucaucgucaucauguccuccgccggcuacaucuacacccagcucauggaggaggccuccuccgcccagcagggccccuucuacgucaccaacguccucgagaucaaccacgaggaccucaagcaggacuccaacucccaggucgccggcggcggcgucuccgucuacuacucccacguccuccagaugcucuucuucuccuacugccagggcaaguccuucgccgccaccaucucccgcaccacccucgagguccuccagcucuuccccaucaacaucaaguccuucgucgucugcuccuccaacggcggcuccaagaccucccccgcccucugccagugguccgaggucaugaaccaccccggccucgucugcugcguccagcagaccaccggcgucccccucgucgucauggucaagcccgacaccuuccucauccaggagaucaagacccuccccgccaaggccaagauccaggacauggucgccauccgccacaccgccugcaacgagcagcagcgcaccaccaugauccuccucugcgaggacggcucccuccgcaucuacauggccaacgucgagaacaccuccuacuggcuccagcccucccuccagcccuccuccgucaucuccaucaugaagcccguccgcaagcgcaagaccgccaccaucaccacccgcaccuccucccaggucaccuuccccaucgacuucuucgagcacaaccagcagcucaccgacgucgaguucggcggcaacgaccuccuccaggucuacaacgcccagcagaucaagcaccgccucaacuccaccggcauguacgucgccaacaccaagcccggcggcuucaccaucgagaucuccaacaacaacuccaccauggucaugaccggcaugcgcauccagaucggcacccaggccaucgagcgcgcccccuccuacaucgagaucuucggccgcaccaugcagcucaaccucucccgcucccgcugguucgacuuccccuucacccgcgaggaggcccuccaggccgacaagaagcucaaccucuucaucggcgccuccgucgaccccgccggcgucaccaugaucgacgccgucaagaucuacggcaagaccaaggagcaguucggcuggcccgacgagccccccgaggaguuccccuccgccuccgucuccaacaucugccccuccaaccucaaccaguccaacggcaccggcgacuccgacuccgccgcccccaccaccaccuccggcaccguccucgaguccuccgagaccgagucccucaccaagcucgaccgccucgucgucuccucccucgaggcccucgaguccugcuucgccgucggccccaucaucgagaaggagcgcaacaagaacgccgcccaggagcucgccacccuccuccucucccuccccgcccccgccuccguccagcagcaguccaagucccuccucgccucccuccacaccucccgcuccgccuaccacucccacaaggaccaggcccuccucuccaaggccguccagugccucaacaccuccuccaaggagggcaaggaccucgaccccgaggucuuccagcgccucgucaucaccgcccgcuccaucgccaucaugcgccccaacaaccucguccacuucaccgaguccaagcucccccagauggagaccgacugcuucuucccccgcugcgccugcuggucccucggcaucgucggcauccucaucggcgccccccucgagacccccucccccgagggcauggacgagggcaaggagccccagaagcagcucgagggcgacugcugcuccuucaucacccagcucgucaaccacuucuggaagcuccacgccuccaagcccaagaacgccuuccucgcccccgccugccuccccggccucacccacaucgaggccaccgucaacgcccucgucgacaucauccacggcuacugcaccugcgagcucgacugcaucaacaccgccuccaagaucuacaugcagaugcuccucugccccgaccccgccgucuccuucuccugcaagcaggcccucauccgcguccuccgcccccgcaacaagcgccgccacgucacccuccccuccuccccccgcuccaacacccccaugggcgacaaggacgacgacgacgacgacgacgccgacgagaagaugcaguccuccggcauccccaacggcggccacauccgccaggagucccaggagcaguccgaggucgaccacggcgacuucgagauggucuccgaguccaugguccucgagaccgccgagaacgucaacaacggcaaccccuccccccucgaggcccuccucgccggcgccgagggcuucccccccaugcucgacaucccccccgacgccgacgacgagaccauggucgagcucgccaucgcccucucccuccagcaggaccagcagggcuccuccuccuccgcccucggccuccagucccucggccucuccggccaggcccccuccuccuccucccucgacgccggcacccucuccgacaccaccgccuccgcccucgucacccucuccgcccccgccuccgacgacgagggcuccaccgccgccaccgacggcuccacccuccgcaccucccccgccgaccacggcggcuccgucggcuccgaguccggcggcuccgccgucgacuccgucgccggcgagcacuccgucuccggccgcuccuccgccuacggcgacgccaccgccgagggccaccccgccggccccggcuccgucuccuccuccaccggcgccaucuccaccaccaccggccaccaggagggcgacggcuccgagggcgagggcgagggcgagaccgagggcgacguccacaccuccaaccgccuccacaugguccgccucaugcuccucgagcgccuccuccagacccucccccagcuccgcaacgucggcggcguccgcgccauccccuacaugcaggucauccucaugcucaccaccgaccucgacggcgaggacgagaaggacaagggcgcccucgacaaccuccucucccagcucaucgccgagcucggcauggacaagaaggacgucuccaagaagaacgagcgcuccgcccucaacgagguccaccucgucgucaugcgccuccucuccgucuucaugucccgcaccaaguccggcuccaaguccuccaucugcgaguccuccucccucaucuccuccgccaccgccgccgcccuccucuccuccggcgccgucgacuacugccuccacguccucaagucccuccucgaguacuggaagucccagcagaacgacgaggagcccgucgccaccucccagcuccucaagccccacaccaccuccuccccccccgacaugucccccuucuuccuccgccaguacgucaagggccacgccgccgacgucuucgaggccuacacccagcuccucaccgagaugguccuccgccuccccuaccagaucaagaagaucaccgacaccaacucccgcauccccccccccgucuucgaccacuccugguucuacuuccucuccgaguaccucaugauccagcagacccccuucguccgccgccagguccgcaagcuccuccucuucaucugcggcuccaaggagaaguaccgccagcuccgcgaccuccacacccucgacucccacguccgcggcaucaagaagcuccucgaggagcagggcaucuuccuccgcgccuccgucgucaccgccuccuccggcuccgcccuccaguacgacacccucaucucccucauggagcaccucaaggccugcgccgagaucgccgcccagcgcaccaucaacuggcagaaguucugcaucaaggacgacuccguccucuacuuccuccuccaggucuccuuccucgucgacgagggcgucucccccguccuccuccagcuccucuccugcgcccucugcggcuccaagguccucgccgcccucgccgccuccuccggcuccuccuccgccuccuccuccuccgcccccgucgccgccuccuccggccaggccaccacccaguccaaguccuccaccaagaaguccaagaaggaggagaaggagaaggagaaggacggcgagaccuccggcucccaggaggaccagcucugcaccgcccucgucaaccagcucaacaaguucgccgacaaggagacccucauccaguuccuccgcugcuuccuccucgaguccaacuccuccuccguccgcuggcaggcccacugccucacccuccacaucuaccgcaacuccuccaagucccagcaggagcuccuccucgaccucaugugguccaucuggcccgagcuccccgccuacggccgcaaggccgcccaguucgucgaccuccucggcuacuucucccucaagaccccccagaccgagaagaagcucaaggaguacucccagaaggccgucgagauccuccgcacccagaaccacauccucaccaaccaccccaacuccaacaucuacaacacccucuccggccucgucgaguucgacggcuacuaccucgaguccgaccccugccucgucugcaacaaccccgagguccccuucugcuacaucaagcucuccuccaucaaggucgacacccgcuacaccaccacccagcaggucgucaagcucaucggcucccacaccaucuccaaggucaccgucaagaucggcgaccucaagcgcaccaagaugguccgcaccaucaaccucuacuacaacaaccgcaccguccaggccaucgucgagcucaagaacaagcccgcccgcuggcacaaggccaagaagguccagcucacccccggccagaccgaggucaagaucgaccucccccuccccaucgucgccuccaaccucaugaucgaguucgccgacuucuacgagaacuaccaggccuccaccgagacccuccagugcccccgcugcuccgccuccguccccgccaaccccggcgucugcggcaacugcggcgagaacgucuaccagugccacaagugccgcuccaucaacuacgacgagaaggaccccuuccucugcaacgccugcggcuucugcaaguacgcccgcuucgacuucaugcucuacgccaagcccugcugcgccgucgaccccaucgagaacgaggaggaccgcaagaaggccgucuccaacaucaacacccuccucgacaaggccgaccgcgucuaccaccagcucaugggccaccgcccccagcucgagaaccuccucugcaaggucaacgaggccgcccccgagaagccccaggacgacuccggcaccgccggcggcaucuccuccaccuccgccuccgucaaccgcuacauccuccagcucgcccaggaguacugcggcgacugcaagaacuccuucgacgagcucuccaagaucauccagaaggucuucgccucccgcaaggagcuccucgaguacgaccuccagcagcgcgaggccgccaccaaguccucccgcaccuccguccagcccaccuucaccgccucccaguaccgcgcccucuccguccucggcugcggccacaccuccuccaccaagugcuacggcugcgccuccgccgucaccgagcacugcaucacccuccuccgcgcccucgccaccaaccccgcccuccgccacauccucgucucccagggccucauccgcgagcucuucgacuacaaccuccgccgcggcgccgccgccaugcgcgaggagguccgccagcucaugugccuccucacccgcgacaaccccgaggccacccagcagaugaacgaccucaucaucggcaaggucuccaccgcccucaagggccacugggccaaccccgaccucgccuccucccuccaguacgagaugcuccuccucaccgacuccaucuccaaggaggacuccugcugggagcuccgccuccgcugcgcccucucccucuuccucauggccgucaacaucaagacccccgucgucgucgagaacaucacccucaugugccuccgcauccuccagaagcucaucaagccccccgcccccaccuccaagaagaacaaggacguccccgucgaggcccucaccaccgucaagcccuacugcaacgagauccacgcccaggcccagcucuggcucaagcgcgaccccaaggccuccuacgacgccuggaagaagugccuccccauccgcggcaucgacggcaacggcaaggcccccuccaaguccgagcuccgccaccucuaccucaccgagaaguacgucuggcgcuggaagcaguuccucucccgccgcggcaagcgcaccuccccccucgaccucaagcucggccacaacaacuggcuccgccagguccucuucacccccgccacccaggccgcccgccaggccgccugcaccaucgucgaggcccucgccaccauccccucccgcaagcagcagguccucgaccuccucaccuccuaccucgacgagcucuccaucgccggcgagugcgccgccgaguaccucgcccucuaccagaagcucaucaccuccgcccacuggaaggucuaccucgccgcccgcggcguccuccccuacgucggcaaccucaucaccaaggagaucgcccgccuccucgcccucgaggaggccacccucuccaccgaccuccagcagggcuacgcccucaagucccucaccggccuccucuccuccuucgucgaggucgaguccaucaagcgccacuucaagucccgccucgucggcaccguccucaacggcuaccucugccuccgcaagcucgucguccagcgcaccaagcucaucgacgagacccaggacaugcuccucgagaugcucgaggacaugaccaccggcaccgaguccgagaccaaggccuucauggccgucugcaucgagaccgccaagcgcuacaaccucgacgacuaccgcacccccgucuucaucuucgagcgccucugcuccaucaucuaccccgaggagaacgaggucaccgaguucuucgucacccucgagaaggacccccagcaggaggacuuccuccagggccgcaugcccggcaaccccuacuccuccaacgagcccggcaucggcccccucaugcgcgacaucaagaacaagaucugccaggacugcgaccucgucgcccuccucgaggacgacuccggcauggagcuccucgucaacaacaagaucaucucccucgaccuccccgucgccgaggucuacaagaaggucuggugcaccaccaacgagggcgagcccaugcgcaucgucuaccgcaugcgcggccuccucggcgacgccaccgaggaguucaucgagucccucgacuccaccaccgacgaggaggaggacgaggaggaggucuacaagauggccggcgucauggcccagugcggcggccucgagugcaugcucaaccgccucgccggcauccgcgacuucaagcagggccgccaccuccucaccguccuccucaagcucuucuccuacugcgucaaggucaaggucaaccgccagcagcucgucaagcucgagaugaacacccucaacgucaugcucggcacccucaaccucgcccucgucgccgagcaggaguccaaggacuccggcggcgccgccgucgccgagcagguccucuccaucauggagaucauccucgacgaguccaacgccgagccccucuccgaggacaagggcaaccuccuccucaccggcgacaaggaccagcucgucaugcuccucgaccagaucaacuccaccuucguccgcuccaaccccuccguccuccagggccuccuccgcaucauccccuaccucuccuucggcgaggucgagaagaugcagauccucgucgagcgcuucaagcccuacugcaacuucgacaaguacgacgaggaccacuccggcgacgacaaggucuuccucgacugcuucugcaagaucgccgccggcaucaagaacaacuccaacggccaccagcucaaggaccucauccuccagaagggcaucacccagaacgcccucgacuacaugaagaagcacauccccuccgccaagaaccucgacgccgacaucuggaagaaguuccucucccgccccgcccuccccuucauccuccgccuccuccgcggccucgccauccagcaccccggcacccagguccucaucggcaccgacuccauccccaaccuccacaagcucgagcaggucuccuccgacgagggcaucggcacccucgccgagaaccuccucgaggcccuccgcgagcaccccgacgucaacaagaagaucgacgccgcccgccgcgagacccgcgccgagaagaagcgcauggccauggccaugcgccagaaggcccucggcacccucggcaugaccaccaacgagaagggccaggucgucaccaagaccgcccuccucaagcagauggaggagcucaucgaggagcccggccucaccugcugcaucugccgcgagggcuacaaguuccagcccaccaagguccucggcaucuacaccuucaccaagcgcgucgcccucgaggagauggagaacaagccccgcaagcagcagggcuacuccaccgucucccacuucaacaucguccacuacgacugccaccucgccgccguccgccucgcccgcggccgcgaggagugggaguccgccgcccuccagaacgccaacaccaagugcaacggccuccuccccgucuggggcccccacguccccgaguccgccuucgccaccugccucgcccgccacaacaccuaccuccaggagugcaccggccagcgcgagcccaccuaccagcucaacauccacgacaucaagcuccucuuccuccgcuucgccauggagcaguccuucuccgccgacaccggcggcggcggccgcgaguccaacauccaccucauccccuacaucauccacaccguccucuacguccucaacaccacccgcgccaccucccgcgaggagaagaaccuccagggcuuccucgagcagcccaaggagaagugggucgaguccgccuucgaggucgacggccccuacuacuucaccguccucgcccuccacauccucccccccgagcaguggcgcgccacccgcgucgagauccuccgccgccuccucgucaccucccaggcccgcgccgucgcccccggcggcgccacccgccucaccgacaaggccgucaaggacuacuccgccuaccgcuccucccuccucuucugggcccucgucgaccucaucuacaacauguucaagaagguccccaccuccaacaccgagggcggcugguccugcucccucgccgaguacauccgccacaacgacaugcccaucuacgaggccgccgacaaggcccucaagaccuuccaggaggaguucaugcccgucgagaccuucuccgaguuccucgacgucgccggccuccucuccgagaucaccgaccccgaguccuuccucaaggaccuccucaacuccguccccuga

SEQ ID NO: 51440 - RNA, 8397 nt, Artificial Sequence
  derived and/or modified sequence opt2 from UBR5__Homo_sapiens__NP_001269802
augaccuccauccacuucgucguccacccccuccccggcaccgaggaccagcucaacgaccgccuccgcgaggucuccgagaagcucaacaaguacaaccucaacucccaccccccccucaacguccucgagcaggccaccaucaagcagugcgucgucggccccaaccacgccgccuuccuccucgaggacggccgcgucugccgcaucggcuucuccguccagcccgaccgccucgagcucggcaagcccgacaacaacgacggcuccaagcucaacuccaacuccggcgccggccgcaccucccgccccggccgcaccuccgacucccccugguuccucuccggcuccgagacccucggccgccucgccggcaacacccucggcucccgcugguccuccggcgucggcggcuccggcggcggcuccuccggccgcuccuccgccggcgcccgcgacucccgccgccagacccgcgucauccgcaccggccgcgaccgcggcuccggccuccucggcucccagccccagcccgucauccccgccuccgucauccccgaggagcucaucucccaggcccaggucguccuccagggcaagucccgcuccgucaucauccgcgagcuccagcgcaccaaccucgacgucaaccucgccgucaacaaccuccucucccgcgacgacgaggacggcgacgacggcgacgacaccgccuccgaguccuaccuccccggcgaggaccucaugucccuccucgacgccgacauccacuccgcccaccccuccgucaucaucgacgccgacgccauguucuccgaggacaucuccuacuucggcuaccccuccuuccgccgcuccucccucucccgccucggcuccucccgcguccuccuccucccccucgagcgcgacuccgagcuccuccgcgagcgcgaguccguccuccgccuccgcgagcgccgcuggcucgacggcgccuccuucgacaacgagcgcggcuccaccuccaaggagggcgagcccaaccucgacaagaagaacacccccguccagucccccgucucccucggcgaggaccuccagugguggcccgacaaggacggcaccaaguucaucugcaucggcgcccucuacuccgagcuccucgccgucuccuccaagggcgagcucuaccaguggaagugguccgaguccgagcccuaccgcaacgcccagaaccccucccuccaccacccccgcgccaccuuccucggccucaccaacgagaagaucguccuccucuccgccaacuccauccgcgccaccgucgccaccgagaacaacaaggucgccaccugggucgacgagacccucuccuccgucgccuccaagcucgagcacaccgcccagaccuacuccgagcuccagggcgagcgcaucgucucccuccacugcugcgcccucuacaccugcgcccagcucgagaacucccucuacugguggggcgucguccccuucucccagcgcaagaagaugcucgagaaggcccgcgccaagaacaagaagcccaaguccuccgccggcaucuccuccaugcccaacaucaccgucggcacccaggucugccuccgcaacaacccccucuaccacgccggcgccgucgccuucuccaucuccgccggcauccccaaggucggcguccucauggaguccgucuggaacaugaacgacuccugccgcuuccagcuccgcucccccgagucccucaagaacauggagaaggccuccaagaccaccgaggccaagcccgaguccaagcaggagcccgucaagaccgagaugggccccccccccucccccgccuccaccugcuccgacgccuccuccaucgccuccuccgccuccaugcccuacaagcgccgccgcuccacccccgcccccaaggaggaggagaaggucaacgaggagcaguggucccuccgcgaggucgucuucgucgaggacgucaagaacguccccgucggcaagguccucaaggucgacggcgccuacgucgccgucaaguuccccggcaccuccuccaacaccaacugccagaacuccuccggccccgacgccgaccccuccucccuccuccaggacugccgccuccuccgcaucgacgagcuccaggucgucaagaccggcggcacccccaagguccccgacugcuuccagcgcacccccaagaagcucugcauccccgagaagaccgagauccucgccgucaacgucgacuccaagggcguccacgccguccucaagaccggcaacuggguccgcuacugcaucuucgaccucgccaccggcaaggccgagcaggagaacaacuuccccaccuccuccaucgccuuccucggccagaacgagcgcaacgucgccaucuucaccgccggccaggagucccccaucauccuccgcgacggcaacggcaccaucuaccccauggccaaggacugcaugggcggcauccgcgaccccgacuggcucgaccucccccccaucuccucccucggcaugggcguccacucccucaucaaccuccccgccaacuccaccaucaagaagaaggccgccgucaucaucauggccgucgagaagcagacccucaugcagcacauccuccgcugcgacuacgaggccugccgccaguaccucaugaaccucgagcaggccgucguccucgagcagaaccuccagaugcuccagaccuucaucucccaccgcugcgacggcaaccgcaacauccuccacgccugcgucuccgucugcuuccccaccuccaacaaggagaccaaggaggaggaggaggccgagcgcuccgagcgcaacaccuucgccgagcgccucuccgccgucgaggccaucgccaacgccaucuccgucgucuccuccaacggccccggcaaccgcgccggcuccuccuccucccgcucccuccgccuccgcgagaugaugcgccgcucccuccgcgccgccggccucggccgccacgaggccggcgccuccuccuccgaccaccaggaccccgucuccccccccaucgccccccccuccuggguccccgacccccccgccauggaccccgacggcgacaucgacuucauccucgcccccgccgucggcucccucaccaccgccgccaccggcaccggccagggccccuccaccuccaccauccccggccccuccaccgagcccuccgucgucgaguccaaggaccgcaaggccaacgcccacuucauccucaagcuccucugcgacuccgucguccuccagcccuaccuccgcgagcuccucuccgccaaggacgcccgcggcaugacccccuucauguccgccgucuccggccgcgccuaccccgccgccaucaccauccucgagaccgcccagaagaucgccaaggccgagaucuccuccuccgagaaggaggaggacgucuucaugggcauggucugccccuccggcaccaaccccgacgacuccccccucuacguccucugcugcaacgacaccugcuccuucaccuggaccggcgccgagcacaucaaccaggacaucuucgagugccgcaccugcggccuccucgagucccucugcugcugcaccgagugcgcccgcgucugccacaagggccacgacugcaagcucaagcgcaccucccccaccgccuacugcgacugcugggagaagugcaagugcaagacccucaucgccggccagaaguccgcccgccucgaccuccucuaccgccuccucaccgccaccaaccucgucacccuccccaacucccgcggcgagcaccuccuccucuuccucguccagaccgucgcccgccagaccgucgagcacugccaguaccgccccccccgcauccgcgaggaccgcaaccgcaagaccgccucccccgaggacuccgacaugcccgaccacgaccucgagcccccccgcuucgcccagcucgcccucgagcgcguccuccaggacuggaacgcccucaaguccaugaucauguucggcucccaggagaacaaggacccccucuccgccuccucccgcaucggccaccuccuccccgaggagcaggucuaccucaaccagcaguccggcaccauccgccucgacugcuucacccacugccucaucgucaagugcaccgccgacauccuccuccucgacacccuccucggcacccucgucaaggagcuccagaacaaguacacccccggccgccgcgaggaggccaucgccgucaccaugcgcuuccuccgcuccgucgcccgcgucuucgucauccucuccgucgagauggccuccuccaagaagaagaacaacuucaucccccagcccaucggcaagugcaagcgcgucuuccaggcccuccuccccuacgccgucgaggagcucugcaacgucgccgagucccucaucguccccguccgcaugggcaucgcccgccccaccgcccccuucacccucgccuccaccuccaucgacgccaugcagggcuccgaggagcucuucuccgucgagccccuccccccccgccccuccuccgaccaguccuccuccuccucccagucccaguccuccuacaucauccgcaacccccagcagcgccgcaucucccagucccagcccguccgcggccgcgacgaggagcaggacgacaucgucuccgccgacgucgaggaggucgaggucgucgagggcgucgccggcgaggaggaccaccacgacgagcaggaggagcacggcgaggagaacgccgaggccgagggccagcacgacgagcacgacgaggacggcuccgacauggagcucgaccuccucgccgccgccgagaccgaguccgacuccgaguccaaccacuccaaccaggacaacgccuccggccgccgcuccgucgucaccgccgccaccgccggcuccgaggccggcgccuccuccguccccgccuucuucuccgaggacgacucccaguccaacgacuccuccgacuccgacuccuccuccucccaguccgacgacaucgagcaggagaccuucaugcucgacgagccccucgagcgcaccaccaacuccucccacgccaacggcgccgcccaggccccccgcuccaugcagugggccguccgcaacacccagcaccagcgcgccgccuccaccgcccccuccuccaccuccacccccgccgccuccuccgccggccucaucuacaucgaccccuccaaccuccgccgcuccggcaccaucuccaccuccgccgccgccgccgccgccgcccucgaggccuccaacgccuccuccuaccucaccuccgccuccucccucgcccgcgccuacuccaucgucauccgccagaucuccgaccucaugggccucauccccaaguacaaccaccucgucuacucccagauccccgccgccgucaagcucaccuaccaggacgccgucaaccuccagaacuacgucgaggagaagcucauccccaccuggaacuggauggucuccaucauggacuccaccgaggcccagcuccgcuacggcuccgcccucgccuccgccggcgaccccggccaccccaaccacccccuccacgccucccagaacuccgcccgccgcgagcgcaugaccgcccgcgaggaggccucccuccgcacccucgagggccgccgccgcgccacccuccucuccgcccgccagggcaugauguccgcccgcggcgacuuccucaacuacgcccucucccucaugcgcucccacaacgacgagcacuccgacguccuccccguccucgacgucugcucccucaagcacgucgccuacgucuuccaggcccucaucuacuggaucaaggccaugaaccagcagaccacccucgacaccccccagcucgagcgcaagcgcacccgcgagcuccucgagcucggcaucgacaacgaggacuccgagcacgagaacgacgacgacaccaaccaguccgccacccucaacgacaaggacgacgacucccuccccgccgagaccggccagaaccaccccuucuuccgccgcuccgacuccaugaccuuccucggcugcaucccccccaaccccuucgaggucccccucgccgaggccaucccccucgccgaccagccccaccuccuccagcccaacgcccgcaaggaggaccucuucggccgccccucccagggccucuacuccuccuccgccuccuccggcaagugccucauggaggucaccgucgaccgcaacugccucgagguccuccccaccaagauguccuacgccgccaaccucaagaacgucaugaacaugcagaaccgccagaagaaggagggcgaggagcagcccguccuccccgaggagaccgaguccuccaagcccggccccuccgcccacgaccucgccgcccagcucaaguccucccuccucgccgagaucggccucaccgaguccgagggccccccccucaccuccuuccgcccccagugcuccuucaugggcauggucaucucccacgacaugcuccucggccgcuggcgccucucccucgagcucuucggccgcgucuucauggaggacgucggcgccgagcccggcuccauccucaccgagcucggcggcuucgaggucaaggaguccaaguuccgccgcgagauggagaagcuccgcaaccagcagucccgcgaccucucccucgaggucgaccgcgaccgcgaccuccucauccagcagaccaugcgccagcucaacaaccacuucggccgccgcugcgccaccacccccauggccguccaccgcgucaaggucaccuucaaggacgagcccggcgagggcuccggcgucgcccgcuccuucuacaccgccaucgcccaggccuuccucuccaacgagaagcuccccaaccucgagugcauccagaacgccaacaagggcacccacaccucccucaugcagcgccuccgcaaccgcggcgagcgcgaccgcgagcgcgagcgcgagcgcgagaugcgccgcuccuccggccuccgcgccggcucccgccgcgaccgcgaccgcgacuuccgccgccagcucuccaucgacacccgccccuuccgccccgccuccgagggcaaccccuccgacgaccccgagccccuccccgcccaccgccaggcccucggcgagcgccucuacccccgcguccaggccaugcagcccgccuucgccuccaagaucaccggcaugcuccucgagcucucccccgcccagcuccuccuccuccucgccuccgaggacucccuccgcgcccgcgucgacgaggccauggagcucaucaucgcccacggccgcgagaacggcgccgacuccauccucgaccucggccucgucgacuccuccgagaagguccaggagaaccgcaagcgccacggcuccucccgcuccgucgucgacauggaccucgacgacaccgacgacggcgacgacaacgccccccucuucuaccagcccggcaagcgcggcuucuacaccccccgccccggcaagaacaccgaggcccgccucaacugcuuccgcaacaucggccgcauccucggccucugccuccuccagaacgagcucugccccaucacccucaaccgccacgucaucaagguccuccucggccgcaaggucaacuggcacgacuucgccuucuucgaccccgucauguacgagucccuccgccagcucauccucgccucccaguccuccgacgccgacgccgucuucuccgccauggaccucgccuucgccaucgaccucugcaaggaggagggcggcggccaggucgagcucauccccaacggcgucaacauccccgucaccccccagaacgucuacgaguacguccgcaaguacgccgagcaccgcaugcucgucgucgccgagcagccccuccacgccaugcgcaagggccuccucgacguccuccccaagaacucccucgaggaccucaccgccgaggacuuccgccuccucgucaacggcugcggcgaggucaacguccagaugcucaucuccuucaccuccuucaacgacgaguccggcgagaacgccgagaagcuccuccaguucaagcgcugguucugguccaucgucgagaagauguccaugaccgagcgccaggaccucgucuacuucuggaccuccucccccucccuccccgccuccgaggagggcuuccagcccaugcccuccaucaccauccgcccccccgacgaccagcaccuccccaccgccaacaccugcaucucccgccucuacgucccccucuacuccuccaagcagauccucaagcagaagcuccuccucgccaucaagaccaagaacuucggcuucgucuga

SEQ ID NO: 51441 - RNA, 1278 nt, Artificial Sequence
  derived and/or modified sequence opt2 from UBR7__Homo_sapiens__NP_786924
auggccggcgccgagggcgccgccggccgccaguccgagcucgagcccgucgucucccucgucgacguccucgaggaggacgaggagcucgagaacgaggccugcgccguccucggcggcuccgacuccgagaagugcuccuacucccagggcuccgucaagcgccaggcccucuacgccugcuccaccugcacccccgagggcgaggagcccgccggcaucugccucgccugcuccuacgagugccacggcucccacaagcucuucgagcucuacaccaagcgcaacuuccgcugcgacugcggcaacuccaaguucaagaaccucgagugcaagcuccuccccgacaaggccaaggucaacuccggcaacaaguacaacgacaacuucuucggccucuacugcaucugcaagcgccccuaccccgaccccgaggacgagauccccgacgagaugauccagugcgucgucugcgaggacugguuccacggccgccaccucggcgccaucccccccgaguccggcgacuuccaggagauggucugccaggccugcaugaagcgcugcuccuuccucugggccuacgccgcccagcucgccgucaccaagaucuccaccgaggacgacggccucguccgcaacaucgacggcaucggcgaccaggaggucaucaagcccgagaacggcgagcaccaggacuccacccucaaggaggacguccccgagcagggcaaggacgacguccgcgaggucaaggucgagcagaacuccgagcccugcgccggcuccuccuccgaguccgaccuccagaccgucuucaagaacgagucccucaacgccgaguccaaguccggcugcaagcuccaggagcucaaggccaagcagcucaucaagaaggacaccgccaccuacuggccccucaacuggcgcuccaagcucugcaccugccaggacugcaugaagauguacggcgaccucgacguccucuuccucaccgacgaguacgacaccguccucgccuacgagaacaagggcaagaucgcccaggccaccgaccgcuccgacccccucauggacacccucuccuccaugaaccgcguccagcaggucgagcucaucugcgaguacaacgaccucaagaccgagcucaaggacuaccucaagcgcuucgccgacgagggcaccgucgucaagcgcgaggacauccagcaguucuucgaggaguuccaguccaagaagcgccgccgcgucgacggcaugcaguacuacugcuccuga

SEQ ID NO: 51442 - RNA, 705 nt, Artificial Sequence
  derived and/or modified sequence opt2 from UBTD2__Homo_sapiens__NP_689490
augggcggcugcgucggcgcccagcacgacuccuccggcucccucaacgagaacuccgagggcaccggcgucgcccucggccgcaaccagccccucaagaaggagaagcccaaguggaaguccgacuaccccaugaccgacggccagcuccgcuccaagcgcgacgaguucugggacaccgcccccgccuucgagggccgcaaggagaucugggacgcccucaaggccgccgcccacgccuucgaguccaacgaccacgagcucgcccaggccaucaucgacggcgccaacaucacccucccccacggcgcccucaccgagugcuacgacgagcucggcaaccgcuaccagcuccccgucuacugccucgccccccccaucaacaugaucgaggagaaguccgacaucgagacccucgacauccccgagcccccccccaacuccggcuacgagugccagcuccgccuccgccucuccaccggcaaggaccucaagcucgucguccgcuccaccgacaccgucuuccacaugaagcgccgccuccacgccgccgagggcgucgagcccggcucccagcgcugguucuucuccggccgcccccucaccgacaagaugaaguucgaggagcucaagauccccaaggacuacgucguccaggucaucgucucccagcccguccagaaccccacccccgucgagaacuga

SEQ ID NO: 51443 - RNA, 2184 nt, Artificial Sequence
  derived and/or modified sequence opt2 from UBTF__Homo_sapiens__NP_001070151
augaacggcgaggccgacugccccaccgaccucgagauggccgcccccaagggccaggaccgcuggucccaggaggacaugcucacccuccucgagugcaugaagaacaaccuccccuccaacgacuccuccaaguucaagaccaccgagucccacauggacugggagaaggucgccuucaaggacuucuccggcgacaugugcaagcucaagugggucgagaucuccaacgagguccgcaaguuccgcacccucaccgagcucauccucgacgcccaggagcacgucaagaaccccuacaagggcaagaagcucaagaagcaccccgacuuccccaagaagccccucacccccuacuuccgcuucuucauggagaagcgcgccaaguacgccaagcuccaccccgagauguccaaccucgaccucaccaagauccucuccaagaaguacaaggagcuccccgagaagaagaagaugaaguacauccaggacuuccagcgcgagaagcaggaguucgagcgcaaccucgcccgcuuccgcgaggaccaccccgaccucauccagaacgccaagaaguccgacauccccgagaagcccaagaccccccagcagcucugguacacccacgagaagaaggucuaccucaagguccgccccgacgagaucaugcgcgacuacauccagaagcaccccgagcucaacaucuccgaggagggcaucaccaaguccacccucaccaaggccgagcgccagcucaaggacaaguucgacggccgccccaccaagcccccccccaacuccuacucccucuacugcgccgagcucauggccaacaugaaggacguccccuccaccgagcgcaugguccucugcucccagcaguggaagcuccucucccagaaggagaaggacgccuaccacaagaagugcgaccagaagaagaaggacuacgaggucgagcuccuccgcuuccucgagucccuccccgaggaggagcagcagcgcguccucggcgaggagaagaugcucaacaucaacaagaagcaggccaccucccccgccuccaagaagcccgcccaggagggcggcaagggcggcuccgagaagcccaagcgccccgucuccgccauguucaucuucuccgaggagaagcgccgccagcuccaggaggagcgccccgagcucuccgaguccgagcucacccgccuccucgcccgcauguggaacgaccucuccgagaagaagaaggccaaguacaaggcccgcgaggccgcccucaaggcccaguccgagcgcaagcccggcggcgagcgcgaggagcgcggcaagcuccccgagucccccaagcgcgccgaggagaucuggcagcaguccgucaucggcgacuaccucgcccgcuucaagaacgaccgcgucaaggcccucaaggccauggagaugaccuggaacaacauggagaagaaggagaagcucauguggaucaagaaggccgccgaggaccagaagcgcuacgagcgcgagcucuccgagaugcgcgccccccccgccgccaccaacuccuccaagaagaugaaguuccagggcgagcccaagaagccccccaugaacggcuaccagaaguucucccaggagcuccucuccaacggcgagcucaaccaccucccccucaaggagcgcauggucgagaucggcucccgcuggcagcgcaucucccagucccagaaggagcacuacaagaagcucgccgaggagcagcagaagcaguacaagguccaccucgaccucugggucaagucccucuccccccaggaccgcgccgccuacaaggaguacaucuccaacaagcgcaaguccaugaccaagcuccgcggccccaaccccaaguccucccgcaccacccuccaguccaaguccgaguccgaggaggacgacgaggaggacgaggacgacgaggacgaggacgaggaggaggaggacgacgagaacggcgacuccuccgaggacggcggcgacuccuccgaguccuccuccgaggacgaguccgaggacggcgacgagaacgaggaggacgacgaggacgaggacgacgacgaggacgacgacgaggacgaggacaacgaguccgagggcuccuccuccuccuccuccuccuccggcgacuccuccgacuccgacuccaacuga

SEQ ID NO: 51444 - RNA, 894 nt, Artificial Sequence
  derived and/or modified sequence opt2 from UBXN1__Homo_sapiens__NP_001273006
auggccgagcucaccgcccucgagucccucaucgagaugggcuucccccgcggccgcgccgagaaggcccucgcccucaccggcaaccagggcaucgaggccgccauggacuggcucauggagcacgaggacgaccccgacgucgacgagccccucgagaccccccucggccacauccucggccgcgagcccaccuccuccgagcagggcggccucgagggcuccggcuccgccgccggcgagggcaagcccgcccucuccgaggaggagcgccaggagcagaccaagcgcaugcucgagcucgucgcccagaagcagcgcgagcgcgaggagcgcgaggagcgcgaggcccucgagcgcgagcgccagcgccgccgccagggccaggagcucuccgccgcccgccagcgccuccaggaggacgagaugcgccgcgccgccgaggagcgccgccgcgagaaggccgaggagcucgccgcccgccagcgcguccgcgagaagaucgagcgcgacaaggccgagcgcgccaagaaguacggcggcuccgucggcucccagcccccccccgucgcccccgagcccggccccguccccuccucccccucccaggagccccccaccaagcgcgaguacgaccagugccgcauccagguccgccuccccgacggcaccucccucacccagaccuuccgcgcccgcgagcagcucgccgccguccgccucuacgucgagcuccaccgcggcgaggagcucggcggcggccaggaccccguccagcuccucuccggcuucccccgccgcgccuucuccgaggccgacauggagcgcccccuccaggagcucggccucguccccuccgccguccucaucgucgccaagaagugccccuccuga

SEQ ID NO: 51445 - RNA, 780 nt, Artificial Sequence
  derived and/or modified sequence opt2 from UBXN2A__Homo_sapiens__NP_859064
augaaggacgucgacaaccucaaguccaucaaggaggagugggucugcgagaccggcuccgacaaccagccccucggcaacaaccagcaguccaacugcgaguacuucgucgacucccucuucgaggaggcccagaaggucuccuccaagugcgucucccccgccgagcagaagaagcaggucgacgucaacaucaagcucuggaagaacggcuucaccgucaacgacgacuuccgcuccuacuccgacggcgccucccagcaguuccucaacuccaucaagaagggcgagcuccccuccgagcuccagggcaucuucgacaaggaggaggucgacgucaaggucgaggacaagaagaacgagaucugccucuccaccaagcccgucuuccagcccuucuccggccagggccaccgccucggcuccgccacccccaagaucgucuccaaggccaagaacaucgaggucgagaacaagaacaaccucuccgccgucccccucaacaaccucgagcccaucaccaacauccagaucuggcucgccaacggcaagcgcaucguccagaaguucaacaucacccaccgcgucucccacaucaaggacuucaucgagaaguaccagggcucccagcgcuccccccccuucucccucgccaccgcccuccccguccuccgccuccucgacgagacccucacccucgaggaggccgaccuccagaacgccgucaucauccagcgccuccagaagaccgccuccuuccgcgagcucuccgagcacuga

SEQ ID NO: 51446 - RNA, 996 nt, Artificial Sequence
  derived and/or modified sequence opt2 from UBXN2B__Homo_sapiens__NP_001071087
auggccgagggcggcggccccgagcccggcgagcaggagcgccgcuccuccggcccccgcccccccuccgcccgcgaccuccagcucgcccucgccgagcucuacgaggacgaggucaagugcaaguccuccaaguccaaccgccccaaggccaccgucuucaaguccccccgcacccccccccagcgcuucuacuccuccgagcacgaguacuccggccucaacaucguccgccccuccaccggcaagaucgucaacgagcucuucaaggaggcccgcgagcacggcgccgucccccucaacgaggccacccgcgccuccggcgacgacaaguccaaguccuucaccggcggcggcuaccgccucggcuccuccuucugcaagcgcuccgaguacaucuacggcgagaaccagcuccaggacguccagauccuccucaagcucugguccaacggcuucucccucgacgacggcgagcuccgccccuacaacgagcccaccaacgcccaguuccucgaguccgucaagcgcggcgagaucccccucgagcuccagcgccucguccacggcggccaggucaaccucgacauggaggaccaccaggaccaggaguacaucaagccccgccuccgcuucaaggccuucuccggcgagggccagaagcucggcucccucacccccgagaucgucuccacccccuccucccccgaggaggaggacaaguccauccucaacgccgucguccucaucgacgacuccguccccaccaccaagauccagauccgccucgccgacggcucccgccucauccagcgcuucaacuccacccaccgcauccucgacguccgcaacuucaucguccagucccgccccgaguucgccgcccucgacuucauccucgucaccuccuuccccaacaaggagcucaccgacgagucccucacccuccucgaggccgacauccucaacaccguccuccuccagcagcucaaguga

SEQ ID NO: 51447 - RNA, 1527 nt, Artificial Sequence
  derived and/or modified sequence opt2 from UBXN4__Homo_sapiens__NP_055422
augcucugguuccagggcgccauccccgccgccaucgccaccgccaagcgcuccggcgccgucuucgucgucuucgucgccggcgacgacgagcaguccacccagauggccgccuccugggaggacgacaaggucaccgaggccuccuccaacuccuucgucgccaucaagaucgacaccaaguccgaggccugccuccaguucucccagaucuaccccgucgucugcguccccuccuccuucuucaucggcgacuccggcaucccccucgaggucaucgccggcuccgucuccgccgacgagcucgucacccgcauccacaagguccgccagaugcaccuccucaaguccgagaccuccgucgccaacggcucccaguccgaguccuccgucuccacccccuccgccuccuucgagcccaacaacaccugcgagaacucccagucccgcaacgccgagcucugcgagaucccccccaccuccgacaccaaguccgacaccgccaccggcggcgaguccgccggccacgccaccuccucccaggagcccuccggcugcuccgaccagcgccccgccgaggaccucaacauccgcgucgagcgccucaccaagaagcucgaggagcgccgcgaggagaagcgcaaggaggaggagcagcgcgagaucaagaaggagaucgagcgccgcaagaccggcaaggagaugcucgacuacaagcgcaagcaggaggaggagcucaccaagcgcaugcucgaggagcgcaaccgcgagaaggccgaggaccgcgccgcccgcgagcgcaucaagcagcagaucgcccucgaccgcgccgagcgcgccgcccgcuucgccaagaccaaggaggaggucgaggccgccaaggccgccgcccuccucgccaagcaggccgagauggaggucaagcgcgaguccuacgcccgcgagcgcuccaccgucgcccgcauccaguuccgccuccccgacggcuccuccuucaccaaccaguuccccuccgacgccccccucgaggaggcccgccaguucgccgcccagaccgucggcaacaccuacggcaacuucucccucgccaccauguucccccgccgcgaguucaccaaggaggacuacaagaagaagcuccucgaccucgagcucgcccccuccgccuccgucguccuccuccccgccggccgccccaccgccuccaucguccacuccuccuccggcgacaucuggacccuccucggcaccguccucuaccccuuccucgccaucuggcgccucaucuccaacuuccucuucuccaaccccccccccacccagaccuccguccgcgucaccuccuccgagccccccaaccccgccuccuccuccaaguccgagaagcgcgagcccguccgcaagcgcguccucgagaagcgcggcgacgacuucaagaaggagggcaagaucuaccgccuccgcacccaggacgacggcgaggacgagaacaacaccuggaacggcaacuccacccagcagauguga

SEQ ID NO: 51448 - RNA, 672 nt, Artificial Sequence
  derived and/or modified sequence opt2 from UCHL1__Homo_sapiens__NP_004172
augcagcucaagcccauggagaucaaccccgagaugcucaacaagguccucucccgccucggcgucgccggccaguggcgcuucgucgacguccucggccucgaggaggagucccucggcuccguccccgcccccgccugcgcccuccuccuccucuucccccucaccgcccagcacgagaacuuccgcaagaagcagaucgaggagcucaagggccaggaggucucccccaaggucuacuucaugaagcagaccaucggcaacuccugcggcaccaucggccucauccacgccgucgccaacaaccaggacaagcucggcuucgaggacggcuccguccucaagcaguuccucuccgagaccgagaagaugucccccgaggaccgcgccaagugcuucgagaagaacgaggccauccaggccgcccacgacgccgucgcccaggagggccagugccgcgucgacgacaaggucaacuuccacuucauccucuucaacaacgucgacggccaccucuacgagcucgacggccgcaugcccuuccccgucaaccacggcgccuccuccgaggacacccuccucaaggacgccgccaaggucugccgcgaguucaccgagcgcgagcagggcgagguccgcuucuccgccgucgcccucugcaaggccgccuga

SEQ ID NO: 51449 - RNA, 693 nt, Artificial Sequence
  derived and/or modified sequence opt2 from UCHL3__Homo_sapiens__NP_005993
auggagggccagcgcuggcucccccucgaggccaaccccgaggucaccaaccaguuccucaagcagcucggccuccaccccaacuggcaguucgucgacgucuacggcauggaccccgagcuccucuccauggucccccgccccgucugcgccguccuccuccucuuccccaucaccgagaaguacgaggucuuccgcaccgaggaggaggagaagaucaagucccagggccaggacgucaccuccuccgucuacuucaugaagcagaccaucuccaacgccugcggcaccaucggccucauccacgccaucgccaacaacaaggacaagaugcacuucgaguccggcuccacccucaagaaguuccucgaggaguccgucuccaugucccccgaggagcgcgcccgcuaccucgagaacuacgacgccauccgcgucacccacgagaccuccgcccacgagggccagaccgaggcccccuccaucgacgagaaggucgaccuccacuucaucgcccucguccacgucgacggccaccucuacgagcucgacggccgcaagcccuuccccaucaaccacggcgagaccuccgacgagacccuccucgaggacgccaucgaggucugcaagaaguucauggagcgcgaccccgacgagcuccgcuucaacgccaucgcccucuccgccgccuga

SEQ ID NO: 51450 - RNA, 987 nt, Artificial Sequence
  derived and/or modified sequence opt2 from UCHL5__Homo_sapiens__NP_001186190
augaccggcaacgccggcgaguggugccucauggaguccgaccccggcgucuucaccgagcucaucaagggcuucggcugccgcggcgcccaggucgaggagaucuggucccucgagcccgagaacuucgagaagcucaagcccguccacggccucaucuuccucuucaaguggcagcccggcgaggagcccgccggcuccgucguccaggacucccgccucgacaccaucuucuucgccaagcaggucaucaacaacgccugcgccacccaggccaucgucuccguccuccucaacugcacccaccaggacguccaccucggcgagacccucuccgaguucaaggaguucucccaguccuucgacgccgccaugaagggccucgcccucuccaacuccgacgucauccgccagguccacaacuccuucgcccgccagcagauguucgaguucgacaccaagaccuccgccaaggaggaggacgccuuccacuucgucuccuacguccccgucaacggccgccucuacgagcucgacggccuccgcgagggccccaucgaccucggcgccugcaaccaggacgacuggaucuccgccguccgccccgucaucgagaagcgcauccagaaguacuccgagggcgagauccgcuucaaccucauggccaucgucuccgaccgcaagaugaucuacgagcagaagaucgccgagcuccagcgccagcucgccgaggagcccauggacaccgaccagggcaacuccaugcucuccgccauccaguccgaggucgccaagaaccagaugcucaucgaggaggagguccagaagcucaagcgcuacaagaucgagaacauccgccgcaagcacaacuaccuccccuucaucauggagcuccucaagacccucgccgagcaccagcagcucaucccccucgucgagaaggccaaggagaagcagaacgccaagaaggcccaggagaccaaguga

SEQ ID NO: 51451 - RNA, 606 nt, Artificial Sequence
  derived and/or modified sequence opt2 from UCK1__Homo_sapiens__NP_001129426
auggccuccgccggcggcgaggacugcgagucccccgcccccgaggccgaccgcccccaccagcgccccuuccucaucggcgucuccggcggcaccgccuccggcaaguccaccgucugcgagaagaucauggagcuccucggccagaacgaggucgagcagcgccagcgcaaggucgucauccucucccaggaccgcuucuacaagguccucaccgccgagcagaaggccaaggcccucaagggccaguacaacuucgaccaccccgacgccuucgacaacgaccucaugcaccgcacccucaagaacaucgucgagggcaagaccgucgagguccccaccuacgacuucgucacccacucccgccuccccgagaccaccgucgucuaccccgccgacgucguccucuucgagggcauccucgucuucuacucccaggagauccgcgacauguuccaccuccgccucuucgucgacaccgacuccgacguccgccucucccgccgcgacaaggaggucugccgcugcgaccaccccgcccgcuccggccaguacggcugccaccagcccgaccgcgccgcccaccccggccacuccgagugguga

SEQ ID NO: 51452 - RNA, 786 nt, Artificial Sequence
  derived and/or modified sequence opt2 from UCK2__Homo_sapiens__NP_036606
auggccggcgacuccgagcagacccuccagaaccaccagcagcccaacggcggcgagcccuuccucaucggcgucuccggcggcaccgccuccggcaaguccuccgucugcgccaagaucguccagcuccucggccagaacgaggucgacuaccgccagaagcaggucgucauccucucccaggacuccuucuaccgcguccucaccuccgagcagaaggccaaggcccucaagggccaguucaacuucgaccaccccgacgccuucgacaacgagcucauccucaagacccucaaggagaucaccgagggcaagaccguccagauccccgucuacgacuucgucucccacucccgcaaggaggagaccgucaccgucuaccccgccgacgucguccucuucgagggcauccucgccuucuacucccaggagguccgcgaccucuuccagaugaagcucuucgucgacaccgacgccgacacccgccucucccgccgcguccuccgcgacaucuccgagcgcggccgcgaccucgagcagauccucucccaguacaucaccuucgucaagcccgccuucgaggaguucugccuccccaccaagaaguacgccgacgucaucaucccccgcggcgccgacaaccucgucgccaucaaccucaucguccagcacauccaggacauccucaacggcggccccuccaagcgccagaccaacggcugccucaacggcuacacccccucccgcaagcgccaggccuccgaguccuccucccgcccccacuga

SEQ ID NO: 51453 - RNA, 1602 nt, Artificial Sequence
  derived and/or modified sequence opt2 from UCKL1__Homo_sapiens__NP_001180308
auguccuccccccccgccuaccccggcauccgcaucuccggcugccgcgcccucggcgccgagggcuccuccaacgccgagucccucgaccgccuccucccccccgucggcaccggccgcuccccccgcaagcgcaccaccucccagugcaaguccgagcccccccuccuccgcaccuccaagcgcaccaucuacaccgccggccgcccccccugguacaacgagcacggcacccaguccaaggaggccuucgccaucggccucggcggcggcuccgccuccggcaagaccaccgucgcccgcaugaucaucgaggcccucgacguccccugggucguccuccucuccauggacuccuucuacaagguccucaccgagcagcagcaggagcaggccgcccacaacaacuucaacuucgaccaccccgacgccuucgacuucgaccucaucaucuccacccucaagaagcucaagcagggcaaguccgucaagguccccaucuacgacuucaccacccacucccgcaagaaggacuggaagacccucuacggcgccaacgucaucaucuucgagggcaucauggccuucgccgacaagacccuccucgagcuccucgacaugaagaucuucgucgacaccgacuccgacauccgccucguccgccgccuccgccgcgacaucuccgagcgcggccgcgacaucgagggcgucaucaagcaguacaacaaguucgucaagcccuccuucgaccaguacauccagcccaccaugcgccucgccgacaucgucgucccccgcggcuccggcaacaccgucgccaucgaccucaucguccagcacguccacucccagcucgaggagcgcgagcucuccguccgcgccgcccucgccuccgcccaccagugccacccccucccccgcacccucuccguccucaaguccaccccccagguccgcggcaugcacaccaucauccgcgacaaggagaccucccgcgacgaguucaucuucuacuccaagcgccucaugcgccuccucaucgagcacgcccucuccuuccuccccuuccaggacugcgucguccagaccccccagggccaggacuacgccggcaagugcuacgccggcaagcagaucaccggcgucuccauccuccgcgccggcgagaccauggagcccgcccuccgcgccgucugcaaggacguccgcaucggcaccauccucauccagaccaaccagcucaccggcgagcccgagcuccacuaccuccgccuccccaaggacaucuccgacgaccacgucauccucauggacugcaccgucuccaccggcgccgccgccaugauggccguccgcguccuccucgaccacgacguccccgaggacaagaucuuccuccucucccuccucauggccgagaugggcguccacuccgucgccuacgccuucccccgcguccgcaucaucaccaccgccgucgacaagcgcgucaacgaccucuuccgcaucauccccggcaucggcaacuucggcgaccgcuacuucggcaccgacgccguccccgacggcuccgacgaggaggaggucgccuacaccggcuga

SEQ ID NO: 51454 - RNA, 417 nt, Artificial Sequence
  derived and/or modified sequence opt2 from UCMA__Homo_sapiens__NP_660357
augaccuggcgccaggccguccuccucuccugcuucuccgccgucguccuccucuccaugcuccgcgagggcaccuccgucuccgucggcaccaugcagauggccggcgaggaggccuccgaggacgccaagcagaagaucuucaugcaggaguccgacgccuccaacuuccucaagcgccgcggcaagcgcucccccaagucccgcgacgaggucaacgucgagaaccgccagaagcuccgcgucgacgagcuccgccgcgaguacuacgaggagcagcgcaacgaguucgagaacuucgucgaggagcagaacgacgagcaggaggagcgcucccgcgaggccgucgagcaguggcgccaguggcacuacgacggccuccaccccuccuaccucuacaaccgccaccacaccuga

SEQ ID NO: 51455 - RNA, 339 nt, Artificial Sequence
  derived and/or modified sequence opt2 from UCN2__Homo_sapiens__NP_149976
augacccgcugcgcccuccuccuccucaugguccucaugcucggccgcguccucgucguccccgucacccccauccccaccuuccagcuccgcccccagaacuccccccagaccaccccccgccccgccgccuccgagucccccuccgccgcccccaccuggcccugggccgcccagucccacugcucccccacccgccaccccggcucccgcaucguccucucccucgacguccccaucggccuccuccagauccuccucgagcaggcccgcgcccgcgccgcccgcgagcaggccaccaccaacgcccgcauccucgcccgcgucggccacugcuga

SEQ ID NO: 51456 - RNA, 486 nt, Artificial Sequence
  derived and/or modified sequence opt2 from UCN3__Homo_sapiens__NP_444277
augcucaugcccguccacuuccuccuccuccuccuccuccuccucggcggcccccgcaccggccucccccacaaguucuacaaggccaagcccaucuucuccugccucaacaccgcccucuccgaggccgagaagggccagugggaggacgccucccuccucuccaagcgcuccuuccacuaccuccgcucccgcgacgccuccuccggcgaggaggaggagggcaaggagaagaagaccuuccccaucuccggcgcccgcggcggcgcccgcggcacccgcuaccgcuacgucucccaggcccagccccgcggcaagccccgccaggacaccgccaaguccccccaccgcaccaaguucacccucucccucgacguccccaccaacaucaugaaccuccucuucaacaucgccaaggccaagaaccuccgcgcccaggccgccgccaacgcccaccucauggcccagaucggccgcaagaaguga

SEQ ID NO: 51457 - RNA, 375 nt, Artificial Sequence
  derived and/or modified sequence opt2 from UCN__Homo_sapiens__NP_003344
augcgccaggccggccgcgccgcccuccucgccgcccuccuccuccucguccagcucugccccggcuccucccagcgcucccccgaggccgccggcguccaggaccccucccuccgcuggucccccggcgcccgcaaccagggcggcggcgcccgcgcccuccuccuccuccucgccgagcgcuucccccgccgcgccggccccggccgccucggccucggcaccgccggcgagcgcccccgccgcgacaaccccucccucuccaucgaccucaccuuccaccuccuccgcacccuccucgagcucgcccgcacccagucccagcgcgagcgcgccgagcagaaccgcaucaucuucgacuccgucggcaaguga

SEQ ID NO: 51458 - RNA, 924 nt, Artificial Sequence
  derived and/or modified sequence opt2 from UCP1__Homo_sapiens__NP_068605
augggcggccucaccgccuccgacguccaccccacccucggcguccagcucuucuccgccggcaucgccgccugccucgccgacgucaucaccuucccccucgacaccgccaagguccgccuccagguccagggcgagugccccaccuccuccgucauccgcuacaagggcguccucggcaccaucaccgccgucgucaagaccgagggccgcaugaagcucuacuccggccuccccgccggccuccagcgccagaucuccuccgccucccuccgcaucggccucuacgacaccguccaggaguuccucaccgccggcaaggagaccgcccccucccucggcuccaagauccucgccggccucaccaccggcggcgucgccgucuucaucggccagcccaccgaggucgucaagguccgccuccaggcccagucccaccuccacggcaucaagccccgcuacaccggcaccuacaacgccuaccgcaucaucgccaccaccgagggccucaccggccucuggaagggcaccacccccaaccucaugcgcuccgucaucaucaacugcaccgagcucgucaccuacgaccucaugaaggaggccuucgucaagaacaacauccucgccgacgacguccccugccaccucgucuccgcccucaucgccggcuucugcgccaccgccauguccucccccgucgacgucgucaagacccgcuucaucaacuccccccccggccaguacaaguccguccccaacugcgccaugaaggucuucaccaacgagggccccaccgccuucuucaagggccucguccccuccuuccuccgccucggcuccuggaacgucaucauguucgucugcuucgagcagcucaagcgcgagcucuccaagucccgccagaccauggacugcgccaccuga

SEQ ID NO: 51459 - RNA, 930 nt, Artificial Sequence
  derived and/or modified sequence opt2 from UCP2__Homo_sapiens__NP_003346
auggucggcuucaaggccaccgacgucccccccaccgccaccgucaaguuccucggcgccggcaccgccgccugcaucgccgaccucaucaccuucccccucgacaccgccaagguccgccuccagauccagggcgagucccagggccccguccgcgccaccgccuccgcccaguaccgcggcgucaugggcaccauccucaccaugguccgcaccgagggcccccgcucccucuacaacggccucgucgccggccuccagcgccagauguccuucgccuccguccgcaucggccucuacgacuccgucaagcaguucuacaccaagggcuccgagcacgccuccaucggcucccgccuccucgccggcuccaccaccggcgcccucgccgucgccgucgcccagcccaccgacgucgucaagguccgcuuccaggcccaggcccgcgccggcggcggccgccgcuaccaguccaccgucaacgccuacaagaccaucgcccgcgaggagggcuuccgcggccucuggaagggcaccucccccaacgucgcccgcaacgccaucgucaacugcgccgagcucgucaccuacgaccucaucaaggacgcccuccucaaggccaaccucaugaccgacgaccuccccugccacuucaccuccgccuucggcgccggcuucugcaccaccgucaucgccucccccgucgacgucgucaagacccgcuacaugaacuccgcccucggccaguacuccuccgccggccacugcgcccucaccaugcuccagaaggagggcccccgcgccuucuacaagggcuucaugcccuccuuccuccgccucggcuccuggaacgucgucauguucgucaccuacgagcagcucaagcgcgcccucauggccgccugcaccucccgcgaggcccccuucuga

SEQ ID NO: 51460 - RNA, 939 nt, Artificial Sequence
  derived and/or modified sequence opt2 from UCP3__Homo_sapiens__NP_003347
auggucggccucaagcccuccgacgucccccccaccauggccgucaaguuccucggcgccggcaccgccgccugcuucgccgaccucgucaccuucccccucgacaccgccaagguccgccuccagauccagggcgagaaccaggccguccagaccgcccgccucguccaguaccgcggcguccucggcaccauccucaccaugguccgcaccgagggccccugcucccccuacaacggccucgucgccggccuccagcgccagauguccuucgccuccauccgcaucggccucuacgacuccgucaagcaggucuacacccccaagggcgccgacaacuccucccucaccacccgcauccucgccggcugcaccaccggcgccauggccgucaccugcgcccagcccaccgacgucgucaagguccgcuuccaggccuccauccaccucggccccucccgcuccgaccgcaaguacuccggcaccauggacgccuaccgcaccaucgcccgcgaggagggcguccgcggccucuggaagggcacccuccccaacaucaugcgcaacgccaucgucaacugcgccgaggucgucaccuacgacauccucaaggagaagcuccucgacuaccaccuccucaccgacaacuuccccugccacuucgucuccgccuucggcgccggcuucugcgccaccgucgucgccucccccgucgacgucgucaagacccgcuacaugaacuccccccccggccaguacuucuccccccucgacugcaugaucaagauggucgcccaggagggccccaccgccuucuacaagggcuucacccccuccuuccuccgccucggcuccuggaacgucgucauguucgucaccuacgagcagcucaagcgcgcccucaugaagguccagaugcuccgcgagucccccuucuga

SEQ ID NO: 51461 - RNA, 1416 nt, Artificial Sequence
  derived and/or modified sequence opt2 from UEVLD__Homo_sapiens__NP_001035787
auggaguucgacugcgagggccuccgccgccuccucggcaaguacaaguuccgcgaccucaccgucgaggagcuccgcaacgucaacgucuucuucccccacuucaaguacuccauggacaccuacgucuucaaggacuccucccagaaggaccuccucaacuucaccggcaccauccccgucauguaccagggcaacaccuacaacauccccauccgcuucuggauccucgacucccaccccuucgccccccccaucugcuuccucaagcccaccgccaacaugggcauccucgucggcaagcacgucgacgcccagggccgcaucuaccuccccuaccuccagaacuggucccaccccaaguccgucaucgucggccucaucaaggagaugaucgccaaguuccaggaggagcuccccauguacucccucuccuccuccgacgaggcccgccaggucgaccuccucgccuacaucgccaagaucaccgagggcgucuccgacaccaacuccaaguccugggccaaccacgagaacaagaccgucaacaagaucaccgucgucggcggcggcgagcucggcaucgccugcacccucgccaucuccgccaagggcaucgccgaccgccucguccuccucgaccucuccgagggcaccaagggcgccaccauggaccucgagaucuucaaccuccccaacgucgagaucuccaaggaccucuccgccuccgcccacuccaaggucgucaucuucaccgucaacucccucggcuccucccaguccuaccucgacgucguccaguccaacgucgacauguuccgcgcccucguccccgcccucggccacuacucccagcacuccguccuccucgucgccucccagcccgucgagaucaugaccuacgucaccuggaagcucuccaccuuccccgccaaccgcgucaucggcaucggcugcaaccucgacucccagcgccuccaguacaucaucaccaacguccucaaggcccagaccuccggcaaggaggucugggucaucggcgagcagggcgaggacaagguccucaccugguccggccaggaggaggucgucucccacaccucccagguccagcucuccaaccgcgccauggagcuccuccgcgucaagggccagcgcuccugguccgucggccucuccgucgccgacauggucgacuccaucgucaacaacaagaagaagguccacuccgucuccgcccucgccaagggcuacuacgacaucaacuccgaggucuuccucucccuccccugcauccucggcaccaacggcgucuccgaggucaucaagaccacccucaaggaggacaccgucaccgagaagcuccaguccuccgccuccuccauccacucccuccagcagcagcucaagcucuga

SEQ ID NO: 51462 - RNA, 801 nt, Artificial Sequence
  derived and/or modified sequence opt2 from UFD1L__Homo_sapiens__NP_001030324
auguucuccuucaacauguucgaccaccccaucccccgcgucuuccagaaccgcuucuccacccaguaccgcugcuucuccgucuccaugcucgccggccccaacgaccgcuccgacgucgagaagggcggcaagaucaucaugccccccuccgcccucgaccagcucucccgccucaacaucaccuaccccaugcucuucaagcucaccaacaagaacuccgaccgcaugacccacugcggcguccucgaguucgucgccgacgagggcaucugcuaccucccccacuggaugaugcagaaccuccuccucgaggagggcggccucguccaggucgaguccgucaaccuccaggucgccaccuacuccaaguuccagccccagucccccgacuuccucgacaucaccaaccccaaggccguccucgagaacgcccuccgcaacuucgccugccucaccaccggcgacgucaucgccaucaacuacaacgagaagaucuacgagcuccgcgucauggagaccaagcccgacaaggccgucuccaucaucgagugcgacaugaacgucgacuucgacgccccccucggcuacaaggagcccgagcgccagguccagcacgaggaguccaccgagggcgaggccgaccacuccggcuacgccggcgagcucggcuuccgcgccuucuccggcuccggcaaccgccucgacggcaagaagaagggcgucgagcccucccccucccccaucaagcccggcgacaucaagcgcggcauccccaacuacgaguucaagcucggcuga

SEQ ID NO: 51463 - RNA, 2385 nt, Artificial Sequence
  derived and/or modified sequence opt2 from UFL1__Homo_sapiens__NP_056138
auggccgacgccugggaggagauccgccgccucgccgccgacuuccagcgcgcccaguucgccgaggccacccagcgccucuccgagcgcaacugcaucgagaucgucaacaagcucaucgcccagaagcagcucgaggucguccacacccucgacggcaaggaguacaucacccccgcccagaucuccaaggagaugcgcgacgagcuccacguccgcggcggccgcgucaacaucgucgaccuccagcaggucaucaacgucgaccucauccacaucgagaaccgcaucggcgacaucaucaaguccgagaagcacguccagcucguccucggccagcucaucgacgagaacuaccucgaccgccucgccgaggaggucaacgacaagcuccaggaguccggccaggucaccaucuccgagcucugcaagaccuacgaccuccccggcaacuuccucacccaggcccucacccagcgccucggccgcaucaucuccggccacaucgaccucgacaaccgcggcgucaucuucaccgaggccuucgucgcccgccacaaggcccgcauccgcggccucuucuccgccaucacccgccccaccgccgucaacucccucaucuccaaguacggcuuccaggagcagcuccucuacuccguccucgaggagcucgucaacuccggccgccuccgcggcaccgucgucggcggccgccaggacaaggccgucuucguccccgacaucuacucccgcacccaguccaccugggucgacuccuucuuccgccagaacggcuaccucgaguucgacgcccucucccgccucggcauccccgacgccgucuccuacaucaagaagcgcuacaagaccacccagcuccucuuccucaaggccgccugcgucggccagggccucgucgaccaggucgaggccuccgucgaggaggccaucuccuccggcaccugggucgacaucgccccccuccuccccaccucccucuccgucgaggacgccgccauccuccuccagcaggucaugcgcgccuucuccaagcaggccuccaccgucgucuucuccgacaccgucgucgucuccgagaaguucaucaacgacugcaccgagcucuuccgcgagcucaugcaccagaaggccgagaaggagaugaagaacaaccccguccaccucaucaccgaggaggaccucaagcagaucuccacccucgaguccgucuccaccuccaagaaggacaagaaggacgagcgccgccgcaaggccaccgagggcuccggcuccaugcgcggcggcggcggcggcaacgcccgcgaguacaagaucaagaaggucaagaagaagggccgcaaggacgacgacuccgacgacgagucccaguccucccacaccggcaagaagaagcccgagaucuccuucauguuccaggacgagaucgaggacuuccuccgcaagcacauccaggacgcccccgaggaguucaucuccgagcucgccgaguaccucaucaagccccucaacaagaccuaccucgaggucguccgcuccgucuucauguccuccaccaccuccgccuccggcaccggccgcaagcgcaccaucaaggaccuccaggaggaggucuccaaccucuacaacaacauccgccucuucgagaagggcaugaaguucuucgccgacgacacccaggccgcccucaccaagcaccuccucaaguccgucugcaccgacaucaccaaccucaucuucaacuuccucgccuccgaccucaugauggccgucgacgaccccgccgccaucaccuccgagauccgcaagaagauccucuccaagcucuccgaggagaccaaggucgcccucaccaagcuccacaacucccucaacgagaaguccaucgaggacuucaucuccugccucgacuccgccgccgaggccugcgacaucauggucaagcgcggcgacaagaagcgcgagcgccagauccucuuccagcaccgccaggcccucgccgagcagcucaaggucaccgaggaccccgcccucauccuccaccucaccuccguccuccucuuccaguucuccacccacuccaugcuccacgcccccggccgcugcgucccccagaucaucgccuuccucaacuccaagauccccgaggaccagcacgcccuccucgucaaguaccagggccucgucgucaagcagcucgucucccaguccaagaagaccggccagggcgacuacccccucaacaacgagcucgacaaggagcaggaggacgucgccuccaccacccgcaaggagcuccaggagcucuccuccuccaucaaggaccucguccucaagucccgcaaguccuccgucaccgaggaguga

SEQ ID NO: 51464 - RNA, 312 nt, Artificial Sequence
  derived and/or modified sequence opt2 from UFM1__Homo_sapiens__NP_001273633
augauccgcgccuuccccaccaccaccccccgcucccuccaccucuucaccuccuccaccuuccucgcccgcgcccuccccggcgccuuccccaccggcgccugcgaggagcgccucuccguccccgaguccacccccuucaccgccguccucaaguucgccgccgaggaguucaagguccccgccgccaccuccgccaucaucaccaacgacggcaucggcaucaaccccgcccagaccgccggcaacgucuuccucaagcacggcuccgagcuccgcaucaucccccgcgaccgcgucggcuccugcuga

SEQ ID NO: 51465 - RNA, 1185 nt, Artificial Sequence
  derived and/or modified sequence opt2 from UGCG__Homo_sapiens__NP_003349
auggcccuccucgaccucgcccucgagggcauggccgucuucggcuucguccucuuccucguccucuggcucaugcacuucauggccaucaucuacacccgccuccaccucaacaagaaggccaccgacaagcagcccuacuccaagcuccccggcgucucccuccucaagccccucaagggcgucgaccccaaccucaucaacaaccucgagaccuucuucgagcucgacuaccccaaguacgagguccuccucugcguccaggaccacgacgaccccgccaucgacgucugcaagaagcuccucggcaaguaccccaacgucgacgcccgccucuucaucggcggcaagaaggucggcaucaaccccaagaucaacaaccucaugcccggcuacgaggucgccaaguacgaccucaucuggaucugcgacuccggcauccgcgucauccccgacacccucaccgacauggucaaccagaugaccgagaaggucggccucguccacggccuccccuacgucgccgaccgccagggcuucgccgccacccucgagcaggucuacuucggcaccucccacccccgcuacuacaucuccgccaacgucaccggcuucaagugcgucaccggcauguccugccucaugcgcaaggacguccucgaccaggccggcggccucaucgccuucgcccaguacaucgccgaggacuacuucauggccaaggccaucgccgaccgcggcuggcgcuucgccauguccacccaggucgccaugcagaacuccggcuccuacuccaucucccaguuccagucccgcaugauccgcuggaccaagcuccgcaucaacaugcuccccgccaccaucaucugcgagcccaucuccgagugcuucgucgccucccucaucaucggcugggccgcccaccacgucuuccgcugggacaucauggucuucuucaugugccacugccucgccugguucaucuucgacuacauccagcuccgcggcguccagggcggcacccucugcuucuccaagcucgacuacgccgucgccugguucauccgcgaguccaugaccaucuacaucuuccucuccgcccucugggaccccaccaucuccuggcgcaccggccgcuaccgccuccgcugcggcggcaccgccgaggagauccucgacgucuga

SEQ ID NO: 51466 - RNA, 1284 nt, Artificial Sequence
  derived and/or modified sequence opt2 from UGDH__Homo_sapiens__NP_001171629
auguucgagaucaagaagaucugcugcaucggcgccggcuacgucggcggccccaccugcuccgucaucgcccacaugugccccgagauccgcgucaccgucgucgacgucaacgagucccgcaucaacgccuggaacucccccacccuccccaucuacgagcccggccucaaggaggucgucgaguccugccgcggcaagaaccucuucuucuccaccaacaucgacgacgccaucaaggaggccgaccucgucuucaucuccguccucuccaaccccgaguuccucgccgagggcaccgccaucaaggaccucaagaaccccgaccgcguccucaucggcggcgacgagacccccgagggccagcgcgccguccaggcccucugcgccgucuacgagcacugggucccccgcgagaagauccucaccaccaacaccugguccuccgagcucuccaagcucgccgccaacgccuuccucgcccagcgcaucuccuccaucaacuccaucuccgcccucugcgaggccaccggcgccgacgucgaggaggucgccaccgccaucggcauggaccagcgcaucggcaacaaguuccucaaggccuccgucggcuucggcggcuccugcuuccagaaggacguccucaaccucgucuaccucugcgaggcccucaaccuccccgaggucgcccgcuacuggcagcaggucaucgacaugaacgacuaccagcgccgccgcuucgccucccgcaucaucgacucccucuucaacaccgucaccgacaagaagaucgccauccucggcuucgccuucaagaaggacaccggcgacacccgcgaguccuccuccaucuacaucuccaaguaccucauggacgagggcgcccaccuccacaucuacgaccccaaggucccccgcgagcagaucgucgucgaccucucccaccccggcgucuccgaggacgaccaggucucccgccucgucaccaucuccaaggaccccuacgaggccugcgacggcgcccacgccgucgucaucugcaccgagugggacauguucaaggagcucgacuacgagcgcauccacaagaagaugcucaagcccgccuucaucuucgacggccgccgcguccucgacggccuccacaacgagcuccagaccaucggcuuccagaucgagaccaucggcaagaaggucuccuccaagcgcauccccuacgcccccuccggcgagauccccaaguucucccuccaggacccccccaacaagaagcccaaggucuga

SEQ ID NO: 51467 - RNA, 4668 nt, Artificial Sequence
  derived and/or modified sequence opt2 from UGGT1__Homo_sapiens__NP_064505
augggcugcaagggcgacgccuccggcgccugcgccgccggcgcccuccccgucaccggcgucugcuacaagaugggcguccucgucguccucaccguccucuggcucuucuccuccgucaaggccgacuccaaggccaucaccaccucccucaccaccaagugguucuccaccccccuccuccucgaggccuccgaguuccucgccgaggacucccaggagaaguucuggaacuucgucgaggccucccagaacaucggcuccuccgaccacgacggcaccgacuacuccuacuaccacgccauccucgaggccgccuuccaguuccucuccccccuccagcagaaccucuucaaguucugccucucccuccgcuccuacuccgccaccauccaggccuuccagcagaucgccgccgacgagcccccccccgagggcugcaacuccuucuucuccguccacggcaagaagaccugcgaguccgacacccucgaggcccuccuccucaccgccuccgagcgccccaagccccuccucuucaagggcgaccaccgcuaccccuccuccaaccccgagucccccgucgucaucuucuacuccgagaucggcuccgaggaguucuccaacuuccaccgccagcucaucuccaaguccaacgccggcaagaucaacuacgucuuccgccacuacaucuucaacccccgcaaggagcccgucuaccucuccggcuacggcgucgagcucgccaucaaguccaccgaguacaaggccaaggacgacacccaggucaagggcaccgaggucaacaccaccgucaucggcgagaacgaccccaucgacgagguccagggcuuccucuucggcaagcuccgcgaccuccaccccgaccucgagggccagcucaaggagcuccgcaagcaccucgucgaguccaccaacgagauggccccccucaaggucuggcagcuccaggaccucuccuuccagaccgccgcccgcauccucgccucccccgucgagcucgcccucgucgucaugaaggaccucucccagaacuuccccaccaaggcccgcgccaucaccaagaccgccgucuccuccgagcuccgcaccgaggucgaggagaaccagaaguacuucaagggcacccucggccuccagcccggcgacuccgcccucuucaucaacggccuccacauggaccucgacacccaggacaucuucucccucuucgacguccuccgcaacgaggcccgcgucauggagggccuccaccgccucggcaucgagggccucucccuccacaacguccucaagcucaacauccagcccuccgaggccgacuacgccgucgacauccgcucccccgccaucuccugggucaacaaccucgaggucgacucccgcuacaacuccuggcccuccucccuccaggagcuccuccgccccaccuuccccggcgucauccgccagauccgcaagaaccuccacaacauggucuucaucgucgaccccgcccacgagaccaccgccgagcucaugaacaccgccgagauguuccucuccaaccacaucccccuccgcaucggcuucaucuucgucgucaacgacuccgaggacgucgacggcaugcaggacgccggcgucgccguccuccgcgccuacaacuacgucgcccaggaggucgacgacuaccacgccuuccagacccucacccacaucuacaacaagguccgcaccggcgagaaggucaaggucgagcacgucgucuccguccucgagaagaaguaccccuacgucgaggucaacuccauccucggcaucgacuccgccuacgaccgcaaccgcaaggaggcccgcggcuacuacgagcagaccggcgucggcccccuccccgucguccucuucaacggcaugcccuucgagcgcgagcagcucgaccccgacgagcucgagaccaucaccaugcacaagauccucgagaccaccaccuucuuccagcgcgccgucuaccucggcgagcucccccacgaccaggacgucgucgaguacaucaugaaccagcccaacgucgucccccgcaucaacucccgcauccucaccgccgagcgcgacuaccucgaccucaccgccuccaacaacuucuucgucgacgacuacgcccgcuucaccauccucgacucccagggcaagaccgccgccgucgccaacuccaugaacuaccucaccaagaagggcauguccuccaaggagaucuacgacgacuccuucauccgccccgucaccuucuggaucgucggcgacuucgacucccccuccggccgccagcuccucuacgacgccaucaagcaccagaaguccuccaacaacguccgcaucuccaugaucaacaaccccgccaaggagaucuccuacgagaacacccagaucucccgcgccaucugggccgcccuccagacccagaccuccaacgccgccaagaacuucaucaccaagauggccaaggagggcgccgccgaggcccucgccgccggcgccgacaucgccgaguucuccgucggcggcauggacuucucccucuucaaggaggucuucgaguccuccaagauggacuucauccucucccacgccgucuacugccgcgacguccucaagcucaagaagggccagcgcgccgucaucuccaacggccgcaucaucggcccccucgaggacuccgagcucuucaaccaggacgacuuccaccuccucgagaacaucauccucaagaccuccggccagaagaucaagucccacauccagcagcuccgcgucgaggaggacgucgccuccgaccucgucaugaaggucgacgcccuccucuccgcccagcccaagggcgacccccgcaucgaguaccaguucuucgaggaccgccacuccgccaucaagcuccgccccaaggagggcgagaccuacuucgacgucgucgccgucgucgaccccgucacccgcgaggcccagcgccucgccccccuccuccucguccucgcccagcucaucaacaugaaccuccgcgucuucaugaacugccaguccaagcucuccgacaugccccucaaguccuucuaccgcuacguccucgagcccgagaucuccuucaccuccgacaacuccuucgccaagggccccaucgccaaguuccucgacaugccccaguccccccucuucacccucaaccucaacacccccgaguccuggauggucgaguccguccgcacccccuacgaccucgacaacaucuaccucgaggaggucgacuccgucgucgccgccgaguacgagcucgaguaccuccuccucgagggccacugcuacgacaucaccaccggccagcccccccgcggccuccaguucacccucggcaccuccgccaaccccgucaucgucgacaccaucgucauggccaaccucggcuacuuccagcucaaggccaaccccggcgccuggauccuccgccuccgcaagggccgcuccgaggacaucuaccgcaucuacucccacgacggcaccgacuccccccccgacgccgacgaggucgucaucguccucaacaacuucaaguccaagaucaucaaggucaagguccagaagaaggccgacauggucaacgaggaccuccucuccgacggcaccuccgagaacgaguccggcuucugggacuccuucaaguggggcuucaccggccagaagaccgaggaggucaagcaggacaaggacgacaucaucaacaucuucuccgucgccuccggccaccucuacgagcgcuuccuccgcaucaugaugcucuccguccucaagaacaccaagacccccgucaaguucugguuccucaagaacuaccucucccccaccuucaaggaguucauccccuacauggccaacgaguacaacuuccaguacgagcucguccaguacaaguggccccgcuggcuccaccagcagaccgagaagcagcgcaucaucuggggcuacaagauccucuuccucgacguccucuucccccucgucgucgacaaguuccucuucgucgacgccgaccagaucguccgcaccgaccucaaggagcuccgcgacuucaaccucgacggcgcccccuacggcuacacccccuucugcgacucccgccgcgagauggacggcuaccgcuucuggaaguccggcuacugggccucccaccucgccggccgcaaguaccacaucuccgcccucuacgucgucgaccucaagaaguuccgcaagaucgccgccggcgaccgccuccgcggccaguaccagggccucucccaggaccccaacucccucuccaaccucgaccaggaccuccccaacaacaugauccaccagguccccaucaagucccucccccaggaguggcucuggugcgagaccuggugcgacgacgccuccaagaagcgcgccaagaccaucgaccucugcaacaaccccaugaccaaggagcccaagcucgaggccgccguccgcaucguccccgaguggcaggacuacgaccaggagaucaagcagcuccagauccgcuuccagaaggagaaggagaccggcgcccucuacaaggagaagaccaaggagcccucccgcgagggcccccagaagcgcgaggagcucuga

SEQ ID NO: 51468 - RNA, 4551 nt, Artificial Sequence
  derived and/or modified sequence opt2 from UGGT2__Homo_sapiens__NP_064506
auggcccccgccaaggccaccaacgucguccgccuccuccucggcuccaccgcccucuggcucucccagcucggcuccggcaccgucgccgccuccaaguccgucaccgcccaccucgccgccaaguggcccgagaccccccuccuccucgaggccuccgaguucauggccgaggaguccaacgagaaguucuggcaguuccucgagaccguccaggagcucgccaucuacaagcagaccgaguccgacuacuccuacuacaaccucauccucaagaaggccggccaguuccucgacaaccuccacaucaaccuccucaaguucgccuucuccauccgcgccuacucccccgccauccagauguuccagcagaucgccgccgacgagcccccccccgacggcugcaacgccuucgucgucauccacaagaagcacaccugcaagaucaacgagaucaagaagcuccucaagaaggccgccucccgcacccgccccuaccucuucaagggcgaccacaaguuccccaccaacaaggagaaccuccccgucgucauccucuacgccgagaugggcacccgcaccuucuccgccuuccacaagguccucuccgagaaggcccagaacgaggagauccucuacguccuccgccacuacauccagaagcccuccucccgcaagauguaccucuccggcuacggcgucgagcucgccaucaaguccaccgaguacaaggcccucgacgacacccaggucaagaccgucaccaacaccaccgucgaggacgagaccgagaccaacgagguccagggcuuccucuucggcaagcucaaggagaucuacuccgaccuccgcgacaaccucaccgccuuccagaaguaccucaucgaguccaacaagcagaugaugccccucaaggucugggagcuccaggaccucuccuuccaggccgccucccagaucauguccgcccccgucuacgacuccaucaagcucaugaaggacaucucccagaacuuccccaucaaggcccgcucccucacccgcaucgccgucaaccagcacaugcgcgaggagaucaaggagaaccagaaggaccuccagguccgcuucaagauccagcccggcgacgcccgccucuucaucaacggccuccgcgucgacauggacgucuacgacgccuucuccauccucgacaugcucaagcucgagggcaagaugaugaacggccuccgcaaccucggcaucaacggcgaggacauguccaaguuccucaagcucaacucccacaucugggaguacaccuacguccucgacauccgccacuccuccaucauguggaucaacgaccucgagaacgacgaccucuacaucaccuggcccaccuccugccagaagcuccucaagcccgucuuccccggcuccguccccuccauccgccgcaacuuccacaaccucguccucuucaucgaccccgcccaggaguacacccucgacuucaucaagcucgccgacgucuucuacucccacgaggucccccuccgcaucggcuucgucuucauccucaacaccgacgacgaggucgacggcgccaacgacgccggcgucgcccucuggcgcgccuucaacuacaucgccgaggaguucgacaucuccgaggccuucaucuccaucguccacauguaccagaaggucaagaaggaccagaacauccucaccgucgacaacgucaaguccguccuccagaacaccuucccccacgccaacaucugggacauccucggcauccacuccaaguacgacgaggagcgcaaggccggcgccuccuucuacaagaugaccggccucggcccccucccccaggcccucuacaacggcgagcccuucaagcacgaggagaugaacaucaaggagcucaagauggccguccuccagcgcaugauggacgccuccgucuaccuccagcgcgaggucuuccucggcacccucaacgaccgcaccaacgccaucgacuuccucauggaccgcaacaacgucgucccccgcaucaacacccucauccuccgcaccaaccagcaguaccucaaccucaucuccaccuccgucaccgccgacgucgaggacuucuccaccuucuucuuccucgacucccaggacaaguccgccgucaucgccaagaacauguacuaccucacccaggacgacgaguccaucaucuccgccgucacccucuggaucaucgccgacuucgacaagcccuccggccgcaagcuccucuucaacgcccucaagcacaugaagaccuccguccacucccgccucggcaucaucuacaaccccaccuccaagaucaacgaggagaacaccgccaucucccgcggcauccucgccgccuuccucacccagaagaacauguuccuccgcuccuuccucggccagcucgccaaggaggagaucgccaccgccaucuacuccggcgacaagaucaagaccuuccucaucgagggcauggacaagaacgccuucgagaagaaguacaacaccgucggcgucaacaucuuccgcacccaccagcucuucugccaggacguccucaagcuccgccccggcgagaugggcaucgucuccaacggccgcuuccucggcccccucgacgaggacuucuacgccgaggacuucuaccuccucgagaagaucaccuucuccaaccucggcgagaagaucaagggcaucgucgagaacaugggcaucaacgccaacaacauguccgacuucaucaugaaggucgacgcccucauguccuccguccccaagcgcgccucccgcuacgacgucaccuuccuccgcgagaaccacuccgucaucaagaccaacccccaggagaacgacauguucuucaacgucaucgccaucgucgacccccucacccgcgaggcccagaagauggcccagcuccucgucguccucggcaagaucaucaacaugaagaucaagcucuucaugaacugccgcggccgccucuccgaggccccccucgaguccuucuaccgcuucguccucgagcccgagcucauguccggcgccaacgacgucuccucccucggccccgucgccaaguuccucgacauccccgaguccccccuccucauccucaacaugaucacccccgagggcuggcucgucgagaccguccacuccaacugcgaccucgacaacauccaccucaaggacaccgagaagaccgucaccgccgaguacgagcucgaguaccuccuccucgagggccagugcuucgacaaggucaccgagcagcccccccgcggccuccaguucacccucggcaccaagaacaagcccgccgucgucgacaccaucgucauggcccaccacggcuacuuccagcucaaggccaaccccggcgccuggauccuccgccuccaccagggcaaguccgaggacaucuaccagaucgucggccacgagggcaccgacucccaggccgaccucgaggacaucaucgucguccucaacuccuucaaguccaagauccucaaggucaaggucaagaaggagaccgacaagaucaaggaggacauccucaccgacgaggacgagaagaccaagggccucugggacuccaucaaguccuucaccgucucccuccacaaggagaacaagaaggagaaggacguccucaacaucuucuccgucgccuccggccaccucuacgagcgcuuccuccgcaucaugaugcucuccguccuccgcaacaccaagacccccgucaaguucuggcuccucaagaacuaccucucccccaccuucaaggaggucaucccccacauggccaaggaguacggcuuccgcuacgagcucguccaguaccgcuggccccgcuggcuccgccagcagaccgagcgccagcgcaucaucuggggcuacaagauccucuuccucgacguccucuucccccucgccgucgacaagaucaucuucgucgacgccgaccagaucguccgccacgaccucaaggagcuccgcgacuucgaccucgacggcgcccccuacggcuacacccccuucugcgacucccgccgcgagauggacggcuaccgcuucuggaagaccggcuacugggccucccaccuccuccgccgcaaguaccacaucuccgcccucuacgucgucgaccucaagaaguuccgccgcaucggcgccggcgaccgccuccgcucccaguaccaggcccucucccaggaccccaacucccucuccaaccucgaccaggaccuccccaacaacaugaucuaccaggucgccaucaagucccucccccaggacuggcucuggugcgagaccuggugcgacgacgaguccaagcagcgcgccaagaccaucgaccucugcaacaaccccaagaccaaggaguccaagcucaaggccgccgcccgcaucguccccgagugggucgaguacgacgccgagauccgccagcuccucgaccaccucgagaacaagaagcaggacaccauccucacccacgacgagcucuga

SEQ ID NO: 51469 - RNA, 1527 nt, Artificial Sequence
  derived and/or modified sequence opt2 from UGP2__Homo_sapiens__NP_006750
augucccgcuucguccaggaccucuccaaggccaugucccaggacggcgccucccaguuccaggaggucauccgccaggagcucgagcucuccgucaagaaggagcucgagaagauccucaccaccgccuccucccacgaguucgagcacaccaagaaggaccucgacggcuuccgcaagcucuuccaccgcuuccuccaggagaagggccccuccgucgacuggggcaagauccagcgcccccccgaggacuccauccagcccuacgagaagaucaaggcccgcggccuccccgacaacaucuccuccguccucaacaagcucgucgucgucaagcucaacggcggccucggcaccuccaugggcugcaagggccccaagucccucaucggcguccgcaacgagaacaccuuccucgaccucaccguccagcagaucgagcaccucaacaagaccuacaacaccgacgucccccucguccucaugaacuccuucaacaccgacgaggacaccaagaagauccuccagaaguacaaccacugccgcgucaagaucuacaccuucaaccagucccgcuacccccgcaucaacaaggagucccuccuccccgucgccaaggacgucuccuacuccggcgagaacaccgaggccugguacccccccggccacggcgacaucuacgccuccuucuacaacuccggccuccucgacaccuucaucggcgagggcaaggaguacaucuucgucuccaacaucgacaaccucggcgccaccgucgaccucuacauccucaaccaccucaugaacccccccaacggcaagcgcugcgaguucgucauggaggucaccaacaagacccgcgccgacgucaagggcggcacccucacccaguacgagggcaagcuccgccucgucgagaucgcccagguccccaaggcccacgucgacgaguucaaguccgucuccaaguucaagaucuucaacaccaacaaccucuggaucucccucgccgccgucaagcgccuccaggagcagaacgccaucgacauggagaucaucgucaacgccaagacccucgacggcggccucaacgucauccagcucgagaccgccgucggcgccgccaucaaguccuucgagaacucccucggcaucaacgucccccgcucccgcuuccuccccgucaagaccaccuccgaccuccuccucgucauguccaaccucuacucccucaacgccggcucccucaccauguccgagaagcgcgaguuccccaccgucccccucgucaagcucggcuccuccuucaccaagguccaggacuaccuccgccgcuucgaguccauccccgacaugcucgagcucgaccaccucaccgucuccggcgacgucaccuucggcaagaacgucucccucaagggcaccgucaucaucaucgccaaccacggcgaccgcaucgacaucccccccggcgccguccucgagaacaagaucgucuccggcaaccuccgcauccucgaccacuga

SEQ ID NO: 51470 - RNA, 1593 nt, Artificial Sequence
  derived and/or modified sequence opt2 from UGT1A10__Homo_sapiens__NP_061948
auggcccgcgccggcuggaccucccccgucccccucugcgucugccuccuccucaccugcggcuucgccgaggccggcaagcuccucgucguccccauggacggcucccacugguucaccaugcaguccgucgucgagaagcucauccuccgcggccacgaggucgucgucgucaugcccgaggucuccuggcagcucgagcgcucccucaacugcaccgucaagaccuacuccaccuccuacacccucgaggaccagaaccgcgaguucauggucuucgcccacgcccaguggaaggcccaggcccaguccaucuucucccuccucauguccuccuccuccggcuuccucgaccucuucuucucccacugccgcucccucuucaacgaccgcaagcucgucgaguaccucaaggaguccuccuucgacgccgucuuccucgaccccuucgacaccugcggccucaucgucgccaaguacuucucccuccccuccgucgucuucacccgcggcaucuucugccaccaccucgaggagggcgcccagugccccgccccccucuccuacguccccaacgaccuccucggcuucuccgacgccaugaccuucaaggagcgcgucuggaaccacaucguccaccucgaggaccaccucuucugccaguaccucuuccgcaacgcccucgagaucgccuccgagauccuccagacccccgucaccgccuacgaccucuacucccacaccuccaucuggcuccuccgcaccgacuucguccucgacuaccccaagcccgucaugcccaacaugaucuucaucggcggcaucaacugccaccagggcaagccccuccccauggaguucgaggccuacaucaacgccuccggcgagcacggcaucgucgucuucucccucggcuccauggucuccgagauccccgagaagaaggccauggccaucgccgacgcccucggcaagaucccccagaccguccucuggcgcuacaccggcacccgccccuccaaccucgccaacaacaccauccucgucaaguggcucccccagaacgaccuccucggccaccccaugacccgcgccuucaucacccacgccggcucccacggcgucuacgaguccaucugcaacggcguccccauggucaugaugccccucuucggcgaccagauggacaacgccaagcgcauggagaccaagggcgccggcgucacccucaacguccucgagaugaccuccgaggaccucgagaacgcccucaaggccgucaucaacgacaaguccuacaaggagaacaucaugcgccucuccucccuccacaaggaccgccccgucgagccccucgaccucgccgucuucugggucgaguucgucaugcgccacaagggcgccccccaccuccgccccgccgcccacgaccucaccugguaccaguaccacucccucgacgucaucggcuuccuccucgccgucguccucaccgucgccuucaucaccuucaagugcugcgccuacggcuaccgcaagugccucggcaagaagggccgcgucaagaaggcccacaaguccaagacccacuga

SEQ ID NO: 51471 - RNA, 1602 nt, Artificial Sequence
  derived and/or modified sequence opt2 from UGT1A1__Homo_sapiens__NP_000454
auggccgucgagucccagggcggccgcccccucguccucggccuccuccucugcguccucggccccgucgucucccacgccggcaagauccuccucauccccgucgacggcucccacuggcucuccaugcucggcgccauccagcagcuccagcagcgcggccacgagaucgucguccucgcccccgacgccucccucuacauccgcgacggcgccuucuacacccucaagaccuaccccguccccuuccagcgcgaggacgucaaggaguccuucgucucccucggccacaacgucuucgagaacgacuccuuccuccagcgcgucaucaagaccuacaagaagaucaagaaggacuccgccaugcuccucuccggcugcucccaccuccuccacaacaaggagcucauggccucccucgccgaguccuccuucgacgucaugcucaccgaccccuuccuccccugcucccccaucgucgcccaguaccucucccuccccaccgucuucuuccuccacgcccuccccugcucccucgaguucgaggccacccagugccccaaccccuucuccuacgucccccgcccccucuccucccacuccgaccacaugaccuuccuccagcgcgucaagaacaugcucaucgccuucucccagaacuuccucugcgacgucgucuacucccccuacgccacccucgccuccgaguuccuccagcgcgaggucaccguccaggaccuccucuccuccgccuccgucuggcucuuccgcuccgacuucgucaaggacuacccccgccccaucaugcccaacauggucuucgucggcggcaucaacugccuccaccagaacccccucucccaggaguucgaggccuacaucaacgccuccggcgagcacggcaucgucgucuucucccucggcuccauggucuccgagauccccgagaagaaggccauggccaucgccgacgcccucggcaagaucccccagaccguccucuggcgcuacaccggcacccgccccuccaaccucgccaacaacaccauccucgucaaguggcucccccagaacgaccuccucggccaccccaugacccgcgccuucaucacccacgccggcucccacggcgucuacgaguccaucugcaacggcguccccauggucaugaugccccucuucggcgaccagauggacaacgccaagcgcauggagaccaagggcgccggcgucacccucaacguccucgagaugaccuccgaggaccucgagaacgcccucaaggccgucaucaacgacaaguccuacaaggagaacaucaugcgccucuccucccuccacaaggaccgccccgucgagccccucgaccucgccgucuucugggucgaguucgucaugcgccacaagggcgccccccaccuccgccccgccgcccacgaccucaccugguaccaguaccacucccucgacgucaucggcuuccuccucgccgucguccucaccgucgccuucaucaccuucaagugcugcgccuacggcuaccgcaagugccucggcaagaagggccgcgucaagaaggcccacaaguccaagacccacuga

SEQ ID NO: 51472 - RNA, 1605 nt, Artificial Sequence
  derived and/or modified sequence opt2 from UGT1A3__Homo_sapiens__NP_061966
auggccaccggccuccaggucccccuccccuggcucgccaccggccuccuccuccuccucuccguccagcccugggccgaguccggcaagguccucgucguccccaucgacggcucccacuggcucuccaugcgcgagguccuccgcgagcuccacgcccgcggccaccaggccgucguccucacccccgaggucaacaugcacaucaaggaggagaacuucuucacccucaccaccuacgccaucuccuggacccaggacgaguucgaccgccacguccucggccacacccagcucuacuucgagaccgagcacuuccucaagaaguucuuccgcuccauggccaugcucaacaacaugucccucgucuaccaccgcuccugcgucgagcuccuccacaacgaggcccucauccgccaccucaacgccaccuccuucgacgucguccucaccgaccccgucaaccucugcgccgccguccucgccaaguaccucuccauccccaccgucuucuuccuccgcaacauccccugcgaccucgacuucaagggcacccagugccccaaccccuccuccuacaucccccgccuccucaccaccaacuccgaccacaugaccuucaugcagcgcgucaagaacaugcucuacccccucgcccucuccuacaucugccacgccuucuccgcccccuacgccucccucgccuccgagcucuuccagcgcgaggucuccgucgucgacauccucucccacgccuccgucuggcucuuccgcggcgacuucgucauggacuacccccgccccaucaugcccaacauggucuucaucggcggcaucaacugcgccaaccgcaagccccucucccaggaguucgaggccuacaucaacgccuccggcgagcacggcaucgucgucuucucccucggcuccauggucuccgagauccccgagaagaaggccauggccaucgccgacgcccucggcaagaucccccagaccguccucuggcgcuacaccggcacccgccccuccaaccucgccaacaacaccauccucgucaaguggcucccccagaacgaccuccucggccaccccaugacccgcgccuucaucacccacgccggcucccacggcgucuacgaguccaucugcaacggcguccccauggucaugaugccccucuucggcgaccagauggacaacgccaagcgcauggagaccaagggcgccggcgucacccucaacguccucgagaugaccuccgaggaccucgagaacgcccucaaggccgucaucaacgacaaguccuacaaggagaacaucaugcgccucuccucccuccacaaggaccgccccgucgagccccucgaccucgccgucuucugggucgaguucgucaugcgccacaagggcgccccccaccuccgccccgccgcccacgaccucaccugguaccaguaccacucccucgacgucaucggcuuccuccucgccgucguccucaccgucgccuucaucaccuucaagugcugcgccuacggcuaccgcaagugccucggcaagaagggccgcgucaagaaggcccacaaguccaagacccacuga

SEQ ID NO: 51473 - RNA, 1605 nt, Artificial Sequence
  derived and/or modified sequence opt2 from UGT1A4__Homo_sapiens__NP_009051
auggcccgcggccuccaggucccccucccccgccucgccaccggccuccuccuccuccucuccguccagcccugggccgaguccggcaagguccucgucguccccaccgacggcucccccuggcucuccaugcgcgaggcccuccgcgagcuccacgcccgcggccaccaggccgucguccucacccccgaggucaacaugcacaucaaggaggagaaguucuucacccucaccgccuacgccguccccuggacccagaaggaguucgaccgcgucacccucggcuacacccagggcuucuucgagaccgagcaccuccucaagcgcuacucccgcuccauggccaucaugaacaacgucucccucgcccuccaccgcugcugcgucgagcuccuccacaacgaggcccucauccgccaccucaacgccaccuccuucgacgucguccucaccgaccccgucaaccucugcggcgccguccucgccaaguaccucuccauccccgccgucuucuucuggcgcuacauccccugcgaccucgacuucaagggcacccagugccccaaccccuccuccuacauccccaagcuccucaccaccaacuccgaccacaugaccuuccuccagcgcgucaagaacaugcucuacccccucgcccucuccuacaucugccacaccuucuccgcccccuacgccucccucgccuccgagcucuuccagcgcgaggucuccgucgucgaccucgucuccuacgccuccgucuggcucuuccgcggcgacuucgucauggacuacccccgccccaucaugcccaacauggucuucaucggcggcaucaacugcgccaacggcaagccccucucccaggaguucgaggccuacaucaacgccuccggcgagcacggcaucgucgucuucucccucggcuccauggucuccgagauccccgagaagaaggccauggccaucgccgacgcccucggcaagaucccccagaccguccucuggcgcuacaccggcacccgccccuccaaccucgccaacaacaccauccucgucaaguggcucccccagaacgaccuccucggccaccccaugacccgcgccuucaucacccacgccggcucccacggcgucuacgaguccaucugcaacggcguccccauggucaugaugccccucuucggcgaccagauggacaacgccaagcgcauggagaccaagggcgccggcgucacccucaacguccucgagaugaccuccgaggaccucgagaacgcccucaaggccgucaucaacgacaaguccuacaaggagaacaucaugcgccucuccucccuccacaaggaccgccccgucgagccccucgaccucgccgucuucugggucgaguucgucaugcgccacaagggcgccccccaccuccgccccgccgcccacgaccucaccugguaccaguaccacucccucgacgucaucggcuuccuccucgccgucguccucaccgucgccuucaucaccuucaagugcugcgccuacggcuaccgcaagugccucggcaagaagggccgcgucaagaaggcccacaaguccaagacccacuga

SEQ ID NO: 51474 - RNA, 1605 nt, Artificial Sequence
  derived and/or modified sequence opt2 from UGT1A5__Homo_sapiens__NP_061951
auggccaccggccuccaggucccccucccccagcucgccaccggccuccuccuccuccucuccguccagcccugggccgaguccggcaagguccucgucguccccaccgacggcucccacuggcucuccaugcgcgaggcccuccgcgaccuccacgcccgcggccaccaggucgucguccucacccucgaggucaacauguacaucaaggaggagaacuucuucacccucaccaccuacgccaucuccuggacccaggacgaguucgaccgccuccuccucggccacacccaguccuucuucgagaccgagcaccuccucaugaaguucucccgccgcauggccaucaugaacaacaugucccucaucauccaccgcuccugcgucgagcuccuccacaacgaggcccucauccgccaccuccacgccaccuccuucgacgucguccucaccgaccccuuccaccucugcgccgccguccucgccaaguaccucuccauccccgccgucuucuuccuccgcaacauccccugcgaccucgacuucaagggcacccagugccccaaccccuccuccuacaucccccgccuccucaccaccaacuccgaccacaugaccuuccuccagcgcgucaagaacaugcucuacccccucgcccucuccuaccucugccacgccgucuccgcccccuacgccucccucgccuccgagcucuuccagcgcgaggucuccgucgucgaccucgucucccacgccuccgucuggcucuuccgcggcgacuucgucauggacuacccccgccccaucaugcccaacauggucuucaucggcggcaucaacugcgccaacggcaagccccucucccaggaguucgaggccuacaucaacgccuccggcgagcacggcaucgucgucuucucccucggcuccauggucuccgagauccccgagaagaaggccauggccaucgccgacgcccucggcaagaucccccagaccguccucuggcgcuacaccggcacccgccccuccaaccucgccaacaacaccauccucgucaaguggcucccccagaacgaccuccucggccaccccaugacccgcgccuucaucacccacgccggcucccacggcgucuacgaguccaucugcaacggcguccccauggucaugaugccccucuucggcgaccagauggacaacgccaagcgcauggagaccaagggcgccggcgucacccucaacguccucgagaugaccuccgaggaccucgagaacgcccucaaggccgucaucaacgacaaguccuacaaggagaacaucaugcgccucuccucccuccacaaggaccgccccgucgagccccucgaccucgccgucuucugggucgaguucgucaugcgccacaagggcgccccccaccuccgccccgccgcccacgaccucaccugguaccaguaccacucccucgacgucaucggcuuccuccucgccgucguccucaccgucgccuucaucaccuucaagugcugcgccuacggcuaccgcaagugccucggcaagaagggccgcgucaagaaggcccacaaguccaagacccacuga

SEQ ID NO: 51475 - RNA, 1599 nt, Artificial Sequence
  derived and/or modified sequence opt2 from UGT1A6__Homo_sapiens__NP_001063
auggccugccuccuccgcuccuuccagcgcaucuccgccggcgucuucuuccucgcccucuggggcauggucgucggcgacaagcuccucgucgucccccaggacggcucccacuggcucuccaugaaggacaucgucgagguccucuccgaccgcggccacgagaucgucgucgucguccccgaggucaaccuccuccucaaggaguccaaguacuacacccgcaagaucuaccccguccccuacgaccaggaggagcucaagaaccgcuaccaguccuucggcaacaaccacuucgccgagcgcuccuuccucaccgccccccagaccgaguaccgcaacaacaugaucgucaucggccucuacuucaucaacugccagucccuccuccaggaccgcgacacccucaacuucuucaaggaguccaaguucgacgcccucuucaccgaccccgcccuccccugcggcgucauccucgccgaguaccucggccuccccuccgucuaccucuuccgcggcuuccccugcucccucgagcacaccuucucccgcucccccgaccccgucuccuacaucccccgcugcuacaccaaguucuccgaccacaugaccuucucccagcgcgucgccaacuuccucgucaaccuccucgagcccuaccucuucuacugccucuucuccaaguacgaggagcucgccuccgccguccucaagcgcgacgucgacaucaucacccucuaccagaaggucuccgucuggcuccuccgcuacgacuucguccucgaguacccccgccccgucaugcccaacauggucuucaucggcggcaucaacugcaagaagcgcaaggaccucucccaggaguucgaggccuacaucaacgccuccggcgagcacggcaucgucgucuucucccucggcuccauggucuccgagauccccgagaagaaggccauggccaucgccgacgcccucggcaagaucccccagaccguccucuggcgcuacaccggcacccgccccuccaaccucgccaacaacaccauccucgucaaguggcucccccagaacgaccuccucggccaccccaugacccgcgccuucaucacccacgccggcucccacggcgucuacgaguccaucugcaacggcguccccauggucaugaugccccucuucggcgaccagauggacaacgccaagcgcauggagaccaagggcgccggcgucacccucaacguccucgagaugaccuccgaggaccucgagaacgcccucaaggccgucaucaacgacaaguccuacaaggagaacaucaugcgccucuccucccuccacaaggaccgccccgucgagccccucgaccucgccgucuucugggucgaguucgucaugcgccacaagggcgccccccaccuccgccccgccgcccacgaccucaccugguaccaguaccacucccucgacgucaucggcuuccuccucgccgucguccucaccgucgccuucaucaccuucaagugcugcgccuacggcuaccgcaagugccucggcaagaagggccgcgucaagaaggcccacaaguccaagacccacuga

SEQ ID NO: 51476 - RNA, 1593 nt, Artificial Sequence
  derived and/or modified sequence opt2 from UGT1A7__Homo_sapiens__NP_061950
auggcccgcgccggcuggaccggccuccucccccucuacgucugccuccuccucaccugcggcuucgccaaggccggcaagcuccucgucguccccauggacggcucccacugguucaccaugcaguccgucgucgagaagcucauccuccgcggccacgaggucgucgucgucaugcccgaggucuccuggcagcucggccgcucccucaacugcaccgucaagaccuacuccaccuccuacacccucgaggaccaggaccgcgaguucauggucuucgccgacgcccgcuggaccgccccccuccgcuccgccuucucccuccucaccuccuccuccaacggcaucuucgaccucuucuucuccaacugccgcucccucuucaacgaccgcaagcucgucgaguaccucaaggaguccugcuucgacgccgucuuccucgaccccuucgacgccugcggccucaucgucgccaaguacuucucccuccccuccgucgucuucgcccgcggcaucuucugccacuaccucgaggagggcgcccagugccccgccccccucuccuacgucccccgccuccuccucggcuucuccgacgccaugaccuucaaggagcgcgucuggaaccacaucaugcaccucgaggagcaccucuucugccccuacuucuucaagaacguccucgagaucgccuccgagauccuccagacccccgucaccgccuacgaccucuacucccacaccuccaucuggcuccuccgcaccgacuucguccucgaguaccccaagcccgucaugcccaacaugaucuucaucggcggcaucaacugccaccagggcaagcccguccccauggaguucgaggccuacaucaacgccuccggcgagcacggcaucgucgucuucucccucggcuccauggucuccgagauccccgagaagaaggccauggccaucgccgacgcccucggcaagaucccccagaccguccucuggcgcuacaccggcacccgccccuccaaccucgccaacaacaccauccucgucaaguggcucccccagaacgaccuccucggccaccccaugacccgcgccuucaucacccacgccggcucccacggcgucuacgaguccaucugcaacggcguccccauggucaugaugccccucuucggcgaccagauggacaacgccaagcgcauggagaccaagggcgccggcgucacccucaacguccucgagaugaccuccgaggaccucgagaacgcccucaaggccgucaucaacgacaaguccuacaaggagaacaucaugcgccucuccucccuccacaaggaccgccccgucgagccccucgaccucgccgucuucugggucgaguucgucaugcgccacaagggcgccccccaccuccgccccgccgcccacgaccucaccugguaccaguaccacucccucgacgucaucggcuuccuccucgccgucguccucaccgucgccuucaucaccuucaagugcugcgccuacggcuaccgcaagugccucggcaagaagggccgcgucaagaaggcccacaaguccaagacccacuga

SEQ ID NO: 51477 - RNA, 1593 nt, Artificial Sequence
  derived and/or modified sequence opt2 from UGT1A8__Homo_sapiens__NP_061949
auggcccgcaccggcuggaccucccccaucccccucugcgucucccuccuccucaccugcggcuucgccgaggccggcaagcuccucgucguccccauggacggcucccacugguucaccaugcaguccgucgucgagaagcucauccuccgcggccacgaggucgucgucgucaugcccgaggucuccuggcagcucggcaagucccucaacugcaccgucaagaccuacuccaccuccuacacccucgaggaccucgaccgcgaguucauggacuucgccgacgcccaguggaaggcccagguccgcucccucuucucccucuuccucuccuccuccaacggcuucuucaaccucuucuucucccacugccgcucccucuucaacgaccgcaagcucgucgaguaccucaaggaguccuccuucgacgccgucuuccucgaccccuucgacgccugcggccucaucgucgccaaguacuucucccuccccuccgucgucuucgcccgcggcaucgccugccacuaccucgaggagggcgcccagugccccgccccccucuccuacgucccccgcauccuccucggcuucuccgacgccaugaccuucaaggagcgcguccgcaaccacaucaugcaccucgaggagcaccucuucugccaguacuucuccaagaacgcccucgagaucgccuccgagauccuccagacccccgucaccgccuacgaccucuacucccacaccuccaucuggcuccuccgcaccgacuucguccucgacuaccccaagcccgucaugcccaacaugaucuucaucggcggcaucaacugccaccagggcaagccccuccccauggaguucgaggccuacaucaacgccuccggcgagcacggcaucgucgucuucucccucggcuccauggucuccgagauccccgagaagaaggccauggccaucgccgacgcccucggcaagaucccccagaccguccucuggcgcuacaccggcacccgccccuccaaccucgccaacaacaccauccucgucaaguggcucccccagaacgaccuccucggccaccccaugacccgcgccuucaucacccacgccggcucccacggcgucuacgaguccaucugcaacggcguccccauggucaugaugccccucuucggcgaccagauggacaacgccaagcgcauggagaccaagggcgccggcgucacccucaacguccucgagaugaccuccgaggaccucgagaacgcccucaaggccgucaucaacgacaaguccuacaaggagaacaucaugcgccucuccucccuccacaaggaccgccccgucgagccccucgaccucgccgucuucugggucgaguucgucaugcgccacaagggcgccccccaccuccgccccgccgcccacgaccucaccugguaccaguaccacucccucgacgucaucggcuuccuccucgccgucguccucaccgucgccuucaucaccuucaagugcugcgccuacggcuaccgcaagugccucggcaagaagggccgcgucaagaaggcccacaaguccaagacccacuga

SEQ ID NO: 51478 - RNA, 1593 nt, Artificial Sequence
  derived and/or modified sequence opt2 from UGT1A9__Homo_sapiens__NP_066307
auggccugcaccggcuggaccuccccccucccccucugcgucugccuccuccucaccugcggcuucgccgaggccggcaagcuccucgucguccccauggacggcucccacugguucaccaugcgcuccgucgucgagaagcucauccuccgcggccacgaggucgucgucgucaugcccgaggucuccuggcagcucggccgcucccucaacugcaccgucaagaccuacuccaccuccuacacccucgaggaccucgaccgcgaguucaaggccuucgcccacgcccaguggaaggcccagguccgcuccaucuacucccuccucaugggcuccuacaacgacaucuucgaccucuucuucuccaacugccgcucccucuucaaggacaagaagcucgucgaguaccucaaggaguccuccuucgacgccgucuuccucgaccccuucgacaacugcggccucaucgucgccaaguacuucucccuccccuccgucgucuucgcccgcggcauccucugccacuaccucgaggagggcgcccagugccccgccccccucuccuacgucccccgcauccuccucggcuucuccgacgccaugaccuucaaggagcgcguccgcaaccacaucaugcaccucgaggagcaccuccucugccaccgcuucuucaagaacgcccucgagaucgccuccgagauccuccagacccccgucaccgaguacgaccucuacucccacaccuccaucuggcuccuccgcaccgacuucguccucgacuaccccaagcccgucaugcccaacaugaucuucaucggcggcaucaacugccaccagggcaagccccuccccauggaguucgaggccuacaucaacgccuccggcgagcacggcaucgucgucuucucccucggcuccauggucuccgagauccccgagaagaaggccauggccaucgccgacgcccucggcaagaucccccagaccguccucuggcgcuacaccggcacccgccccuccaaccucgccaacaacaccauccucgucaaguggcucccccagaacgaccuccucggccaccccaugacccgcgccuucaucacccacgccggcucccacggcgucuacgaguccaucugcaacggcguccccauggucaugaugccccucuucggcgaccagauggacaacgccaagcgcauggagaccaagggcgccggcgucacccucaacguccucgagaugaccuccgaggaccucgagaacgcccucaaggccgucaucaacgacaaguccuacaaggagaacaucaugcgccucuccucccuccacaaggaccgccccgucgagccccucgaccucgccgucuucugggucgaguucgucaugcgccacaagggcgccccccaccuccgccccgccgcccacgaccucaccugguaccaguaccacucccucgacgucaucggcuuccuccucgccgucguccucaccgucgccuucaucaccuucaagugcugcgccuacggcuaccgcaagugccucggcaagaagggccgcgucaagaaggcccacaaguccaagacccacuga

SEQ ID NO: 51479 - RNA, 2082 nt, Artificial Sequence
  derived and/or modified sequence opt2 from UGT2A1__Homo_sapiens__NP_001239203
augcucaacaaccuccuccucuucucccuccagaucucccucaucggcaccacccucggcggcaacguccucaucuggcccauggagggcucccacuggcucaacgucaagaucaucaucgacgagcucaucaagaaggagcacaacgucaccguccucgucgccuccggcgcccucuucaucacccccaccuccaaccccucccucaccuucgagaucuacaagguccccuucggcaaggagcgcaucgagggcgucaucaaggacuucguccucaccuggcucgagaaccgccccucccccuccaccaucuggcgcuucuaccaggagauggccaaggucaucaaggacuuccacauggucucccaggagaucugcgacggcguccucaagaaccagcagcucauggccaagcucaagaaguccaaguucgagguccucgucuccgaccccgucuuccccugcggcgacaucgucgcccucaagcucggcauccccuucauguacucccuccgcuucucccccgccuccaccgucgagaagcacugcggcaagguccccuacccccccuccuacguccccgccguccucuccgagcucaccgaccagauguccuucaccgaccgcauccgcaacuucaucuccuaccaccuccaggacuacauguucgagacccucuggaaguccugggacuccuacuacuccaaggcccucgacggcucccacuggcucaacaucaagaucauccucgaggagcucauccagcgcaaccacaacgucaccguccucgccuccuccgccacccucuucaucaacuccaaccccgacucccccgucaacuucgaggucauccccgucuccuacaagaaguccaacaucgacucccucaucgagcacaugaucaugcucuggaucgaccaccgccccaccccccucaccaucugggccuucuacaaggagcucggcaagcuccucgacaccuucuuccagaucaacauccagcucugcgacggcguccucaagaaccccaagcucauggcccgccuccagaagggcggcuucgacguccucgucgccgaccccgucaccaucugcggcgaccucgucgcccucaagcucggcauccccuucauguacacccuccgcuucucccccgccuccaccgucgagcgccacugcggcaagauccccgcccccgucuccuacguccccgccgcccucuccgagcucaccgaccagaugaccuucggcgagcgcaucaagaacaccaucuccuacucccuccaggacuacaucuuccaguccuacuggggcgaguggaacuccuacuacuccaagauccucggccgccccaccacccucugcgagaccaugggcaaggccgagaucuggcucauccgcaccuacugggacuucgaguucccccgccccuaccuccccaacuucgaguucgucggcggccuccacugcaagcccgccaagccccuccccaagguccucuggcgcuacaagggcaagaagcccgccacccucggcaacaacacccagcucuucgacuggaucccccagaacgaccuccucggccaccccaagaccaaggccuucaucacccacggcggcaccaacggcaucuacgaggccaucuaccacggcguccccauggucggcguccccauguucgccgaccagcccgacaacaucgcccacaugaaggccaagggcgccgccgucgaggucaaccucaacaccaugaccuccgucgaccuccucuccgcccuccgcaccgucaucaacgagcccuccuacaaggagaacgccaugcgccucucccgcauccaccacgaccagcccgucaagccccucgaccgcgccgucuucuggaucgaguucgucaugcgccacaagggcgccaagcaccuccgcgucgccgcccacgaccucaccugguuccaguaccacucccucgacgucaucggcuuccuccucgucugcgucaccaccgccaucuuccucgucauccagugcugccucuucuccugccagaaguucggcaagaucggcaagaagaagaagcgcgaguga

SEQ ID NO: 51480 - RNA, 1611 nt, Artificial Sequence
  derived and/or modified sequence opt2 from UGT2A2__Homo_sapiens__NP_001099147
auggucuccauccgcgacuucaccaugcccaagaaguucguccagaugcucgucuucaaccucacccucaccgaggucguccucuccggcaacguccucaucuggcccaccgacggcucccacuggcucaacaucaagaucauccucgaggagcucauccagcgcaaccacaacgucaccguccucgccuccuccgccacccucuucaucaacuccaaccccgacucccccgucaacuucgaggucauccccgucuccuacaagaaguccaacaucgacucccucaucgagcacaugaucaugcucuggaucgaccaccgccccaccccccucaccaucugggccuucuacaaggagcucggcaagcuccucgacaccuucuuccagaucaacauccagcucugcgacggcguccucaagaaccccaagcucauggcccgccuccagaagggcggcuucgacguccucgucgccgaccccgucaccaucugcggcgaccucgucgcccucaagcucggcauccccuucauguacacccuccgcuucucccccgccuccaccgucgagcgccacugcggcaagauccccgcccccgucuccuacguccccgccgcccucuccgagcucaccgaccagaugaccuucggcgagcgcaucaagaacaccaucuccuacucccuccaggacuacaucuuccaguccuacuggggcgaguggaacuccuacuacuccaagauccucggccgccccaccacccucugcgagaccaugggcaaggccgagaucuggcucauccgcaccuacugggacuucgaguucccccgccccuaccuccccaacuucgaguucgucggcggccuccacugcaagcccgccaagccccuccccaaggagauggaggaguucauccaguccuccggcaagaacggcgucgucgucuucucccucggcuccauggucaagaaccucaccgaggagaaggccaaccucaucgccuccgcccucgcccagaucccccagaagguccucuggcgcuacaagggcaagaagcccgccacccucggcaacaacacccagcucuucgacuggaucccccagaacgaccuccucggccaccccaagaccaaggccuucaucacccacggcggcaccaacggcaucuacgaggccaucuaccacggcguccccauggucggcguccccauguucgccgaccagcccgacaacaucgcccacaugaaggccaagggcgccgccgucgaggucaaccucaacaccaugaccuccgucgaccuccucuccgcccuccgcaccgucaucaacgagcccuccuacaaggagaacgccaugcgccucucccgcauccaccacgaccagcccgucaagccccucgaccgcgccgucuucuggaucgaguucgucaugcgccacaagggcgccaagcaccuccgcgucgccgcccacgaccucaccugguuccaguaccacucccucgacgucaucggcuuccuccucgucugcgucaccaccgccaucuuccucgucauccagugcugccucuucuccugccagaaguucggcaagaucggcaagaagaagaagcgcgaguga

SEQ ID NO: 51481 - RNA, 1584 nt, Artificial Sequence
  derived and/or modified sequence opt2 from UGT2A3__Homo_sapiens__NP_079019
augcgcuccgacaaguccgcccucgucuuccuccuccuccagcucuucugcgucggcugcggcuucugcggcaagguccucgucuggcccugcgacaugucccacuggcucaacgucaaggucauccucgaggagcucaucguccgcggccacgaggucaccguccucacccacuccaagcccucccucaucgacuaccgcaagcccuccgcccucaaguucgaggucguccacaugccccaggaccgcaccgaggagaacgagaucuucgucgaccucgcccucaacguccuccccggccucuccaccuggcaguccgucaucaagcucaacgacuucuucgucgagauccgcggcacccucaagaugaugugcgaguccuucaucuacaaccagacccucaugaagaagcuccaggagaccaacuacgacgucaugcucaucgaccccgucauccccugcggcgaccucauggccgagcuccucgccguccccuucguccucacccuccgcaucuccgucggcggcaacauggagcgcuccugcggcaagcuccccgccccccucuccuacguccccguccccaugaccggccucaccgaccgcaugaccuuccucgagcgcgucaagaacuccaugcucuccguccucuuccacuucuggauccaggacuacgacuaccacuucugggaggaguucuacuccaaggcccucggccgccccaccacccucugcgagaccgucggcaaggccgagaucuggcucauccgcaccuacugggacuucgaguucccccagcccuaccagcccaacuucgaguucgucggcggccuccacugcaagcccgccaaggcccuccccaaggagauggagaacuucguccaguccuccggcgaggacggcaucgucgucuucucccucggcucccucuuccagaacgucaccgaggagaaggccaacaucaucgccuccgcccucgcccagaucccccagaagguccucuggcgcuacaagggcaagaagcccuccacccucggcgccaacacccgccucuacgacuggaucccccagaacgaccuccucggccaccccaagaccaaggccuucaucacccacggcggcaugaacggcaucuacgaggccaucuaccacggcguccccauggucggcguccccaucuucggcgaccagcucgacaacaucgcccacaugaaggccaagggcgccgccgucgagaucaacuucaagaccaugaccuccgaggaccuccuccgcgcccuccgcaccgucaucaccgacuccuccuacaaggagaacgccaugcgccucucccgcauccaccacgaccagcccgucaagccccucgaccgcgccgucuucuggaucgaguucgucaugcgccacaagggcgccaagcaccuccgcuccgccgcccacgaccucaccugguuccagcacuacuccaucgacgucaucggcuuccuccucgccugcgucgccaccgccaucuuccucuucaccaagugcuuccucuucuccugccagaaguucaacaagacccgcaagaucgagaagcgcgaguga

SEQ ID NO: 51482 - RNA, 1587 nt, Artificial Sequence
  derived and/or modified sequence opt2 from UGT2B10__Homo_sapiens__NP_001066
auggcccucaaguggaccaccguccuccucauccagcucuccuucuacuucuccuccggcuccugcggcaagguccucgucugggccgccgaguacucccucuggaugaacaugaagaccauccucaaggagcucguccagcgcggccacgaggucaccguccucgccuccuccgccuccauccucuucgaccccaacgacuccuccacccucaagcucgaggucuaccccaccucccucaccaagaccgaguucgagaacaucaucaugcagcucgucaagcgccucuccgagauccagaaggacaccuucuggcuccccuucucccaggagcaggagauccucugggccaucaacgacaucauccgcaacuucugcaaggacgucgucuccaacaagaagcucaugaagaagcuccaggagucccgcuucgacaucgucuucgccgacgccuaccuccccugcggcgagcuccucgccgagcucuucaacauccccuucgucuacucccacuccuucucccccggcuacuccuucgagcgccacuccggcggcuucaucuucccccccuccuacguccccgucgucauguccaagcucuccgaccagaugaccuucauggagcgcgucaagaacaugcucuacguccucuacuucgacuucugguuccagaucuucaacaugaagaagugggaccaguucuacuccgagguccucggccgccccaccacccucuccgagaccaugcgcaaggccgacaucuggcucaugcgcaacuccuggaacuucaaguucccccaccccuuccuccccaacgucgacuucgucggcggccuccacugcaagcccgccaagccccuccccaaggagauggaggaguucguccaguccuccggcgagaacggcgucgucgucuucucccucggcuccauggucuccaacaugaccgaggagcgcgccaacgucaucgccaccgcccucgccaagaucccccagaagguccucuggcgcuucgacggcaacaagcccgacgcccucggccucaacacccgccucuacaaguggaucccccagaacgaccuccucggccaccccaagacccgcgccuucaucacccacggcggcgccaacggcaucuacgaggccaucuaccacggcauccccauggucggcaucccccucuucuucgaccagcccgacaacaucgcccacaugaaggccaagggcgccgccguccgcgucgacuucaacaccauguccuccaccgaccuccucaacgcccucaagaccgucaucaacgaccccuccuacaaggagaacaucaugaagcucucccgcauccagcacgaccagcccgucaagccccucgaccgcgccgucuucuggaucgaguucgucaugcgccacaagggcgccaagcaccuccgcgucgccgcccacaaccucaccugguuccaguaccacucccucgacgucaucggcuuccuccucgccugcgucgccaccguccucuucaucaucaccaagugcugccucuucugcuucuggaaguucgcccgcaagggcaagaagggcaagcgcgacuga

SEQ ID NO: 51483 - RNA, 1590 nt, Artificial Sequence
  derived and/or modified sequence opt2 from UGT2B11__Homo_sapiens__NP_001064
augacccucaaguggaccuccguccuccuccucauccaccucuccugcuacuucuccuccggcuccugcggcaagguccucgucugggccgccgaguacucccacuggaugaacaugaagaccauccucaaggagcucguccagcgcggccacgaggucaccguccucgccuccuccgccuccauccucuucgaccccaacgacgccuccacccucaaguucgaggucuaccccaccucccucaccaagaccgaguucgagaacaucaucaugcagcaggucaagcgcugguccgacauccgcaaggacuccuucuggcucuacuucucccaggagcaggagauccucugggagcucuacgacaucuuccgcaacuucugcaaggacgucgucuccaacaagaaggucaugaagaagcuccaggagucccgcuucgacaucgucuucgccgacgccgucuuccccugcggcgagcuccucgccgcccuccucaacauccgcuucgucuacucccuccgcuucacccccggcuacaccaucgagcgccacuccggcggccucaucuucccccccuccuacauccccaucgucauguccaagcucuccgaccagaugaccuucauggagcgcgucaagaacaugaucuacguccucuacuucgacuucugguuccagauguccgacaugaagaagugggaccaguucuacuccgagguccucggccgccccaccacccucuucgagaccaugggcaaggccgacaucuggcucaugcgcaacuccugguccuuccaguucccccaccccuuccuccccaacgucgacuucgucggcggcuuccacugcaagcccgccaagccccuccccaaggagauggaggaguucguccaguccuccggcgagaacggcgucgucgucuucucccucggcuccgucaucuccaacaugaccgccgagcgcgccaacgucaucgccaccgcccucgccaagaucccccagaagguccucuggcgcuucgacggcaacaagcccgacgcccucggccucaacacccgccucuacaaguggaucccccagaacgaccuccucggccaccccaagacccgcgccuucaucacccacggcggcgccaacggcaucuacgaggccaucuaccacggcauccccauggucggcaucccccucuucuucgaccagcccgacaacaucgcccacaugaaggccaagggcgccgccguccgccucgacuucaacaccauguccuccaccgaccuccucaacgcccucaagaccgucaucaacgacccccucuacaaggagaacaucaugaagcucucccgcauccagcacgaccagcccgucaagccccucgaccgcgccgucuucuggaucgaguucgucaugccccacaagggcgccaagcaccuccgcgucgccgcccacgaccucaccugguuccaguaccacucccucgacgucaucggcuuccuccucgccugcgucgccaccgucaucuucaucaucaccaaguucugccucuucugcuucuggaaguucgcccgcaagggcaagaagggcaagcgcgacuga

SEQ ID NO: 51484 - RNA, 1593 nt, Artificial Sequence
  derived and/or modified sequence opt2 from UGT2B15__Homo_sapiens__NP_001067
augucccucaaguggaccuccgucuuccuccucauccagcucuccugcuacuucuccuccggcuccugcggcaagguccucgucuggcccaccgaguacucccacuggaucaacaugaagaccauccucgaggagcucguccagcgcggccacgaggucaccguccucaccuccuccgccuccacccucgucaacgccuccaaguccuccgccaucaagcucgaggucuaccccaccucccucaccaagaacuaccucgaggacucccuccucaagauccucgaccgcuggaucuacggcgucuccaagaacaccuucugguccuacuucucccagcuccaggagcucugcugggaguacuacgacuacuccaacaagcucugcaaggacgccguccucaacaagaagcucaugaugaagcuccaggaguccaaguucgacgucauccucgccgacgcccucaaccccugcggcgagcuccucgccgagcucuucaacauccccuuccucuacucccuccgcuucuccgucggcuacaccuucgagaagaacggcggcggcuuccucuucccccccuccuacguccccgucgucauguccgagcucuccgaccagaugaucuucauggagcgcaucaagaacaugauccacaugcucuacuucgacuucugguuccagaucuacgaccucaagaagugggaccaguucuacuccgagguccucggccgccccaccacccucuucgagaccaugggcaaggccgagauguggcucauccgcaccuacugggacuucgaguucccccgccccuuccuccccaacgucgacuucgucggcggccuccacugcaagcccgccaagccccuccccaaggagauggaggaguucguccaguccuccggcgagaacggcaucgucgucuucucccucggcuccaugaucuccaacauguccgaggaguccgccaacaugaucgccuccgcccucgcccagaucccccagaagguccucuggcgcuucgacggcaagaagcccaacacccucggcuccaacacccgccucuacaaguggcucccccagaacgaccuccucggccaccccaagaccaaggccuucaucacccacggcggcaccaacggcaucuacgaggccaucuaccacggcauccccauggucggcaucccccucuucgccgaccagcacgacaacaucgcccacaugaaggccaagggcgccgcccucuccgucgacauccgcaccauguccucccgcgaccuccucaacgcccucaaguccgucaucaacgaccccgucuacaaggagaacgucaugaagcucucccgcauccaccacgaccagcccaugaagccccucgaccgcgccgucuucuggaucgaguucgucaugcgccacaagggcgccaagcaccuccgcgucgccgcccacaaccucaccuggauccaguaccacucccucgacgucaucgccuuccuccucgccugcgucgccaccgucaucuucaucaucaccaaguucugccucuucugcuuccgcaagcucgccaagaagggcaagaagaagaagcgcgacuga

SEQ ID NO: 51485 - RNA, 1008 nt, Artificial Sequence
  derived and/or modified sequence opt2 from UGT2B28__Homo_sapiens__NP_001193933
auggcccucaaguggaccuccguccuccuccucauccaccucggcugcuacuucuccuccggcuccugcggcaagguccucgucuggaccggcgaguacucccacuggaugaacaugaagaccauccucaaggagcucguccagcgcggccacgaggucaccguccucgccuccuccgccuccauccucuucgaccccaacgacgccuucacccucaagcucgaggucuaccccaccucccucaccaagaccgaguucgagaacaucaucaugcagcaggucaagcgcugguccgacauccagaaggacuccuucuggcucuacuucucccaggagcaggagauccucugggaguuccacgacaucuuccgcaacuucugcaaggacgucgucuccaacaagaaggucaugaagaagcuccaggagucccgcuucgacaucaucuucgccgacgccuucuuccccugcggcgagcuccucgccgcccuccucaacauccccuucgucuacucccucugcuucacccccggcuacaccaucgagcgccacuccggcggccucaucuucccccccuccuacauccccgucgucauguccaagcucuccgaccagaugaccuucauggagcgcgucaagaacaugaucuacguccucuacuucgacuucugguuccagaugugcgacaugaagaagugggaccaguucuacuccgagguccucggccgccccaccacccucuucgagaccaugggcaaggccgacaucuggcucaugcgcaacuccugguccuuccaguucccccaccccuuccuccccaacaucgacuucgucggcggccuccacugcaagcccgccaagccccuccccaaggagauggaggaguucguccaguccuccggcgagaacggcgucgucgucuucucccucggcuccgucaucuccaacaugaccgccgagcgcgccaacgucaucgccaccgcccucgccaagaucccccagaagaucuga

SEQ ID NO: 51486 - RNA, 1110 nt, Artificial Sequence
  derived and/or modified sequence opt2 from UGT2B4__Homo_sapiens__NP_001284544
auguccaugaaguggaccuccgcccuccuccucauccagcucuccugcuacuucuccuccggcuccugcggcaagguccucgucuggcccaccgaguucucccacuggaugaacaucaagaccauccucgacgagcucguccagcgcggccacgaggucaccguccucgccuccuccgccuccaucuccuucgaccccaacucccccuccacccucaaguucgaggucuaccccgucucccucaccaagaccgaguucgaggacaucaucaagcagcucgucaagcgcugggccgagcuccccaaggacaccuucugguccuacuucucccagguccaggagaucauguggaccuucaacgacauccuccgcaaguucugcaaggacaucgucuccaacaagaagcucaugaagaagcuccaggagucccgcuucgacgucguccucgccgacgccgucuuccccuucggcgagcuccucgccgagcuccucaagauccccuucgucuacucccuccgcuucucccccggcuacgccaucgagaagcacuccggcggccuccucuucccccccuccuacguccccgucgucauguccgagcucuccgaccagaugaccuucaucgagcgcgucaagaacaugaucuacguccucuacuucgaguucugguuccagaucuucgacaugaagaagugggaccaguucuacuccgagguccucggccgccccaccacccucuccgagaccauggccaaggccgacaucuggcucauccgcaacuacugggacuuccaguucccccacccccuccuccccaacgucgaguucgucggcggccuccacugcaagcccgccaagccccuccccaaggagauggaggaguucguccaguccuccggcgagaacggcgucgucgucuucucccucggcuccauggucuccaacaccuccgaggagcgcgccaacgucaucgccuccgcccucgccaagaucccccagaagguccucuggcgcuucgacggcaacaagcccgacacccucggccucaacacccgccucuacaaguggaucccccagaacgaccuccucgacaucaagcgcaugcucuga

SEQ ID NO: 51487 - RNA, 1590 nt, Artificial Sequence
  derived and/or modified sequence opt2 from UGT2B7__Homo_sapiens__NP_001065
auguccgucaaguggaccuccgucauccuccucauccagcucuccuucugcuucuccuccggcaacugcggcaagguccucgucugggccgccgaguacucccacuggaugaacaucaagaccauccucgacgagcucauccagcgcggccacgaggucaccguccucgccuccuccgccuccauccucuucgaccccaacaacuccuccgcccucaagaucgagaucuaccccaccucccucaccaagaccgagcucgagaacuucaucaugcagcagaucaagcgcugguccgaccuccccaaggacaccuucuggcucuacuucucccagguccaggagaucauguccaucuucggcgacaucacccgcaaguucugcaaggacgucgucuccaacaagaaguucaugaagaagguccaggagucccgcuucgacgucaucuucgccgacgccaucuuccccugcuccgagcuccucgccgagcucuucaacauccccuucgucuacucccucuccuucucccccggcuacaccuucgagaagcacuccggcggcuucaucuucccccccuccuacguccccgucgucauguccgagcucaccgaccagaugaccuucauggagcgcgucaagaacaugaucuacguccucuacuucgacuucugguucgagaucuucgacaugaagaagugggaccaguucuacuccgagguccucggccgccccaccacccucuccgagaccaugggcaaggccgacgucuggcucauccgcaacuccuggaacuuccaguuccccuacccccuccuccccaacgucgacuucgucggcggccuccacugcaagcccgccaagccccuccccaaggagauggaggacuucguccaguccuccggcgagaacggcgucgucgucuucucccucggcuccauggucuccaacaugaccgaggagcgcgccaacgucaucgccuccgcccucgcccagaucccccagaagguccucuggcgcuucgacggcaacaagcccgacacccucggccucaacacccgccucuacaaguggaucccccagaacgaccuccucggccaccccaagacccgcgccuucaucacccacggcggcgccaacggcaucuacgaggccaucuaccacggcauccccauggucggcaucccccucuucgccgaccagcccgacaacaucgcccacaugaaggcccgcggcgccgccguccgcgucgacuucaacaccauguccuccaccgaccuccucaacgcccucaagcgcgucaucaacgaccccuccuacaaggagaacgucaugaagcucucccgcauccagcacgaccagcccgucaagccccucgaccgcgccgucuucuggaucgaguucgucaugcgccacaagggcgccaagcaccuccgcgucgccgcccacgaccucaccugguuccaguaccacucccucgacgucaucggcuuccuccucgucugcgucgccaccgucaucuucaucgucaccaagugcugccucuucugcuucuggaaguucgcccgcaaggccaagaagggcaagaacgacuga

SEQ ID NO: 51488 - RNA, 1470 nt, Artificial Sequence
  derived and/or modified sequence opt2 from UGT3A2__Homo_sapiens__NP_001161788
auggccggccagcgcguccuccuccucgucggcuuccuccuccccggcguccuccucuccgaggccgccaagauccucaccaucuccaccgucgacuucaagaaggaggagaaguccuaccaggucaucuccuggcucgcccccgaggaccaccagcgcgaguucaagaaguccuucgacuucuuccucgaggagacccucggcggccgcggcaaguucgagaaccuccucaacguccucgaguaccucgcccuccagugcucccacuuccucaaccgcaaggacaucauggacucccucaagaacgagaacuucgacauggucaucgucgagaccuucgacuacugccccuuccucaucgccgagaagcucggcaagcccuucgucgccauccucuccaccuccuucggcucccucgaguucggccuccccaucccccucuccuacguccccgucuuccgcucccuccucaccgaccacauggacuucuggggccgcgucaagaacuuccucauguucuucuccuucugccgccgccagcagcacaugcaguccaccuucgacaacaccaucaaggagcacuucaccgagggcucccgccccguccucucccaccuccuccucaaggccgagcucugguucaucaacuccgacuucgccuucgacuucgcccgcccccuccuccccaacaccgucuacgucggcggccucauggagaagcccaucaagcccgucccccaggaccucgagaacuucaucgccaaguucggcgacuccggcuucguccucgucacccucggcuccauggucaacaccugccagaaccccgagaucuucaaggagaugaacaacgccuucgcccaccucccccagggcgucaucuggaagugccagugcucccacuggcccaaggacguccaccucgccgccaacgucaagaucgucgacuggcucccccaguccgaccuccucgcccaccccuccauccgccucuucgucacccacggcggccagaacuccaucauggaggccauccagcacggcguccccauggucggcaucccccucuucggcgaccagcccgagaacaugguccgcgucgaggccaagaaguucggcgucuccauccagcucaagaagcucaaggccgagacccucgcccucaagaugaagcagaucauggaggacaagcgcuacaaguccgccgccgucgccgccuccgucauccuccgcucccacccccucucccccacccagcgccucgucggcuggaucgaccacguccuccagaccggcggcgccacccaccucaagcccuacgucuuccagcagcccuggcacgagcaguaccuccucgacgucuucgucuuccuccucggccucacccucggcacccucuggcucugcggcaagcuccucggcauggccgucugguggcuccgcggcgcccgcaaggucaaggagaccuga

SEQ ID NO: 51489 - RNA, 1626 nt, Artificial Sequence
  derived and/or modified sequence opt2 from UGT8__Homo_sapiens__NP_001121646
augaaguccuacacccccuacuucauccuccucugguccgccgucggcaucgccaaggccgccaagaucaucaucgucccccccaucauguucgagucccacauguacaucuucaagacccucgccuccgcccuccacgagcgcggccaccacaccgucuuccuccucuccgagggccgcgacaucgcccccuccaaccacuacucccuccagcgcuaccccggcaucuucaacuccaccaccuccgacgccuuccuccaguccaagaugcgcaacaucuucuccggccgccucaccgccaucgagcucuucgacauccucgaccacuacaccaagaacugcgaccucauggucggcaaccacgcccucauccagggccucaagaaggagaaguucgaccuccuccucgucgaccccaacgacaugugcggcuucgucaucgcccaccuccucggcgucaaguacgccgucuucuccaccggccucugguaccccgccgaggucggcgcccccgccccccucgccuacguccccgaguucaacucccuccucaccgaccgcaugaaccuccuccagcgcaugaagaacaccggcgucuaccucaucucccgccucggcgucuccuuccucguccuccccaaguacgagcgcaucaugcagaaguacaaccuccuccccgagaaguccauguacgaccucguccacggcuccucccucuggaugcucugcaccgacgucgcccucgaguucccccgccccacccuccccaacgucgucuacgucggcggcauccucaccaagcccgccuccccccuccccgaggaccuccagcgcugggucaacggcgccaacgagcacggcuucguccucgucuccuucggcgccggcgucaaguaccucuccgaggacaucgccaacaagcucgccggcgcccucggccgccucccccagaaggucaucuggcgcuucuccggccccaagcccaagaaccucggcaacaacaccaagcucaucgaguggcucccccagaacgaccuccucggccacuccaagaucaaggccuuccucucccacggcggccucaacuccaucuucgagaccauguaccacggcguccccgucgucggcaucccccucuucggcgaccacuacgacaccaugacccgcguccaggccaagggcaugggcauccuccucgaguggaagaccgucaccgagaaggagcucuacgaggcccucgucaaggucaucaacaaccccuccuaccgccagcgcgcccagaagcucuccgagauccacaaggaccagcccggccaccccgucaaccgcaccaucuacuggaucgacuacaucauccgccacaacggcgcccaccaccuccgcgccgccguccaccagaucuccuucugccaguacuuccuccucgacaucgccuucguccuccuccucggcgccgcccuccucuacuuccuccucuccugggucaccaaguucaucuaccgcaagaucaagucccucuggucccgcaacaagcacuccaccgucaacggccacuaccacaacggcauccucaacggcaaguacaagcgcaacggccacaucaagcacgagaagaaggucaaguga

SEQ ID NO: 51490 - RNA, 1038 nt, Artificial Sequence
  derived and/or modified sequence opt2 from UHMK1__Homo_sapiens__NP_001171692
auguuccucacccgccccaaggucugcgucgaccucaaccgccgcgucacccucuacggcgucuucaccauccacuucucccccaacguccccucccgcugccuccuccucgagcuccucgacgucuccgucuccgagcuccuccucuacuccucccaccagggcugcuccauguggaugauccagcacugcgcccgcgacguccucgaggcccucgccuuccuccaccacgagggcuacguccacgccgaccucaagccccgcaacauccucugguccgccgagaacgagugcuucaagcucaucgacuucggccucuccuucaaggagggcaaccaggacgucaaguacauccagaccgacggcuaccgcgcccccgaggccgagcuccagaacugccucgcccaggccggccuccaguccgacaccgagugcaccuccgccgucgaccucuggucccucggcaucauccuccucgagauguucuccggcaugaagcucaagcacaccguccgcucccaggaguggaaggccaacuccuccgccaucaucgaccacaucuucgccuccaaggccgucgucaacgccgccauccccgccuaccaccuccgcgaccucaucaaguccaugcuccacgacgaccccucccgccgcauccccgccgagauggcccucugcucccccuucuucuccauccccuucgccccccacaucgaggaccucgucaugcuccccacccccguccuccgccuccucaacguccucgacgacgacuaccucgagaacgaggaggaguacgaggacgucgucgaggacgucaaggaggagugccagaaguacggccccgucgucucccuccucguccccaaggagaaccccggccgcggccaggucuucgucgaguacgccaacgccggcgacuccaaggccgcccagaagcuccucaccggccgcauguucgacggcaaguucgucgucgccaccuucuacccccucuccgccuacaagcgcggcuaccucuaccagacccuccucuga

SEQ ID NO: 51491 - RNA, 4323 nt, Artificial Sequence
  derived and/or modified sequence opt2 from UHRF1BP1__Homo_sapiens__NP_060224
auggccggcaucaucaagaagcagauccucaagcaccucucccgcuucaccaagaaccucucccccgacaagaucaaccucuccacccucaagggcgagggccagcucaccaaccucgagcucgacgaggagguccuccagaacguccucgagcuccccaccuggcucgccaucacccgcgucuacugcaaccgcgccuccauccgcauccaguggaccaagcucaagacccaccccaucugccucugccucgacaaggucgaggucgagaugaagaccugcgaggacccccgcccccccaacggccagucccccaucgcccucgccuccggccaguccgaguacggcuucgccgagaaggucgucgagggcauguucaucaucgucaacuccaucaccaucaagauccacuccaaggccuuccacgccuccuucgagcucuggcagcuccagggcuacuccgucaaccccaacuggcagcaguccgaccuccgccucacccgcaucaccgaccccugccgcggcgagguccucaccuucaaggagaucaccuggcagacccuccgcaucgaggccgacgccaccgacaacggcgaccaggaccccgucaccaccccccuccgccucaucaccaaccagggccgcauccagaucgcccucaagcgccgcaccaaggacugcaacgucaucuccuccaagcucauguuccuccucgacgaccuccucuggguccucaccgacucccagcucaaggccaugaugaaguacgccgagucccucuccgaggccauggagaaguccgcccaccagcgcaagucccucgcccccgagcccguccagaucaccccccccgcccccuccgcccagcaguccugggcccaggccuucggcggcucccagggcaacuccaacuccuccuccucccgccucucccaguacuucgagaaguucgacgucaaggaguccuccuaccaccuccucaucucccgccucgaccuccacaucugcgacgacucccagucccgcgagcccggcgucuccgccaaccgccucaugggcggcgccaugcagcucaccuuccgcaagauggccuucgacuacuaccccuuccacugggccggcgacuccugcaagcacuggguccgccacugcgaggccauggagacccgcggccagugggcccagaagcucgucauggaguuccaguccaagauggagaaguggcacgaggagaccggccucaagccccccuggcaccucggcgucgacucccucuuccgccgcaaggccgacucccucuccuccccccgcaagaacccccucgagcgcucccccucccagggccgccagcccgccuuccagccccccgccuggaaccgccuccgcuccuccugcauggucguccgcgucgacgaccucgacauccaccaggucuccaccgccggccagcccuccaagaagcccuccacccuccucuccugcucccgcaagcuccacaaccuccccacccaggucuccgccauccacaucgaguucaccgaguacuacuuccccgacaaccaggagcuccccguccccugccccaaccucuacauccagcucaacggccucaccuucaccauggaccccgucucccuccucuggggcaaccucuucugccucgaccucuaccgcucccucgagcaguucaaggccaucuacaagcucgaggacuccucccagaaggacgagcaccucgacauccgccucgacgccuucuggcucaaggucuccuucccccucgagaagcgcgagcgcgccgagcuccaccgcccccaggcccucgucuucuccgccuccggcaugaucgccaccaacacccgccacgccccccacugcuccugcuccgaccuccagucccucuuccgcggcuucgccgccgccgaguucuuccacuccaacuacgaccacuuccccaagguccccggcggcuucucccuccuccacaugcucuuccuccaccacgccuuccagauggacuccugccucccccagcccaacacccuccccccccagcgccccaaggccuccugggaccucugguccguccacuucacccagaucucccucgacuucgagggcaccgagaacuucaagggccacacccucaacuucgucgcccccuucccccucuccaucugggccugccucccccuccgcuggcagcaggcccaggcccgcaagcuccuccucgccuccgagggccgccucaagcccuccgccuccuucggcucccccguccaguccgaggcccucgcccccgacuccaugucccacccccgcuccaagaccgagcacgaccucaagucccucuccggccucaccgaggucauggagauccucaaggagggcuccuccggcauggacaacaagggcccccucaccgagcucgaggacgucgccgacguccacaugcucguccacucccccgcccacguccgcguccgccucgaccacuaccaguaccucgcccuccuccgccucaaggagguccuccagcgccuccaggagcagcucaccaaggacaccgaguccaugaccggcuccccccuccagaaccagaccgccugcaucggcguccucuuccccuccgccgaggucgcccuccucaugcaccccgcccccggcgccgucgacgccgacuccgccggcuccgacuccaccucccucgucgacuccgagcucucccccuccgaggaccgcgagcucaaguccgacgccuccuccgaccagggccccgccucccccgagaagguccucgaggaguccuccaucgagaaccaggacgucucccaggagcgcccccacuccaacggcgagcuccaggacuccggcccccucgcccagcagcucgccggcaagggccacgaggccgucgagucccuccaggccaagaagcucucccgcacccaggccuccuccucccccgccgcccucaagccccccgccggccgcgagaccgccgucaacggccagggcgagcucaucccccucaagaacaucgagggcgagcucuccuccgccauccacaugaccaaggacgccaccaaggaggcccuccacgccaccauggaccucaccaaggaggccgucucccucaccaaggacgccuucucccucggccgcgaccgcaugaccuccaccaugcacaagaugcucucccucccccccgccaaggagcccauggccaagaccgacgagggcgucgccgcccccgucuccggcggcgccgcccgccuccgcuucuucuccaugaagcgcaccgucucccagcaguccuucgacggcgucucccucgacuccuccggccccgaggaccgcaucuccgucgacuccgacggcuccgacuccuucgucaugcuccucgaguccgaguccggccccgaguccgucccccccggcucccucuccaacgucuccgacaacgccggcguccagggcuccccccucgucaacaacuacggccagggcucccccgccgccaacuccuccgucucccccuccggcgaggaccucaucuuccaccccgucuccguccucguccucaaggucaacgaggucuccuucggcaucgagguccgcggcgaggaccucaccgucgcccuccaggccgaggagcucacccuccagcagcucggcaccgucggccucuggcaguuccuccacggccagugccccggcaccugcuuccaggaguccuccacccucaagaccggccacauccgccccgccgucggccuccgcuucgaggucggccccggcgccgccguccacuccccccucgccucccagaacggcuuccuccaccuccuccuccacggcugcgaccucgagcuccucaccuccguccucuccggccucggccccuuccucgaggacgaggagauccccgucgucguccccaugcagaucgagcuccucaacuccuccaucacccucaaggacgacaucccccccaucuaccccaccucccccggccccauccccaucacccucgccauggagcacgucguccucaagcgcuccgacgacggcgucuuccacaucggcgccgccgcccaggacaagcccuccgccgagguccucaaguccgagaagcgccagccccccaaggagcaggucuuccucguccccaccggcgaggucuucgagcagcaggucaaggagcuccccauccuccagaaggagcucaucgagaccaagcaggcccucgccaacgccaaccaggacaaggagaagcuccuccaggagauccgcaaguacaaccccuucuucgagcucuga

SEQ ID NO: 51492 - RNA, 2382 nt, Artificial Sequence
  derived and/or modified sequence opt2 from UHRF1__Homo_sapiens__NP_001276980
auguggauccagguccgcaccauggacggccgccagacccacaccgucgacucccucucccgccucaccaaggucgaggagcuccgccgcaagauccaggagcucuuccacgucgagcccggccuccagcgccucuucuaccgcggcaagcagauggaggacggccacacccucuucgacuacgagguccgccucaacgacaccauccagcuccucguccgccagucccucguccucccccacuccaccaaggagcgcgacuccgagcucuccgacaccgacuccggcugcugccucggccaguccgaguccgacaaguccuccacccacggcgaggccgccgccgagaccgacucccgccccgccgacgaggacaugugggacgagaccgagcucggccucuacaaggucaacgaguacgucgacgcccgcgacaccaacaugggcgccugguucgaggcccaggucguccgcgucacccgcaaggcccccucccgcgacgagcccugcuccuccaccucccgccccgcccucgaggaggacgucaucuaccacgucaaguacgacgacuaccccgagaacggcgucguccagaugaacucccgcgacguccgcgcccgcgcccgcaccaucaucaaguggcaggaccucgaggucggccaggucgucaugcucaacuacaaccccgacaaccccaaggagcgcggcuucugguacgacgccgagaucucccgcaagcgcgagacccgcaccgcccgcgagcucuacgccaacgucguccucggcgacgacucccucaacgacugccgcaucaucuucgucgacgaggucuucaagaucgagcgccccggcgagggcucccccauggucgacaaccccaugcgccgcaaguccggccccuccugcaagcacugcaaggacgacgucaaccgccucugccgcgucugcgccugccaccucugcggcggccgccaggaccccgacaagcagcucaugugcgacgagugcgacauggccuuccacaucuacugccucgaccccccccucuccuccguccccuccgaggacgagugguacugccccgagugccgcaacgacgccuccgaggucguccucgccggcgagcgccuccgcgaguccaagaagaaggccaagauggccuccgccaccuccuccucccagcgcgacuggggcaagggcauggccugcgucggccgcaccaaggagugcaccaucguccccuccaaccacuacggccccauccccggcauccccgucggcaccauguggcgcuuccgcguccaggucuccgaguccggcguccaccgcccccacgucgccggcauccacggccgcuccaacgacggcgccuacucccucguccucgccggcggcuacgaggacgacgucgaccacggcaacuucuucaccuacaccggcuccggcggccgcgaccucuccggcaacaagcgcaccgccgagcaguccugcgaccagaagcucaccaacaccaaccgcgcccucgcccucaacugcuucgcccccaucaacgaccaggagggcgccgaggccaaggacuggcgcuccggcaagcccguccgcgucguccgcaacgucaagggcggcaagaacuccaaguacgcccccgccgagggcaaccgcuacgacggcaucuacaaggucgucaaguacuggcccgagaagggcaaguccggcuuccucgucuggcgcuaccuccuccgccgcgacgacgacgagcccggccccuggaccaaggagggcaaggaccgcaucaagaagcucggccucaccaugcaguaccccgagggcuaccucgaggcccucgccaaccgcgagcgcgagaaggagaacuccaagcgcgaggaggaggagcagcaggagggcggcuucgccuccccccgcaccggcaagggcaaguggaagcgcaaguccgccggcggcggccccucccgcgccggcuccccccgccgcaccuccaagaagaccaaggucgagcccuacucccucaccgcccagcaguccucccucauccgcgaggacaaguccaacgccaagcucuggaacgagguccucgccucccucaaggaccgccccgccuccggcucccccuuccagcucuuccucuccaaggucgaggagaccuuccagugcaucugcugccaggagcucgucuuccgccccaucaccaccgucugccagcacaacgucugcaaggacugccucgaccgcuccuuccgcgcccaggucuucuccugccccgccugccgcuacgaccucggccgcuccuacgccaugcaggucaaccagccccuccagaccguccucaaccagcucuuccccggcuacggcaacggccgcuga

SEQ ID NO: 51493 - RNA, 2409 nt, Artificial Sequence
  derived and/or modified sequence opt2 from UHRF2__Homo_sapiens__NP_690856
auguggauccagguccgcaccaucgacggcuccaagaccugcaccaucgaggacgucucccgcaaggccaccaucgaggagcuccgcgagcgcgucugggcccucuucgacguccgccccgagugccagcgccucuucuaccgcggcaagcagcucgagaacggcuacacccucuucgacuacgacgucggccucaacgacaucauccagcuccucguccgccccgaccccgaccaccuccccggcaccuccacccagaucgaggccaagcccugcuccaacuccccccccaaggucaagaaggccccccgcgucggccccuccaaccagcccuccaccuccgcccgcgcccgccucaucgaccccggcuucggcaucuacaaggucaacgagcucgucgacgcccgcgacgucggccucggcgccugguucgaggcccacauccacuccgucacccgcgccuccgacggccagucccgcggcaagaccccccucaagaacggcuccuccugcaagcgcaccaacggcaacaucaagcacaaguccaaggagaacaccaacaagcucgacuccguccccuccaccuccaacuccgacugcgucgccgccgacgaggacgucaucuaccacauccaguacgacgaguaccccgaguccggcacccucgagaugaacgucaaggaccuccgcccccgcgcccgcaccauccucaaguggaacgagcucaacgucggcgacgucgucauggucaacuacaacgucgagucccccggccagcgcggcuucugguucgacgccgagaucaccacccucaagaccaucucccgcaccaagaaggagcuccgcgucaagaucuuccucggcggcuccgagggcacccucaacgacugcaagaucaucuccgucgacgagaucuucaagaucgagcgccccggcgcccacccccucuccuucgccgacggcaaguuccuccgccgcaacgaccccgagugcgaccucugcggcggcgaccccgagaagaagugccacuccugcuccugccgcgucugcggcggcaagcacgagcccaacaugcagcuccucugcgacgagugcaacgucgccuaccacaucuacugccucaaccccccccucgacaagguccccgaggaggaguacugguacugccccuccugcaagaccgacuccuccgaggucgucaaggccggcgagcgccucaagauguccaagaagaaggccaagaugcccuccgccuccaccgagucccgccgcgacuggggccgcggcauggccugcgucggccgcacccgcgagugcaccaucguccccuccaaccacuacggccccauccccggcauccccgucggcuccaccuggcgcuuccgcguccaggucuccgaggccggcguccaccgcccccacgucggcggcauccacggccgcuccaacgacggcgccuacucccucguccucgccggcggcuucgccgacgaggucgaccgcggcgacgaguucaccuacaccggcuccggcggcaagaaccucgccggcaacaagcgcaucggcgcccccuccgccgaccagacccucaccaacaugaaccgcgcccucgcccucaacugcgacgccccccucgacgacaagaucggcgccgagucccgcaacuggcgcgccggcaagcccguccgcgucauccgcuccuucaagggccgcaagaucuccaaguacgcccccgaggagggcaaccgcuacgacggcaucuacaaggucgucaaguacuggcccgagaucuccuccucccacggcuuccucgucuggcgcuaccuccuccgccgcgacgacgucgagcccgcccccuggaccuccgagggcaucgagcgcucccgccgccucugccuccgccuccaguaccccgccggcuaccccuccgacaaggagggcaagaagcccaagggccaguccaagaagcagcccuccggcaccaccaagcgccccaucuccgacgacgacugccccuccgccuccaaggucuacaaggccuccgacuccgccgaggccaucgaggccuuccagcucaccccccagcagcagcaccucauccgcgaggacugccagaaccagaagcucugggacgagguccucucccaccucgucgagggccccaacuuccucaagaagcucgagcaguccuucaugugcgucugcugccaggagcucgucuaccagcccgucaccaccgagugcuuccacaacgucugcaaggacugccuccagcgcuccuucaaggcccaggucuucuccugccccgccugccgccacgaccucggccagaacuacaucaugauccccaacgagauccuccagacccuccucgaccucuucuuccccggcuacuccaagggccgcuga

SEQ ID NO: 51494 - RNA, 2160 nt, Artificial Sequence
  derived and/or modified sequence opt2 from UIMC1__Homo_sapiens__NP_057374
augccccgccgcaagaagaaggucaaggaggucuccgagucccgcaaccucgagaagaaggacgucgagaccaccuccuccgucuccgucaagcgcaagcgccgccucgaggacgccuucaucgucaucuccgacuccgacggcgaggagcccaaggaggagaacggccuccagaagaccaagaccaagcaguccaaccgcgccaagugccucgccaagcgcaagaucgcccagaugaccgaggaggagcaguucgcccucgcccucaagauguccgagcaggaggcccgcgaggucaacucccaggaggaggaggaggaggagcuccuccgcaaggccaucgccgagucccucaacuccugccgccccuccgacgccuccgccacccgcucccgcccccucgccaccggccccuccucccagucccaccaggagaagaccaccgacuccggccucaccgagggcaucuggcagcucgucccccccucccucuucaagggcucccacaucucccagggcaacgaggccgaggagcgcgaggagcccugggaccacaccgagaagaccgaggaggagcccgucuccggcuccuccggcuccugggaccaguccucccagcccgucuucgagaacgucaacgucaaguccuucgaccgcugcaccggccacuccgccgagcacacccagugcggcaagccccaggaguccaccggccgcggcuccgccuuccucaaggccguccagggcuccggcgacaccucccgccacugccuccccacccucgccgacgccaagggccuccaggacaccggcggcaccgucaacuacuucuggggcauccccuucugccccgacggcgucgaccccaaccaguacaccaaggucauccucugccagcucgaggucuaccagaagucccucaagauggcccagcgccagcuccucaacaagaagggcuucggcgagcccguccucccccgcccccccucccucauccagaacgagugcggccagggcgagcaggccuccgagaagaacgagugcaucuccgaggacaugggcgacgaggacaaggaggagcgccaggagucccgcgccuccgacuggcacuccaagaccaaggacuuccaggaguccuccaucaagucccucaaggagaagcuccuccucgaggaggagcccaccaccucccacggccaguccucccagggcaucgucgaggagaccuccgaggagggcaacuccguccccgccucccaguccgucgccgcccucaccuccaagcgcucccucguccucaugcccgaguccuccgccgaggagaucaccgucugccccgagacccagcucuccuccuccgagaccuucgaccucgagcgcgaggucucccccggcucccgcgacauccucgacggcguccgcaucaucauggccgacaaggaggucggcaacaaggaggacgccgagaaggaggucgccaucuccaccuucuccuccuccaaccaggucuccugcccccucugcgaccagugcuucccccccaccaagaucgagcgccacgccauguacugcaacggccucauggaggaggacaccguccucacccgccgccagaaggaggccaagaccaaguccgacuccggcaccgccgcccagaccucccucgacaucgacaagaacgagaagugcuaccucugcaagucccucguccccuuccgcgaguaccagugccacgucgacuccugccuccagcucgccaaggccgaccagggcgacggccccgagggcuccggccgcgccugcuccaccgucgagggcaaguggcagcagcgccucaagaaccccaaggagaagggccacuccgagggccgccuccucuccuuccucgagcaguccgagcacaagaccuccgacgccgacaucaaguccuccgagaccggcgccuuccgcguccccucccccggcauggaggaggccggcugcucccgcgagaugcaguccuccuucacccgccgcgaccucaacgagucccccgucaaguccuucgucuccaucuccgaggccaccgacugccucgucgacuucaagaagcaggucaccguccagcccggcucccgcacccgcaccaaggccggccgcggccgccgccgcaaguucuga

SEQ ID NO: 51495 - RNA, 735 nt, Artificial Sequence
  derived and/or modified sequence opt2 from ULBP1__Homo_sapiens__NP_079494
auggccgccgccgccucccccgccuuccuccucugccucccccuccuccaccuccucuccggcuggucccgcgccggcugggucgacacccacugccucugcuacgacuucaucaucacccccaagucccgccccgagccccaguggugcgagguccagggccucgucgacgagcgccccuuccuccacuacgacugcgucaaccacaaggccaaggccuucgccucccucggcaagaaggucaacgucaccaagaccugggaggagcagaccgagacccuccgcgacgucgucgacuuccucaagggccagcuccucgacauccaggucgagaaccucauccccaucgagccccucacccuccaggcccgcauguccugcgagcacgaggcccacggccacggccgcggcuccuggcaguuccucuucaacggccagaaguuccuccucuucgacuccaacaaccgcaaguggaccgcccuccaccccggcgccaagaagaugaccgagaagugggagaagaaccgcgacgucaccauguucuuccagaagaucucccucggcgacugcaagauguggcucgaggaguuccucauguacugggagcagaugcucgaccccaccaagccccccucccucgcccccggcaccacccagcccaaggccauggccaccacccucucccccuggucccuccucaucaucuuccucugcuucauccucgccggccgcuga

SEQ ID NO: 51496 - RNA, 741 nt, Artificial Sequence
  derived and/or modified sequence opt2 from ULBP2__Homo_sapiens__NP_079493
auggccgccgccgccgccaccaagauccuccucugccucccccuccuccuccuccucuccggcuggucccgcgccggccgcgccgacccccacucccucugcuacgacaucaccgucauccccaaguuccgccccggcccccgcuggugcgccguccagggccaggucgacgagaagaccuuccuccacuacgacugcggcaacaagaccgucacccccgucuccccccucggcaagaagcucaacgucaccaccgccuggaaggcccagaaccccguccuccgcgaggucgucgacauccucaccgagcagcuccgcgacauccagcucgagaacuacacccccaaggagccccucacccuccaggcccgcauguccugcgagcagaaggccgagggccacuccuccggcuccuggcaguucuccuucgacggccagaucuuccuccucuucgacuccgagaagcgcauguggaccaccguccaccccggcgcccgcaagaugaaggagaagugggagaacgacaaggucgucgccauguccuuccacuacuucuccaugggcgacugcaucggcuggcucgaggacuuccucaugggcauggacuccacccucgagcccuccgccggcgccccccucgccauguccuccggcaccacccagcuccgcgccaccgccaccacccucauccucugcugccuccucaucauccuccccugcuucauccuccccggcaucuga

SEQ ID NO: 51497 - RNA, 735 nt, Artificial Sequence
  derived and/or modified sequence opt2 from ULBP3__Homo_sapiens__NP_078794
auggccgccgccgccucccccgccauccucccccgccucgccauccuccccuaccuccucuucgacugguccggcaccggccgcgccgacgcccacucccucugguacaacuucaccaucauccaccucccccgccacggccagcaguggugcgagguccagucccaggucgaccagaagaacuuccucuccuacgacugcggcuccgacaagguccucuccaugggccaccucgaggagcagcucuacgccaccgacgccuggggcaagcagcucgagaugcuccgcgaggucggccagcgccuccgccucgagcucgccgacaccgagcucgaggacuucacccccuccggcccccucacccuccagguccgcauguccugcgagugcgaggccgacggcuacauccgcggcuccuggcaguucuccuucgacggccgcaaguuccuccucuucgacuccaacaaccgcaaguggaccgucguccacgccggcgcccgccgcaugaaggagaagugggagaaggacuccggccucaccaccuucuucaagauggucuccaugcgcgacugcaaguccuggcuccgcgacuuccucaugcaccgcaagaagcgccucgagcccaccgccccccccaccauggcccccggccucgcccagcccaaggccaucgccaccacccucucccccugguccuuccucaucauccucugcuucauccuccccggcaucuga

SEQ ID NO: 51498 - RNA, 3153 nt, Artificial Sequence
  derived and/or modified sequence opt2 from ULK1__Homo_sapiens__NP_003556
auggagcccggccgcggcggcaccgagaccgucggcaaguucgaguucucccgcaaggaccucaucggccacggcgccuucgccgucgucuucaagggccgccaccgcgagaagcacgaccucgaggucgccgucaagugcaucaacaagaagaaccucgccaagucccagacccuccucggcaaggagaucaagauccucaaggagcucaagcacgagaacaucgucgcccucuacgacuuccaggagauggccaacuccgucuaccucgucauggaguacugcaacggcggcgaccucgccgacuaccuccacgccaugcgcacccucuccgaggacaccauccgccucuuccuccagcagaucgccggcgccaugcgccuccuccacuccaagggcaucauccaccgcgaccucaagccccagaacauccuccucuccaaccccgccggccgccgcgccaaccccaacuccauccgcgucaagaucgccgacuucggcuucgcccgcuaccuccaguccaacaugauggccgccacccucugcggcucccccauguacauggcccccgaggucaucaugucccagcacuacgacggcaaggccgaccucugguccaucggcaccaucgucuaccagugccucaccggcaaggcccccuuccaggccuccuccccccaggaccuccgccucuucuacgagaagaacaagacccucguccccaccaucccccgcgagaccuccgccccccuccgccagcuccuccucgcccuccuccagcgcaaccacaaggaccgcauggacuucgacgaguucuuccaccaccccuuccucgacgccucccccuccguccgcaaguccccccccguccccguccccuccuaccccuccuccggcuccggcuccuccuccuccuccuccuccaccucccaccucgccuccccccccucccucggcgagaugcagcagcuccagaagacccucgccucccccgccgacaccgccggcuuccuccacuccucccgcgacuccggcggcuccaaggacuccuccugcgacaccgacgacuucgucaugguccccgcccaguuccccggcgaccucgucgccgaggcccccuccgccaagcccccccccgacucccucaugugcuccggcuccucccucgucgccuccgccggccucgagucccacggccgcacccccucccccuccccccccugcuccuccucccccucccccuccggccgcgccggccccuucuccuccucccgcugcggcgccuccguccccauccccguccccacccagguccagaacuaccagcgcaucgagcgcaaccuccagucccccacccaguuccagaccccccgcuccuccgccauccgccgcuccggcuccaccuccccccucggcuucgcccgcgccucccccuccccccccgcccacgccgagcacggcggcguccucgcccgcaagaugucccucggcggcggccgccccuacacccccuccccccaggucggcaccauccccgagcgccccggcugguccggcacccccuccccccagggcgccgagaugcgcggcggccgcuccccccgccccggcuccuccgcccccgagcacuccccccgcaccuccggccucggcugccgccuccacuccgcccccaaccucuccgaccuccacgucguccgccccaagcuccccaagccccccaccgacccccucggcgccgucuucucccccccccaggccucccccccccagcccucccacggccuccaguccugccgcaaccuccgcggcucccccaagcuccccgacuuccuccagcgcaacccccucccccccauccucggcucccccaccaaggccguccccuccuucgacuuccccaagacccccuccucccagaaccuccucgcccuccucgcccgccagggcgucgucaugacccccccccgcaaccgcacccuccccgaccucuccgaggucggccccuuccacggccagccccucggccccggccuccgccccggcgaggaccccaagggccccuucggccgcuccuucuccaccucccgccucaccgaccuccuccucaaggccgccuucggcacccaggcccccgaccccggcuccaccgagucccuccaggagaagcccauggagaucgcccccuccgccggcuucggcggcucccuccaccccggcgcccgcgccggcggcaccuccucccccucccccgucgucuucaccgucggcuccccccccuccggcuccacccccccccagggcccccgcacccgcauguucuccgccggccccaccggcuccgccuccuccuccgcccgccaccucguccccggccccugcuccgaggcccccgcccccgagcuccccgcccccggccacggcugcuccuucgccgaccccaucgccgccaaccucgagggcgccgucaccuucgaggcccccgaccuccccgaggagacccucauggagcaggagcacaccgagauccuccgcggccuccgcuucacccuccucuucguccagcacguccucgagaucgccgcccucaagggcuccgccuccgaggccgccggcggccccgaguaccagcuccaggaguccgucgucgccgaccagaucucccuccucucccgcgaguggggcuucgccgagcagcucguccucuaccucaaggucgccgagcuccucuccuccggccuccaguccgccaucgaccagauccgcgccggcaagcucugccucuccuccaccgucaagcaggucguccgccgccucaacgagcucuacaaggccuccgucgucuccugccagggccucucccuccgccuccagcgcuucuuccucgacaagcagcgccuccucgaccgcauccacuccaucaccgccgagcgccucaucuucucccacgccguccagaugguccaguccgccgcccucgacgagauguuccagcaccgcgagggcugcgucccccgcuaccacaaggcccuccuccuccucgagggccuccagcacaugcucuccgaccaggccgacaucgagaacgucaccaagugcaagcucugcaucgagcgccgccucuccgcccuccucaccggcaucugcgccuga

SEQ ID NO: 51499 - RNA, 3111 nt, Artificial Sequence
  derived and/or modified sequence opt2 from ULK2__Homo_sapiens__NP_001136082
auggaggucgucggcgacuucgaguacuccaagcgcgaccucgucggccacggcgccuucgccgucgucuuccgcggccgccaccgccagaagaccgacugggaggucgccaucaaguccaucaacaagaagaaccucuccaagucccagauccuccucggcaaggagaucaagauccucaaggagcuccagcacgagaacaucgucgcccucuacgacguccaggagcuccccaacuccgucuuccucgucauggaguacugcaacggcggcgaccucgccgacuaccuccaggccaagggcacccucuccgaggacaccauccgcgucuuccuccaccagaucgccgccgccaugcgcauccuccacuccaagggcaucauccaccgcgaccucaagccccagaacauccuccucuccuacgccaaccgccgcaaguccuccgucuccggcauccgcaucaagaucgccgacuucggcuucgcccgcuaccuccacuccaacaugauggccgccacccucugcggcucccccauguacauggcccccgaggucaucaugucccagcacuacgacgccaaggccgaccucugguccaucggcaccgucaucuaccagugccucgucggcaagccccccuuccaggccaacuccccccaggaccuccgcauguucuacgagaagaaccgcucccucaugcccuccaucccccgcgagaccucccccuaccucgccaaccuccuccucggccuccuccagcgcaaccagaaggaccgcauggacuucgaggccuucuucucccaccccuuccucgagcagggccccgucaagaaguccugccccguccccguccccauguacuccggcuccgucuccggcuccuccugcggcuccucccccuccugccgcuucgccuccccccccucccuccccgacaugcagcacauccaggaggagaaccucuccucccccccccucggcccccccaacuaccuccaggucuccaaggacuccgccuccaccuccuccaagaacuccuccugcgacaccgacgacuucguccucgucccccacaacaucuccuccgaccacuccugcgacaugcccgucggcaccgccggccgccgcgccuccaacgaguuccucgucugcggcggccagugccagcccaccgucuccccccacuccgagaccgcccccauccccguccccacccagauccgcaacuaccagcgcaucgagcagaaccucaccuccaccgccuccuccggcaccaacguccacggcuccccccgcuccgccgucguccgccgcuccaacaccucccccaugggcuuccuccgccccggcuccugcucccccguccccgccgacaccgcccagaccgucggccgccgccucuccaccggcuccucccgccccuacucccccuccccccucgucggcaccauccccgagcaguucucccagugcugcugcggccacccccagggccacgacucccgcucccgcaacuccuccggcucccccgucccccaggcccaguccccccagucccuccucuccggcgcccgccuccaguccgcccccacccucaccgacaucuaccagaacaagcagaagcuccgcaagcagcacuccgaccccgucugccccucccacaccggcgccggcuacuccuacuccccccagcccucccgccccggcucccucggcaccucccccaccaagcaccucggcuccuccccccgcuccuccgacugguucuucaagaccccccuccccaccaucaucggcucccccaccaagaccaccgcccccuucaagauccccaagacccaggccuccuccaaccuccucgcccucgucacccgccacggccccgccgaggagcaguccaaggacggcaacgagccccgcgagugcgcccacugccuccucguccagggcuccgagcgccagcgcgccgagcagcaguccaaggccgucuucggccgcuccgucuccaccggcaagcucuccgaccagcagggcaagacccccaucugccgccaccagggcuccaccgacucccucaacaccgagcgccccauggacaucgcccccgccggcgccugcggcggcguccucgccccccccgccggcaccgccgccuccuccaaggccguccucuucaccgucggcucccccccccacuccgccgccgcccccaccugcacccacauguuccuccgcacccgcaccaccuccgucggccccuccaacuccggcggcucccucugcgccauguccggccgcgucugcgucggcuccccccccggccccggcuucggcuccuccccccccggcgccgaggccgcccccucccuccgcuacguccccuacggcgccuccccccccucccucgagggccucaucaccuucgaggcccccgagcuccccgaggagacccucauggagcgcgagcacaccgacacccuccgccaccucaacgucaugcucauguucaccgagugcguccucgaccucaccgccaugcgcggcggcaaccccgagcucugcaccuccgccgucucccucuaccagauccaggaguccgucgucgucgaccagaucucccagcucuccaaggacuggggccgcgucgagcagcucguccucuacaugaaggccgcccagcuccucgccgccucccuccaccucgccaaggcccagaucaaguccggcaagcucucccccuccaccgccgucaagcaggucgucaagaaccucaacgagcgcuacaaguucugcaucaccaugugcaagaagcucaccgagaagcucaaccgcuucuucuccgacaagcagcgcuucaucgacgagaucaacuccgucaccgccgagaagcucaucuacaacugcgccgucgagaugguccaguccgccgcccucgacgagauguuccagcagaccgaggacaucgucuaccgcuaccacaaggccgcccuccuccucgagggccucucccgcauccuccaggaccccgccgacaucgagaacguccacaaguacaagugcuccaucgagcgccgccucuccgcccucugccacuccaccgccaccgucuga

SEQ ID NO: 51500 - RNA, 1419 nt, Artificial Sequence
  derived and/or modified sequence opt2 from ULK3__Homo_sapiens__NP_001092906
auggccggccccggcuggggccccccccgccucgacggcuucauccucaccgagcgccucggcuccggcaccuacgccaccgucuacaaggccuacgccaagaaggacacccgcgaggucgucgccaucaagugcgucgccaagaagucccucaacaaggccuccgucgagaaccuccucaccgagaucgagauccucaagggcauccgccacccccacaucguccagcucaaggacuuccagugggacuccgacaacaucuaccucaucauggaguucugcgccggcggcgaccucucccgcuucauccacacccgccgcauccuccccgagaaggucgcccgcgucuucaugcagcagcucgccuccgcccuccaguuccuccacgagcgcaacaucucccaccucgaccucaagccccagaacauccuccucuccucccucgagaagccccaccucaagcucgccgacuucggcuucgcccagcacaugucccccugggacgagaagcacguccuccgcggcuccccccucuacauggcccccgagauggucugccagcgccaguacgacgcccgcgucgaccucugguccaugggcgucauccucuacgaggcccucuucggccagccccccuucgccucccgcuccuucuccgagcucgaggagaagauccgcuccaaccgcgucaucgagcucccccuccgcccccuccucucccgcgacugccgcgaccuccuccagcgccuccucgagcgcgaccccucccgccgcaucuccuuccaggacuucuucgcccaccccugggucgaccucgagcacaugcccuccggcgagucccucggccgcgccaccgcccucgucguccaggccgucaagaaggaccaggagggcgacuccgccgccgcccucucccucuacugcaaggcccucgacuucuucguccccgcccuccacuacgaggucgacgcccagcgcaaggaggccaucaaggccaaggucggccaguacgucucccgcgccgaggagcucaaggccaucgucuccuccuccaaccaggcccuccuccgccagggcaccuccgcccgcgaccuccuccgcgagauggcccgcgacaagccccgccuccucgccgcccucgaggucgccuccgccgccauggccaaggaggaggccgccggcggcgagcaggacgcccucgaccucuaccagcacucccucggcgagcuccuccuccuccucgccgccgagccccccggccgccgccgcgagcuccuccacaccgagguccagaaccucauggcccgcgccgaguaccucaaggagcaggucaagaugcgcgagucccgcugggaggccgacacccucgacaaggagggccucuccgaguccguccgcuccuccugcacccuccaguga

SEQ ID NO: 51501 - RNA, 3828 nt, Artificial Sequence
  derived and/or modified sequence opt2 from ULK4__Homo_sapiens__NP_060356
auggagaacuucauccucuacgaggagaucggccgcggcuccaagaccgucgucuacaagggccgccgcaagggcaccaucaacuucgucgccauccucugcaccgacaagugcaagcgccccgagaucaccaacuggguccgccucacccgcgagaucaagcacaagaacaucgucaccuuccacgagugguacgagaccuccaaccaccucuggcucgucgucgagcucugcaccggcggcucccucaagaccgucaucgcccaggacgagaaccuccccgaggacgucguccgcgaguucggcaucgaccucaucuccggccuccaccaccuccacaagcucggcauccucuucugcgacaucuccccccgcaagauccuccucgagggccccggcacccucaaguucuccaacuucugccucgccaaggucgagggcgagaaccucgaggaguucuucgcccucgucgccgccgaggagggcggcggcgacaacggcgagaacguccucaagaaguccaugaagucccgcgucaagggcucccccgucuacaccgcccccgaggucguccgcggcgccgacuucuccaucuccuccgaccucuggucccucggcugccuccucuacgagauguucuccggcaagccccccuucuucuccgaguccaucuccgagcucaccgagaagauccucugcgaggacccccucccccccauccccaaggacuccucccgccccaaggccuccuccgacuucaucaaccuccucgacggccuccuccagcgcgacccccagaagcgccucaccuggacccgccuccuccagcacuccuucuggaagaaggccuucgccggcgccgaccaggaguccuccgucgaggaccucucccucucccgcaacaccauggagugcuccggcccccaggacuccaaggagcuccuccagaacucccagucccgccaggccaagggccacaaguccggccagccccucggccacuccuuccgccucgagaaccccaccgaguuccgccccaaguccacccucgagggccagcucaacgaguccauguuccuccucuccucccgccccaccccccgcaccuccaccgccgucgaggucucccccggcgaggacaugacccacugcuccccccagaagaccuccccccucaccaagaucaccuccggccaccucucccagcaggaccucgagucccagaugcgcgagcucaucuacaccgacuccgaccucgucgucacccccaucaucgacaaccccaagaucaugaagcagccccccgucaaguucgacgccaagauccuccaccuccccaccuacuccgucgacaagcuccucuuccucaaggaccaggacuggaacgacuuccuccagcaggucugcucccagaucgacuccaccgagaaguccaugggcgccucccgcgccaagcucaaccuccucugcuaccucugcgucgucgccggccaccaggaggucgccacccgccuccuccacuccccccucuuccagcuccucauccagcaccuccgcaucgcccccaacugggacauccgcgccaaggucgcccacgucaucggccuccucgccucccacaccgccgagcuccaggagaacacccccgucgucgaggccaucguccuccucaccgagcucauccgcgagaacuuccgcaacuccaagcucaagcagugccuccuccccacccucggcgagcucaucuaccucgucgccacccaggaggagaagaagaagaacccccgcgagugcugggccgucccccucgccgccuacaccguccucaugcgcugccuccgcgagggcgaggagcgcgucgucaaccacauggccgccaagaucaucgagaacgucugcaccaccuucuccgcccagucccagggcuucaucaccggcgagaucggccccauccucugguaccucuuccgccacuccaccgccgacucccuccgcaucaccgccgucuccgcccucugccgcaucacccgccacucccccaccgccuuccagaacgucaucgagaaggucggccucaacuccgucaucaacucccucgccuccgccaucugcaagguccagcaguacaugcucacccucuucgccgccaugcucuccugcggcauccaccuccagcgccucauccaggagaagggcuucgucuccaccaucauccgccuccucgacucccccuccaccugcauccgcgccaaggccuuccucguccuccucuacauccucaucuacaaccgcgagaugcuccuccucuccugccaggcccgccucgucauguacaucgagcgcgacucccgcaagaccacccccggcaaggagcagcaguccggcaacgaguaccucuccaagugccucgaccuccucaucugccacaucguccaggagcucccccgcauccucggcgacauccucaacucccucgccaacgucuccggccgcaagcaccccuccaccguccaggucaagcagcucaagcucugccucccccucaugcccgucguccuccaccucgucaccucccaggucuuccgcccccaggucgucaccgaggaguuccucuucuccuacggcaccauccucucccacaucaaguccgucgacuccggcgagaccaacaucgacggcgccaucggccucaccgccuccgaggaguucaucaagaucacccucuccgccuucgaggccaucauccaguaccccauccuccucaaggacuaccgcuccaccgucgucgacuacauccuccccccccucgucucccucguccagucccagaacgucgaguggcgccucuucucccuccgccuccucuccgagaccaccucccuccucgucaaccaggaguucggcgacggcaaggagaaggccuccgucgacuccgacuccaaccuccucgcccucauccgcgacguccuccucccccaguacgagcacauccuccucgagcccgaccccguccccgccuacgcccucaagcuccucgucgccaugaccgagcacaaccccaccuucacccgccucgucgaggaguccaagcucaucccccucaucuucgaggucacccucgagcaccaggaguccauccucggcaacaccaugcaguccgucaucgcccuccucuccaaccucgucgccugcaaggacuccaacauggagcuccucuacgagcagggccucgucucccacaucugcaaccuccucaccgagaccgccacccucugccucgacgucgacaacaagaacaacaacgagauggccgccccccuccucuucucccuccucgacauccuccacuccaugcucaccuacaccuccggcaucguccgccucgcccuccaggcccagaaguccggcuccggcgaggacccccaggccgccgaggaccuccuccuccucaaccgcccccucaccgaccucaucucccuccucaucccccuccuccccaacgaggaccccgagaucuucgacgucuccuccaagugccucuccauccucguccagcucuacggcggcgagaaccccgacucccucucccccgagaacgucgagaucuucgcccaccuccucaccuccaaggaggaccccaaggagcagaagcuccuccuccgcauccuccgccgcaugaucaccuccaacgagaagcaccucgagucccucaagaacgccggcucccuccuccgcgcccucgagcgccucgcccccggcuccggcuccuucgccgacuccgccgucgccccccucgcccucgagauccuccaggccgucggccacuga

SEQ ID NO: 51502 - RNA, 1923 nt, Artificial Sequence
  derived and/or modified sequence opt2 from UMOD__Homo_sapiens__NP_001008390
augggccagcccucccucaccuggaugcucauggucgucgucgccuccugguucaucaccaccgccgccaccgacaccuccgaggcccgcuggugcuccgagugccacuccaacgccaccugcaccgaggacgaggccgucaccaccugcaccugccaggagggcuucaccggcgacggccucaccugcgucgaccucgacgagugcgccauccccggcgcccacaacugcuccgccaacuccuccugcgucaacacccccggcuccuucuccugcgucugccccgagggcuuccgccucucccccggccucggcugcaccgacgucgacgagugcgccgagcccggccucucccacugccacgcccucgccaccugcgucaacgucgucggcuccuaccucugcgucugccccgccggcuaccgcggcgacggcuggcacugcgagugcucccccggcuccugcggccccggccucgacugcguccccgagggcgacgcccucgucugcgccgaccccugccaggcccaccgcacccucgacgaguacuggcgcuccaccgaguacggcgagggcuacgccugcgacaccgaccuccgcggcugguaccgcuucgucggccagggcggcgcccgcauggccgagaccugcguccccguccuccgcugcaacaccgccgcccccauguggcucaacggcacccaccccuccuccgacgagggcaucgucucccgcaaggccugcgcccacugguccggccacugcugccucugggacgccuccguccaggucaaggccugcgccggcggcuacuacgucuacaaccucaccgccccccccgagugccaccucgccuacugcaccgaccccuccuccgucgagggcaccugcgaggagugcuccaucgacgaggacugcaaguccaacaacggccgcuggcacugccagugcaagcaggacuucaacaucaccgacaucucccuccucgagcaccgccucgagugcggcgccaacgacaugaaggucucccucggcaagugccagcucaagucccucggcuucgacaaggucuucauguaccucuccgacucccgcugcuccggcuucaacgaccgcgacaaccgcgacugggucuccgucgucacccccgcccgcgacggccccugcggcaccguccucacccgcaacgagacccacgccaccuacuccaacacccucuaccucgccgacgagaucaucauccgcgaccucaacaucaagaucaacuucgccugcuccuacccccucgacaugaaggucucccucaagaccgcccuccagcccauggucuccgcccucaacauccgcgucggcggcaccggcauguucaccguccgcauggcccucuuccagacccccuccuacacccagcccuaccagggcuccuccgucacccucuccaccgaggccuuccucuacgucggcaccaugcucgacggcggcgaccucucccgcuucgcccuccucaugaccaacugcuacgccacccccuccuccaacgccaccgacccccucaaguacuucaucauccaggaccgcugcccccacacccgcgacuccaccauccaggucgucgagaacggcgaguccucccagggccgcuucuccguccagauguuccgcuucgccggcaacuacgaccucgucuaccuccacugcgaggucuaccucugcgacaccaugaacgagaagugcaagcccaccugcuccggcacccgcuuccgcuccggcuccgucaucgaccagucccgcguccucaaccucggccccaucacccgcaagggcguccaggccaccgucucccgcgccuucuccucccucggccuccucaaggucuggcucccccuccuccucuccgccacccucacccucaccuuccaguga

SEQ ID NO: 51503 - RNA, 3957 nt, Artificial Sequence
  derived and/or modified sequence opt2 from UMODL1__Homo_sapiens__NP_001004416
augcuccgcaccuccggccucgcccuccucgcccucgucuccgccgucggccccucccaggccuccggcuucaccgagaagggccucucccuccucggcuaccagcucugcucccaccgcgucacccacaccguccagaaggucgaggccguccagaccuccuacaccuccuacgucuccugcggcggcuggauccccuggcgccgcugccccaagauggucuaccgcacccaguaccucgucgucgagguccccgagucccgcaacgucaccgacugcugcgagggcuacgagcagcucggccucuacugcguccucccccucaaccaguccggccaguucaccucccgccccggcgccugccccgccgagggccccgagcccuccaccucccccugcucccucgacaucgacugccccggccucgagaagugcugccccugguccggcggccgcuacugcauggcccccgccccccaggcccccgagcgcgaccccgucggcuccugguacaacgucaccauccucgucaagauggacuucaaggagcuccagcaggucgacccccgccuccucaaccacaugcgccuccuccacucccucgucaccuccgcccuccagcccauggccuccaccguccaccaccuccacuccgcccccggcaacgccuccaccaccgucucccgccuccuccucggccucccccgcccccuccccgucgccgacgucuccacccuccucggcgacaucgccaagcgcgucuacgaggucaucuccguccagguccaggacgucaacgagugcuucuacgaggagcucaacgccugcuccggccgcgagcucugcgccaaccucgagggcuccuacuggugcgucugccaccaggaggcccccgccaccuccccccgcaagcucaaccucgagugggaggacugcccccccgucuccgacuacgucguccucaacgucaccuccgacuccuuccaggucuccuggcgccucaacuccacccagaaccacaccuuccacguccgcgucuaccgcggcauggagcuccuccgcuccgcccgcacccagucccaggcccucgccgucgccggccucgaggccggcguccucuaccgcgucaagaccuccuaccagggcugcggcgccgacgucuccaccacccucaccaucaagaccaacgcccaggucuucgaggucaccaucaagaucgucaaccacaaccucaccgagaagcuccucaaccgcuccuccgucgaguaccaggacuucucccgccagcuccuccacgaggucgaguccuccuucccccccgucgucuccgaccucuaccgcuccggcaagcuccgcaugcagaucgucucccuccaggccggcuccgucgucguccgccucaagcucaccguccaggaccccggcuuccccaugggcaucuccacccucgcccccauccuccagccccuccucgccuccaccgucuuccagaucgaccgccagggcacccgcguccaggacugggacgagugcgucgacuccgccgagcacgacugcucccccgccgccuggugcaucaaccucgagggcuccuacaccugccagugccgcaccacccgcgacgccacccccucccgcgccggccgcgccugcgagggcgaccucgucucccccaccggcggcggccucuccgccgccaccggcgucaccguccccggccucggcaccggcaccgccgcccucggccucgagaacuucacccucucccccucccccggcuacccccagggcacccccgccgccggccaggccuggacccccgagcccuccccccgccgcggcggcuccaacgucgucggcuacgaccgcaacaacaccggcaagggcgucgagcaggagcuccagggcaacuccaucauggagccccccuccuggcccucccccaccgaggaccccaccggccacuuccucuggcacgccacccgcuccacccgcgagacccuccucaaccccaccuggcuccgcaacgaggacuccggccccuccggcuccgucgaccucccccucaccuccacccucaccgcccucaagacccccgccugcguccccgucuccaucggccgcaucauggucuccaacgucaccuccaccggcuuccaccucgccugggaggccgaccucgccauggacuccaccuuccagcucacccucaccuccauguggucccccgccgucguccucgagaccuggaacaccuccgucacccucuccggccucgagcccggcguccuccaccucgucgagaucauggccaaggccugcggcaaggagggcgcccgcgcccaccucaagguccgcaccgccgcccgcaagcucaucggcaagguccgcaucaagaacguccgcuacuccgaguccuuccgcaacgccuccucccaggaguaccgcgacuuccucgagcucuucuuccgcaugguccgcggcucccuccccgccaccaugugccagcacauggacgccggcggcguccgcauggaggucgucuccgucaccaacggcuccaucgucgucgaguuccaccuccucaucaucgccgacgucgacguccaggaggucuccgccgccuuccucaccgccuuccagaccgucccccuccucgaggucauccgcggcgacaccuucauccaggacuacgacgagugcgagcgcaaggaggacgacugcguccccggcaccuccugccgcaacacccucggcuccuucaccugcuccugcgagggcggcgcccccgacuuccccgucgaguacuccgagcgccccugcgagggcgacucccccggcaacgagaccugggccaccucccccgagcgcccccucaccaccgccggcaccaaggccgccuucguccagggcaccucccccaccccccagggccucccccagcgccucaaccucaccggcgccguccgcguccucugcgagaucgagaaggucgucgucgccauccagaagcgcuuccuccagcaggaguccauccccgaguccucccucuaccucucccaccccuccugcaacgucucccacuccaacggcacccacguccuccucgaggccggcugguccgagugcggcacccucaugcaguccaacaugaccaacaccgucguccgcaccacccuccgcaacgaccucucccaggagggcaucauccaccaccucaagauccucucccccaucuacugcgccuuccagaacgaccuccucaccuccuccggcuucacccucgaguggggcgucuacaccaucaucgaggaccuccacggcgccggcaacuucgucaccgagaugcagcucuucaucggcgacucccccaucccccagaacuacuccgucuccgccuccgacgacguccgcaucgaggucggccucuaccgccagaaguccaaccucaaggucguccucaccgagugcugggccacccccuccuccaacgcccgcgaccccaucaccuucuccuucaucaacaacuccugccccguccccaacaccuacaccaacgucaucgagaacggcaacuccaacaaggcccaguucaagcuccgcaucuucuccuucaucaacgacuccaucgucuaccuccacugcaagcuccgcgucugcauggagucccccggcgccaccugcaagaucaacugcaacaacuuccgccuccuccagaacuccgagaccuccgccacccaccagauguccuggggcccccucauccgcuccgagggcgagcccccccacgccgaggccggccucggcgccggcuacgucguccucaucgucgucgccaucuucguccucgucgccggcaccgccacccuccucaucguccgcuaccagcgcaugaacggccgcuacaacuucaagauccaguccaacaacuucuccuaccaggucuucuacgaguga

SEQ ID NO: 51504 - RNA, 1443 nt, Artificial Sequence
  derived and/or modified sequence opt2 from UMPS__Homo_sapiens__NP_000364
auggccgucgcccgcgccgcccucggcccccucgucaccggccucuacgacguccaggccuucaaguucggcgacuucguccucaaguccggccucuccucccccaucuacaucgaccuccgcggcaucgucucccgcccccgccuccucucccaggucgccgacauccucuuccagaccgcccagaacgccggcaucuccuucgacaccgucugcggcguccccuacaccgcccucccccucgccaccgucaucugcuccaccaaccagauccccaugcucauccgccgcaaggagaccaaggacuacggcaccaagcgccucgucgagggcaccaucaaccccggcgagaccugccucaucaucgaggacgucgucaccuccggcuccuccguccucgagaccgucgagguccuccagaaggagggccucaaggucaccgacgccaucguccuccucgaccgcgagcagggcggcaaggacaagcuccaggcccacggcauccgccuccacuccgucugcacccucuccaagaugcucgagauccucgagcagcagaagaaggucgacgccgagaccgucggccgcgucaagcgcuucauccaggagaacgucuucgucgccgccaaccacaacggcuccccccucuccaucaaggaggcccccaaggagcucuccuucggcgcccgcgccgagcucccccgcauccaccccgucgccuccaagcuccuccgccucaugcagaagaaggagaccaaccucugccucuccgccgacgucucccucgcccgcgagcuccuccagcucgccgacgcccucggccccuccaucugcaugcucaagacccacgucgacauccucaacgacuucacccucgacgucaugaaggagcucaucacccucgccaagugccacgaguuccucaucuucgaggaccgcaaguucgccgacaucggcaacaccgucaagaagcaguacgagggcggcaucuucaagaucgccuccugggccgaccucgucaacgcccacgucguccccggcuccggcgucgucaagggccuccaggaggucggccucccccuccaccgcggcugccuccucaucgccgagauguccuccaccggcucccucgccaccggcgacuacacccgcgccgccguccgcauggccgaggagcacuccgaguucgucgucggcuucaucuccggcucccgcgucuccaugaagcccgaguuccuccaccucacccccggcguccagcucgaggccggcggcgacaaccucggccagcaguacaacuccccccaggaggucaucggcaagcgcggcuccgacaucaucaucgucggccgcggcaucaucuccgccgccgaccgccucgaggccgccgagauguaccgcaaggccgccugggaggccuaccucucccgccucggcgucuga

SEQ ID NO: 51505 - RNA, 723 nt, Artificial Sequence
  derived and/or modified sequence opt2 from UNC119__Homo_sapiens__NP_005139
augaaggucaagaagggcggcggcggcgccggcaccgccaccgaguccgcccccggccccuccggccaguccgucgcccccaucccccagccccccgccgaguccgaguccggcuccgaguccgagcccgacgccggccccggcccccgccccggcccccuccagcgcaagcagcccaucggccccgaggacguccucggccuccagcgcaucaccggcgacuaccucugcucccccgaggagaacaucuacaagaucgacuucguccgcuucaagauccgcgacauggacuccggcaccguccucuucgagaucaagaagccccccgucuccgagcgccuccccaucaaccgccgcgaccucgaccccaacgccggccgcuucguccgcuaccaguucacccccgccuuccuccgccuccgccaggucggcgccaccgucgaguucaccgucggcgacaagcccgucaacaacuuccgcaugaucgagcgccacuacuuccgcaaccagcuccucaaguccuucgacuuccacuucggcuucugcauccccuccuccaagaacaccugcgagcacaucuacgacuuccccccccucuccgaggagcucaucuccgagaugauccgccaccccuacgagacccaguccgacuccuucuacuucgucgacgaccgccucgucaugcacaacaaggccgacuacuccuacuccggcacccccuga

SEQ ID NO: 51506 - RNA, 5112 nt, Artificial Sequence
  derived and/or modified sequence opt2 from UNC13A__Homo_sapiens__NP_001073890
augucccuccucugcgucggcgucaagaaggccaaguucgacggcgcccaggagaaguucaacaccuacgucacccucaagguccagaacgucaaguccaccaccaucgccguccgcggcucccagcccuccugggagcaggacuucauguucgagaucaaccgccucgaccucggccucaccgucgaggucuggaacaagggccucaucugggacaccauggucggcaccgucuggaucccccuccgcaccauccgccaguccaacgaggagggccccggcgaguggcucacccucgacucccaggucaucauggccgacuccgagaucugcggcaccaaggaccccaccuuccaccgcauccuccucgacacccgcuucgagcucccccucgacauccccgaggaggaggcccgcuacugggccaagaagcucgagcagcucaacgccaugcgcgaccaggacgaguacuccuuccaggacgagcaggacaagccccuccccguccccuccaaccagugcugcaacuggaacuacuucggcuggggcgagcagcacaacgacgaccccgacuccgccgucgacgaccgcgacuccgacuaccgcuccgagaccuccaacuccauccccccccccuacuacaccaccucccagcccaacgccuccguccaccaguacuccguccgcccccccccccucggcucccgcgaguccuacuccgacuccaugcacuccuacgaggaguucuccgagccccaggcccucucccccaccggcuccucccgcuacgccuccuccggcgagcucucccagggcuccucccagcucuccgaggacuucgaccccgacgagcacucccuccagggcuccgacauggaggacgagcgcgaccgcgacuccuaccacuccugccacuccuccgucuccuaccacaaggacuccccccgcugggaccaggacgaggaggagcucgaggaggaccucgaggacuuccucgaggaggaggagcuccccgaggacgaggaggagcucgaggaggaggaggaggagguccccgacgaccucggcuccuacgcccagcgcgaggacgucgccgucgccgagcccaaggacuucaagcgcaucucccucccccccgccgcccccggcaaggaggacaaggcccccgucgcccccaccgaggcccccgacauggccaaggucgcccccaagcccgccacccccgacaagguccccgccgccgagcagauccccgaggccgagccccccaaggacgaggaguccuuccgcccccgcgaggacgaggagggccaggagggccaggacuccaugucccgcgccaaggccaacuggcuccgcgccuucaacaagguccgcaugcagcuccaggaggcccgcggcgagggcgagauguccaagucccucugguucaagggcggccccggcggcggccucaucaucaucgacuccaugcccgacauccgcaagcgcaagcccaucccccucgucuccgaccucgccaugucccucguccagucccgcaaggccggcaucaccuccgcccucgccuccuccacccucaacaacgaggagcucaagaaccacgucuacaagaagacccuccaggcccucaucuaccccaucuccugcaccaccccccacaacuucgaggucuggaccgccaccacccccaccuacugcuacgagugcgagggccuccucuggggcaucgcccgccagggcaugcgcugcaccgagugcggcgucaagugccacgagaagugccaggaccuccucaacgccgacugccuccagcgcgccgccgagaaguccuccaagcacggcgccgaggaccgcacccagaacaucaucaugguccucaaggaccgcaugaagauccgcgagcgcaacaagcccgagaucuucgagcucauccaggagaucuucgccgucaccaagaccgcccacacccagcagaugaaggccgucaagcaguccguccucgacggcaccuccaagugguccgccaagaucuccaucaccgucgucugcgcccagggccuccaggccaaggacaagaccggcuccuccgaccccuacgucaccguccaggucggcaagaccaagaagcgcaccaagaccaucuacggcaaccucaaccccgucugggaggagaacuuccacuucgagugccacaacuccuccgaccgcaucaagguccgcgucugggacgaggacgacgacaucaagucccgcgucaagcagcgcuucaagcgcgaguccgacgacuuccucggccagaccaucaucgagguccgcacccucuccggcgagauggacgucugguacaaccucgacaagcgcaccgacaaguccgccgucuccggcgccauccgccuccacaucuccgucgagaucaagggcgaggagaaggucgcccccuaccacguccaguacaccugccuccacgagaaccucuuccacuucgucaccgacguccagaacaacggcgucgucaagauccccgacgccaagggcgacgacgccuggaaggucuacuacgacgagaccgcccaggagaucgucgacgaguucgccaugcgcuacggcgucgaguccaucuaccaggccaugacccacuucgccugccucuccuccaaguacaugugccccggcguccccgccgucauguccacccuccucgccaacaucaacgccuacuacgcccacaccaccgccuccaccaacgucuccgccuccgaccgcuucgccgccuccaacuucggcaaggagcgcuucgucaagcuccucgaccagcuccacaacucccuccgcaucgaccucuccauguaccgcaacaacuuccccgccuccucccccgagcgccuccaggaccucaaguccaccgucgaccuccucaccuccaucaccuucuuccgcaugaagguccaggagcuccagucccccccccgcgccucccaggucgucaaggacugcgucaaggccugccucaacuccaccuacgaguacaucuucaacaacugccacgagcucuacucccgcgaguaccagaccgaccccgccaagaagggcgagguccuccccgaggagcagggccccuccaucaagaaccucgacuucugguccaagcucaucacccucaucgucuccaucaucgaggaggacaagaacuccuacacccccugccucaaccaguucccccaggagcucaacgucggcaagaucuccgccgaggucauguggaaccucuucgcccaggacaugaaguacgccauggaggagcacgacaagcaccgccucugcaaguccgccgacuacaugaaccuccacuucaaggucaaguggcucuacaacgaguacgucaccgagcuccccgccuucaaggaccgcguccccgaguaccccgccugguucgagcccuucgucauccaguggcucgacgagaacgaggaggucucccgcgacuuccuccacggcgcccucgagcgcgacaagaaggacggcuuccagcagaccuccgagcacgcccucuucuccugcuccgucgucgacgucuucucccagcucaaccaguccuucgagaucaucaagaagcucgagugccccgacccccagaucgucggccacuacaugcgccgcuucgccaagaccaucuccaacguccuccuccaguacgccgacaucaucuccaaggacuucgccuccuacugcuccaaggagaaggagaagguccccugcauccucaugaacaacacccagcagcuccgcguccagcucgagaagauguucgaggccaugggcggcaaggagcucgacgccgaggccuccgacauccucaaggagcuccaggucaagcucaacaacguccucgacgagcucucccgcgucuucgccaccuccuuccagccccacaucgaggagugcgucaagcagaugggcgacauccucucccaggucaagggcaccggcaacguccccgccuccgccugcuccuccgucgcccaggacgccgacaacguccuccagcccaucauggaccuccucgacuccaaccucacccucuucgccaagaucugcgagaagaccguccucaagcgcguccucaaggagcucuggaagcucgucaugaacaccauggagaagaccaucguccuccccccccucaccgaccagaccaugaucggcaaccuccuccgcaagcacggcaagggccucgagaagggccgcgucaagcuccccucccacuccgacggcacccagaugaucuucaacgccgccaaggagcucggccagcucuccaagcucaaggaccacaugguccgcgaggaggccaagucccucacccccaagcagugcgccgucgucgagcucgcccucgacaccaucaagcaguacuuccacgccggcggcgucggccucaagaagaccuuccucgagaagucccccgaccuccagucccuccgcuacgcccucucccucuacacccaggccaccgaccuccucaucaagaccuucguccagacccaguccgcccagggccucggcgucgaggaccccgucggcgaggucuccguccacgucgagcucuucacccaccccggcaccggcgagcacaaggucaccgucaaggucgucgccgccaacgaccucaaguggcagaccuccggcaucuuccgccccuucaucgaggucaacaucaucggcccccagcucuccgacaagaagcgcaaguucgccaccaaguccaagaacaacuccugggcccccaaguacaacgaguccuuccaguucacccucuccgccgacgccggccccgagugcuacgagcuccaggucugcgucaaggacuacugcuucgcccgcgaggaccgcaccgucggccucgccguccuccagcuccgcgagcucgcccagcgcggcuccgccgccugcuggcucccccucggccgccgcauccacauggacgacaccggccucaccguccuccgcauccucucccagcgcuccaacgacgaggucgccaaggaguucgucaagcucaaguccgacacccgcuccgccgaggagggcggcgccgcccccgcccccuga

SEQ ID NO: 51507 - RNA, 4776 nt, Artificial Sequence
  derived and/or modified sequence opt2 from UNC13B__Homo_sapiens__NP_006368
augucccuccucugcguccgcgucaagcgcgccaaguuccagggcucccccgacaaguucaacaccuacgucacccucaagguccagaacgucaaguccaccaccgucgccguccgcggcgaccagcccuccugggagcaggacuucauguucgagaucucccgccucgaccucggccucuccgucgaggucuggaacaagggccucaucugggacaccauggucggcaccgucuggaucgcccucaagaccauccgccaguccgacgaggagggccccggcgagugguccacccucgaggccgagacccucaugaaggacgacgagaucugcggcacccgcaaccccaccccccacaagauccuccucgacacccgcuucgagcuccccuucgacauccccgaggaggaggcccgcuacuggaccuacaagugggagcagaucaacgcccucggcgccgacaacgaguacuccucccaggaggagucccagcgcaagccccuccccaccgccgccgcccagugcuccuucgaggaccccgacuccgccgucgacgaccgcgacuccgacuaccgcuccgagaccuccaacuccuuccccccccccuaccacaccgccucccagcccaacgccuccguccaccaguuccccguccccguccgcuccccccagcagcuccuccuccagggcuccucccgcgacuccugcaacgacuccaugcaguccuacgaccucgacuaccccgagcgccgcgccaucucccccaccuccuccucccgcuacggcuccuccugcaacgucucccagggcuccucccagcucuccgagcucgaccaguaccacgagcaggacgacgaccaccgcgagaccgacuccauccacuccugccacuccucccacucccucucccgcgacggccaggccggcuucggcgagcaggagaagccccucgaggucaccggccaggccgagaaggaggccgccugcgagcccaaggagaugaaggaggacgccaccacccaccccccccccgaccucguccuccagaaggaccacuuccucggcccccaggaguccuuccccgaggagaacgccuccucccccuucacccaggcccgcgcccacuggauccgcgccgucaccaagguccgccuccagcuccaggagauccccgacgacggcgaccccucccucccccaguggcuccccgagggccccgccggcggccucuacggcaucgacuccaugcccgaccuccgccgcaagaagccccucccccucgucuccgaccucucccucguccagucccgcaaggccggcaucaccuccgccauggccacccgcaccucccucaaggacgaggagcucaagucccacgucuacaagaagacccuccaggcccucaucuaccccaucuccugcaccaccccccacaacuucgaggucuggaccgccaccacccccaccuacugcuacgagugcgagggccuccucuggggcaucgcccgccagggcaugcgcugcuccgagugcggcgucaagugccacgagaagugccaggaccuccucaacgccgacugccuccagcgcgccgccgagaaguccugcaagcacggcgccgaggaccgcacccagaacaucaucauggccaugaaggaccgcaugaagauccgcgagcgcaacaagcccgagaucuucgaggucauccgcgacgucuucaccgucaacaaggccgcccacguccagcagaugaagaccgucaagcaguccguccucgacggcaccuccaagugguccgccaagaucaccaucaccgucgucugcgcccagggccuccaggccaaggacaagaccggcuccuccgaccccuacgucaccguccaggucuccaagaccaagaagcgcaccaagaccaucuucggcaaccucaaccccgucugggaggagaaguuccacuucgagugccacaacuccuccgaccgcaucaagguccgcgucugggacgaggacgacgacaucaagucccgcgucaagcagcgccucaagcgcgaguccgacgacuuccucggccagaccaucaucgagguccgcacccucuccggcgagauggacgucugguacaaccucgagaagcgcaccgacaaguccgccgucuccggcgccauccgccuccagaucuccgucgagaucaagggcgaggagaaggucgcccccuaccacguccaguacaccugccuccacgagaaccucuuccacuaccucaccgacauccagggcuccggcggcguccgcauccccgaggcccgcggcgacgacgccuggaaggucuacuucgacgagaccgcccaggagaucgucgacgaguucgccaugcgcuacggcaucgaguccaucuaccaggccaugacccacuucgccugccucuccuccaaguacaugugccccggcguccccgccgucauguccacccuccucgccaacaucaacgccuacuacgcccacaccaccgccuccaccaacgucuccgccuccgaccgcuucgccgccuccaacuucggcaaggagcgcuucgucaagcuccucgaccagcuccacaacucccuccgcaucgaccucuccaccuaccgcaacaacuuccccgccggcucccccgagcgccuccaggaccucaaguccaccgucgaccuccucaccuccaucaccuucuuccgcaugaagguccaggagcuccagucccccccccgcgccucccaggucgucaaggacugcgucaaggccugccucaacuccaccuacgaguacaucuucaacaacugccacgaccucuacucccgccaguaccagcucaagcaggagcucccccccgaggagcagggccccuccauccgcaaccucgacuucuggcccaagcucaucacccucaucgucuccaucaucgaggaggacaagaacuccuacacccccguccucaaccaguucccccaggagcucaacgucggcaaggucuccgccgaggucauguggcaccucuucgcccaggacaugaaguacgcccucgaggagcacgagaaggaccaccucugcaaguccgccgacuacaugaaccuccacuucaaggucaaguggcuccacaacgaguacguccgcgaccuccccguccuccagggccagguccccgaguaccccgccugguucgagcaguucguccuccaguggcucgacgagaacgaggacgucucccucgaguuccuccgcggcgcccucgagcgcgacaagaaggacggcuuccagcagaccuccgagcacgcccucuucuccugcuccgucgucgacgucuucacccagcucaaccaguccuucgagaucauccgcaagcucgagugccccgaccccuccauccucgcccacuacaugcgccgcuucgccaagaccaucggcaagguccucaugcaguacgccgacauccucuccaaggacuuccccgccuacugcaccaaggagaagcuccccugcauccucaugaacaacguccagcagcuccgcguccagcucgagaagauguucgaggccaugggcggcaaggagcucgaccucgaggccgccgacucccucaaggagcuccaggucaagcucaacaccguccucgacgagcucuccauggucuucggcaacuccuuccagguccgcaucgacgagugcguccgccagauggccgacauccucggccagguccgcggcaccggcaacgccucccccgacgcccgcgccuccgccgcccaggacgccgacuccguccuccgcccccucauggacuuccucgacggcaaccucacccucuucgccaccgucugcgagaagaccguccucaagcgcguccucaaggagcucuggcgcgucgucaugaacaccauggagcgcaugaucguccuccccccccucaccgaccagaccggcacccagcucaucuucaccgccgccaaggagcucucccaccucuccaagcucaaggaccacaugguccgcgaggagacccgcaaccucacccccaagcagugcgccguccucgaccucgcccucgacaccaucaagcaguacuuccacgccggcggcaacggccucaagaagaccuuccucgagaagucccccgaccuccagucccuccgcuacgcccucucccucuacacccagaccaccgacacccucaucaagaccuucguccgcucccagaccacccagggcuccggcgucgacgaccccgucggcgaggucuccauccaggucgaccucuucacccaccccggcaccggcgagcacaaggucaccgucaaggucgucgccgccaacgaccucaaguggcagaccgccggcauguuccgccccuucgucgaggucaccauggucggcccccaccaguccgacaagaagcgcaaguucaccaccaaguccaaguccaacaacugggcccccaaguacaacgagaccuuccacuuccuccucggcaacgaggagggccccgaguccuacgagcuccagaucugcgucaaggacuacugcuucgcccgcgaggaccgcguccucggccucgccgucaugccccuccgcgacgucaccgccaagggcuccugcgccugcuggugcccccucggccgcaagauccacauggacgagaccggccucaccauccuccgcauccucucccagcgcuccaacgacgaggucgcccgcgaguucgucaagcucaaguccgagucccgcuccaccgaggagggcuccuga

SEQ ID NO: 51508 - RNA, 6645 nt, Artificial Sequence
  derived and/or modified sequence opt2 from UNC13C__Homo_sapiens__NP_001074003
auggucgccaacuucuucaagucccucauccuccccuacauccacaagcucugcaagggcauguucaccaagaagcucggcaacaccaacaagaacaaggaguaccgccagcagaagaaggaccaggacuuccccaccgccggccagaccaagucccccaaguucuccuacaccuucaaguccaccgucaagaagaucgccaagugcuccuccacccacaaccucuccaccgaggaggacgaggccuccaaggaguucucccucucccccaccuucuccuaccgcgucgccaucgccaacggccuccagaagaacgccaaggucaccaacuccgacaacgaggaccuccuccaggagcucuccuccaucgaguccuccuacuccgagucccucaacgagcuccgcuccuccaccgagaaccaggcccaguccacccacaccaugcccguccgccgcaaccgcaaguccuccuccucccucgcccccuccgagggcuccuccgacggcgagcgcacccuccacggccucaagcucggcgcccuccgcaagcuccgcaaguggaagaagucccaggagugcgucuccuccgacuccgagcucuccaccaugaagaaguccuggggcauccgcuccaagucccucgaccgcaccguccgcaaccccaagaccaacgcccucgagcccggcuucuccuccuccggcugcaucucccagacccacgacgucauggagaugaucuucaaggagcuccagggcaucucccagaucgagaccgagcucuccgagcuccgcggccacgucaacgcccucaagcacuccaucgacgagaucuccuccuccgucgaggucguccaguccgagaucgagcagcuccgcaccggcuucguccagucccgccgcgagacccgcgacauccacgacuacaucaagcaccucggccacaugggcuccaaggccucccuccgcuuccucaacgucaccgaggagcgcuucgaguacgucgaguccgucgucuaccagauccucaucgacaagaugggcuucuccgacgcccccaacgccaucaagaucgaguucgcccagcgcaucggccaccagcgcgacugccccaacgccaagccccgccccauccucgucuacuucgagaccccccagcagcgcgacuccguccucaagaaguccuacaagcucaagggcaccggcaucggcaucuccaccgacauccucacccacgacauccgcgagcgcaaggagaagggcauccccuccucccagaccuacgaguccauggccaucaagcucuccacccccgagcccaagaucaagaagaacaacuggcagucccccgacgacuccgacgaggaccucgaguccgaccucaaccgcaacuccuacgccguccucuccaaguccgagcuccucaccaagggcuccaccuccaagcccuccuccaagucccacuccgcccgcuccaagaacaagaccgccaacuccucccgcaucuccaacaaguccgacuacgacaagaucuccucccagcuccccgaguccgacauccucgagaagcagaccaccacccacuacgccgacgccaccccccucuggcacucccaguccgacuucuucaccgccaagcucucccgcuccgaguccgacuucuccaagcucugccaguccuacuccgaggacuucuccgagaaccaguucuucacccgcaccaacggcuccucccuccucuccuccuccgaccgcgagcucuggcagcgcaagcaggagggcaccgccacccucuacgacucccccaaggaccagcaccucaacggcggcguccagggcauccagggccagaccgagaccgagaacaccgagaccgucgacuccggcauguccaacggcauggucugcgccuccggcgaccgcucccacuacuccgacucccagcucucccuccacgaggaccucucccccuggaaggaguggaaccagggcgccgaccucggccucgacuccuccacccaggagggcuucgacuacgagaccaacucccucuucgaccagcagcucgacgucuacaacaaggaccucgaguaccucggcaagugccacuccgaccuccaggacgacuccgaguccuacgaccucacccaggacgacaacuccucccccugccccggccucgacaacgagccccagggccagugggucggccaguacgacuccuaccagggcgccaacuccaacgagcucuaccagaaccagaaccagcucuccaugauguaccgcucccaguccgagcuccaguccgacgacuccgaggacgccccccccaaguccuggcacucccgccucuccaucgaccucuccgacaagaccuucuccuuccccaaguucggcuccacccuccagcgcgccaaguccgcccucgaggucgucuggaacaaguccacccagucccucuccggcuacgaggacuccggcuccucccucaugggccgcuuccgcacccucucccaguccaccgccaacgaguccuccaccacccucgacuccgacgucuacaccgagcccuacuacuacaaggccgaggacgaggaggacuacaccgagcccgucgccgacaacgagaccgacuacgucgaggucauggagcagguccucgccaagcucgagaaccgcaccuccaucaccgagaccgacgagcagaugcaggccuacgaccaccucuccuacgagacccccuacgagaccccccaggacgagggcuacgacggccccgccgacgacauggucuccgaggagggccucgagccccucaacgagaccuccgccgagauggagauccgcgaggacgagaaccagaacauccccgagcagcccgucgagaucaccaagcccaagcgcauccgccccuccuucaaggaggccgcccuccgcgccuacaagaagcagauggccgagcucgaggagaagauccucgccggcgacuccuccuccgucgacgagaaggcccgcaucgucuccggcaacgaccucgacgccuccaaguucuccgcccuccaggucugcggcggcgccggcggcggccucuacggcaucgacuccaugcccgaccuccgccgcaagaagacccuccccaucguccgcgacgucgccaugacccucgccgcccgcaaguccggccucucccucgccauggucauccgcaccucccucaacaacgaggagcucaagaugcacgucuucaagaagacccuccaggcccucaucuaccccauguccuccaccaucccccacaacuucgaggucuggaccgccaccacccccaccuacugcuacgagugcgagggccuccucuggggcaucgcccgccagggcaugaagugccucgagugcggcgucaagugccacgagaagugccaggaccuccucaacgccgacugccuccagcgcgccgccgagaaguccuccaagcacggcgccgaggacaagacccagaccaucaucaccgccaugaaggagcgcaugaagauccgcgagaagaaccgccccgaggucuucgaggucauccaggagauguuccagaucuccaaggaggacuucguccaguucaccaaggccgccaagcaguccguccucgacggcaccuccaagugguccgccaagaucaccaucaccgucgucuccgcccagggccuccaggccaaggacaagaccggcuccuccgaccccuacgucaccguccaggucggcaagaacaagcgccgcaccaagaccaucuucggcaaccucaaccccgucugggacgagaaguucuacuucgagugccacaacuccaccgaccgcaucaagguccgcgucugggacgaggacgacgacaucaagucccgcgucaagcagcacuucaagaaggaguccgacgacuuccucggccagaccaucgucgagguccgcacccucuccggcgagauggacgucugguacaaccucgagaagcgcaccgacaaguccgccgucuccggcgccauccgccucaagaucaacgucgagaucaagggcgaggagaaggucgcccccuaccacauccaguacaccugccuccacgagaaccucuuccacuaccucaccgaggucaaguccaacggcggcgucaagauccccgaggucaagggcgacgaggccuggaaggucuucuucgacgacgccucccaggagaucgucgacgaguucgccaugcgcuacggcaucgaguccaucuaccaggccaugacccacuucuccugccucuccuccaaguacaugugccccggcguccccgccgucauguccacccuccucgccaacaucaacgccuucuacgcccacaccaccgucuccaccaacauccaggucuccgccuccgaccgcuucgccgccaccaacuucggccgcgagaaguucaucaagcuccucgaccagcuccacaacucccuccgcaucgaccucuccaaguaccgcgagaacuuccccgccuccaacaccgagcgccuccaggaccucaaguccaccgucgaccuccucaccuccaucaccuucuuccgcaugaagguccucgagcuccaguccccccccaaggccuccauggucgucaaggacugcguccgcgccugccucgacuccaccuacaaguacaucuucgacaacugccacgagcucuacucccagcucaccgaccccuccaagaagcaggacaucccccgcgaggaccagggccccaccaccaagaaccucgacuucuggccccagcucaucacccucauggucaccaucaucgacgaggacaagaccgccuacacccccguccucaaccaguucccccaggagcucaacaugggcaagaucuccgccgagaucauguggacccucuucgcccucgacaugaaguacgcccucgaggagcacgagaaccagcgccucugcaaguccaccgacuacaugaaccuccacuucaaggucaagugguucuacaacgaguacguccgcgagcuccccgccuucaaggacgccguccccgaguacucccucugguucgagcccuucgucaugcaguggcucgacgagaacgaggacgucuccauggaguuccuccacggcgcccucggccgcgacaagaaggacggcuuccagcagaccuccgagcacgcccucuucuccugcuccgucgucgacgucuucgcccagcucaaccaguccuucgagaucaucaagaagcucgagugccccaaccccgaggcccucucccaccucaugcgccgcuucgccaagaccaucaacaagguccuccuccaguacgccgccaucgucuccuccgacuucuccucccacugcgacaaggagaacguccccugcauccucaugaacaacauccagcagcuccgcguccagcucgagaagauguucgaguccaugggcggcaaggagcucgacuccgaggccuccaccauccucaaggagcuccaggucaagcucuccggcguccucgacgagcucuccgucaccuacggcgaguccuuccaggucaucaucgaggagugcaucaagcagauguccuucgagcucaaccagaugcgcgccaacggcaacaccaccuccaacaagaacuccgccgccauggacgccgagaucguccuccgcucccucauggacuuccucgacaagacccucucccucuccgccaagaucugcgagaagaccguccucaagcgcguccucaaggagcucuggaagcucguccucaacaagaucgagaagcagaucguccuccccccccucaccgaccagaccggcccccagaugaucuucaucgccgccaaggaccucggccagcucuccaagcucaaggagcacaugauccgcgaggacgcccgcggccucaccccccgccagugcgccaucauggaggucguccucgccaccaucaagcaguacuuccacgccggcggcaacggccucaagaagaacuuccucgagaagucccccgaccuccagucccuccgcuacgcccucucccucuacacccagaccaccgacgcccucaucaagaaguucaucgacacccagaccucccagucccgcuccuccaaggacgccgucggccagaucuccguccacgucgacaucaccgccacccccggcaccggcgaccacaaggucaccgucaaggucaucgccaucaacgaccucaacuggcagaccaccgccauguuccgccccuucgucgaggucugcauccucggccccaaccucggcgacaagaagcgcaagcagggcaccaagaccaaguccaacaccuggucccccaaguacaacgagaccuuccaguucauccucggcaaggagaaccgccccggcgccuacgagcuccaccucuccgucaaggacuacugcuucgcccgcgaggaccgcaucaucggcaugaccgucauccagcuccagaacaucgccgagaagggcuccuacggcgccugguacccccuccucaagaacaucuccauggacgagaccggccucaccauccuccgcauccucucccagcgcaccuccgacgacgucgccaaggaguucguccgccucaaguccgagacccgcuccaccgaggaguccgccuga

SEQ ID NO: 51509 - RNA, 3273 nt, Artificial Sequence
  derived and/or modified sequence opt2 from UNC13D__Homo_sapiens__NP_954712
auggccacccuccucucccacccccagcagcgcccccccuuccuccgccaggccaucaagauccgccgccgccgcguccgcgaccuccaggacccccccccccagauggcccccgagauccagccccccucccaccacuucucccccgagcagcgcgcccuccucuacgaggacgcccucuacaccguccuccaccgccucggccaccccgagcccaaccacgucaccgaggccuccgagcuccuccgcuaccuccaggaggccuuccacgucgagcccgaggagcaccagcagacccuccagcgcguccgcgagcucgagaagcccaucuucugccucaaggccaccgucaagcaggccaagggcauccucggcaaggacgucuccggcuucuccgaccccuacugccuccucggcaucgagcagggcgucggcguccccggcggcucccccggcucccgccaccgccagaaggccgucguccgccacaccauccccgaggaggagacccaccgcacccaggucaucacccagacccucaaccccgucugggacgagaccuucauccucgaguucgaggacaucaccaacgccuccuuccaccucgacaugugggaccucgacaccgucgaguccguccgccagaagcucggcgagcucaccgaccuccacggccuccgccgcaucuucaaggaggcccgcaaggacaagggccaggacgacuuccucggcaacgucguccuccgccuccaggaccuccgcugccgcgaggaccagugguacccccucgagccccgcaccgagaccuaccccgaccgcggccagugccaccuccaguuccagcucauccacaagcgccgcgccaccuccgccucccgcucccagcccuccuacaccguccaccuccaccuccuccagcagcucgucucccacgaggucacccagcacgaggccggcuccaccuccugggacggcucccucuccccccaggccgccaccguccucuuccuccacgccacccagaaggaccucuccgacuuccaccaguccauggcccaguggcucgccuacucccgccucuaccagucccucgaguuccccuccuccugccuccuccaccccaucaccuccaucgaguaccaguggauccagggccgccucaaggccgagcagcaggaggagcucgccgccuccuucuccucccuccucaccuacggccucucccucauccgccgcuuccgcuccgucuucccccucuccgucuccgacucccccgcccgccuccagucccuccuccgcguccucguccagaugugcaagaugaaggccuucggcgagcucugccccaacaccgccccccucccccagcucgucaccgaggcccuccagaccggcaccaccgagugguuccaccucaagcagcagcaccaccagcccaugguccagggcauccccgaggccggcaaggcccuccucggccucguccaggacgucaucggcgaccuccaccagugccagcgcaccugggacaagaucuuccacaacacccucaagauccaccucuucuccauggccuuccgcgagcuccaguggcucgucgccaagcgcguccaggaccacaccaccgucgucggcgacgucgucucccccgagaugggcgagucccucuuccagcucuacaucucccucaaggagcucugccagcuccgcauguccuccuccgagcgcgacggcguccucgcccucgacaacuuccaccgcugguuccagcccgccauccccuccuggcuccagaagaccuacaacgaggcccucgcccgcguccagcgcgccguccagauggacgagcucgucccccucggcgagcucaccaagcacuccaccuccgccgucgaccucuccaccugcuucgcccagaucucccacaccgcccgccagcucgacuggcccgaccccgaggaggccuucaugaucaccgucaaguucgucgaggacaccugccgccucgcccucgucuacugcucccucaucaaggcccgcgcccgcgagcucuccuccggccagaaggaccagggccaggccgccaacaugcucugcgucgucgucaacgacauggagcagcuccgccucgucaucggcaagcuccccgcccagcucgccugggaggcccucgagcagcgcgucggcgccguccucgagcagggccagcuccagaacacccuccacgcccagcuccaguccgcccucgccggccucggccacgagauccgcaccggcguccgcacccucgccgagcagcucgaggucggcaucgccaagcacauccagaagcucgucggcguccgcgaguccguccuccccgaggacgccauccucccccucaugaaguuccucgaggucgagcucugcuacaugaacaccaaccucguccaggagaacuucuccucccuccucacccuccucuggacccacacccucaccguccucgucgaggccgccgccucccagcgcuccuccucccucgccuccaaccgccucaagaucgcccuccagaaccucgagaucugcuuccacgccgagggcugcggccucccccccaaggcccuccacaccgccaccuuccaggcccuccagcgcgaccucgagcuccaggccgccuccucccgcgagcucauccgcaaguacuucugcucccgcauccagcagcaggccgagaccaccuccgaggagcucggcgccgucaccgucaaggccuccuaccgcgccuccgagcagaagcuccgcgucgagcuccucuccgccuccucccuccucccccucgacuccaacggcuccuccgaccccuucguccagcucacccucgagccccgccacgaguuccccgagcucgccgcccgcgagacccagaagcacaagaaggaccuccacccccucuucgacgagaccuucgaguuccucguccccgccgagcccugccgcaaggccggcgccugccuccuccucaccguccucgacuacgacacccucggcgccgacgaccucgagggcgaggccuuccucccccuccgcgagguccccggccucuccggcuccgaggagcccggcgaggucccccagacccgccucccccucaccuaccccgcccccaacggcgaccccauccuccagcuccucgagggccgcaagggcgaccgcgaggcccaggucuucguccgccuccgccgccaccgcgccaagcaggccucccagcacgcccuccgccccgcccccuga

SEQ ID NO: 51510 - RNA, 2790 nt, Artificial Sequence
  derived and/or modified sequence opt2 from UNC45A__Homo_sapiens__NP_001034764
augaccgccuccuccgucgagcagcuccgcaaggagggcaacgagcucuucaagugcggcgacuacggcggcgcccucgccgccuacacccaggcccucggccucgacgccaccccccaggaccaggccguccuccaccgcaaccgcgccgccugccaccucaagcucgaggacuacgacaaggccgagaccgaggccuccaaggccaucgagaaggacggcggcgacgucaaggcccucuaccgccgcucccaggcccucgagaagcucggccgccucgaccaggccguccucgaccuccagcgcugcgucucccucgagcccaagaacaaggucuuccaggaggcccuccgcaacaucggcggccagauccaggagaagguccgcuacauguccuccaccgacgccaaggucgagcagauguuccagauccuccucgaccccgaggagaagggcaccgagaagaagcagaaggccucccagaaccucgucguccucgcccgcgaggacgccggcgccgagaagaucuuccgcuccaacggcguccagcuccuccagcgccuccucgacaugggcgagaccgaccucaugcucgccgcccuccgcacccucgucggcaucugcuccgagcaccagucccgcaccgucgccacccucuccauccucggcacccgccgcgucgucuccauccucggcgucgagucccaggccgucucccucgccgccugccaccuccuccaggucauguucgacgcccucaaggagggcgucaagaagggcuuccgcggcaaggagggcgccaucaucgucgaccccgcccgcgagcucaagguccucaucuccaaccuccucgaccuccucaccgaggucggcgucuccggccagggccgcgacaacgcccucacccuccucaucaaggccgucccccgcaagucccucaaggaccccaacaacucccucacccucugggucaucgaccagggccucaagaagauccucgaggucggcggcucccuccaggacccccccggcgagcucgccgucaccgccaacucccgcauguccgccuccauccuccucuccaagcucuucgacgaccucaagugcgacgccgagcgcgagaacuuccaccgccucugcgagaacuacaucaaguccugguucgagggccagggccucgccggcaagcuccgcgccauccagaccgucuccugccuccuccagggccccugcgacgccggcaaccgcgcccucgagcucuccggcgucauggaguccgucaucgcccucugcgccuccgagcaggaggaggagcagcucgucgccgucgaggcccucauccacgccgccggcaaggccaagcgcgccuccuucaucaccgccaacggcgucucccuccucaaggaccucuacaagugcuccgagaaggacuccauccgcauccgcgcccucgucggccucugcaagcucggcuccgccggcggcaccgacuucuccaugaagcaguucgccgagggcuccacccucaagcucgccaagcagugccgcaaguggcucugcaacgaccagaucgacgccggcacccgccgcugggccgucgagggccucgccuaccucaccuucgacgccgacgucaaggaggaguucgucgaggacgccgccgcccucaaggcccucuuccagcucucccgccucgaggagcgcuccguccucuucgccgucgccuccgcccucgucaacugcaccaacuccuacgacuacgaggagcccgaccccaagauggucgagcucgccaaguacgccaagcagcacguccccgagcagcaccccaaggacaagcccuccuucguccgcgcccgcgucaagaagcuccucgccgccggcgucgucuccgccauggucugcauggucaagaccgagucccccguccucaccuccuccugccgcgagcuccucucccgcgucuuccucgcccucgucgaggaggucgaggaccgcggcaccgucgucgcccagggcggcggccgcgcccucaucccccucgcccucgagggcaccgacgucggccagaccaaggccgcccaggcccucgccaagcucaccaucaccuccaaccccgagaugaccuuccccggcgagcgcaucuacgaggucguccgcccccucgucucccuccuccaccucaacugcuccggccuccagaacuucgaggcccucauggcccucaccaaccucgccggcaucuccgagcgccuccgccagaagauccucaaggagaaggccguccccaugaucgagggcuacauguucgaggagcacgagaugauccgccgcgccgccaccgagugcaugugcaaccucgccauguccaaggagguccaggaccucuucgaggcccagggcaacgaccgccucaagcuccucguccucuacuccggcgaggacgacgagcuccuccagcgcgccgccgccggcggccucgccaugcucaccuccaugcgccccacccucugcucccgcaucccccaggucaccacccacuggcucgagauccuccaggcccuccuccucuccuccaaccaggagcuccagcaccgcggcgccgucgucguccucaacauggucgaggccucccgcgagaucgccuccacccucauggaguccgagaugauggagauccucuccguccucgccaagggcgaccacucccccgucacccgcgccgccgccgccugccucgacaaggccgucgaguacggccucauccagcccaaccaggacggcgaguga

SEQ ID NO: 51511 - RNA, 2790 nt, Artificial Sequence
  derived and/or modified sequence opt2 from UNC45B__Homo_sapiens__NP_001253981
auggccgaggucgaggccguccagcucaaggaggagggcaaccgccacuuccagcuccaggacuacaaggccgccaccaacuccuacucccaggcccucaagcucaccaaggacaaggcccuccucgccacccucuaccgcaaccgcgccgccugcggccucaagaccgaguccuacguccaggccgccuccgacgccucccgcgccaucgacaucaacuccuccgacaucaaggcccucuaccgccgcugccaggcccucgagcaccucggcaagcucgaccaggccuucaaggacguccagcgcugcgccacccucgagccccgcaaccagaacuuccaggagaugcuccgccgccucaacaccuccauccaggagaagcuccgcguccaguucuccaccgacucccgcguccagaagauguucgagauccuccucgacgagaacuccgaggccgacaagcgcgagaaggccgccaacaaccucaucguccucggccgcgaggaggccggcgccgagaagaucuuccagaacaacggcgucgcccuccuccuccagcuccucgacaccaagaagcccgagcucguccucgccgccguccgcacccucuccggcaugugcuccggccaccaggcccgcgccaccgucauccuccacgccguccgcaucgaccgcaucugcucccucauggccgucgagaacgaggagaugucccucgccgucugcaaccuccuccaggccaucaucgacucccucuccggcgaggacaagcgcgagcaccgcggcaaggaggaggcccucguccucgacaccaagaaggaccucaagcagaucaccucccaccuccucgacaugcucgucuccaagaaggucuccggccagggccgcgaccaggcccucaaccuccucaacaagaacgucccccgcaaggaccucgccauccacgacaacucccgcaccaucuacgucgucgacaacggccuccgcaagauccucaaggucgucggccagguccccgaccuccccuccugccucccccucaccgacaacacccgcaugcucgccuccauccucaucaacaagcucuacgacgaccuccgcugcgaccccgagcgcgaccacuuccgcaagaucugcgaggaguacaucaccggcaaguucgacccccaggacauggacaagaaccucaacgccauccagaccgucuccggcauccuccagggccccuucgaccucggcaaccagcuccucggccucaagggcgucauggagaugauggucgcccucugcggcuccgagcgcgagaccgaccagcucgucgccgucgaggcccucauccacgccuccaccaagcucucccgcgccaccuucaucaucaccaacggcgucucccuccucaagcagaucuacaagaccaccaagaacgagaagaucaagauccgcacccucgucggccucugcaagcucggcuccgccggcggcaccgacuacggccuccgccaguucgccgagggcuccaccgagaagcucgccaagcagugccgcaaguggcucugcaacauguccaucgacacccgcacccgccgcugggccgucgagggccucgccuaccucacccucgacgccgacgucaaggacgacuucguccaggacguccccgcccuccaggccauguucgagcucgccaagaccuccgacaagaccauccucuacuccgucgccaccacccucgucaacugcaccaacuccuacgacgucaaggaggucauccccgagcucguccagcucgccaaguucuccaagcagcacguccccgaggagcaccccaaggacaagaaggacuucaucgacaugcgcgucaagcgccuccucaaggccggcgucaucuccgcccucgccugcauggucaaggccgacuccgccauccucaccgaccagaccaaggagcuccucgcccgcgucuuccucgcccucugcgacaaccccaaggaccgcggcaccaucgucgcccagggcggcggcaaggcccucaucccccucgcccucgagggcaccgacgucggcaaggucaaggccgcccacgcccucgccaagaucgccgccgucuccaaccccgacaucgccuuccccggcgagcgcgucuacgaggucguccgcccccucguccgccuccucgacacccagcgcgacggccuccagaacuacgaggcccuccucggccucaccaaccucuccggccgcuccgacaagcuccgccagaagaucuucaaggagcgcgcccuccccgacaucgagaacuacauguucgagaaccacgaccagcuccgccaggccgccaccgagugcaugugcaacaugguccuccacaaggagguccaggagcgcuuccucgccgacggcaacgaccgccucaagcucgucguccuccucugcggcgaggacgacgacaagguccagaacgccgccgccggcgcccucgccaugcucaccgccgcccacaagaagcucugccucaagaugacccaggucaccacccaguggcucgagauccuccagcgccucugccuccacgaccagcucuccguccagcaccgcggccucgucaucgccuacaaccuccucgccgccgacgccgagcucgccaagaagcucgucgaguccgagcuccucgagauccucaccgucgucggcaagcaggagcccgacgagaagaaggccgaggucguccagaccgcccgcgagugccucaucaagugcauggacuacggcuucaucaagcccgucuccuga

SEQ ID NO: 51512 - RNA, 2529 nt, Artificial Sequence
  derived and/or modified sequence opt2 from UNC5A__Homo_sapiens__NP_588610
auggccguccgccccggccucuggcccgcccuccucggcaucguccucgccgccuggcuccgcggcuccggcgcccagcaguccgccaccgucgccaaccccguccccggcgccaaccccgaccuccucccccacuuccucgucgagcccgaggacgucuacaucgucaagaacaagcccguccuccucgucugcaaggccguccccgccacccagaucuucuucaagugcaacggcgaguggguccgccaggucgaccacgucaucgagcgcuccaccgacggcuccuccggccuccccaccauggagguccgcaucaacgucucccgccagcaggucgagaaggucuucggccucgaggaguacuggugccagugcgucgccugguccuccuccggcaccaccaagucccagaaggccuacauccgcaucgccuaccuccgcaagaacuucgagcaggagccccucgccaaggaggucucccucgagcagggcaucguccuccccugccgcccccccgagggcaucccccccgccgaggucgaguggcuccgcaacgaggaccucgucgaccccucccucgaccccaacgucuacaucacccgcgagcacucccucgucguccgccaggcccgccucgccgacaccgccaacuacaccugcgucgccaagaacaucgucgcccgccgccgcuccgccuccgccgccgucaucgucuacgucgacggcuccuggucccccugguccaagugguccgccugcggccucgacugcacccacuggcgcucccgcgagugcuccgaccccgccccccgcaacggcggcgaggagugccagggcaccgaccucgacacccgcaacugcaccuccgaccucugcguccacaccgccuccggccccgaggacgucgcccucuacgucggccucaucgccgucgccgucugccucguccuccuccuccucguccucauccucgucuacugccgcaagaaggagggccucgacuccgacgucgccgacuccuccauccucaccuccggcuuccagcccgucuccaucaagcccuccaaggccgacaacccccaccuccucaccauccagcccgaccucuccaccaccaccaccaccuaccagggcucccucugcccccgccaggacggccccucccccaaguuccagcucaccaacggccaccuccucuccccccucggcggcggccgccacacccuccaccacuccucccccaccuccgaggccgaggaguucgucucccgccucuccacccagaacuacuuccgcucccucccccgcggcaccuccaacaugaccuacggcaccuucaacuuccucggcggccgccucaugauccccaacaccggcaucucccuccucaucccccccgacgccaucccccgcggcaagaucuacgagaucuaccucacccuccacaagcccgaggacguccgccucccccucgccggcugccagacccuccucucccccaucgucuccugcggcccccccggcguccuccucacccgccccgucauccucgccauggaccacugcggcgagcccucccccgacuccuggucccuccgccucaagaagcaguccugcgagggcuccugggaggacguccuccaccucggcgaggaggcccccucccaccucuacuacugccagcucgaggccuccgccugcuacgucuucaccgagcagcucggccgcuucgcccucgucggcgaggcccucuccgucgccgccgccaagcgccucaagcuccuccucuucgcccccgucgccugcaccucccucgaguacaacauccgcgucuacugccuccacgacacccacgacgcccucaaggaggucguccagcucgagaagcagcucggcggccagcucauccaggagccccgcguccuccacuucaaggacuccuaccacaaccuccgccucuccauccacgacguccccuccucccucuggaaguccaagcuccucgucuccuaccaggagauccccuucuaccacaucuggaacggcacccagcgcuaccuccacugcaccuucacccucgagcgcgucucccccuccaccuccgaccucgccugcaagcucugggucuggcaggucgagggcgacggccaguccuucuccaucaacuucaacaucaccaaggacacccgcuucgccgagcuccucgcccucgaguccgaggccggcguccccgcccucgucggccccuccgccuucaagauccccuuccucauccgccagaagaucaucuccucccucgacccccccugccgccgcggcgccgacuggcgcacccucgcccagaagcuccaccucgacucccaccucuccuucuucgccuccaagcccucccccaccgccaugauccucaaccucugggaggcccgccacuuccccaacggcaaccucucccagcucgccgccgccgucgccggccucggccagcccgacgccggccucuucaccgucuccgaggccgagugcuga

SEQ ID NO: 51513 - RNA, 2805 nt, Artificial Sequence
  derived and/or modified sequence opt2 from UNC5B__Homo_sapiens__NP_001231818
augggcgcccgcuccggcgcccgcggcgcccuccuccucgcccuccuccucugcugggacccccgccucucccaggccggcaccgacuccggcuccgagguccuccccgacuccuuccccuccgcccccgccgagccccuccccuacuuccuccaggagccccaggacgccuacaucgucaagaacaagcccgucgagcuccgcugccgcgccuuccccgccacccagaucuacuucaagugcaacggcgagugggucucccagaacgaccacgucacccaggagggccucgacgaggccaccggccuccgcguccgcgagguccagaucgaggucucccgccagcaggucgaggagcucuucggccucgaggacuacuggugccagugcgucgccugguccuccgccggcaccaccaagucccgccgcgccuacguccgcaucgccuaccuccgcaagaacuucgaccaggagccccucggcaaggaggucccccucgaccacgagguccuccuccagugccgcccccccgagggcguccccgucgccgaggucgaguggcucaagaacgaggacgucaucgaccccacccaggacaccaacuuccuccucaccaucgaccacaaccucaucauccgccaggcccgccucuccgacaccgccaacuacaccugcgucgccaagaacaucgucgccaagcgccgcuccaccaccgccaccgucaucgucuacgucaacggcggcugguccuccugggccgaguggucccccugcuccaaccgcugcggccgcggcuggcagaagcgcacccgcaccugcaccaaccccgccccccucaacggcggcgccuucugcgagggccaggccuuccagaagaccgccugcaccaccaucugccccgucgacggcgccuggaccgagugguccaagugguccgccugcuccaccgagugcgcccacuggcgcucccgcgagugcauggccccccccccccagaacggcggccgcgacugcuccggcacccuccucgacuccaagaacugcaccgacggccucugcaugcagaugcucgaggccuccggcgacgccgcccucuacgccggccucgucgucgccaucuucgucgucgucgccauccucauggccgucggcgucgucgucuaccgccgcaacugccgcgacuucgacaccgacaucaccgacuccuccgccgcccucaccggcggcuuccaccccgucaacuucaagaccgcccgccccuccaacccccagcuccuccaccccuccgucccccccgaccucaccgccuccgccggcaucuaccgcggccccgucuacgcccuccaggacuccaccgacaagauccccaugaccaacuccccccuccucgacccccuccccucccucaaggucaaggucuacuccuccuccaccaccggcuccggccccggccucgccgacggcgccgaccuccucggcguccucccccccggcaccuaccccuccgacuucgcccgcgacacccacuuccuccaccuccgcuccgccucccucggcucccagcagcuccucggccucccccgcgaccccggcuccuccgucuccggcaccuucggcugccucggcggccgccucuccauccccggcaccggcgucucccuccucguccccaacggcgccaucccccagggcaaguucuacgagauguaccuccucaucaacaaggccgaguccacccucccccucuccgagggcacccagaccguccucucccccuccgucaccugcggccccaccggccuccuccucugccgccccgucauccucaccaugccccacugcgccgaggucuccgcccgcgacuggaucuuccagcucaagacccaggcccaccagggccacugggaggaggucgucacccucgacgaggagacccucaacacccccugcuacugccagcucgagccccgcgccugccacauccuccucgaccagcucggcaccuacgucuucaccggcgaguccuacucccgcuccgccgucaagcgccuccagcucgccgucuucgcccccgcccucugcaccucccucgaguacucccuccgcgucuacugccucgaggacacccccgucgcccucaaggagguccucgagcucgagcgcacccucggcggcuaccucgucgaggagcccaagccccucauguucaaggacuccuaccacaaccuccgccucucccuccacgaccucccccacgcccacuggcgcuccaagcuccucgccaaguaccaggagauccccuucuaccacaucugguccggcucccagaaggcccuccacugcaccuucacccucgagcgccacucccucgccuccaccgagcucaccugcaagaucugcguccgccaggucgagggcgagggccagaucuuccagcuccacaccacccucgccgagacccccgccggcucccucgacacccucugcuccgcccccggcuccaccgucaccacccagcucggccccuacgccuucaagaucccccucuccauccgccagaagaucugcaacucccucgacgcccccaacucccgcggcaacgacuggcgcaugcucgcccagaagcucuccauggaccgcuaccucaacuacuucgccaccaaggccucccccaccggcgucauccucgaccucugggaggcccuccagcaggacgacggcgaccucaacucccucgccuccgcccucgaggagaugggcaaguccgagaugcucgucgccgucgccaccgacggcgacugcuga

SEQ ID NO: 51514 - RNA, 2796 nt, Artificial Sequence
  derived and/or modified sequence opt2 from UNC5C__Homo_sapiens__NP_003719
augcgcaagggccuccgcgccaccgccgcccgcugcggccucggccucggcuaccuccuccagaugcucguccuccccgcccucgcccuccucuccgccuccggcaccggcuccgccgcccaggacgacgacuucuuccacgagcuccccgagaccuuccccuccgacccccccgagccccucccccacuuccucaucgagcccgaggaggccuacaucgucaagaacaagcccgucaaccucuacugcaaggccucccccgccacccagaucuacuucaagugcaacuccgaguggguccaccagaaggaccacaucgucgacgagcgcgucgacgagaccuccggccucaucguccgcgaggucuccaucgagaucucccgccagcaggucgaggagcucuucggccccgaggacuacuggugccagugcgucgccugguccuccgccggcaccaccaagucccgcaaggccuacguccgcaucgccuaccuccgcaagaccuucgagcaggagccccucggcaaggaggucucccucgagcaggagguccuccuccagugccgcccccccgagggcauccccgucgccgaggucgaguggcucaagaacgaggacaucaucgaccccgucgaggaccgcaacuucuacaucaccaucgaccacaaccucaucaucaagcaggcccgccucuccgacaccgccaacuacaccugcgucgccaagaacaucgucgccaagcgcaaguccaccaccgccaccgucaucgucuacgucaacggcggcugguccaccuggaccgagugguccgucugcaacucccgcugcggccgcggcuaccagaagcgcacccgcaccugcaccaaccccgccccccucaacggcggcgccuucugcgagggccaguccguccagaagaucgccugcaccacccucugccccgucgacggccgcuggacccccugguccaagugguccaccugcggcaccgagugcacccacuggcgccgccgcgagugcaccgcccccgcccccaagaacggcggcaaggacugcgacggccucguccuccaguccaagaacugcaccgacggccucugcaugcagaccgcccccgacuccgacgacgucgcccucuacgucggcaucgucaucgccgucaucgucugccucgccaucuccgucgucgucgcccucuucgucuaccgcaagaaccaccgcgacuucgaguccgacaucaucgacuccuccgcccucaacggcggcuuccagcccgucaacaucaaggccgcccgccaggaccuccucgccgucccccccgaccucaccuccgccgccgccauguaccgcggccccgucuacgcccuccacgacgucuccgacaagauccccaugaccaacucccccauccucgacccccuccccaaccucaagaucaaggucuacaacaccuccggcgccgucaccccccaggacgaccucuccgaguucaccuccaagcucuccccccagaugacccagucccuccucgagaacgaggcccucucccucaagaaccagucccucgcccgccagaccgaccccuccugcaccgccuucggcuccuucaacucccucggcggccaccucaucguccccaacuccggcgucucccuccucauccccgccggcgccaucccccagggccgcgucuacgagauguacgucaccguccaccgcaaggagaccaugcgcccccccauggacgacucccagacccuccucacccccgucgucuccugcggcccccccggcgcccuccucacccgccccgucguccucaccaugcaccacugcgccgaccccaacaccgaggacuggaagauccuccucaagaaccaggccgcccagggccagugggaggacgucgucgucgucggcgaggagaacuucaccacccccugcuacauccagcucgacgccgaggccugccacauccucaccgagaaccucuccaccuacgcccucgucggccacuccaccaccaaggccgccgccaagcgccucaagcucgccaucuucggcccccucugcugcuccucccucgaguacuccauccgcgucuacugccucgacgacacccaggacgcccucaaggagauccuccaccucgagcgccagaugggcggccagcuccucgaggagcccaaggcccuccacuucaagggcuccacccacaaccuccgccucuccauccacgacaucgcccacucccucuggaaguccaagcuccucgccaaguaccaggagauccccuucuaccacgucugguccggcucccagcgcaaccuccacugcaccuucacccucgagcgcuucucccucaacaccgucgagcucgucugcaagcucugcguccgccaggucgagggcgagggccagaucuuccagcucaacugcaccgucuccgaggagcccaccggcaucgaccucccccuccucgaccccgccaacaccaucaccaccgucaccggccccuccgccuucuccaucccccuccccauccgccagaagcucugcuccucccucgacgccccccagacccgcggccacgacuggcgcaugcucgcccacaagcucaaccucgaccgcuaccucaacuacuucgccaccaaguccucccccaccggcgucauccucgaccucugggaggcccagaacuuccccgacggcaaccucuccaugcucgccgccguccucgaggagaugggccgccacgagaccgucgucucccucgccgccgagggccaguacuga

SEQ ID NO: 51515 - RNA, 2862 nt, Artificial Sequence
  derived and/or modified sequence opt2 from UNC5D__Homo_sapiens__NP_543148
augggccgcgccgccgccaccgccggcggcggcggcggcgcccgccgcuggcuccccuggcucggccucugcuucugggccgccggcaccgccgccgcccgcggcaccgacaacggcgaggcccuccccgaguccauccccuccgcccccggcacccucccccacuucaucgaggagcccgacgacgccuacaucaucaaguccaaccccaucgcccuccgcugcaaggcccgccccgccaugcagaucuucuucaagugcaacggcgaguggguccaccagaacgagcacgucuccgaggagacccucgacgaguccuccggccucaagguccgcgaggucuucaucaacgucacccgccagcaggucgaggacuuccacggccccgaggacuacuggugccagugcgucgccuggucccaccucggcaccuccaagucccgcaaggccuccguccgcaucgccuaccuccgcaagaacuucgagcaggacccccagggccgcgagguccccaucgagggcaugaucguccuccacugccgcccccccgagggcguccccgccgccgaggucgaguggcucaagaacgaggagcccaucgacuccgagcaggacgagaacaucgacacccgcgccgaccacaaccucaucauccgccaggcccgccucuccgacuccggcaacuacaccugcauggccgccaacaucgucgccaagcgccgcucccucuccgccaccgucgucgucuacgucaacggcggcugguccuccuggaccgagugguccgccugcaacguccgcugcggccgcggcuggcagaagcgcucccgcaccugcaccaaccccgccccccucaacggcggcgccuucugcgagggcauguccguccagaagaucaccugcaccucccucugccccgucgacggcuccugggaggucugguccgagugguccgucugcucccccgagugcgagcaccuccgcauccgcgagugcaccgccccccccccccgcaacggcggcaaguucugcgagggccucucccaggaguccgagaacugcaccgacggccucugcauccucgacaagaagccccuccacgagaucaagccccaguccaucgagaacgccuccgacaucgcccucuacuccggccucggcgccgccgucgucgccgucgccguccucgucaucggcgucacccucuaccgccgcucccaguccgacuacggcgucgacgucaucgacuccuccgcccucaccggcggcuuccagaccuucaacuucaagaccguccgccagggcaacucccuccuccucaacuccgccaugcagcccgaccucaccgucucccgcaccuacuccggccccaucugccuccaggacccccucgacaaggagcucaugaccgaguccucccucuucaacccccucuccgacaucaaggucaagguccaguccuccuucauggucucccucggcgucuccgagcgcgccgaguaccacggcaagaaccacucccgcaccuucccccacggcaacaaccacuccuucuccaccaugcacccccgcaacaagaugcccuacauccagaaccucuccucccuccccacccgcaccgagcuccgcaccaccggcgucuucggccaccucggcggccgccucgucaugcccaacaccggcgucucccuccucaucccccacggcgccauccccgaggagaacuccugggagaucuacauguccaucaaccagggcgagcccucccuccaguccgacggcuccgagguccuccucucccccgaggucaccugcggcccccccgacaugaucgucaccacccccuucgcccucaccaucccccacugcgccgacgucuccuccgagcacuggaacauccaccucaagaagcgcacccagcagggcaagugggaggaggucauguccgucgaggacgaguccaccuccugcuacugccuccucgaccccuucgccugccacguccuccucgacuccuucggcaccuacgcccucaccggcgagcccaucaccgacugcgccgucaagcagcucaaggucgccgucuucggcugcauguccugcaacucccucgacuacaaccuccgcgucuacugcgucgacaacacccccugcgccuuccaggaggucgucuccgacgagcgccaccagggcggccagcuccucgaggagcccaagcuccuccacuucaagggcaacaccuucucccuccagaucuccguccucgacaucccccccuuccucuggcgcaucaagcccuucaccgccugccaggagguccccuucucccgcgucuggugcuccaaccgccagccccuccacugcgccuucucccucgagcgcuacacccccaccaccacccagcucuccugcaagaucugcauccgccagcucaagggccacgagcagauccuccagguccagaccuccauccucgaguccgagcgcgagaccaucaccuucuucgcccaggaggacuccaccuuccccgcccagaccggccccaaggccuucaagauccccuacuccauccgccagcgcaucugcgccaccuucgacacccccaacgccaagggcaaggacuggcagaugcucgcccagaagaacuccaucaaccgcaaccucuccuacuucgccacccaguccucccccuccgccgucauccucaaccucugggaggcccgccaccagcacgacggcgaccucgacucccucgccugcgcccucgaggagaucggccgcacccacaccaagcucuccaacaucuccgagucccagcucgacgaggccgacuucaacuacucccgccagaacggccucuga

SEQ ID NO: 51516 - RNA, 7377 nt, Artificial Sequence
  derived and/or modified sequence opt2 from UNC79__Homo_sapiens__NP_065869
augaucuccacccucgccaccuucccccccuuccuccacaaggacaucaucgaguaccucuccaccuccuuccuccccauggccauccucggcuccucccgccgcgagggcguccccgcccacgucaaccucuccgccuccuccaugcucaugaucgccaugcaguacaccuccaaccccgucuaccacugccagcuccucgagugccucaugaaguacaagcaggaggucuggaaggaccuccucuacgucaucgccuacggccccucccaggucaagccccccgccguccagaugcucuuccacuacuggcccaaccucaagccccccggcgccaucuccgaguaccgcggccuccaguacaccgccuggaaccccauccacugccagcacaucgagugccacaacgccaucaacaagcccgccgucaagaugugcaucgaccccucccucuccgucgcccucggcgacaagccccccccccucuaccucugcgaggagugcuccgagcgcaucgccggcgaccacuccgaguggcucaucgacguccuccucccccaggccgagaucuccgccaucugccagaagaagaacugcuccucccacguccgccgcgccgucgucaccugcuucuccgccggcugcugcggccgccacggcaaccgccccguccgcuacugcaagcgcugccacuccaaccaccacuccaacgaggucggcgccgccgccgagacccaccucuaccagaccucccccccccccaucaacacccgcgagugcggcgccgaggagcucgucugcgccgucgaggccgucaucucccuccucaaggaggccgaguuccacgccgagcagcgcgagcacgagcucaaccgccgccgccagcucggccucuccuccucccaccacucccucgacaacgccgacuucgacaacaaggacgacgacaagcacgaccagcgccuccucucccaguucggcaucugguuccucgucucccucugcacccccuccgagaacacccccaccgagucccucgcccgccucgucgccauggucuuccagugguuccacuccaccgccuacaugauggacgacgaggucggcucccucgucgagaagcucaagccccaguucgucaccaaguggcucaagaccgucugcgacguccgcuucgacgucauggucaugugccuccuccccaagcccauggaguucgcccgcgucggcggcuacugggacaaguccugcuccaccgucacccagcucaaggagggccucaaccgcauccucugccucauccccuacaacgucaucaaccaguccgucugggagugcaucaugcccgaguggcucgaggccauccgcaccgagguccccgacaaccagcucaaggaguuccgcgagguccucuccaagauguucgacaucgagcucugcccccuccccuucuccauggaggagauguucggcuucaucuccugccgcuucaccggcuaccccuccuccguccaggagcaggcccuccucuggcuccacguccucuccgagcucgacaucauggucccccuccagcuccucaucuccauguucuccgacggcgucaacuccgucaaggagcucgccaaccagcgcaagucccgcgucuccgagcucgccggcaaccucgccucccgccgcgucuccgucgccuccgaccccggccgccgcguccagcacaacaugcucucccccuuccacucccccuuccagucccccuuccgcuccccccuccgcucccccuuccgcucccccuucaagaacuucggccaccccggcggccgcaccaucgacuucgacugcgaggacgacgagaugaaccucaacugcuucauccucauguucgaccuccuccucaagcagauggagcuccaggacgacggcaucaccaugggccucgagcacucccucuccaaggacaucaucuccaucaucaacaacgucuuccaggcccccuggggcggcucccacaccugccagaaggacgagaaggccaucgagugcaaccucugccaguccuccauccucugcuaccagcucgccugcgagcuccucgagcgccucgcccccaaggaggagucccgccucgucgagcccaccgacucccucgaggacucccuccucuccucccgccccgaguucaucaucggccccgagggcgaggaggaggagaaccccgccuccaagcacggcgagaaccccggcaacugcaccgagcccgucgagcacgccgccgucaagaacgacaccgagcgcaaguucugcuaccagcagcuccccgucacccuccgccucaucuacaccaucuuccaggagauggccaaguucgaggagcccgacauccucuucaacaugcucaacugccucaagauccucugccuccacggcgagugccucuacaucgcccgcaaggaccacccccaguuccucgccuacauccaggaccacaugcucaucgccucccucuggcgcgucgucaaguccgaguucucccagcucuccucccucgccgucccccuccuccuccacgcccucucccucccccacggcgccgacaucuucuggaccaucaucaacggcaacuucaacuccaaggacuggaagaugcgcuucgaggccgucgagaaggucgccgucaucugccgcuuccucgacauccacuccgucaccaagaaccaccuccucaaguacucccucgcccacgccuucugcugcuuccucaccgccgucgaggacgucaaccccgccgucgccacccgcgccggccuccuccucgacaccaucaagcgccccgcccuccagggccucugccucugccucgacuuccaguucgacaccgucgucaaggaccgccccaccauccucuccaagcuccuccuccuccacuuccucaagcaggacauccccgcccucuccugggaguucuucgucaaccgcuucgagacccucucccucgaggcccagcuccaccucgacugcaacaaggaguuccccuuccccaccaccaucaccgccguccgcaccaacgucgccaaccucuccgacgccgcccucuggaagaucaagcgcgcccgcuucgcccgcaaccgccagaaguccguccgcucccuccgcgacuccgucaagggccccgucgaguccaagcgcgcccucucccuccccgagacccucaccuccaagauccgccagcagucccccgagaacgacaacaccaucaaggaccuccuccccgaggacgccggcaucgaccaccagaccguccaccagcucaucaccguccucaugaaguucauggccaaggacgaguccuccgccgaguccgacaucuccuccgccaaggccuucaacaccgucaagcgccaccucuacguccuccucggcuacgaccagcaggagggcugcuucaugaucgccccccagaagaugcgccucuccaccugcuucaacgccuucaucgccggcaucgcccaggucauggacuacaacaucaaccucggcaagcaccuccucccccucgucguccagguccucaaguacugcuccugcccccagcuccgccacuacuuccagcagcccccccgcugcucccucuggucccucaagccccacauccgccagauguggcucaaggcccuccucgucauccucuacaaguaccccuaccgcgacugcgacaucuccaagauccuccuccaccucauccacaucaccgucaacacccucaacgcccaguaccacuccugcaagccccacgccaccgccggcccccucuacuccgacaacuccaacaucucccgcuacuccgagaaggagaagggcgagaucgagcucgccgaguaccgcgagaccggcgcccuccaggacucccuccuccacugcguccgcgaggaguccauccccaagaagaagcuccgcuccuucaagcagaagucccucgacaucggcaacgccgacucccuccucuucacccucgacgagcaccgccgcaaguccugcaucgaccgcugcgacaucgagaagccccccacccaggccgccuacaucgcccagcgccccaacgaccccggccgcucccgccagaacuccgccacccgccccgacaacuccgagauccccgagaaccccgccauggagggcuuccccgacgcccgccgccccgucauccccgagguccgccucaacugcauggagaccuucgaggucaaggucgacucccccgucaagcccgcccccaaggaggaccucgaccucaucgaccucuccuccgacuccaccuccggccccgagaagcacuccauccucuccaccuccgacuccgacucccucgucuucgagccccuccccccccuccgcaucgucgaguccgacgaggaggaggagaccaugaaccagggcgacgacggccccuccggcaagaacgccgccuccucccccuccguccccucccaccccuccguccucucccucuccaccgccccccucguccaggucuccgucgaggacugcuccaaggacuucuccuccaaggacuccggcaacaaccaguccgccggcaacaccgacuccgcccucaucacccucgaggaccccauggacgccgagggcuccuccaagcccgaggagcuccccgaguucuccugcggcuccccccucacccucaagcagaagcgcgaccuccuccagaaguccuucgcccuccccgagaugucccucgacgaccaccccgaccccggcaccgagggcgagaagcccggcgagcucaugcccuccuccggcgccaagaccguccuccucaagguccccgaggacgccgagaaccccaccgaguccgagaagcccgacaccuccgccgaguccgacaccgagcagaaccccgagcgcaaggucgaggaggacggcgccgaggaguccgaguucaagauccagaucgucccccgccagcgcaagcagcgcaagaucgccgucuccgccauccagcgcgaguaccucgacaucuccuucaacauccucgacaagcucggcgagcagaaggaccccgaccccuccaccaagggccucuccacccucgagaugccccgcgaguccuccuccgcccccacccucgacgccggcguccccgagaccuccucccacuccuccaucuccacccaguaccgccagaugaagcgcggcucccucggcguccucaccaugucccagcucaugaagcgccagcucgagcaccaguccuccgccccccacaacaucuccaacugggacaccgagcagauccagcccggcaagcgccagugcaacguccccaccugccucaaccccgaccucgagggccagccccuccgcaugcgcggcgccaccaaguccucccuccucuccgcccccuccaucgucuccauguucguccccgcccccgaggaguucaccgacgagcagcccaccgucaugaccgacaagugccacgacugcggcgccauccucgaggaguacgacgaggagacccucggccucgccaucgucguccucuccaccuucauccaccucucccccgaccucgccgccccccuccuccucgacaucaugcaguccgucggccgccucgccuccuccaccaccuucuccaaccaggccgaguccaugaugguccccggcaacgccgccggcgucgccaagcaguuccuccgcugcaucuuccaccagcucgcccccaacggcaucuucccccagcucuuccaguccaccaucaaggacggcaccuuccuccgcacccucgccuccucccucauggacuucaacgagcucuccuccaucgccgcccucucccagcuccucgagggccucaacaacaagaagaaccuccccgccggcggcgccaugauccgcugccucgagaacaucgccaccuucauggaggcccuccccauggacucccccuccucccucuggaccaccaucuccaaccaguuccagaccuucuucgccaagcuccccugcguccucccccucaagugcucccucgacuccucccuccgcaucaugaucugccuccucaagauccccuccaccaacgccacccgcucccuccucgagcccuucuccaagcuccucuccuucgucauccagaacgccgucuucacccucgccuaccucgucgagcucugcggccucugcuaccgcgccuucaccaaggagcgcgacaaguucuaccucucccgcuccgucguccucgagcuccuccaggcccucaagcucaaguccccccuccccgacaccaaccuccuccuccucguccaguucaucugcgccgacgccggcaccaagcucgccgaguccaccauccucuccaagcagaugaucgccuccguccccggcugcggcaccgccgccauggagugcguccgccaguacaucaacgagguccucgacuucauggccgacaugcacacccucaccaagcucaagucccacaugaagaccugcucccagccccuccacgaggacaccuucggcggccaccucaaggucggccucgcccagaucgccgccauggacaucucccgcggcaaccaccgcgacaacaaggccgucauccgcuaccuccccuggcucuaccacccccccuccgccaugcagcagggccccaaggaguucaucgagugcgucucccacauccgccuccucuccuggcuccuccucggcucccucacccacaacgccgucugccccaacgccuccucccccugccuccccaucccccucgacgccggcucccacgucgccgaccaccucaucgucauccucaucggcuuccccgagcaguccaagaccuccguccuccacaugugcucccucuuccacgccuucaucuucgcccagcucuggaccgucuacugcgagcaguccgccgucgccaccaaccuccagaaccagaacgaguucuccuucaccgccauccucaccgcccucgaguucuggucccgcgucacccccuccauccuccagcucauggcccacaacaaggucauggucgagauggucugccuccacgucaucucccucauggaggcccuccaggagugcaacuccaccaucuucgucaagcucauccccauguggcuccccaugauccaguccaacaucaagcaccucuccgccggccuccagcuccgccuccaggccauccagaaccacgucaaccaccacucccuccgcacccuccccggcuccggccaguccuccgccggccucgccgcccuccgcaaguggcuccagugcacccaguucaagauggcccaggucgagauccaguccuccgaggccgccucccaguucuacccccucuga

SEQ ID NO: 51517 - RNA, 1248 nt, Artificial Sequence
  derived and/or modified sequence opt2 from UNC93A__Homo_sapiens__NP_001137419
auggaccgcucccuccgcaacguccucgucgucuccuucggcuuccuccuccucuucaccgccuacggcggccuccagucccuccaguccucccucuacuccgaggagggccucggcgucaccgcccucuccacccucuacggcggcaugcuccucuccuccauguuccuccccccccuccucaucgagcgccucggcugcaagggcaccaucauccucuccaugugcggcuacgucgccuucuccgucggcaacuucuucgccuccugguacacccucauccccaccuccauccuccucggccucggcgccgccccccucugguccgcccagugcaccuaccucaccaucaccggcaacacccacgccgagaaggccggcaagcgcggcaaggacauggucaaccaguacuucggcaucuucuuccucaucuuccaguccuccggcgucuggggcaaccucaucuccucccucgucuucggccagacccccucccagggcuccggcguccucgccguccucaugaucgccgccuuccuccagcccauccgcgacguccagcgcgaguccgagggcgagaagaaguccguccccuucugguccacccuccucuccaccuucaagcucuaccgcgacaagcgccucugccuccucauccuccucccccucuacuccggccuccagcagggcuuccucuccuccgaguacacccgcuccuacgucaccugcacccucggcauccaguucgucggcuacgucaugaucugcuucuccgccaccgacgcccucugcuccguccucuacggcaaggucucccaguacaccggccgcgccguccucuacguccucggcgccgucacccacgucuccugcaugaucgcccuccuccucuggcgcccccgcgccgaccaccucgccgucuucuucgucuucuccggccucuggggcgucgccgacgccgucuggcagacccagaacaacgcccucuacggcguccucuucgagaaguccaaggaggccgccuucgccaacuaccgccucugggaggcccucggcuucgucaucgccuucggcuacuccauguuccucugcguccacgucaagcucuacauccuccucggcguccucucccucaccauggucgccuacggccucgucgagugcgucgaguccaagaaccccauccgcccccacgcccccggccaggucaaccaggccgaggacgaggagauccagaccaagauguga

SEQ ID NO: 51518 - RNA, 1794 nt, Artificial Sequence
  derived and/or modified sequence opt2 from UNC93B1__Homo_sapiens__NP_112192
auggaggccgagcccccccucuaccccauggccggcgccgccggcccccagggcgacgaggaccuccucggcguccccgacggccccgaggccccccucgacgagcucgucggcgccuaccccaacuacaacgaggaggaggaggagcgccgcuacuaccgccgcaagcgccucggcguccucaagaacguccucgccgccuccgccggcggcaugcucaccuacggcgucuaccucggccuccuccagaugcagcucauccuccacuacgacgagaccuaccgcgaggucaaguacggcaacaugggccuccccgacaucgacuccaagaugcucaugggcaucaacgucacccccaucgccgcccuccucuacacccccguccucauccgcuucuucggcaccaaguggaugauguuccucgccgucggcaucuacgcccucuucgucuccaccaacuacugggagcgcuacuacacccucguccccuccgccgucgcccucggcauggccaucgucccccucugggccuccaugggcaacuacaucacccgcauggcccagaaguaccacgaguacucccacuacaaggagcaggacggccagggcaugaagcagcgccccccccgcggcucccacgcccccuaccuccucgucuuccaggccaucuucuacuccuucuuccaccucuccuucgccugcgcccagcuccccaugaucuacuuccucaaccacuaccucuacgaccucaaccacacccucuacaacguccaguccugcggcaccaacucccacggcauccucuccggcuucaacaagaccguccuccgcacccucccccgcuccggcaaccucaucgucgucgaguccguccucauggccgucgccuuccucgccaugcuccucguccucggccucugcggcgccgccuaccgccccaccgaggagaucgaccuccgcuccgucggcuggggcaacaucuuccagcuccccuucaagcacguccgcgacuaccgccuccgccaccucguccccuucuucaucuacuccggcuucgagguccucuucgccugcaccggcaucgcccucggcuacggcgucugcuccgucggccucgagcgccucgccuaccuccucgucgccuacucccucggcgccuccgccgccucccuccucggccuccucggccucuggcucccccgccccgucccccucgucgccggcgccggcguccaccuccuccucaccuucauccucuucuucugggcccccgucccccgcguccuccagcacuccuggauccucuacgucgccgccgcccucuggggcgucggcuccgcccucaacaagaccggccucuccacccuccucggcauccucuacgaggacaaggagcgccaggacuucaucuucaccaucuaccacugguggcaggccgucgccaucuucaccgucuaccucggcuccucccuccacaugaaggccaagcucgccguccuccucgucacccucgucgccgccgccgucuccuaccuccgcauggagcagaagcuccgccgcggcgucgccccccgccagccccgcaucccccgcccccagcacaagguccgcggcuaccgcuaccucgaggaggacaacuccgacgaguccgacgccgagggcgagcacggcgacggcgccgaggaggaggccccccccgccggcccccgccccggccccgagcccgccggccucggccgccgccccugccccuacgagcaggcccagggcggcgacggccccgaggagcaguga

SEQ ID NO: 51519 - RNA, 915 nt, Artificial Sequence
  derived and/or modified sequence opt2 from UNG__Homo_sapiens__NP_003353
augggcgucuucugccucggccccuggggccucggccgcaagcuccgcacccccggcaagggcccccuccagcuccucucccgccucugcggcgaccaccuccaggccauccccgccaagaaggcccccgccggccaggaggagcccggcaccccccccuccuccccccucuccgccgagcagcucgaccgcauccagcgcaacaaggccgccgcccuccuccgccucgccgcccgcaacguccccgucggcuucggcgaguccuggaagaagcaccucuccggcgaguucggcaagcccuacuucaucaagcucaugggcuucgucgccgaggagcgcaagcacuacaccgucuacccccccccccaccaggucuucaccuggacccagaugugcgacaucaaggacgucaaggucgucauccucggccaggaccccuaccacggccccaaccaggcccacggccucugcuucuccguccagcgccccgucccccccccccccucccucgagaacaucuacaaggagcucuccaccgacaucgaggacuucguccaccccggccacggcgaccucuccggcugggccaagcagggcguccuccuccucaacgccguccucaccguccgcgcccaccaggccaacucccacaaggagcgcggcugggagcaguucaccgacgccgucgucuccuggcucaaccagaacuccaacggccucgucuuccuccucuggggcuccuacgcccagaagaagggcuccgccaucgaccgcaagcgccaccacguccuccagaccgcccaccccuccccccucuccgucuaccgcggcuucuucggcugccgccacuucuccaagaccaacgagcuccuccagaaguccggcaagaagcccaucgacuggaaggagcucuga

SEQ ID NO: 51520 - RNA, 1155 nt, Artificial Sequence
  derived and/or modified sequence opt2 from UPB1__Homo_sapiens__NP_057411
auggccggcgccgaguggaagucccucgaggagugccucgagaagcaccucccccuccccgaccuccaggaggucaagcgcguccucuacggcaaggagcuccgcaagcucgaccucccccgcgaggccuucgaggccgccucccgcgaggacuucgagcuccagggcuacgccuucgaggccgccgaggagcagcuccgccgcccccgcaucguccacgucggccucguccagaaccgcaucccccuccccgccaacgcccccgucgccgagcaggucuccgcccuccaccgccgcaucaaggccaucgucgaggucgccgccaugugcggcgucaacaucaucugcuuccaggaggccuggaccaugcccuucgccuucugcacccgcgagaagcuccccuggaccgaguucgccgaguccgccgaggacggccccaccacccgcuucugccagaagcucgccaagaaccacgacauggucgucgucucccccauccucgagcgcgacuccgagcacggcgacguccucuggaacaccgccgucgucaucuccaacuccggcgccguccucggcaagacccgcaagaaccacaucccccgcgucggcgacuucaacgaguccaccuacuacauggagggcaaccucggccaccccgucuuccagacccaguucggccgcaucgccgucaacaucugcuacggccgccaccacccccucaacuggcucauguacuccaucaacggcgccgagaucaucuucaaccccuccgccaccaucggcgcccucuccgagucccucuggcccaucgaggcccgcaacgccgccaucgccaaccacugcuucaccugcgccaucaaccgcgucggcaccgagcacuuccccaacgaguucaccuccggcgacggcaagaaggcccaccaggacuucggcuacuucuacggcuccuccuacgucgccgcccccgacuccucccgcacccccggccucucccgcucccgcgacggccuccucgucgccaagcucgaccucaaccucugccagcaggucaacgacgucuggaacuucaagaugaccggccgcuacgagauguacgcccgcgagcucgccgaggccgucaaguccaacuacucccccaccaucgucaaggaguga

SEQ ID NO: 51521 - RNA, 3357 nt, Artificial Sequence
  derived and/or modified sequence opt2 from UPF1__Homo_sapiens__NP_002902
auguccgucgaggccuacggccccuccucccagacccucaccuuccucgacaccgaggaggccgagcuccucggcgccgacacccagggcuccgaguucgaguucaccgacuucacccuccccucccagacccagaccccccccggcggccccggcggccccggcggcggcggcgccggcggccccggcggcgccggcgccggcgccgccgccggccagcucgacgcccaggucggccccgagggcauccuccagaacggcgccgucgacgacuccgucgccaagaccucccagcuccucgccgagcucaacuucgaggaggacgaggaggacaccuacuacaccaaggaccuccccauccacgccugcuccuacugcggcauccacgaccccgccugcgucgucuacugcaacaccuccaagaagugguucugcaacggccgcggcaacaccuccggcucccacaucgucaaccaccucguccgcgccaagugcaaggaggucacccuccacaaggacggcccccucggcgagaccguccucgagugcuacaacugcggcugccgcaacgucuuccuccucggcuucauccccgccaaggccgacuccgucgucguccuccucugccgccagcccugcgccucccaguccucccucaaggacaucaacugggacuccucccaguggcagccccucauccaggaccgcugcuuccucuccuggcucgucaagauccccuccgagcaggagcagcuccgcgcccgccagaucaccgcccagcagaucaacaagcucgaggagcucuggaaggagaaccccuccgccacccucgaggaccucgagaagcccggcgucgacgaggagccccagcacguccuccuccgcuacgaggacgccuaccaguaccagaacaucuucggcccccucgucaagcucgaggccgacuacgacaagaagcucaaggagucccagacccaggacaacaucaccguccgcugggaccucggccucaacaagaagcgcaucgccuacuucacccuccccaagaccgacuccgacaugcgccucaugcagggcgacgagaucugccuccgcuacaagggcgaccucgccccccucuggaagggcaucggccacgucaucaagguccccgacaacuacggcgacgagaucgccaucgagcuccgcuccuccgucggcgcccccgucgaggucacccacaacuuccaggucgacuucgucuggaaguccaccuccuucgaccgcaugcaguccgcccucaagaccuucgccgucgacgagaccuccgucuccggcuacaucuaccacaagcuccucggccacgaggucgaggacgucaucaucaagugccagcuccccaagcgcuucaccgcccagggccuccccgaccucaaccacucccaggucuacgccgucaagaccguccuccagcgcccccucucccucauccagggcccccccggcaccggcaagaccgucaccuccgccaccaucgucuaccaccucgcccgccagggcaacggccccguccucgucugcgcccccuccaacaucgccgucgaccagcucaccgagaagauccaccagaccggccucaaggucguccgccucugcgccaagucccgcgaggccaucgacucccccgucuccuuccucgcccuccacaaccagauccgcaacauggacuccaugcccgagcuccagaagcuccagcagcucaaggacgagaccggcgagcucuccuccgccgacgagaagcgcuaccgcgcccucaagcgcaccgccgagcgcgagcuccucaugaacgccgacgucaucugcugcaccugcgucggcgccggcgacccccgccucgccaagaugcaguuccgcuccauccucaucgacgaguccacccaggccaccgagcccgagugcaugguccccgucguccucggcgccaagcagcucauccucgucggcgaccacugccagcucggccccgucgucaugugcaagaaggccgccaaggccggccucucccagucccucuucgagcgccucgucguccucggcauccgccccauccgccuccagguccaguaccgcaugcaccccgcccucuccgccuuccccuccaacaucuucuacgagggcucccuccagaacggcgucaccgccgccgaccgcgucaagaagggcuucgacuuccaguggccccagcccgacaagcccauguucuucuacgucacccagggccaggaggagaucgccuccuccggcaccuccuaccucaaccgcaccgaggccgccaacgucgagaagaucaccaccaagcuccucaaggccggcgccaagcccgaccagaucggcaucaucacccccuacgagggccagcgcuccuaccucguccaguacaugcaguucuccggcucccuccacaccaagcucuaccaggaggucgagaucgccuccgucgacgccuuccagggccgcgagaaggacuucaucauccucuccugcguccgcgccaacgagcaccagggcaucggcuuccucaacgacccccgccgccucaacgucgcccucacccgcgcccgcuacggcgucaucaucgucggcaaccccaaggcccucuccaagcagccccucuggaaccaccuccucaacuacuacaaggagcagaagguccucgucgagggcccccucaacaaccuccgcgagucccucaugcaguucuccaagccccgcaagcucgucaacaccaucaaccccggcgcccgcuucaugaccaccgccauguacgacgcccgcgaggccaucauccccggcuccgucuacgaccgcuccucccagggccgccccuccuccauguacuuccagacccacgaccagaucggcaugaucuccgccggccccucccacgucgccgccaugaacauccccauccccuucaaccucgucaugccccccaugcccccccccggcuacuucggccaggccaacggccccgccgccggccgcggcacccccaagggcaagaccggccgcggcggccgccagaagaaccgcuucggccuccccggccccucccagaccaaccuccccaacucccaggccucccaggacgucgccucccagcccuucucccagggcgcccucacccagggcuacaucuccaugucccagcccucccagaugucccagcccggccucucccagcccgagcucucccaggacuccuaccucggcgacgaguucaagucccagaucgacgucgcccucucccaggacuccaccuaccagggcgagcgcgccuaccagcacggcggcgucaccggccucucccaguacuga

SEQ ID NO: 51522 - RNA, 3819 nt, Artificial Sequence
  derived and/or modified sequence opt2 from UPF2__Homo_sapiens__NP_542166
augcccgccgagcgcaagaagcccgccuccauggaggagaaggacucccuccccaacaacaaggagaaggacugcuccgagcgccgcaccgucuccuccaaggagcgccccaaggacgacaucaagcucaccgccaagaaggaggucuccaaggcccccgaggacaagaagaagcgccucgaggacgacaagcgcaagaaggaggacaaggagcgcaagaagaaggacgaggagaaggucaaggccgaggaggaguccaagaagaaggaggaggaggagaagaagaagcaccaggaggaggagcgcaagaagcaggaggagcaggccaagcgccagcaggaggaggaggccgccgcccagaugaaggagaaggaggaguccauccagcuccaccaggaggccugggagcgccaccaccuccgcaaggagcuccgcuccaagaaccagaacgcccccgacucccgccccgaggagaacuucuucucccgccucgacuccucccucaagaagaacaccgccuucgucaagaagcucaagaccaucaccgagcagcagcgcgacucccucucccacgacuucaacggccucaaccucuccaaguacaucgccgaggccgucgccuccaucgucgaggccaagcucaagaucuccgacgucaacugcgccguccaccucugcucccucuuccaccagcgcuacgccgacuucgcccccucccuccuccaggucuggaagaagcacuucgaggcccgcaaggaggagaagacccccaacaucaccaagcuccgcaccgaccuccgcuucaucgccgagcucaccaucgucggcaucuucaccgacaaggagggccucucccucaucuacgagcagcucaagaacaucaucaacgccgaccgcgagucccacacccacgucuccgucgucaucuccuucugccgccacugcggcgacgacaucgccggccucgucccccgcaaggucaaguccgccgccgagaaguucaaccucuccuucccccccuccgagaucaucucccccgagaagcagcagcccuuccagaaccuccucaaggaguacuucaccucccucaccaagcaccucaagcgcgaccaccgcgagcuccagaacaccgagcgccagaaccgccgcauccuccacuccaagggcgagcucuccgaggaccgccacaagcaguacgaggaguucgccauguccuaccagaagcuccucgccaacucccagucccucgccgaccuccucgacgagaacaugcccgaccucccccaggacaagcccacccccgaggagcacggccccggcaucgacaucuucacccccggcaagcccggcgaguacgaccucgagggcggcaucugggaggacgaggacgcccgcaacuucuacgagaaccucaucgaccucaaggccuucguccccgccauccucuucaaggacaacgagaaguccugccagaacaaggaguccaacaaggacgacaccaaggaggccaaggaguccaaggagaacaaggaggucuccucccccgacgaccucgagcucgagcucgagaaccucgagaucaacgacgacacccucgagcucgagggcggcgacgaggccgaggaccucaccaagaagcuccucgacgagcaggagcaggaggacgaggaggccuccaccggcucccaccucaagcucaucgucgacgccuuccuccagcagcuccccaacugcgucaaccgcgaccucaucgacaaggccgccauggacuucugcaugaacaugaacaccaaggccaaccgcaagaagcucguccgcgcccucuucaucgucccccgccagcgccucgaccuccuccccuucuacgcccgccucgucgccacccuccaccccugcauguccgacgucgccgaggaccucugcuccaugcuccgcggcgacuuccgcuuccacguccgcaagaaggaccagaucaacaucgagaccaagaacaagaccguccgcuucaucggcgagcucaccaaguucaagauguucaccaagaacgacacccuccacugccucaagaugcuccucuccgacuucucccaccaccacaucgagauggccugcacccuccucgagaccugcggccgcuuccucuuccgcucccccgagucccaccuccgcaccuccguccuccucgagcagaugaugcgcaagaagcaggccaugcaccucgacgcccgcuacgucaccauggucgagaacgccuacuacuacugcaaccccccccccgccgagaagaccgucaagaagaagcgccccccccuccaggaguacguccgcaagcuccucuacaaggaccucuccaaggucaccaccgagaagguccuccgccagaugcgcaagcuccccuggcaggaccaggaggucaaggacuacgucaucugcugcaugaucaacaucuggaacgucaaguacaacuccauccacugcgucgccaaccuccucgccggccucguccucuaccaggaggacgucggcauccacgucgucgacggcguccucgaggacauccgccucggcauggaggucaaccagcccaaguucaaccagcgccgcaucuccuccgccaaguuccucggcgagcucuacaacuaccgcauggucgaguccgccgucaucuuccgcacccucuacuccuucaccuccuucggcgucaaccccgacggcucccccuccucccucgacccccccgagcaccucuuccgcauccgccucgucugcaccauccucgacaccugcggccaguacuucgaccgcggcuccuccaagcgcaagcucgacugcuuccucgucuacuuccagcgcuacgucugguggaagaagucccucgaggucuggaccaaggaccaccccuuccccaucgacaucgacuacaugaucuccgacacccucgagcuccuccgccccaagaucaagcucugcaacucccucgaggaguccauccgccagguccaggaccucgagcgcgaguuccucaucaagcucggccucgucaacgacaaggacuccaaggacuccaugaccgagggcgagaaccucgaggaggacgaggaggaggaggagggcggcgccgagaccgaggagcaguccggcaacgaguccgaggucaacgagcccgaggaggaggagggcuccgacaacgacgacgacgagggcgaggaggaggaggaggagaacaccgacuaccucaccgacuccaacaaggagaacgagaccgacgaggagaacaccgaggucaugaucaagggcggcggccucaagcacguccccugcgucgaggacgaggacuucauccaggcccucgacaagaugaugcucgagaaccuccagcagcgcuccggcgaguccgucaagguccaccagcucgacgucgccaucccccuccaccucaagucccagcuccgcaagggccccccccucggcggcggcgagggcgaggccgaguccgccgacaccaugcccuucgucaugcucacccgcaagggcaacaagcagcaguucaagauccucaacguccccauguccucccagcucgccgccaaccacuggaaccagcagcaggccgagcaggaggagcgcaugcgcaugaagaagcucacccucgacaucaacgagcgccaggagcaggaggacuaccaggagaugcuccagucccucgcccagcgccccgcccccgccaacaccaaccgcgagcgccgcccccgcuaccagcaccccaagggcgcccccaacgccgaccucaucuucaagaccggcggccgccgccgcuga

SEQ ID NO: 51523 - RNA, 1431 nt, Artificial Sequence
  derived and/or modified sequence opt2 from UPF3A__Homo_sapiens__NP_075387
augcgcuccgagaaggagggcgccggcggccuccgcgccgccgucgccgcccgcggccccuccggccgcgagaagcucuccgcccucgagguccaguuccaccgcgacucccagcagcaggaggccgagaccccccccaccuccuccuccggcugcggcggcggcgccggcaagccccgcgaggagaagcgcaccgcccucuccaaggucgucauccgccgccucccccccggccucaccaaggagcagcucgaggagcagcuccgcccccuccccgcccacgacuacuucgaguucuucgccgccgaccucucccucuacccccaccucuacucccgcgccuacaucaacuuccgcaaccccgacgacauccuccucuuccgcgaccgcuucgacggcuacaucuuccucgacuccaagggccucgaguaccccgccgucgucgaguucgcccccuuccagaagaucgccaagaagaagcuccgcaagaaggacgccaagaccggcuccaucgaggacgaccccgaguacaagaaguuccucgagaccuacugcgucgaggaggagaagaccuccgccaaccccgagacccuccucggcgagauggaggccaagacccgcgagcucaucgcccgccgcaccaccccccuccucgaguacaucaagaaccgcaagcucgagaagcagcgcauccgcgaggagaagcgcgaggagcgccgccgccgcgagcucgagaagaagcgccuccgcgaggaggagaagcgccgccgccgcgaggaggagcgcugcaagaagaaggagaccgacaagcagaagaagaucgccgagaaggagguccgcaucaagcuccucaagaagcccgagaagggcgaggagcccaccaccgagaagcccaaggagcgcggcgaggagaucgacaccggcggcggcaagcaggaguccugcgcccccggcgccgucgucaaggcccgccccauggagggcucccucgaggagccccaggagaccucccacuccggcuccgacaaggagcaccgcgacgucgagcgcucccaggagcaggaguccgaggcccagcgcuaccacgucgacgacggccgccgccaccgcgcccaccacgagcccgagcgccucucccgccgcuccgaggacgagcagcgcuggggcaagggccccggccaggaccgcggcaagaagggcucccaggacuccggcgcccccggcgaggccauggagcgccucggccgcgcccagcgcugcgacgacucccccgccccccgcaaggagcgccucgccaacaaggaccgccccgcccuccagcucuacgaccccggcgcccgcuuccgcgcccgcgagugcggcggcaaccgccgcaucugcaaggccgagggcuccggcaccggccccgagaagcgcgaggaggccgaguga

SEQ ID NO: 51524 - RNA, 1413 nt, Artificial Sequence
  derived and/or modified sequence opt2 from UPF3B__Homo_sapiens__NP_075386
augaaggaggagaaggagcaccgccccaaggagaagcgcgucacccuccucacccccgccggcgccaccggcuccggcggcggcaccuccggcgacuccuccaagggcgaggacaagcaggaccgcaacaaggagaagaaggaggcccucuccaaggucgucauccgccgccucccccccacccucaccaaggagcagcuccaggagcaccuccagcccaugcccgagcacgacuacuucgaguucuucuccaacgacaccucccucuacccccacauguacgcccgcgccuacaucaacuucaagaaccaggaggacaucauccucuuccgcgaccgcuucgacggcuacgucuuccucgacaacaagggccaggaguaccccgccaucgucgaguucgcccccuuccagaaggccgccaagaagaagaccaagaagcgcgacaccaaggucggcaccaucgacgacgaccccgaguaccgcaaguuccucgaguccuacgccaccgacaacgagaagaugaccuccacccccgagacccuccucgaggagaucgaggccaagaaccgcgagcucaucgccaagaagaccaccccccuccucuccuuccucaagaacaagcagcgcaugcgcgaggagaagcgcgaggagcgccgccgccgcgagaucgagcgcaagcgccagcgcgaggaggagcgccgcaaguggaaggaggaggagaagcgcaagcgcaaggacaucgagaagcucaagaagaucgaccgcauccccgagcgcgacaagcucaaggacgagcccaagaucaagcuccucaagaagcccgagaagggcgacgagaaggagcucgacaagcgcgagaaggccaagaagcucgacaaggagaaccucuccgacgagcgcgccuccggccaguccugcacccuccccaagcgcuccgacuccgagcucaaggacgagaagcccaagcgccccgaggacgaguccggccgcgacuaccgcgagcgcgagcgcgaguacgagcgcgaccaggagcgcauccuccgcgagcgcgagcgccucaagcgccaggaggaggagcgccgccgccagaaggagcgcuacgagaaggagaagaccuucaagcgcaaggaggaggagaugaagaaggagaaggacacccuccgcgacaagggcaagaaggccgaguccaccgaguccaucggcuccuccgagaagaccgagaagaaggaggaggucgucaagcgcgaccgcauccgcaacaaggaccgccccgccaugcagcucuaccagcccggcgcccgcucccgcaaccgccucugcccccccgacgacuccaccaaguccggcgacuccgccgccgagcgcaagcaggaguccggcaucucccaccgcaaggagggcggcgaggaguga

SEQ ID NO: 51525 - RNA, 822 nt, Artificial Sequence
  derived and/or modified sequence opt2 from UPK1A__Homo_sapiens__NP_001268372
auggccuccgccgccgccgccgaggccgagaagggcucccccgucgucgucggccuccucgucgucggcaacaucaucauccuccucuccggccucucccucuucgccgagaccaucugggucaccgccgaccaguaccgcgucuacccccucaugggcgucuccggcaaggacgacgucuucgccggcgccuggaucgccaucuucugcggcuucuccuucuucauggucgccuccuucggcgucggcgccgcccucugccgccgccgcuccaugguccucaccuaccucguccucaugcucaucgucuacaucuucgagugcgccuccugcaucaccuccuacacccaccgcgacuacauggucuccaaccccucccucaucaccaagcagaugcucaccuucuacuccgccgacaccgaccagggccaggagcucacccgccucugggaccgcgucaugaucgagcaggagugcugcggcaccuccggccccauggacugggucaacuucaccuccgccuuccgcgccgccacccccgaggucgucuuccccuggcccccccucugcugccgccgcaccggcaacuucaucccccucaacgaggagggcugccgccucggccacauggacuaccucuucaccaaggccggcguccaguggcacaaccucuccucccuccagcgccucccccccggcuucaagggcuucucccaccucuccuuccaguccuccugggacuaccgcgccgccuccaacaccuccgccacccccuccaccgccacccgcggcgucucccgcggccucggccuccccuccuga

SEQ ID NO: 51526 - RNA, 783 nt, Artificial Sequence
  derived and/or modified sequence opt2 from UPK1B__Homo_sapiens__NP_008883
auggccaaggacaacuccaccguccgcugcuuccagggccuccucaucuucggcaacgucaucaucggcugcugcggcaucgcccucaccgccgagugcaucuucuucgucuccgaccagcacucccucuacccccuccucgaggccaccgacaacgacgacaucuacggcgccgccuggaucggcaucuucgucggcaucugccucuucugccucuccguccucggcaucgucggcaucaugaaguccucccgcaagauccuccucgccuacuucauccucauguucaucgucuacgccuucgaggucgccuccugcaucaccgccgccacccagcaggacuucuucacccccaaccucuuccucaagcagaugcucgagcgcuaccagaacaacuccccccccaacaacgacgaccaguggaagaacaacggcgucaccaagaccugggaccgccucaugcuccaggacaacugcugcggcgucaacggccccuccgacuggcagaaguacaccuccgccuuccgcaccgagaacaacgacgccgacuaccccuggccccgccagugcugcgucaugaacaaccucaaggagccccucaaccucgaggccugcaagcucggcguccccggcuucuaccacaaccagggcugcuacgagcucaucuccggccccaugaaccgccacgccuggggcgucgccugguucggcuucgccauccucugcuggaccuucuggguccuccucggcaccauguucuacuggucccgcaucgaguacuga

SEQ ID NO: 51527 - RNA, 555 nt, Artificial Sequence
  derived and/or modified sequence opt2 from UPK2__Homo_sapiens__NP_006751
auggccccccuccuccccauccgcacccucccccucauccucauccuccucgcccuccucucccccggcgccgccgacuucaacaucuccucccucuccggccuccucucccccgcccucaccgagucccuccucgucgcccucccccccugccaccucaccggcggcaacgccacccucaugguccgccgcgccaacgacuccaaggucgucaccuccuccuucgucgucccccccugccgcggccgccgcgagcucgucuccgucgucgacuccggcgccggcuucaccgucacccgccucuccgccuaccaggucaccaaccucguccccggcaccaaguucuacaucuccuaccucgucaagaagggcaccgccaccgaguccucccgcgagauccccauguccacccucccccgccgcaacauggaguccaucggccucggcauggcccgcaccggcggcauggucgucaucaccguccuccucuccgucgccauguuccuccucguccucggcuucaucaucgcccucgcccucggcucccgcaaguga

SEQ ID NO: 51528 - RNA, 501 nt, Artificial Sequence
  derived and/or modified sequence opt2 from UPK3A__Homo_sapiens__NP_001161046
augcccccccucugggcccuccucgcccucggcugccuccgcuucggcuccgccgucaaccuccagccccagcucgccuccgucaccuucgccaccaacaaccccacccucaccaccgucgcccucgagaagccccucugcauguucgacuccaaggaggcccucaccggcacccacgaggucuaccucuacguccucgucgacuccgucacccccuacuccaccaucgacaccuggcccggccgccgcuccggcggcaugaucgucaucaccuccauccucggcucccuccccuucuuccuccucgucggcuucgccggcgccaucgcccucucccucgucgacaugggcuccuccgacggcgagaccacccacgacucccagaucacccaggaggccguccccaagucccucggcgccuccgaguccuccuacaccuccgucaaccgcggccccccccucgaccgcgccgaggucuacuccuccaagcuccaggacuga

SEQ ID NO: 51529 - RNA, 933 nt, Artificial Sequence
  derived and/or modified sequence opt2 from UPP1__Homo_sapiens__NP_001274355
auggccgccaccggcgccaacgccgagaaggccgagucccacaacgacugccccguccgccuccucaaccccaacaucgccaagaugaaggaggacauccucuaccacuucaaccucaccaccucccgccacaacuuccccgcccucuucggcgacgucaaguucgucugcgucggcggcucccccucccgcaugaaggccuucauccgcugcgucggcgccgagcucggccucgacugccccggccgcgacuaccccaacaucugcgccggcaccgaccgcuacgccauguacaaggucggccccguccucuccgucucccacggcaugggcauccccuccaucuccaucaugcuccacgagcucaucaagcuccucuacuacgcccgcugcuccaacgucaccaucauccgcaucggcaccuccggcggcaucggccucgagcccggcaccgucgucaucaccgagcaggccgucgacaccugcuucaaggccgaguucgagcagaucguccucggcaagcgcgucauccgcaagaccgaccucaacaagaagcucguccaggagcuccuccucugcuccgccgagcucuccgaguucaccaccgucgucggcaacaccaugugcacccucgacuucuacgagggccagggccgccucgacggcgcccucugcuccuacaccgagaaggacaagcaggccuaccucgaggccgccuacgccgccggcguccgcaacaucgagauggaguccuccgucuucgccgccaugugcuccgccugcggccuccaggccgccgucgucugcgucacccuccucaaccgccucgagggcgaccagaucuccuccccccgcaacguccucuccgaguaccagcagcgcccccagcgccucgucuccuacuucaucaagaagaagcucuccaaggccuga

SEQ ID NO: 51530 - RNA, 1125 nt, Artificial Sequence
  derived and/or modified sequence opt2 from UPP2__Homo_sapiens__NP_001128570
augcucgcccccggcugcgagcucgaccccgaccaggaggucguccgcacccgccccgaggacguccccgccucccccuccaccuccaccaugaucgucuccguccuccgcccccccucccacgccuccugcaccgccugcggcaccgucaccuuccacaucgucgagcgcauggccuccgucauccccgccuccaaccgcuccaugcgcuccgaccgcaacaccuacgucggcaagcgcuucguccacgucaagaaccccuaccucgaccucauggacgaggacauccucuaccaccucgaccucggcaccaagacccacaaccuccccgccauguucggcgacgucaaguucgucugcgucggcggcucccccaaccgcaugaaggccuucgcccucuucaugcacaaggagcucggcuucgaggaggccgaggaggacaucaaggacaucugcgccggcaccgaccgcuacugcauguacaagaccggccccguccucgccaucucccacggcaugggcauccccuccaucuccaucaugcuccacgagcucaucaagcuccuccaccacgcccgcugcugcgacgucaccaucauccgcaucggcaccuccggcggcaucggcaucgcccccggcaccgucgucaucaccgacaucgccgucgacuccuucuucaagccccgcuucgagcaggucauccucgacaacaucgucacccgcuccaccgagcucgacaaggagcucuccgaggagcucuucaacugcuccaaggagauccccaacuuccccacccucgucggccacaccaugugcaccuacgacuucuacgagggccagggccgccucgacggcgcccucugcuccuucucccgcgagaagaagcucgacuaccucaagcgcgccuucaaggccggcguccgcaacaucgagauggaguccaccgucuucgccgccaugugcggccucugcggccucaaggccgccgucgucugcgucacccuccucgaccgccucgacugcgaccagaucaaccucccccacgacguccucgucgaguaccagcagcgcccccagcuccucaucuccaacuucauccgccgccgccucggccucugcgacuga

SEQ ID NO: 51531 - RNA, 930 nt, Artificial Sequence
  derived and/or modified sequence opt2 from UPRT__Homo_sapiens__NP_659489
auggccaccgagcuccagugccccgacuccaugcccugccacaaccagcaggucaacuccgccuccacccccucccccgagcagcuccgccccggcgaccucauccucgaccacgccggcggcaaccgcgccucccgcgccaaggucauccuccucaccggcuacgcccacuccucccuccccgccgagcucgacuccggcgccugcggcggcuccucccucaacuccgagggcaacuccggcuccggcgacuccuccuccuacgacgcccccgccggcaacuccuuccucgaggacugcgagcucucccgccagaucggcgcccagcucaagcuccuccccaugaacgaccagauccgcgagcuccagaccaucauccgcgacaagaccgccucccgcggcgacuucauguucuccgccgaccgccucauccgccucgucgucgaggagggccucaaccagcuccccuacaaggagugcauggucaccacccccaccggcuacaaguacgagggcgucaaguucgagaagggcaacugcggcgucuccaucaugcgcuccggcgaggccauggagcagggccuccgcgacugcugccgcuccauccgcaucggcaagauccucauccaguccgacgaggagacccagcgcgccaaggucuacuacgccaaguucccccccgacaucuaccgccgcaagguccuccucauguaccccauccucuccaccggcaacaccgucaucgaggccgucaagguccucaucgagcacggcguccagcccuccgucaucauccuccucucccucuucuccaccccccacggcgccaaguccaucauccaggaguuccccgagaucaccauccucaccaccgagguccaccccgucgcccccacccacuucggccagaaguacuucggcaccgacuga

SEQ ID NO: 51532 - RNA, 696 nt, Artificial Sequence
  derived and/or modified sequence opt2 from UQCC1__Homo_sapiens__NP_001171906
auggcccuccucguccgcguccuccgcaaccagaccuccaucucccaguggguccccgucugcucccgccucauccccgucucccccacccagggccagggcgaccgcgcccucucccgcaccucccagaagaucaagaucgccgcccuccgcauguacaccuccugcgucgagaagaccgacuucgaggaguucuuccuccgcugccagaugcccgacaccuucaacuccugguuccucaucacccuccuccacgucuggaugugccucguccgcaugaagcaggagggccgcuccggcaaguacaugugccgcaucaucguccacuucaugugggaggacguccagcagcgcggccgcgucaugggcgucaaccccuacauccucaagaagaacaugauccucaugaccaaccacuucuacgccgccauccucggcuacgacgagggcauccucuccgacgaccacggccucgccgccgcccucuggcgcaccuucuucaaccgcaagugcgaggacccccgccaccucgagcuccucgucgaguacguccgcaagcagauccaguaccucgacuccaugaacggcgaggaccuccuccucaccggcgaggucuccuggcgcccccucgucgagaagaacccccaguccauccucaagccccacucccccaccuacaacgacgagggccucuga

SEQ ID NO: 51533 - RNA, 381 nt, Artificial Sequence
  derived and/or modified sequence opt2 from UQCC2__Homo_sapiens__NP_115716
auggccgccucccgcuaccgccgcuuccucaagcucugcgaggaguggcccgucgacgagaccaagcgcggccgcgaccucggcgccuaccuccgccagcgcgucgcccaggccuuccgcgagggcgagaacacccaggucgccgagcccgaggccugcgaccagauguacgagucccucgcccgccuccacuccaacuacuacaagcacaaguacccccgcccccgcgacaccuccuucuccggccucucccucgaggaguacaagcucauccucuccaccgacacccucgaggagcucaaggagaucgacaagggcauguggaagaagcuccaggagaaguucgcccccaagggccccgaggaggaccacaaggccuga

SEQ ID NO: 51534 - RNA, 336 nt, Artificial Sequence
  derived and/or modified sequence opt2 from UQCRB__Homo_sapiens__NP_006285
auggccggcaagcaggccgucuccgccuccggcaaguggcucgacggcauccgcaagugguacuacaacgccgccggcuucaacaagcucggccucaugcgcgacgacaccaucuacgaggacgaggacgucaaggaggccauccgccgccuccccgagaaccucuacaacgaccgcauguuccgcaucaagcgcgcccucgaccucaaccucaagcaccagauccuccccaaggagcaguggaccaaguacgaggaggagaacuucuaccucgagcccuaccucaaggaggucauccgcgagcgcaaggagcgcgaggagugggccaagaaguga

SEQ ID NO: 51535 - RNA, 1443 nt, Artificial Sequence
  derived and/or modified sequence opt2 from UQCRC1__Homo_sapiens__NP_003356
auggccgccuccgucgucugccgcgccgccaccgccggcgcccagguccuccuccgcgcccgccgcucccccgcccuccuccgcacccccgcccuccgcuccaccgccaccuucgcccaggcccuccaguucguccccgagacccaggucucccuccucgacaacggccuccgcgucgccuccgagcaguccucccagcccaccugcaccgucggcgucuggaucgacgucggcucccgcuucgagaccgagaagaacaacggcgccggcuacuuccucgagcaccucgccuucaagggcaccaagaaccgccccggcuccgcccucgagaaggaggucgaguccaugggcgcccaccucaacgccuacuccacccgcgagcacaccgccuacuacaucaaggcccucuccaaggaccuccccaaggccgucgagcuccucggcgacaucguccagaacugcucccucgaggacucccagaucgagaaggagcgcgacgucauccuccgcgagaugcaggagaacgacgccuccaugcgcgacgucgucuucaacuaccuccacgccaccgccuuccagggcaccccccucgcccaggccgucgagggccccuccgagaacguccgcaagcucucccgcgccgaccucaccgaguaccucuccacccacuacaaggccccccgcaugguccucgccgccgccggcggcgucgagcaccagcagcuccucgaccucgcccagaagcaccucggcggcauccccuggaccuacgccgaggacgccguccccacccucacccccugccgcuucaccggcuccgagauccgccaccgcgacgacgcccuccccuucgcccacgucgccaucgccgucgagggccccggcugggccucccccgacaacgucgcccuccaggucgccaacgccaucaucggccacuacgacugcaccuacggcggcggcguccaccucuccuccccccucgccuccggcgccgucgccaacaagcucugccaguccuuccagaccuucuccaucugcuacgccgagaccggccuccucggcgcccacuucgucugcgaccgcaugaagaucgacgacaugauguucguccuccagggccaguggaugcgccucugcaccuccgccaccgaguccgaggucgcccgcggcaagaacauccuccgcaacgcccucgucucccaccucgacggcaccacccccgucugcgaggacaucggccgcucccuccucaccuacggccgccgcaucccccucgccgagugggagucccgcaucgccgaggucgacgccuccgucguccgcgagaucugcuccaaguacaucuacgaccagugccccgccgucgccggcuacggccccaucgagcagcuccccgacuacaaccgcauccgcuccggcauguucuggcuccgcuucuga

SEQ ID NO: 51536 - RNA, 1362 nt, Artificial Sequence
  derived and/or modified sequence opt2 from UQCRC2__Homo_sapiens__NP_003357
augaagcuccucacccgcgccggcuccuucucccgcuucuacucccucaaggucgcccccaaggucaaggccaccgccgcccccgccggcgcccccccccagccccaggaccucgaguucaccaagcuccccaacggccucgucaucgccucccucgagaacuacucccccgucucccgcaucggccucuucaucaaggccggcucccgcuacgaggacuucuccaaccucggcaccacccaccuccuccgccucaccuccucccucaccaccaagggcgccuccuccuucaagaucacccgcggcaucgaggccgucggcggcaagcucuccgucaccgccacccgcgagaacauggccuacaccgucgagugccuccgcggcgacgucgacauccucauggaguuccuccucaacgucaccaccgcccccgaguuccgccgcugggaggucgccgaccuccagccccagcucaagaucgacaaggccgucgccuuccagaacccccagacccacgucaucgagaaccuccacgccgccgccuaccgcaacgcccucgccaacccccucuacugccccgacuaccgcaucggcaaggucaccuccgaggagcuccacuacuucguccagaaccacuucaccuccgcccgcauggcccucaucggccucggcgucucccaccccguccucaagcaggucgccgagcaguuccucaacaugcgcggcggccucggccucuccggcgccaaggccaacuaccgcggcggcgagauccgcgagcagaacggcgacucccucguccacgccgccuucgucgccgaguccgccgucgccggcuccgccgaggccaacgccuucuccguccuccagcacguccucggcgccggcccccacgucaagcgcggcuccaacaccaccucccaccuccaccaggccgucgccaaggccacccagcagcccuucgacgucuccgccuucaacgccuccuacuccgacuccggccucuucggcaucuacaccaucucccaggccaccgccgccggcgacgucaucaaggccgccuacaaccaggucaagaccaucgcccagggcaaccucuccaacaccgacguccaggccgccaagaacaagcucaaggccggcuaccucauguccgucgaguccuccgagugcuuccucgaggaggucggcucccaggcccucgucgccggcuccuacaugccccccuccaccguccuccagcagaucgacuccgucgccaacgccgacaucaucaacgccgccaagaaguucgucuccggccagaaguccauggccgccuccggcaaccucggccacacccccuucgucgacgagcucuga

SEQ ID NO: 51537 - RNA, 825 nt, Artificial Sequence
  derived and/or modified sequence opt2 from UQCRFS1__Homo_sapiens__NP_005994
augcucuccgucgccucccgcuccggccccuucgcccccguccucuccgccaccucccgcggcgucgccggcgcccuccgcccccucguccaggccaccguccccgccacccccgagcagcccguccucgaccucaagcgccccuuccucucccgcgagucccucuccggccaggccguccgccgcccccucgucgccuccgucggccucaacguccccgccuccgucugcuacucccacaccgacaucaagguccccgacuucuccgaguaccgccgccucgagguccucgacuccaccaaguccucccgcgaguccuccgaggcccgcaagggcuucuccuaccucgucaccggcgucaccaccgucggcgucgccuacgccgccaagaacgccgucacccaguucgucuccuccauguccgccuccgccgacguccucgcccucgccaagaucgagaucaagcucuccgacauccccgagggcaagaacauggccuucaaguggcgcggcaagccccucuucguccgccaccgcacccagaaggagaucgagcaggaggccgccgucgagcucucccagcuccgcgacccccagcacgaccucgaccgcgucaagaagcccgagugggucauccucaucggcgucugcacccaccucggcugcguccccaucgccaacgccggcgacuucggcggcuacuacugccccugccacggcucccacuacgacgccuccggccgcauccgccucggccccgccccccucaaccucgagguccccaccuacgaguucaccuccgacgacauggucaucgucggcuga

SEQ ID NO: 51538 - RNA, 249 nt, Artificial Sequence
  derived and/or modified sequence opt2 from UQCRQ__Homo_sapiens__NP_055217
augggccgcgaguucggcaaccucacccgcaugcgccacgucaucuccuacucccucucccccuucgagcagcgcgccuacccccacgucuucaccaagggcauccccaacguccuccgccgcauccgcgaguccuucuuccgcgucgucccccaguucgucgucuucuaccucaucuacaccuggggcaccgaggaguucgagcgcuccaagcgcaagaaccccgccgccuacgagaacgacaaguga

SEQ ID NO: 51539 - RNA, 4464 nt, Artificial Sequence
  derived and/or modified sequence opt2 from URB2__Homo_sapiens__XP_005273417
auggccgccgucuacuccggcaucucccucaagcucaaguccaagaccaccuccugggaggacaagcucaagcucgcccacuucgccuggaucucccaccagugcuuccuccccaacaaggagcagguccuccucgacugggcccgccagucccucgucgccuucuacaagaagaagcucgagcucaaggaggacaucgucgagcgccucuggaucuacaucgacaacauccuccacucccgcaagcuccagaaccuccucaagaacggcaagaccaucaaccuccagaucucccucgucaagaucaucaacgagcgcgucgccgaguucucccucuccggcucccagcgcaacaucugcgccguccuccgcugcugccagggcauccucuccacccccgcccucgccgucaucuacaccgccaagcaggagcucauggucgcccuccucucccagcucugcugguccgccugccgccagcccgagggcgccgucgucgcccagcucuucgaggucauccaccucgcccucggccacuaccuccucauccuccagcagcaggucaacccccgccgcgccuucggcgacgucaccgcccaccuccuccagcccugccucguccuccgccaccuccucuccggcggcaccuggacccaggccggccagggccagcuccgccagguccucucccgcgacauccgcucccagaucgaggccauguuccgcggcggcaucuuccagcccgagcuccucuccuccuacaaggagggccuccucgaccagcagcagggcgacgucaagaccggcgccaugaagaaccuccucgcccccauggacaccguccucaaccgccucgucgacgccggcuacugcgccgccucccuccacaccuccgucgucgccaacuccgucgcccuccucuacaagcucuuccucgacuccuacuucaaggagggcaaccagcuccucugcuuccagguccucccccgccucuucggcugccucaagaucucccaccuccaggaggagcaguccaaggcccucuccaccuccgacuggaccaccgagcuccucgucgucgagcagcuccucaacuccgucgccaacaacaacaucuacaacaucgccgccgaccgcauccgccacgaggaggcccaguuccgcuucuaccgccacgucgccgagcuccucaucaaccacgcccaggcccccauccccgccugguuccgcugccucaagacccucaucucccucaaccaccucauccucgagcccgaccucgacgaccuccucgccuccgccuggaucgacgccgaggucaccgaguuccgcaccaagaaggcccaggaggcccucauccgcaccgucuuccagaccuacgccaagcuccgccaggucccccgccucuucgaggagguccucggcgucaucugccgccccgccgccgaggcccuccgccagcccguccucgccuccggccccuccaccguccucuccgccugccuccucgagcucccccccucccagauccucgacaccuggucccucguccucgagaaguuccagucccucguccuccccuaccuccaguccgacgccgacauggcccucaagucccucucccucucccuccuccuccacugcaucauguucaacaugcgcucccucgacuccuccaccccccuccccaucguccgccgcacccagugcaugauggagcgcaugaugcgcgagcucguccagccccuccucgcccuccuccccgacacccccggccccgagcccgagcucuggcuccagaaggucuccgacuccguccuccuccucuccuacaccugggcccaggucgacgccauguucucccucaacugcucccaguaccacuccauguccggcccccucaucggcgucgcccucgagaucuccaaccuccccucccuccuccccggcgucaagacccagcacuggaagaagaucgagaaguucaccgcccaguucuccucccucggcaccuacugccucgagcagcucuaccuccagaagaugaagcgcacccucaugcagaccuccuuccgcuccgagggcgccauccagucccuccgcugcgacgccgccuucaucaucggcuccggccgcaagucccucaaccagcgcaccaccgccuccugggacggccaggucggcauggucuccggccucaccuaccccgucgcccacuggcaccucaucgucuccaaccucaccauccucaucuccuaccucugccccgacgacgucggcuaccucgccuccguccuccuccgcacccuccccaugggcaaggcccaggaggucuccaucgacgaggaggccuacaucacccucgagaagaucuccaaggccuuccuccacuccccccucuuccccgagaugcagucccuccacuccgccuuccucaccugcgucaccaccuccugcuccuccauccucugcuccggcgcccagcgcgacuccggccucgucucccagcagcuccccuggcucuucgagaaggaccacauggucgucggccacugggagaaccgcuucgccaaggccggccccgagggcaucgagccccgcggcgagaucgcccagaaccuccucucccucgucaaguccgacuuccccauccagcucgagggcgagcagcucgaguccauccucggccuccucgaggucaucuccgcccuccagcucgacucccuccucccccccuaccacguccacuacuuccucguccuccucuccauggccgucaccaagcucggcugcuccugcuccuccucccucgcccucaaguuccucaccaccugcuaccagcuccucggcuaccuccagaagggcaaguccgcccgcuccgucuucaagaucauguacggcuccgacaucuucgaggucguccucaccucccucuuccgcgccuccucccgcuuccucaucgagauggacgaccccgccuggcucgaguuccuccaggucaucggcaccuuccucgaggagcucaugcagaugcucauccagaugaagcucucccucguccucaacuuccgcaagaucaccgccuuccucuccuccuccaagcccuacaccgaggccgccuccuccaagcagcucgagaaccagaacccccagggccgccagcuccuccucgucucccucacccgccucugccacguccucggccccuuccucaaggagcagaagcucggccaggaggcccccgccgcccucuccgagcuccuccagcaggucguccuccagaccggcgccguccuccagcucugcuccguccccggcgcccgcggcuggcgccuccccuccguccucaucuccuccgucuccacccuccucgaggccgaccucggccagcacugccgcgacggcggcgccgacaucucccagggcuccgaccgcacccuccucucccacgucgcccucuaccagggcgucuacucccagauccuccucgagcuccccgcccucgccggccacgaccaguccuuccaggccgcccuccaguuccucacccucuucuuccucgcccccgagcuccaccccaagaaggacuccgucuucaccuccauguuccacuccguccgccgcguccucgccgaccccgagauccccguccaggucacccaggacaucgagccccaccucggcgcccucuucacccagaugcucgaggucggcaccaccgaggaccuccgccucgucaugcagugcauccuccagggccucgacgucuccaacauguggaaggccgacguccagcuccucaaccgcgaggccucccaggagcagcccgucucccucaccgucgucggccccguccucgacguccucgccgcccuccuccgccagggcgaggaggccaucggcaacccccaccacgucucccucgccuucuccauccuccucaccgucccccucgaccaccucaagccccucgaguacggcuccgucuucccccgccuccacaacguccucuucuccauccuccagugccaccccaaggucaugcucaaggccauccccuccuuccucaacuccuucaaccgccucgucuucuccgucaugcgcgagggccgccagaaggacaagggcuccaucgacgaccuccccaccguccucaagugcgcccgccucgucgagcgcauguacucccacaucgccgcccgcgccgaggaguucgccgucuucucccccuucauggucgcccaguacguccucgagguccagaaggucacccucuaccccgccgucaagucccuccuccaggagggcaucuaccucauccucgaccucugcaucgagcccgacguccaguuccuccgcgccucccuccagcccggcaugcgcgacaucuucaaggagcucuacaacgacuaccucaaguaccacaaggccaagcacgagggcgagaagcgcuacaccgccuga

SEQ ID NO: 51540 - RNA, 2796 nt, Artificial Sequence
  derived and/or modified sequence opt2 from URGCP__Homo_sapiens__NP_001071131
auggccucccccggcaucgaggucgagcuccucggcaagggccacuccgaccucggcgaggucgcccccgagaucaaggccuccgagcgccgcaccgccgucgccaucgccgaccucgaguggcgcgagauggagggcgacgacugcgaguuccgcuacggcgacggcaccaacgaggcccaggacaacgacuuccccaccgucgagcgcucccgccuccaggagaugcucucccuccucggccucgagaccuaccagguccagaagcucucccuccaggacucccuccagaucuccuucgacuccaugaagaacugggccccccagguccccaaggaccuccccuggaacuuccuccgcaagcuccaggcccucaacgccgacgcccgcaacaccaccaugguccucgacguccuccccgacgcccgccccgucgagaaggagucccagauggaggaggagaucaucuacugggaccccgccgacgaccucgccgccgacaucuacuccuucuccgagcuccccacccccgacacccccgucaacccccucgaccuccucugcgcccuccuccucuccuccgacuccuuccuccagcaggagaucgcccucaagauggcccucugccaguucgcccucccccucguccuccccgacuccgagaaccacuaccacaccuuccuccucugggccaugcgcggcaucguccgcaccugguggucccagcccccccgcggcaugggcuccuuccgcgaggacuccgucguccucucccgcgcccccgccuucgccuucguccgcauggacgucuccuccaacuccaagucccagcuccucaacgccguccucucccccggccaccgccagugggacugcuucuggcaccgcgaccucaaccucggcaccaacgcccgcgagaucuccgacggccucgucgagaucuccugguucuuccccuccggccgcgaggaccucgacaucuuccccgagcccgucgccuuccucaaccuccgcggcgacaucggcucccacuggcuccaguucaagcuccucaccgagaucuccuccgccgucuucauccucaccgacaacaucuccaagaaggaguacaagcuccucuacuccaugaaggaguccaccaccaaguacuacuucauccucucccccuaccgcggcaagcgcaacaccaaccuccgcuuccucaacaagcucauccccguccucaagaucgaccacucccacguccucgucaaggucuccuccaccgacuccgacuccuucgucaagcgcauccgcgccaucgucggcaacguccuccgcgcccccugccgccgcgucuccgucgaggacauggcccacgccgcccgcaagcucggccucaaggucgacgaggacugcgaggagugccagaaggccaaggaccgcauggagcgcaucacccgcaagaucaaggacuccgacgccuaccgccgcgacgagcuccgccuccagggcgaccccuggcgcaaggccgcccaggucgagaaggaguucugccagcuccagugggccgucgacccccccgagaagcaccgcgccgagcuccgccgccgccuccucgagcuccgcaugcagcagaacggccacgaccccuccuccggcguccaggaguucaucuccggcaucuccucccccucccucuccgagaagcaguacuuccuccgcuggauggaguggggccucgcccgcgucgcccagccccgccuccgccagccccccgagacccuccucacccuccgccccaagcacggcggcaccaccgacgucggcgagccccucuggcccgagccccucggcgucgagcacuuccuccgcgagaugggccaguucuacgaggccgaguccugccucgucgaggccggccgccuccccgccggccagcgccgcuucgcccacuuccccggccucgccuccgagcuccuccucaccggccucccccucgagcucaucgacggcuccacccucuccaugcccguccgcugggucaccggccuccucaaggagcuccacguccgccucgagcgccgcucccgccucgucguccucuccaccgucggcguccccggcaccggcaaguccacccuccucaacaccauguucggccuccgcuucgccaccggcaaguccugcggcccccgcggcgccuucaugcagcucaucaccgucgccgagggcuucucccaggaccucggcugcgaccacauccucgucaucgacuccggcggccucaucggcggcgcccucaccuccgccggcgaccgcuucgagcucgaggccucccucgccacccuccucaugggccucuccaacgucaccgucaucucccucgccgagaccaaggacauccccgccgccauccuccacgccuuccuccgccucgagaagaccggccacaugcccaacuaccaguucgucuaccagaaccuccacgacgucuccguccccggcccccgcccccgcgacaagcgccagcuccucgacccccccggcgaccucucccgcgccgccgcccagauggagaagcagggcgacggcuuccgcgcccucgccggccucgccuucugcgaccccgagaagcagcacaucuggcacauccccggccucuggcacggcgccccccccauggccgccgucucccucgccuacuccgaggccaucuucgagcucaagcgcugccuccucgagaacauccgcaacggccucuccaaccagaacaagaacauccagcagcucaucgagcucguccgccgccucuga

SEQ ID NO: 51541 - RNA, 1428 nt, Artificial Sequence
  derived and/or modified sequence opt2 from URI1__Homo_sapiens__NP_001239570
augaccaccugguccucccuccagggcucccacgucuccaagcgcgcccucgccuacgcccucgucgucaccaacugccaggagcgcauccagcacuggaagaaggucgacaacgacuacaacgcccuccgcgagcgccucuccacccuccccgacaagcucuccuacaacaucaugguccccuucggccccuucgccuucaugcccggcaagcucguccacaccaacgaggucaccguccuccucggcgacaacugguucgccaagugcuccgccaagcaggccgucggccucgucgagcaccgcaaggagcacguccgcaagaccaucgacgaccucaagaaggucaugaagaacuucgagucccgcgucgaguucaccgaggaccuccagaagauguccgacgccgccggcgacaucgucgacauccgcgaggagaucaagugcgacuucgaguucaaggccaagcaccgcaucgcccacaagccccacuccaagcccaagaccuccgacaucuucgaggccgacaucgccaacgacgucaaguccaaggaccuccucgccgacaaggagcucugggcccgccucgaggagcucgagcgccaggaggagcuccucggcgagcucgacuccaagcccgacaccgucaucgccaacggcgaggacaccaccuccuccgaggaggagaaggaggaccgcaacaccaacgucaacgccaugcaccaggucaccgacucccacacccccugccacaaggacgucgccuccuccgagcccuucuccggccaggucaacucccagcucaacugcuccgucaacggcuccuccuccuaccacuccgacgacgacgacgacgacgacgacgacgacgacgacgacaacaucgacgacgacgacggcgacaacgaccacgaggcccucggcgucggcgacaacuccauccccaccaucuacuucucccacaccgucgagcccaagcgcguccgcaucaacaccggcaagaacaccacccucaaguucuccgagaagaaggaggaggccaagcgcaagcgcaagaacuccaccggcuccggccacuccgcccaggagcuccccaccauccgcacccccgccgacaucuaccgcgccuucgucgacgucgucaacggcgaguacgucccccgcaaguccauccucaagucccgcucccgcgagaacuccgucugcuccgacaccuccgaguccuccgccgccgaguucgacgaccgccgcggcguccuccgcuccaucuccugcgaggaggccaccugcuccgacaccuccgaguccauccucgaggaggagccccaggagaaccagaagaagcuccucccccucuccgucacccccgagguccuccgccucgucggcuacucccgcaaccucgccccccucaacgucauccucuga

SEQ ID NO: 51542 - RNA, 441 nt, Artificial Sequence
  derived and/or modified sequence opt2 from URM1__Homo_sapiens__NP_001129419
auggccgccccccucuccgucgaggucgaguucggcggcggcgccgagcuccucuucgacggcaucaagaagcaccgcgucacccuccccggccaggaggagcccugggacauccgcaaccuccucaucuggaucaagaagaaccuccucaaggagcgccccgagcucuucauccagggcgacuccguccgccccggcauccucguccucaucaacgacgccgacugggagcuccucgucuccacccucggcgacauccccccccccgcccccgcccucgccgccuccgucggcaagcgcugggccuccccccaggcccacaucgaguggcucggcaacccccccccccacuccucccccacccuccgccuccucgagucccccacccccggcgaggagggcaugggcuccuggggccacggcuccaccccccccuccuga

SEQ ID NO: 51543 - RNA, 2211 nt, Artificial Sequence
  derived and/or modified sequence opt2 from UROC1__Homo_sapiens__NP_001159446
auguccucccuccaggcccucugcuccggccucccccuccgcccccuccccgagaaccgcggccgccaggccggcgucccccacgcccccguccgcacccccucccucucccccgucgagaagcagcucgcccuccgcaacgcccuccgcuacuucccccccgacguccaggagcuccucgcccccgaguucgcccaggagcuccagcucuacggccacaucuacauguaccgcuucugccccgacaucgagaugcgcgccuaccccaucgagcaguaccccugccagaccaaggucgccgccgccaucaugcacaugaucaugaacaaccucgaccccgccgucgcccaguucccccaggagcucgucaccuacggcggcaacggccaggucuucuccaacugggcccaguucuggcucaccauguucuaccucuccaagaugaccgaggagcagacccucgucauguacuccggccacccccucggccucuuccccuccucccgcuccgccccccgccucgucaucaccaacggcauggucauccccaacuacuccucccgcaccgaguacgagaagcucuucgcccucggcgucaccauguacggccagaugaccgccggcuccuacugcuacaucggcccccagggcaucguccacggcaccguccucaccguccucaacgccgcccgccgcuaccucggcaucgaggaccucgccggcaaggucuucgucaccuccggccucggcggcauguccggcgcccaggccaaggccgccgucaucgucggcugcaucggcgucaucgccgaggucgacaaggccgcccucgagaagcgccaccgccagggcuggcucauggaggucaccgacucccucgaccgcugcauccagcgccuccgcguccuccagcucggccuccagcaggcccucggcugggccggccuccccgccgcccucggccucugcguccucuccugcuucgucaaccucgccccccucggcgagggccgcugccucgcccccuccggcuucucccgcccccuccucggcgcccccguccuccuccucugccccucccgcgaggcccgcaagaagaaggagguccucucccucggcuaccacggcaacgucgucgcccucugggagcgccucguccacgagcucgacaccaccggcgagugccucgucgaccucggcuccgaccagaccuccugccacaaccccuucaacggcggcuacuaccccguccagcucuccuucaccgaggcccagucccucauggccuccaaccccgccgucuucaaggaccucguccaggagucccuccgccgccaggucuccgccaucaaccgccucgccgaggagaaguucuucuucugggacuacggcaacgccuuccuccucgaggcccagcgcgccggcgccgacgucgagaagaagggcgccggccgcaccgaguuccgcuaccccuccuacguccagcacaucaugggcgacaucuucucccagggcuucggccccuuccgcugggucugcaccuccggcgacccccaggaccucgccgucaccgacgagcucgccaccuccguccucgaggaggccaucgccgacggcgucaaggucuccgucaagcuccaguacauggacaacauccgcuggauccgcgaggccgcccgccaccgccucgucgucggcucccaggcccgcauccucuacuccgaccagaagggccgcgucgccaucgccgucgccaucaaccaggccaucgccugccgccgcaucaaggcccccgucguccucucccgcgaccaccacgacgucuccggcaccgacucccccuuccgcgagaccuccaacaucuacgacggcuccgccuucugcgccgacauggccguccagaacuucgucggcgacgccugccgcggcgccaccugggucgcccuccacaacggcggcggcgucggcuggggcgaggucaucaacggcggcuucggccucguccucgacggcacccccgaggccgagggccgcgcccgccucaugcucuccugggacgucuccaacggcgucgcccgccgcugcugguccggcaaccagaaggccuacgagaucaucugccagaccaugcaggagaacuccacccucgucgucacccucccccacaaggucgaggacgagcgcguccuccagcaggcccuccagcucuga

SEQ ID NO: 51544 - RNA, 1041 nt, Artificial Sequence
  derived and/or modified sequence opt2 from UROD__Homo_sapiens__XP_011540382
auggaggccaacggccucggcccccagggcuuccccgagcucaagaacgacaccuuccuccgcgccgccuggggcgaggagaccgacuacacccccgucuggugcaugcgccaggccggccgcuaccuccccgaguuccgcgagacccgcgccgcccaggacuucuucuccaccugccgcucccccgaggccugcugcgagcucacccuccaggcccucggcauggaggucaccaugguccccggcaagggccccuccuuccccgagccccuccgcgaggagcaggaccucgagcgccuccgcgaccccgaggucgucgccuccgagcucggcuacgucuuccaggccaucacccucacccgccagcgccucgccggccgcgucccccucaucggcuucgccggcgcccccuggacccucaugaccuacauggucgagggcggcggcuccuccaccauggcccaggccaagcgcuggcucuaccagcgcccccaggccucccaccagcuccuccgcauccucaccgacgcccucguccccuaccucgucggccaggucgucgccggcgcccaggcccuccagcucuucgagucccacgccggccaccucggcccccagcucuucaacaaguucgcccuccccuacauccgcgacgucgccaagcaggucaaggcccgccuccgcgaggccggccucgcccccguccccaugaucaucuucgccaaggacggccacuucgcccucgaggagcucgcccaggccggcuacgaggucgucggccucgacuggaccgucgcccccaagaaggcccgcgagugcgucggcaagaccgucacccuccagggcaaccucgaccccugcgcccucuacgccuccgaggaggagaucggccagcucgucaagcagaugcucgacgacuucggcccccaccgcuacaucgccaaccucggccacggccucuaccccgacauggaccccgagcacgucggcgccuucgucgacgccguccacaagcacucccgccuccuccgccagaacuga

SEQ ID NO: 51545 - RNA, 798 nt, Artificial Sequence
  derived and/or modified sequence opt2 from UROS__Homo_sapiens__NP_000366
augaagguccuccuccucaaggacgccaaggaggacgacugcggccaggaccccuacauccgcgagcucggccucuacggccucgaggccacccucauccccguccucuccuucgaguuccucucccuccccuccuucuccgagaagcucucccaccccgaggacuacggcggccucaucuucaccuccccccgcgccgucgaggccgccgagcucugccucgagcagaacaacaagaccgaggucugggagcgcucccucaaggagaaguggaacgccaaguccgucuacgucgucggcaacgccaccgccucccucgucuccaagaucggccucgacaccgagggcgagaccugcggcaacgccgagaagcucgccgaguacaucugcucccgcgaguccuccgcccucccccuccucuuccccugcggcaaccucaagcgcgagauccuccccaaggcccucaaggacaagggcaucgccauggaguccaucaccgucuaccagaccgucgcccaccccggcauccagggcaaccucaacuccuacuacucccagcagggcguccccgccuccaucaccuucuucucccccuccggccucaccuacucccucaagcacauccaggagcucuccggcgacaacaucgaccagaucaaguucgccgccaucggccccaccaccgcccgcgcccucgccgcccagggccuccccgucuccugcaccgccgagucccccaccccccaggcccucgccaccggcauccgcaaggcccuccagccccacggcugcugcuga

SEQ ID NO: 51546 - RNA, 744 nt, Artificial Sequence
  derived and/or modified sequence opt2 from USB1__Homo_sapiens__NP_001182231
auguccgccgccccccucgucggcuacuccuccuccggcuccgaggacgaguccgaggacggcaugcgcacccgccccggcgacggcucccaccgccgcggccaguccccccucccccgccagcgcuuccccguccccgacuccguccucaacauguuccccggcaccgaggagggccccgaggacgacuccaccaagcacggcggccgcguccgcaccuucccccacgagcgcggcaacugggccacccacgucuacguccccuacgaggccaaggaggaguuccucgaccuccucgacguccuccucccccacgcccagaccuacgucccccgccucguccgcaugaaggucuuccaccucucccucucccaguccgucguccuccgccaccacuggauccuccccuucguccaggcccucaaggcccgcaugaccuccuuccaccgcaccuucaucggccucgaggucaccuccggccacgcccaguuccucgaccucgucuccgaggucgaccgcgucauggaggaguucaaccucaccaccuucuaccaggaccccuccuuccaccucucccucgccuggugcgucggcgacgcccgccuccagcucgagggccagugccuccaggagcuccaggccaucgucgacggcuucgaggacgccgagguccuccuccgcguccacaccgagcagguccgcugcaaguccggcaacaaguucuucuccaugccccucaaguga

SEQ ID NO: 51547 - RNA, 780 nt, Artificial Sequence
  derived and/or modified sequence opt2 from USE1__Homo_sapiens__NP_060937
auggccgccucccgccucgagcucaaccucguccgccuccucucccgcugcgaggccauggccgccgagaagcgcgaccccgacgaguggcgccucgagaaguacgucggcgcccucgaggacaugcuccaggcccucaagguccacgccuccaagcccgccuccgaggucaucaacgaguacuccuggaaggucgacuuccucaagggcaugcuccaggccgagaagcucaccuccuccuccgagaaggcccucgccaaccaguuccucgcccccggccgcguccccaccaccgcccgcgagcgcguccccgccaccaagaccguccaccuccagucccgcgcccgcuacaccuccgagaugcgcuccgagcuccucggcaccgacuccgccgagcccgagauggacguccgcaagcgcaccggcgucgccggcucccagcccgucuccgagaagcaguccgccgccgagcucgaccucguccuccagcgccaccagaaccuccaggagaagcucgccgaggagaugcucggccucgcccgcucccucaagaccaacacccucgccgcccaguccgucaucaagaaggacaaccagacccucucccacucccucaagauggccgaccagaaccucgagaagcucaagaccgaguccgagcgccucgagcagcacacccagaaguccgucaacuggcuccucugggccaugcucaucaucgucugcuucaucuucaucuccaugauccucuucauccgcaucaugcccaagcucaaguga

SEQ ID NO: 51548 - RNA, 933 nt, Artificial Sequence
  derived and/or modified sequence opt2 from USF1__Homo_sapiens__NP_001263302
augaagggccagcagaagaccgccgagaccgaggagggcaccguccagauccaggagggcgccgucgccaccggcgaggaccccaccuccgucgccaucgccuccauccaguccgccgccaccuuccccgaccccaacgucaaguacgucuuccgcaccgagaacggcggccaggucauguaccgcgucauccaggucuccgagggccagcucgacggccagaccgagggcaccggcgccaucuccggcuaccccgccacccaguccaugacccaggccgucauccagggcgccuucaccuccgacgacgccgucgacaccgagggcaccgccgccgagacccacuacaccuacuuccccuccaccgccgucggcgacggcgccggcggcaccaccuccggcuccaccgccgccgucgucaccacccagggcuccgaggcccuccucggccaggccaccccccccggcaccggccaguucuucgucaugauguccccccaggagguccuccagggcggcucccagcgcuccaucgccccccgcacccaccccuacucccccaaguccgaggccccccgcaccacccgcgacgagaagcgccgcgcccagcacaacgaggucgagcgccgccgccgcgacaagaucaacaacuggaucguccagcucuccaagaucauccccgacugcuccauggaguccaccaaguccggccaguccaagggcggcauccucuccaaggccugcgacuacauccaggagcuccgccaguccaaccaccgccucuccgaggagcuccagggccucgaccagcuccagcucgacaacgacguccuccgccagcaggucgaggaccucaagaacaagaaccuccuccuccgcgcccagcuccgccaccacggccucgaggucgucaucaagaacgacuccaacuga

SEQ ID NO: 51549 - RNA, 1041 nt, Artificial Sequence
  derived and/or modified sequence opt2 from USF2__Homo_sapiens__NP_003358
auggacaugcucgaccccggccucgaccccgccgccuccgccaccgccgccgccgccgccucccacgacaagggccccgaggccgaggagggcgucgagcuccaggagggcggcgacggccccggcgccgaggagcagaccgccgucgccaucaccuccguccagcaggccgccuucggcgaccacaacauccaguaccaguuccgcaccgagaccaacggcggccaggucaccuaccgcgucguccaggucaccgacggccagcucgacggccagggcgacaccgccggcgccgucuccgucgucuccaccgccgccuucgccggcggccagcaggccgucacccaggucggcgucgacggcgccgcccagcgccccggccccgccgccgccuccgucccccccggccccgccgcccccuucccccucgccgucauccagaaccccuucuccaacggcggcucccccgccgccgaggccgucuccggcgaggcccgcuucgccuacuuccccgccuccuccgucggcgacaccaccgccgucuccguccagaccaccgaccagucccuccaggccggcggccaguucuacgucaugaugaccccccaggacguccuccagaccggcacccagcgcaccaucgccccccgcacccaccccuacucccccaagaucgacggcacccgcaccccccgcgacgagcgccgccgcgcccagcacaacgaggucgagcgccgccgccgcgacaagaucaacaacuggaucguccagcucuccaagaucauccccgacugcaacgccgacaacuccaagaccggcgccuccaagggcggcauccucuccaaggccugcgacuacauccgcgagcuccgccagaccaaccagcgcaugcaggagaccuucaaggaggccgagcgccuccagauggacaacgagcuccuccgccagcagaucgaggagcucaagaacgagaacgcccuccuccgcgcccagcuccagcagcacaaccucgagauggucggcgagggcacccgccaguga

SEQ ID NO: 51550 - RNA, 1602 nt, Artificial Sequence
  derived and/or modified sequence opt2 from USH1C__Homo_sapiens__NP_001284693
auggaccgcaaggucgcccgcgaguuccgccacaaggucgacuuccucaucgagaacgacgccgagaaggacuaccucuacgacguccuccgcauguaccaccagaccauggacgucgccguccucgucggcgaccucaagcucgucaucaacgagcccucccgccucccccucuucgacgccauccgcccccucaucccccucaagcaccaggucgaguacgaccagcucaccccccgccgcucccgcaagcucaaggagguccgccucgaccgccuccaccccgagggccucggccucuccguccgcggcggccucgaguucggcugcggccucuucaucucccaccucaucaagggcggccaggccgacuccgucggccuccaggucggcgacgagaucguccgcaucaacggcuacuccaucuccuccugcacccacgaggaggucaucaaccucauccgcaccaagaagaccgucuccaucaagguccgccacaucggccucauccccgucaaguccucccccgacgagccccucaccuggcaguacgucgaccaguucgucuccgaguccggcggcguccgcggcucccucggcucccccggcaaccgcgagaacaaggagaagaaggucuucaucucccucgucggcucccgcggccucggcugcuccaucuccuccggccccauccagaagcccggcaucuucaucucccacgucaagcccggcucccucuccgccgaggucggccucgagaucggcgaccagaucgucgaggucaacggcgucgacuucuccaaccucgaccacaaggagggccgcgagcucuucaugaccgaccgcgagcgccucgccgaggcccgccagcgcgagcuccagcgccaggagcuccucaugcagaagcgccucgccauggaguccaacaagauccuccaggagcagcaggagauggagcgccagcgccgcaaggagaucgcccagaaggccgccgaggagaacgagcgcuaccgcaaggagauggagcagaucgucgaggaggaggagaaguucaagaagcagugggaggaggacuggggcuccaaggagcagcuccuccuccccaagaccaucaccgccgagguccaccccgucccccuccgcaagcccaaguacgaccagggcgucgagcccgagcucgagcccgccgacgaccucgacggcggcaccgaggagcagggcgagcaggacuuccgcaaguacgaggagggcuucgaccccuacuccauguucacccccgagcagaucaugggcaaggacguccgccuccuccgcaucaagaaggagggcucccucgaccucgcccucgagggcggcgucgacucccccaucggcaaggucgucgucuccgccgucuacgagcgcggcgccgccgagcgccacggcggcaucgucaagggcgacgagaucauggccaucaacggcaagaucgucaccgacuacacccucgccgaggccgaggccgcccuccagaaggccuggaaccagggcggcgacuggaucgaccucgucgucgccgucugcccccccaaggaguacgacgacgagcucaccuucuucuga

SEQ ID NO: 51551 - RNA, 1386 nt, Artificial Sequence
  derived and/or modified sequence opt2 from USH1G__Homo_sapiens__NP_775748
augaacgaccaguaccaccgcgccgcccgcgacggcuaccucgagcuccucaaggaggccacccgcaaggagcucaacgcccccgacgaggacggcaugacccccacccucugggccgccuaccacggcaaccucgagucccuccgccucaucgucucccgcggcggcgaccccgacaagugcgacaucuggggcaacaccccccuccaccucgccgccuccaacggccaccuccacugccucuccuuccucgucuccuucggcgccaacaucuggugccucgacaacgacuaccacaccccccucgacauggccgccaugaagggccacauggagugcguccgcuaccucgacuccaucgccgccaagcaguccucccucaaccccaagcucgucggcaagcucaaggacaaggccuuccgcgaggccgagcgccgcauccgcgagugcgccaagcuccagcgccgccaccacgagcgcauggagcgccgcuaccgccgcgagcucgccgagcgcuccgacacccucuccuucuccucccucaccuccuccacccucucccgccgccuccagcaccucgcccucggcucccaccuccccuacucccaggccacccuccacggcaccgcccgcggcaagaccaagaugcagaagaagcucgagcgccgcaagcagggcggcgagggcaccuucaaggucuccgaggacggccgcaaguccgcccgcucccucuccggccuccagcucggcuccgacgucauguucguccgccagggcaccuacgccaaccccaaggaguggggccgcgccccccuccgcgacauguuccucuccgacgaggacuccgucucccgcgccacccucgccgccgagcccgcccacuccgaggucuccaccgacuccggccacgacucccucuucacccgccccggccucggcaccauggucuuccgccgcaacuaccucuccuccggccuccacggccucggccgcgaggacggcggccucgacggcgucggcgccccccgcggccgccuccaguccucccccucccucgacgacgacucccucggcuccgccaacucccuccaggaccgcuccugcggcgaggagcuccccugggacgagcucgaccucggccucgacgaggaccucgagcccgagaccuccccccucgagaccuuccucgccucccuccacauggaggacuucgccgcccuccuccgccaggagaagaucgaccucgaggcccucaugcucugcuccgaccucgaccuccgcuccaucuccgucccccucggcccccgcaagaagauccucggcgccguccgccgccgccgccaggccauggagcgcccccccgcccucgaggacaccgagcucuga

SEQ ID NO: 51552 - RNA, 4641 nt, Artificial Sequence
  derived and/or modified sequence opt2 from USH2A__Homo_sapiens__NP_009054
augaacugccccguccucucccucggcuccggcuuccucuuccaggucaucgagaugcucaucuucgccuacuucgccuccaucucccucaccgagucccgcggccucuucccccgccucgagaacgucggcgccuucaagaaggucuccaucguccccacccaggccgucugcggccuccccgaccgcuccaccuucugccacuccuccgccgccgccgaguccauccaguucugcacccagcgcuucugcauccaggacugccccuaccgcuccucccaccccaccuacaccgcccucuucuccgccggccucuccuccugcaucacccccgacaagaacgaccuccaccccaacgcccacuccaacuccgccuccuucaucuucggcaaccacaaguccugcuucuccuccccccccucccccaagcucauggccuccuucacccucgccgucuggcucaagcccgagcagcagggcgucaugugcgucaucgagaagaccgucgacggccagaucgucuucaagcucaccaucuccgagaaggagaccauguucuacuaccgcaccgucaacggccuccagccccccaucaaggucaugacccucggccgcauccucgucaagaaguggauccaccucuccguccagguccaccagaccaagaucuccuucuucaucaacggcgucgagaaggaccacacccccuucaacgcccgcacccucuccggcuccaucaccgacuucgccuccggcaccguccagaucggccagucccucaacggccucgagcaguucgucggccgcaugcaggacuuccgccucuaccaggucgcccucaccaaccgcgagauccucgaggucuucuccggcgaccuccuccgccuccacgcccagucccacugccgcugccccggcucccacccccgcguccacccccucgcccagcgcuacugcauccccaacgacgccggcgacaccgccgacaaccgcgucucccgccucaaccccgaggcccacccccucuccuucgucaacgacaacgacgucggcaccuccugggucuccaacgucuucaccaacaucacccagcucaaccagggcgucaccaucuccgucgaccucgagaacggccaguaccaggucuucuacaucaucauccaguucuucuccccccagcccaccgagauccgcauccagcgcaagaaggagaacucccucgacugggaggacuggcaguacuucgcccgcaacugcggcgccuucggcaugaagaacaacggcgaccucgagaagcccgacuccgucaacugccuccagcucuccaacuucacccccuacucccgcggcaacgucaccuucuccauccucacccccggccccaacuaccgccccggcuacaacaacuucuacaacacccccucccuccaggaguucgucaaggccacccagauccgcuuccacuuccacggccaguacuacaccaccgagaccgccgucaaccuccgccaccgcuacuacgccgucgacgagaucaccaucuccggccgcugccagugccacggccacgccgacaacugcgacaccaccucccagcccuaccgcugccucugcucccaggaguccuucaccgagggccuccacugcgaccgcugccucccccucuacaacgacaagcccuuccgccagggcgaccaggucuacgccuucaacugcaagcccugccagugcaacucccacuccaaguccugccacuacaacaucuccgucgaccccuuccccuucgagcacuuccgcggcggcggcggcgucugcgacgacugcgagcacaacaccaccggccgcaacugcgagcucugcaaggacuacuucuuccgccaggucggcgccgaccccuccgccaucgacgucugcaagcccugcgacugcgacaccgucggcacccgcaacggcuccauccucugcgaccagaucggcggccagugcaacugcaagcgccacgucuccggccgccagugcaaccagugccagaacggcuucuacaaccuccaggagcucgaccccgacggcugcucccccugcaacugcaacaccuccggcaccgucgacggcgacaucaccugccaccagaacuccggccagugcaagugcaaggccaacgucaucggccuccgcugcgaccacugcaacuucggcuucaaguuccuccgcuccuucaacgacgucggcugcgagcccugccagugcaaccuccacggcuccgucaacaaguucugcaacccccacuccggccagugcgagugcaagaaggaggccaagggccuccagugcgacaccugccgcgagaacuucuacggccucgacgucaccaacugcaaggccugcgacugcgacaccgccggcucccuccccggcaccgucugcaacgccaagaccggccagugcaucugcaagcccaacgucgagggccgccagugcaacaagugccucgagggcaacuucuaccuccgccagaacaacuccuuccucugccuccccugcaacugcgacaagaccggcaccaucaacggcucccuccucugcaacaaguccaccggccagugccccugcaagcucggcgucaccggccuccgcugcaaccagugcgagccccaccgcuacaaccucaccaucgacaacuuccagcacugccagaugugcgagugcgacucccucggcacccuccccggcaccaucugcgaccccaucuccggccagugccucugcguccccaaccgccagggccgccgcugcaaccagugccagcccggcuucuacaucucccccggcaacgccaccggcugccuccccugcuccugccacaccaccggcgccgucaaccacaucugcaacucccucaccggccagugcgucugccaggacgccuccaucgccggccagcgcugcgaccagugcaaggaccacuacuucggcuucgacccccagaccggccgcugccagcccugcaacugccaccucuccggcgcccucaacgagaccugccaccucgucaccggccagugcuucugcaagcaguucgucaccggcuccaagugcgacgccugcguccccuccgccucccaccucgacgucaacaaccuccucggcugcuccaagacccccuuccagcagccccccccccgcggccagguccaguccuccuccgccaucaaccucuccugguccccccccgacucccccaacgcccacuggcucaccuacucccuccuccgcgacggcuucgagaucuacaccaccgaggaccaguaccccuacuccauccaguacuuccucgacaccgaccuccuccccuacaccaaguacuccuacuacaucgagaccaccaacguccacggcuccacccgcuccgucgccgucaccuacaagaccaagcccggcguccccgagggcaaccucacccucuccuacaucauccccaucggcuccgacuccgucacccucaccuggaccacccucuccaaccaguccggccccaucgagaaguacauccucuccugcgccccccucgccggcggccagcccugcgucuccuacgagggccacgagaccuccgccaccaucuggaaccucguccccuucgccaaguacgacuucuccguccaggccugcaccuccggcggcugccuccacucccuccccaucaccgucaccaccgcccaggcccccccccagcgccucuccccccccaagaugcagaagaucuccuccaccgagcuccacgucgagugguccccccccgccgagcucaacggcaucaucauccgcuacgagcucuacaugcgccgccuccgcuccaccaaggagaccaccuccgaggagucccgcgucuuccaguccuccggcuggcucuccccccacuccuucgucgaguccgccaacgagaacgcccucaagcccccccagaccaugaccaccaucaccggccucgagcccuacaccaaguacgaguuccgcguccucgccgucaacauggccggcuccgucuccuccgccugggucuccgagcgcaccggcgaguccgcccccgucuucaugaucccccccuccgucuucccccucuccuccuacucccucaacaucuccugggagaagcccgccgacaacgucacccgcggcaaggucgucggcuacgacaucaacaugcucuccgagcaguccccccagcaguccauccccauggccuucucccagcuccuccacaccgccaagucccaggagcucuccuacaccgucgagggccucaagcccuaccgcaucuacgaguucaccaucacccucugcaacuccgucggcugcgucaccuccgccuccggcgccggccagacccucgccgccgcccccgcccagcuccgccccccccucgucaagggcaucaacuccaccaccauccaccucaagugguucccccccgaggagcucaacggccccucccccaucuaccagcucgagcgccgcgaguccucccuccccgcccucaugaccaccaugaugaagggcauccgcuucaucggcaacggcuacugcaaguuccccuccuccacccaccccgucaacaccgacuucaccggcaagugcgucuga

SEQ ID NO: 51553 - RNA, 2922 nt, Artificial Sequence
  derived and/or modified sequence opt2 from USO1__Homo_sapiens__NP_001276978
augaacuuccuccgcggcgucaugggcggccaguccgccggcccccagcacaccgaggccgagaccauccagaagcucugcgaccgcgucgccuccuccacccuccucgacgaccgccgcaacgccguccgcgcccucaagucccucuccaagaaguaccgccucgaggucggcauccaggccauggagcaccucauccacguccuccagaccgaccgcuccgacuccgagaucaucggcuacgcccucgacacccucuacaacaucaucuccaacgaggaggaggaggaggucgacgacgucgaggaggagaacuccacccgccaguccgaggaccucggcucccaguucaccgagaucuucaucaagcagcaggagaacgucacccuccuccucucccuccucgaggaguucgacuuccacguccgcuggcccggcgucaagcuccucaccucccuccucaagcagcucggcccccagguccagcagaucauccucgucucccccaugggcgucucccgccucauggaccuccucgccgacucccgcgaggucauccgcaacgacggcguccuccuccuccaggcccucacccgcuccaacggcgccauccagaagaucgucgccuucgagaacgccuucgagcgccuccucgacaucaucuccgaggagggcaacuccgacggcggcaucgucgucgaggacugccucauccuccuccagaaccuccucaagaacaacaacuccaaccagaacuucuucaaggagggcuccuacauccagcgcaugaagcccugguucgaggucggcgacgagaacuccggcugguccgcccagaaggucaccaaccuccaccucaugcuccagcucguccgcguccucgucucccccaccaacccccccggcgccaccuccuccugccagaaggccauguuccagugcggccuccuccagcagcucugcaccauccucauggccaccggcguccccgccgacauccucaccgagaccaucaacaccgucuccgaggucauccgcggcugccaggucaaccaggacuacuucgccuccgucaacgcccccuccaaccccccccgccccgccaucgucguccuccucauguccauggucaacgagcgccagcccuucguccuccgcugcgccguccucuacugcuuccagugcuuccucuacaagaaccagaagggccagggcgagaucgucuccacccuccuccccuccaccaucgacgccaccggcaacuccgucuccgccggccagcuccucugcggcggccucuucuccaccgacucccucuccaacuggugcgccgccgucgcccucgcccacgcccuccaggagaacgccacccagaaggagcagcuccuccgcguccagcucgccaccuccaucggcaacccccccgucucccuccuccagcagugcaccaacauccucucccagggcgacaagaucgaccgccgcggcuccaagauccagacccgcgucggccuccucaugcuccucugcaccuggcucuccaacugccccaucgccgucacccacuuccuccacaacuccgccaacguccccuuccucaccggccagaucgccgagaaccucggcgaggaggagcagcucguccagggccucugcgcccuccuccucggcaucuccaucuacuucaacgacaacucccucgaguccuacaugaaggagaagcucaagcagcucaucgagaagcgcaucggcaaggagaacuucaucgagaagcucggcuucaucuccaagcacgagcucuacucccgcgccucccagaagccccagcccaacuuccccucccccgaguacaugaucuucgaccacgaguucaccaagcucgucaaggagcucgagggcgucaucaccaaggccaucuacaaguccuccgaggaggacaagaaggaggaggaggucaagaagacccucgagcagcacgacaacaucgucacccacuacaagaacaugauccgcgagcaggaccuccagcucgaggagcuccgccagcaggucuccacccucaagugccagaacgagcagcuccagaccgccgucacccagcaggucucccagauccagcagcacaaggaccaguacaaccuccucaagauccagcucggcaaggacaaccagcaccagggcuccuacuccgagggcgcccagaugaacggcauccagcccgaggagaucggccgccuccgcgaggagaucgaggagcucaagcgcaaccaggagcuccuccagucccagcucaccgagaaggacuccaugaucgagaacaugaaguccucccagaccuccggcaccaacgagcaguccuccgccaucgucuccgcccgcgacuccgagcaggucgccgagcucaagcaggagcucgccacccucaagucccagcucaacucccaguccgucgagaucaccaagcuccagaccgagaagcaggagcuccuccagaagaccgaggccuucgccaaguccgucgagguccagggcgagaccgagaccaucaucgccaccaagaccaccgacgucgagggccgccucuccgcccuccuccaggagaccaaggagcucaagaacgagaucaaggcccucuccgaggagcgcaccgccaucaaggagcagcucgacuccuccaacuccaccaucgccauccuccagaccgagaaggacaagcucgagcucgagaucaccgacuccaagaaggagcaggacgaccuccucguccuccucgccgaccaggaccagaagauccucucccucaagaacaagcucaaggaccucggccaccccgucgaggaggaggacgagcucgaguccggcgaccaggaggacgaggacgacgaguccgaggaccccggcaaggaccucgaccacaucuga

SEQ ID NO: 51554 - RNA, 2397 nt, Artificial Sequence
  derived and/or modified sequence opt2 from USP10__Homo_sapiens__NP_005144
auggcccuccacuccccccaguacaucuucggcgacuucucccccgacgaguucaaccaguucuucgucaccccccgcuccuccgucgagcucccccccuacuccggcaccguccucugcggcacccaggccgucgacaagcuccccgacggccaggaguaccagcgcaucgaguucggcgucgacgaggucaucgagcccuccgacacccucccccgcacccccuccuacuccaucuccuccacccucaacccccaggcccccgaguucauccucggcugcaccgccuccaagaucacccccgacggcaucaccaaggaggccuccuacggcuccaucgacugccaguaccccggcuccgcccucgcccucgacggcuccuccaacgucgaggccgagguccucgagaacgacggcgucuccggcggccucggccagcgcgagcgcaagaagaagaagaagcgcccccccggcuacuacuccuaccucaaggacggcggcgacgacuccaucuccaccgaggcccucgucaacggccacgccaacuccgccguccccaacuccgucuccgccgaggacgccgaguucaugggcgacaugccccccuccgucaccccccgcaccugcaacuccccccagaacuccaccgacuccgucuccgacaucguccccgacucccccuuccccggcgcccucggcuccgacacccgcaccgccggccagcccgagggcggccccggcgccgacuucggccaguccugcuuccccgccgaggccggccgcgacacccucucccgcaccgccggcgcccagcccugcgucggcaccgacaccaccgagaaccucggcgucgccaacggccagauccucgaguccuccggcgagggcaccgccaccaacggcgucgagcuccacaccaccgaguccaucgaccucgaccccaccaagcccgaguccgccuccccccccgccgacggcaccggcuccgccuccggcacccuccccgucucccagcccaaguccugggccucccucuuccacgacuccaagcccuccuccuccucccccgucgccuacgucgagaccaaguacuccccccccgccaucuccccccucgucuccgagaagcaggucgaggucaaggagggccucguccccgucuccgaggaccccgucgccaucaagaucgccgagcuccucgagaacgucacccucauccacaagcccgucucccuccagccccgcggccucaucaacaagggcaacuggugcuacaucaacgccacccuccaggcccucgucgccugcccccccauguaccaccucaugaaguucaucccccucuacuccaagguccagcgccccugcaccuccacccccaugaucgacuccuucguccgccucaugaacgaguucaccaacaugcccgucccccccaagccccgccaggcccucggcgacaagaucguccgcgacauccgccccggcgccgccuucgagcccaccuacaucuaccgccuccucaccgucaacaaguccucccucuccgagaagggccgccaggaggacgccgaggaguaccucggcuucauccucaacggccuccacgaggagaugcucaaccucaagaagcuccucucccccuccaacgagaagcucaccaucuccaacggccccaagaaccacuccgucaacgaggaggagcaggaggagcagggcgagggcuccgaggacgagugggagcaggucggcccccgcaacaagaccuccgucacccgccaggccgacuucguccagacccccaucaccggcaucuucggcggccacauccgcuccgucgucuaccagcaguccuccaaggaguccgccacccuccagcccuucuucacccuccagcucgacauccaguccgacaagauccgcaccguccaggacgcccucgagucccucgucgcccgcgaguccguccagggcuacaccaccaagaccaagcaggaggucgagaucucccgccgcgucacccucgagaagcucccccccguccucguccuccaccucaagcgcuucgucuacgagaagaccggcggcugccagaagcucaucaagaacaucgaguaccccgucgaccucgagaucuccaaggagcuccucucccccggcgucaagaacaagaacuucaagugccaccgcaccuaccgccucuucgccgucgucuaccaccacggcaacuccgccaccggcggccacuacaccaccgacgucuuccagaucggccucaacggcuggcuccgcaucgacgaccagaccgucaaggucaucaaccaguaccaggucgucaagcccaccgccgagcgcaccgccuaccuccucuacuaccgccgcgucgaccuccucuga

SEQ ID NO: 51555 - RNA, 2892 nt, Artificial Sequence
  derived and/or modified sequence opt2 from USP11__Homo_sapiens__NP_004642
auggccgucgccccccgccucuucggcggccucugcuuccgcuuccgcgaccagaaccccgaggucgccgucgagggccgccuccccaucucccacuccugcgucggcugccgccgcgagcgcaccgccauggccaccgucgccgccaaccccgccgccgccgccgccgccgucgccgccgccgccgccgucaccgaggaccgcgagccccagcacgaggagcuccccggccucgacucccaguggcgccagaucgagaacggcgaguccggccgcgagcgcccccuccgcgccggcgaguccugguuccucgucgagaagcacugguacaagcagugggaggccuacguccagggcggcgaccaggacuccuccaccuuccccggcugcaucaacaacgccacccucuuccaggacgagaucaacuggcgccucaaggagggccucgucgagggcgaggacuacguccuccuccccgccgccgccuggcacuaccucgucuccugguacggccucgagcacggccagccccccaucgagcgcaaggucaucgagcuccccaacauccagaaggucgaggucuaccccgucgagcuccuccucguccgccacaacgaccucggcaagucccacaccguccaguucucccacaccgacuccaucggccucguccuccgcaccgcccgcgagcgcuuccucgucgagccccaggaggacacccgccucugggccaagaacuccgagggcucccucgaccgccucuacgacacccacaucaccguccucgacgccgcccucgagaccggccagcucaucaucauggagacccgcaagaaggacggcaccuggcccuccgcccagcuccacgucaugaacaacaacauguccgaggaggacgaggacuucaagggccagcccggcaucugcggccucaccaaccucggcaacaccugcuucaugaacuccgcccuccagugccucuccaacgucccccagcucaccgaguacuuccucaacaacugcuaccucgaggagcucaacuuccgcaacccccucggcaugaagggcgagaucgccgaggccuacgccgaccucgucaagcaggccugguccggccaccaccgcuccaucgucccccacgucuucaagaacaaggucggccacuucgccucccaguuccucggcuaccagcagcacgacucccaggagcuccucuccuuccuccucgacggccuccacgaggaccucaaccgcgucaagaagaaggaguacgucgagcucugcgacgccgccggccgccccgaccaggaggucgcccaggaggccuggcagaaccacaagcgccgcaacgacuccgucaucgucgacaccuuccacggccucuucaaguccacccucgucugccccgacugcggcaacgucuccgucaccuucgaccccuucugcuaccucuccgucccccuccccaucucccacaagcgcguccucgaggucuucuucauccccauggacccccgccgcaagcccgagcagcaccgccucgucguccccaagaagggcaagaucuccgaccucugcgucgcccucuccaagcacaccggcaucucccccgagcgcaugauggucgccgacgucuucucccaccgcuucuacaagcucuaccagcucgaggagccccucuccuccauccucgaccgcgacgacaucuucgucuacgaggucuccggccgcaucgaggccaucgagggcucccgcgaggacaucgucguccccgucuaccuccgcgagcgcacccccgcccgcgacuacaacaacuccuacuacggccucaugcucuucggccacccccuccucgucuccgucccccgcgaccgcuucaccugggagggccucuacaacguccucauguaccgccucucccgcuacgucaccaagcccaacuccgacgacgaggacgacggcgacgagaaggaggacgacgaggaggacaaggacgacguccccggccccuccaccggcggcucccuccgcgaccccgagcccgagcaggccggccccuccuccggcgucaccaaccgcugccccuuccuccucgacaacugccucggcaccucccaguggcccccccgccgccgccgcaagcagcucuucacccuccagaccgucaacuccaacggcaccuccgaccgcaccaccucccccgaggagguccacgcccagcccuacaucgccaucgacugggagcccgagaugaagaagcgcuacuacgacgaggucgaggccgagggcuacgucaagcacgacugcgucggcuacgucaugaagaaggcccccguccgccuccaggagugcaucgagcucuucaccaccgucgagacccucgagaaggagaaccccugguacugccccuccugcaagcagcaccagcucgccaccaagaagcucgaccucuggaugcuccccgagauccucaucauccaccucaagcgcuucuccuacaccaaguucucccgcgagaagcucgacacccucgucgaguuccccauccgcgaccucgacuucuccgaguucgucauccagccccagaacgaguccaaccccgagcucuacaaguacgaccucaucgccgucuccaaccacuacggcggcaugcgcgacggccacuacaccaccuucgccugcaacaaggacuccggccaguggcacuacuucgacgacaacuccgucucccccgucaacgagaaccagaucgaguccaaggccgccuacguccucuucuaccagcgccaggacgucgcccgccgccuccucucccccgccggcuccuccggcgcccccgccucccccgccugcuccuccccccccuccuccgaguucauggacgucaacuga

SEQ ID NO: 51556 - RNA, 1113 nt, Artificial Sequence
  derived and/or modified sequence opt2 from USP12__Homo_sapiens__NP_872294
auggagauccucaugaccgucuccaaguucgccuccaucugcaccaugggcgccaacgccuccgcccucgagaaggagaucggccccgagcaguuccccgucaacgagcacuacuucggccucgucaacuucggcaacaccugcuacugcaacuccguccuccaggcccucuacuucugccgccccuuccgcgagaagguccucgccuacaagucccagccccgcaagaaggagucccuccucaccugccucgccgaccucuuccacuccaucgccacccagaagaagaaggucggcgucaucccccccaagaaguucaucacccgccuccgcaaggagaacgagcucuucgacaacuacaugcagcaggacgcccacgaguuccucaacuaccuccucaacaccaucgccgacauccuccaggaggagcgcaagcaggagaagcagaacggccgccuccccaacggcaacaucgacaacgagaacaacaacuccacccccgaccccaccuggguccacgagaucuuccagggcacccucaccaacgagacccgcugccucaccugcgagaccaucuccuccaaggacgaggacuuccucgaccucuccgucgacgucgagcagaacaccuccaucacccacugccuccgcggcuucuccaacaccgagacccucugcuccgaguacaaguacuacugcgaggagugccgcuccaagcaggaggcccacaagcgcaugaaggucaagaagcuccccaugauccucgcccuccaccucaagcgcuucaaguacauggaccagcuccaccgcuacaccaagcucuccuaccgcgucgucuucccccucgagcuccgccucuucaacaccuccggcgacgccaccaaccccgaccgcauguacgaccucgucgccgucgucguccacugcggcuccggccccaaccgcggccacuacaucgccaucgucaagucccacgacuucuggcuccucuucgacgacgacaucgucgagaagaucgacgcccaggccaucgaggaguucuacggccucaccuccgacaucuccaagaacuccgaguccggcuacauccucuucuaccagucccgcgacuga

SEQ ID NO: 51557 - RNA, 2592 nt, Artificial Sequence
  derived and/or modified sequence opt2 from USP13__Homo_sapiens__NP_003931
augcagcgccgcggcgcccucuucggcaugcccggcggcuccggcggccgcaagauggccgccggcgacaucggcgagcuccucgucccccacaugcccaccauccgcgucccccgcuccggcgaccgcgucuacaagaacgagugcgccuucuccuacgacucccccaacuccgagggcggccucuacgucugcaugaacaccuuccucgccuucggccgcgagcacgucgagcgccacuuccgcaagaccggccaguccgucuacaugcaccucaagcgccacguccgcgagaagguccgcggcgccuccggcggcgcccuccccaagcgccgcaacuccaagaucuuccucgaccucgacaccgacgacgaccucaacuccgacgacuacgaguacgaggacgaggccaagcucgucaucuuccccgaccacuacgagaucgcccuccccaacaucgaggagcuccccgcccucgucaccaucgccugcgacgccguccucuccuccaagucccccuaccgcaagcaggaccccgacaccugggagaacgagcuccccgucuccaaguacgccaacaaccucacccagcucgacaacggcguccgcaucccccccuccggcuggaagugcgcccgcugcgaccuccgcgagaaccucuggcucaaccucaccgacggcuccguccucugcggcaagugguucuucgacuccuccggcggcaacggccacgcccucgagcacuaccgcgacaugggcuacccccucgccgucaagcucggcaccaucacccccgacggcgccgacgucuacuccuuccaggaggaggagcccguccucgacccccaccucgccaagcaccucgcccacuucggcaucgacaugcuccacaugcacggcaccgagaacggccuccaggacaacgacaucaagcuccgcgucuccgagugggaggucauccaggaguccggcaccaagcucaagcccauguacggccccggcuacaccggccucaagaaccucggcaacuccugcuaccucuccuccgucaugcaggccaucuucuccauccccgaguuccagcgcgccuacgucggcaaccucccccgcaucuucgacuacuccccccucgaccccacccaggacuucaacacccagaugaccaagcucggccacggccuccucuccggccaguacuccaagccccccgucaaguccgagcucaucgagcaggucaugaaggaggagcacaagccccagcagaacggcaucuccccccgcauguucaaggccuucgucuccaagucccaccccgaguucuccuccaaccgccagcaggacgcccaggaguucuuccuccaccucgucaaccucgucgagcgcaaccgcaucggcuccgagaaccccuccgacgucuuccgcuuccucgucgaggagcgcauccagugcugccagacccgcaagguccgcuacaccgagcgcgucgacuaccucaugcagcuccccgucgccauggaggccgccaccaacaaggacgagcucaucgccuacgagcucacccgccgcgaggccgaggccaaccgccgcccccuccccgagcucguccgcgccaagauccccuucuccgccugccuccaggccuucuccgagcccgagaacgucgacgacuucugguccuccgcccuccaggccaaguccgccggcgucaagaccucccgcuucgccuccuuccccgaguaccucgucguccagaucaagaaguucaccuucggccucgacuggguccccaagaaguucgacgucuccaucgacaugcccgaccuccucgacaucaaccaccuccgcgcccgcggccuccagcccggcgaggaggagcuccccgacaucuccccccccaucgucauccccgacgacuccaaggaccgccucaugaaccagcucaucgaccccuccgacaucgacgaguccuccgucaugcagcucgccgagaugggcuucccccucgaggccugccgcaaggccgucuacuucaccggcaacaugggcgccgaggucgccuucaacuggaucaucguccacauggaggagcccgacuucgccgagccccucaccaugcccggcuacggcggcgccgccuccgccggcgccuccgucuucggcgccuccggccucgacaaccagccccccgaggagaucgucgccaucaucaccuccaugggcuuccagcgcaaccaggccauccaggcccuccgcgccaccaacaacaaccucgagcgcgcccucgacuggaucuucucccaccccgaguucgaggaggacuccgacuucgucaucgagauggagaacaacgccaacgccaacaucaucuccgaggccaagcccgagggcccccgcgucaaggacggcuccggcaccuacgagcucuucgccuucaucucccacaugggcaccuccaccauguccggccacuacaucugccacaucaagaaggagggccgcugggucaucuacaacgaccacaaggucugcgccuccgagcgcccccccaaggaccucggcuacauguacuucuaccgccgcauccccuccuga

SEQ ID NO: 51558 - RNA, 1380 nt, Artificial Sequence
  derived and/or modified sequence opt2 from USP14__Homo_sapiens__NP_001032411
augccccucuacuccgucaccgucaaguggggcaaggagaaguucgagggcgucgagcucaacaccgacgagccccccauggucuucaaggcccagcucuucgcccucaccggcguccagcccgcccgccagaaggucauggucaagggcggcacccucaaggacgacgacuggggcaacaucaagaucaagaacauggagcuccccugcggccucaccaaccucggcaacaccugcuacaugaacgccaccguccagugcauccgcuccguccccgagcucaaggacgcccucaagcgcuacgccggcgcccuccgcgccuccggcgagauggccuccgcccaguacaucaccgccgcccuccgcgaccucuucgacuccauggacaagaccuccuccuccaucccccccaucauccuccuccaguuccuccacauggccuucccccaguucgccgagaagggcgagcagggccaguaccuccagcaggacgccaacgagugcuggauccagaugaugcgcguccuccagcagaagcucgaggccaucgaggacgacuccgucaaggagaccgacuccuccuccgccuccgccgccacccccuccaagaagaagucccucaucgaccaguucuucggcgucgaguucgagaccaccaugaagugcaccgaguccgaggaggaggaggucaccaagggcaaggagaaccagcuccagcucuccugcuucaucaaccaggaggucaaguaccucuucaccggccucaagcuccgccuccaggaggagaucaccaagcagucccccacccuccagcgcaacgcccucuacaucaaguccuccaagaucucccgccuccccgccuaccucaccauccagaugguccgcuucuucuacaaggagaaggaguccgucaacgccaagguccucaaggacgucaaguucccccucaugcucgacauguacgagcucugcacccccgagcuccaggagaagauggucuccuuccgcuccaaguucaaggaccucgaggacaagaaggucaaccagcagcccaacaccuccgacaagaaguccuccccccagaaggaggucaaguacgagcccuucuccuucgccgacgacaucggcuccaacaacugcggcuacuacgaccuccaggccguccucacccaccagggccgcuccuccuccuccggccacuacgucuccugggucaagcgcaagcaggacgaguggaucaaguucgacgacgacaaggucuccaucgucacccccgaggacauccuccgccucuccggcggcggcgacuggcacaucgccuacguccuccucuacggcccccgccgcgucgagaucauggaggaggaguccgagcaguga

SEQ ID NO: 51559 - RNA, 2946 nt, Artificial Sequence
  derived and/or modified sequence opt2 from USP15__Homo_sapiens__NP_001239007
auggccgagggcggcgccgccgaccucgacacccagcgcuccgacaucgccacccuccucaagaccucccuccgcaagggcgacaccugguaccucgucgacucccgcugguucaagcaguggaagaaguacgucggcuucgacuccugggacaaguaccagaugggcgaccagaacgucuaccccggccccaucgacaacuccggccuccucaaggacggcgacgcccagucccucaaggagcaccucaucgacgagcucgacuacauccuccuccccaccgagggcuggaacaagcucgucuccugguacacccucauggagggccaggagcccaucgcccgcaaggucgucgagcagggcauguucgucaagcacugcaaggucgaggucuaccucaccgagcucaagcucugcgagaacggcaacaugaacaacgucgucacccgccgcuucuccaaggccgacaccaucgacaccaucgagaaggagauccgcaagaucuucuccauccccgacgagaaggagacccgccucuggaacaaguacauguccaacaccuucgagccccucaacaagcccgacuccaccauccaggacgccggccucuaccagggccagguccucgucaucgagcagaagaacgaggacggcaccuggccccgcggccccuccacccccaagucccccggcgccuccaacuucuccacccuccccaagaucucccccuccucccucuccaacaacuacaacaacaugaacaaccgcaacgucaagaacuccaacuacugccuccccuccuacaccgccuacaagaacuacgacuacuccgagcccggccgcaacaacgagcagcccggccucugcggccucuccaaccucggcaacaccugcuucaugaacuccgccauccagugccucuccaacacccccccccucaccgaguacuuccucaacgacaaguaccaggaggagcucaacuucgacaacccccucggcaugcgcggcgagaucgccaaguccuacgccgagcucaucaagcagaugugguccggcaaguucuccuacgucaccccccgcgccuucaagacccaggucggccgcuucgccccccaguucuccggcuaccagcagcaggacugccaggagcuccucgccuuccuccucgacggccuccacgaggaccucaaccgcauccgcaagaagcccuacauccagcucaaggacgccgacggccgccccgacaaggucgucgccgaggaggccugggagaaccaccucaagcgcaacgacuccaucaucgucgacaucuuccacggccucuucaaguccacccucgucugccccgagugcgccaagaucuccgucaccuucgaccccuucugcuaccucacccucccccuccccaugaagaaggagcgcacccucgaggucuaccucguccgcauggacccccucaccaagcccaugcaguacaaggucgucguccccaagaucggcaacauccucgaccucugcaccgcccucuccgcccucuccggcauccccgccgacaagaugaucgucaccgacaucuacaaccaccgcuuccaccgcaucuucgccauggacgagaaccucuccuccaucauggagcgcgacgacaucuacgucuucgagaucaacaucaaccgcaccgaggacaccgagcacgucaucauccccgucugccuccgcgagaaguuccgccacuccuccuacacccaccacaccggcuccucccucuucggccagcccuuccucauggccgucccccgcaacaacaccgaggacaagcucuacaaccuccuccuccuccgcaugugccgcuacgucaagaucuccaccgagaccgaggagaccgagggcucccuccacugcugcaaggaccagaacaucaacggcaacggccccaacggcauccacgaggagggcucccccuccgagauggagaccgacgagcccgacgacgaguccucccaggaccaggagcuccccuccgagaacgagaacucccaguccgaggacuccgucggcggcgacaacgacuccgagaacggccucugcaccgaggacaccugcaagggccagcucaccggccacaagaagcgccucuucaccuuccaguucaacaaccucggcaacaccgacaucaacuacaucaaggacgacacccgccacauccgcuucgacgaccgccagcuccgccucgacgagcgcuccuuccucgcccucgacugggaccccgaccucaagaagcgcuacuucgacgagaacgccgccgaggacuucgagaagcacgaguccgucgaguacaagccccccaagaagcccuucgucaagcucaaggacugcaucgagcucuucaccaccaaggagaagcucggcgccgaggaccccugguacugccccaacugcaaggagcaccagcaggccaccaagaagcucgaccucuggucccucccccccguccucgucguccaccucaagcgcuucuccuacucccgcuacaugcgcgacaagcucgacacccucgucgacuuccccaucaacgaccucgacauguccgaguuccucaucaaccccaacgccggccccugccgcuacaaccucaucgccgucuccaaccacuacggcggcaugggcggcggccacuacaccgccuucgccaagaacaaggacgacggcaagugguacuacuucgacgacuccuccgucuccaccgccuccgaggaccagaucgucuccaaggccgccuacguccucuucuaccagcgccaggacaccuucuccggcaccggcuucuucccccucgaccgcgagaccaagggcgccuccgccgccaccggcaucccccucgaguccgacgaggacuccaacgacaacgacaacgacaucgagaacgagaacugcaugcacaccaacuga

SEQ ID NO: 51560 - RNA, 1593 nt, Artificial Sequence
  derived and/or modified sequence opt2 from USP17L2__Homo_sapiens__NP_958804
auggaggacgacucccucuaccucggcggcgaguggcaguucaaccacuucuccaagcucaccuccucccgccccgacgccgccuucgccgagauccagcgcaccucccuccccgagaaguccccccucuccuccgaggcccgcgucgaccucugcgacgaccucgcccccgucgcccgccagcucgccccccgcaagaagcucccccucuccucccgccgccccgccgccgucggcgccggccuccagaacaugggcaacaccugcuacgagaacgccucccuccagugccucaccuacacccccccccucgccaacuacaugcucucccgcgagcacucccagaccugccagcgccccaagugcugcaugcucugcaccaugcaggcccacaucaccugggcccuccacucccccggccacgucauccagcccucccaggcccucgccgccggcuuccaccgcggcaagcaggaggacgcccacgaguuccucauguucaccgucgacgccaugaagaaggccugccuccccggccacaagcaggucgaccaccacuccaaggacaccacccucauccaccagaucuucggcggcugcuggcgcucccagaucaagugccuccacugccacggcaucuccgacaccuucgaccccuaccucgacaucgcccucgacauccaggccgcccaguccgucaagcaggcccucgagcagcucgucaagcccgaggagcucaacggcgagaacgccuaccacugcggccucugccuccagcgcgcccccgccuccaagacccucacccuccacaccuccgccaagguccucauccucguccucaagcgcuucuccgacgucaccggcaacaagcucgccaagaacguccaguaccccgagugccucgacaugcagcccuacaugucccagcagaacaccggcccccucgucuacguccucuacgccguccucguccacgccggcugguccugccacgacggccacuacuucuccuacgucaaggcccaggagggccagugguacaagauggacgacgccaaggucaccgccugcuccaucaccuccguccucucccagcaggccuacguccucuucuacauccagaaguccgagugggagcgccacuccgaguccgucucccgcggccgcgagccccgcgcccucggcgccgaggacaccgaccgccgcgccacccagggcgagcucaagcgcgaccaccccugccuccaggcccccgagcucgacgagcgccucgucgagcgcgccacccaggaguccacccucgaccacuggaaguucccccaggagcagaacaagaccaagcccgaguucaacguccgcaaggucgagggcacccucccccccaacguccucgucauccaccaguccaaguacaagugcggcaugaagaaccaccaccccgagcagcaguccucccuccucaaccucuccuccaccacccgcaccgaccaggaguccgucaacaccggcacccucgccucccuccagggccgcacccgccgcuccaagggcaagaacaagcacuccaagcgcgcccuccucgucugccaguga

SEQ ID NO: 51561 - RNA, 1593 nt, Artificial Sequence
  derived and/or modified sequence opt2 from USP17L30__Homo_sapiens__NP_001243796
auggaggacgacucccucuaccuccgcggcgaguggcaguucaaccacuucuccaagcucaccuccucccgccccgacgccgccuucgccgagauccagcgcaccucccuccccgagaaguccccccucuccugcgagacccgcgucgaccucugcgacgaccucgcccccgucgcccgccagcucgccccccgcgagaagcucccccucuccucccgccgccccgccgccgucggcgccggccuccagaacaugggcaacaccugcuacgucaacgccucccuccagugccucaccuacacccccccccucgccaacuacaugcucucccgcgagcacucccagaccugccaccgccacaagggcugcaugcucugcaccaugcaggcccacaucacccgcgcccuccacaaccccggccacgucauccagcccucccaggcccucgccgccggcuuccaccgcggcaagcaggaggacgcccacgaguuccucauguucaccgucgacgccaugaagaaggccugccuccccggccacaagcaggucgaccaccacuccaaggacaccacccucauccaccagaucuucggcggcuacuggcgcucccagaucaagugccuccacugccacggcaucuccgacaccuucgaccccuaccucgacaucgcccucgacauccaggccgcccaguccguccagcaggcccucgagcagcucgucaagcccgaggagcucaacggcgagaacgccuaccacugcggcgucugccuccagcgcgcccccgccuccaagacccucacccuccacaccuccgccaagguccucauccucguccucaagcgcuucuccgacgucaccggcaacaagaucgccaagaacguccaguaccccgagugccucgacaugcagcccuacaugucccagcccaacaccggcccccucgucuacguccucuacgccguccucguccacgccggcugguccugccacaacggccacuacuucuccuacgucaaggcccaggagggccagugguacaagauggacgacgccgaggucaccgccuccuccaucaccuccguccucucccagcaggccuacguccucuucuacauccagaaguccgagugggagcgccacuccgaguccgucucccgcggccgcgagccccgcgcccucggcgccgaggacaccgaccgccgcgccacccagggcgagcucaagcgcgaccaccccugccuccaggcccccgagcucgacgagcaccucgucgagcgcgccacccaggaguccacccucgaccacuggaaguuccuccaggagcagaacaagaccaagcccgaguucaacguccgcaaggucgagggcacccucccccccgacguccucgucauccaccaguccaaguacaagugcggcaugaagaaccaccaccccgagcagcaguccucccuccucaaccucuccuccuccacccccacccaccaggaguccaugaacaccggcacccucgccucccuccgcggccgcgcccgccgcuccaagggcaagaacaagcacuccaagcgcgcccuccucgucugccaguga

SEQ ID NO: 51562 - RNA, 1119 nt, Artificial Sequence
  derived and/or modified sequence opt2 from USP18__Homo_sapiens__NP_059110
auguccaaggccuucggccuccuccgccagaucugccaguccauccucgccgaguccucccagucccccgccgaccucgaggagaagaaggaggaggacuccaacaugaagcgcgagcagccccgcgagcgcccccgcgccugggacuacccccacggccucgucggccuccacaacaucggccagaccugcugccucaacucccucauccaggucuucgucaugaacgucgacuucacccgcauccucaagcgcaucaccgucccccgcggcgccgacgagcagcgccgcuccguccccuuccagaugcuccuccuccucgagaagaugcaggacucccgccagaaggccguccgcccccucgagcucgccuacugccuccagaagugcaacgucccccucuucguccagcacgacgccgcccagcucuaccucaagcucuggaaccucaucaaggaccagaucaccgacguccaccucgucgagcgccuccaggcccucuacaccauccgcgucaaggacucccucaucugcgucgacugcgccauggaguccucccgcaacuccuccaugcucacccucccccucucccucuucgacgucgacuccaagccccucaagacccucgaggacgcccuccacugcuucuuccagccccgcgagcucuccuccaaguccaagugcuucugcgagaacugcggcaagaagacccgcggcaagcagguccucaagcucacccaccucccccagacccucaccauccaccucaugcgcuucuccauccgcaacucccagacccgcaagaucugccacucccucuacuucccccagucccucgacuucucccagauccuccccaugaagcgcgaguccugcgacgccgaggagcaguccggcggccaguacgagcucuucgccgucaucgcccacgucggcauggccgacuccggccacuacugcgucuacauccgcaacgccgucgacggcaagugguucugcuucaacgacuccaacaucugccucgucuccugggaggacauccagugcaccuacggcaaccccaacuaccacuggcaggagaccgccuaccuccucgucuacaugaagauggagugcuga

SEQ ID NO: 51563 - RNA, 2745 nt, Artificial Sequence
  derived and/or modified sequence opt2 from USP20__Homo_sapiens__XP_005251722
augggcgacucccgcgaccucugcccccaccucgacuccaucggcgaggucaccaaggaggaccuccuccucaaguccaagggcaccugccaguccugcggcgucaccggccccaaccucugggccugccuccaggucgccugccccuacgucggcugcggcgaguccuucgccgaccacuccaccauccacgcccaggccaagaagcacaaccucaccgucaaccucaccaccuuccgccucuggugcuacgccugcgagaaggaggucuuccucgagcagcgccucgccgccccccuccucggcuccuccuccaaguucuccgagcaggacucccccccccccucccacccccucaaggccguccccaucgccgucgccgacgagggcgaguccgaguccgaggacgacgaccucaagccccgcggccucaccggcaugaagaaccucggcaacuccugcuacaugaacgccgcccuccaggcccucuccaacugccccccccucacccaguucuuccucgagugcggcggccucguccgcaccgacaagaagcccgcccucugcaaguccuaccagaagcucgucuccgaggucuggcacaagaagcgccccuccuacgucguccccaccucccucucccacggcaucaagcucgucaaccccauguuccgcggcuacgcccagcaggacacccaggaguuccuccgcugccucauggaccagcuccacgaggagcucaaggagcccgucgucgccaccgucgcccucaccgaggcccgcgacuccgacuccuccgacaccgacgagaagcgcgagggcgaccgcucccccuccgaggacgaguuccucuccugcgacuccuccuccgaccgcggcgagggcgacggccagggccgcggcggcggcuccucccaggccgagaccgagcuccucauccccgacgaggccggccgcgccaucuccgagaaggagcgcaugaaggaccgcaaguucuccuggggccagcagcgcaccaacuccgagcaggucgacgaggacgccgacgucgacaccgccauggccgcccucgacgaccagcccgccgaggcccagccccccuccccccgcuccuccucccccugccgcacccccgagcccgacaacgacgcccaccuccgcuccuccucccgccccugcucccccguccaccaccacgagggccacgccaagcucuccuccucccccccccgcgccucccccguccgcauggcccccuccuacguccucaagaaggcccagguccucuccgccggcucccgccgccgcaaggagcagcgcuaccgcuccgucaucuccgacaucuucgacggcuccauccucucccucguccagugccucaccugcgaccgcgucuccaccaccgucgagaccuuccaggaccucucccuccccauccccggcaaggaggaccucgccaagcuccacuccgccaucuaccagaacguccccgccaagcccggcgccugcggcgacuccuacgccgcccagggcuggcucgccuucaucgucgaguacauccgccgcuucgucgucuccugcacccccuccugguucuggggccccgucgucacccucgaggacugccucgccgccuucuucgccgccgacgagcucaagggcgacaacauguacuccugcgagcgcugcaagaagcuccgcaacggcgucaaguacugcaagguccuccgccuccccgagauccucugcauccaccucaagcgcuuccgccacgaggucauguacuccuucaagaucaacucccacgucuccuucccccucgagggccucgaccuccgccccuuccucgccaaggagugcaccucccagaucaccaccuacgaccuccucuccgucaucugccaccacggcaccgccggcuccggccacuacaucgccuacugccagaacgucaucaacggccagugguacgaguucgacgaccaguacgucaccgagguccacgagaccgucguccagaacgccgagggcuacguccucuucuaccgcaaguccuccgaggaggccaugcgcgagcgccagcaggucgucucccucgccgccaugcgcgagcccucccuccuccgcuucuacgucucccgcgaguggcucaacaaguucaacaccuucgccgagcccggccccaucaccaaccagaccuuccucugcucccacggcggcauccccccccacaaguaccacuacaucgacgaccucgucgucauccucccccagaacgucugggagcaccucuacaaccgcuucggcggcggccccgccgucaaccaccucuacgucugcuccaucugccaggucgagaucgaggcccucgccaagcgccgccgcaucgagaucgacaccuucaucaagcucaacaaggccuuccaggccgaggagucccccggcgucaucuacugcaucuccaugcagugguuccgcgagugggaggccuucgucaagggcaaggacaacgagccccccggccccaucgacaacucccgcaucgcccaggucaagggcuccggccacguccagcucaagcagggcgccgacuacggccagaucuccgaggagaccuggaccuaccucaacucccucuacggcggcggccccgagaucgccauccgccaguccgucgcccagccccucggccccgagaaccuccacggcgagcagaagaucgaggccgagacccgcgccgucuga

SEQ ID NO: 51564 - RNA, 1578 nt, Artificial Sequence
  derived and/or modified sequence opt2 from USP22__Homo_sapiens__NP_056091
auggucucccgccccgagcccgagggcgaggccauggacgccgagcucgccgucgccccccccggcugcucccaccucggcuccuucaaggucgacaacuggaagcagaaccuccgcgccaucuaccagugcuucgucugguccggcaccgccgaggcccgcaagcgcaaggccaaguccugcaucugccacgucugcggcguccaccucaaccgccuccacuccugccucuacugcgucuucuucggcugcuucaccaagaagcacauccacgagcacgccaaggccaagcgccacaaccucgccaucgaccucauguacggcggcaucuacugcuuccucugccaggacuacaucuacgacaaggacauggagaucaucgccaaggaggagcagcgcaaggccuggaagaugcagggcgucggcgagaaguucuccaccugggagcccaccaagcgcgagcucgagcuccucaagcacaaccccaagcgccgcaagaucaccuccaacugcaccaucggccuccgcggccucaucaaccucggcaacaccugcuucaugaacugcaucguccaggcccucacccacaccccccuccuccgcgacuucuuccucuccgaccgccaccgcugcgagaugcagucccccuccuccugccucgucugcgagauguccucccucuuccaggaguucuacuccggccaccgcuccccccacauccccuacaagcuccuccaccucgucuggacccacgcccgccaccucgccggcuacgagcagcaggacgcccacgaguuccucaucgccgcccucgacguccuccaccgccacugcaagggcgacgacaacggcaagaaggccaacaaccccaaccacugcaacugcaucaucgaccagaucuucaccggcggccuccaguccgacgucaccugccaggucugccacggcgucuccaccaccaucgaccccuucugggacaucucccucgaccuccccggcuccuccacccccuucuggccccucucccccggcuccgagggcaacgucgucaacggcgagucccacgucuccggcaccaccacccucaccgacugccuccgccgcuucacccgccccgagcaccucggcuccuccgccaagaucaagugcuccggcugccacuccuaccaggaguccaccaagcagcucaccaugaagaagcuccccaucgucgccugcuuccaccucaagcgcuucgagcacuccgccaagcuccgccgcaagaucaccaccuacgucuccuucccccucgagcucgacaugacccccuucauggccuccuccaaggagucccgcaugaacggccaguaccagcagcccaccgacucccucaacaacgacaacaaguacucccucuucgccgucgucaaccaccagggcacccucgaguccggccacuacaccuccuucauccgccagcacaaggaccagugguucaagugcgacgacgccaucaucaccaaggccuccaucaaggacguccucgacuccgagggcuaccuccucuucuaccacaagcaguuccucgaguacgaguga

SEQ ID NO: 51565 - RNA, 3378 nt, Artificial Sequence
  derived and/or modified sequence opt2 from USP25__Homo_sapiens__NP_001269970
augaccgucgagcagaacguccuccagcaguccgccgcccagaagcaccagcagaccuuccucaaccagcuccgcgagaucaccggcaucaacgacacccagauccuccagcaggcccucaaggacuccaacggcaaccucgagcucgccgucgccuuccucaccgccaagaacgccaagaccccccagcaggaggagaccaccuacuaccagaccgcccuccccggcaacgaccgcuacaucuccgucggcucccaggccgacaccaacgucaucgaccucaccggcgacgacaaggacgaccuccagcgcgccaucgcccucucccucgccgaguccaaccgcgccuuccgcgagaccggcaucaccgacgaggagcaggccaucucccgcguccucgaggccuccaucgccgagaacaaggccugccucaagcgcacccccaccgaggucuggcgcgacucccgcaaccccuacgaccgcaagcgccaggacaaggcccccgucggccucaagaacgucggcaacaccugcugguucuccgccgucauccagucccucuucaaccuccucgaguuccgccgccucguccucaacuacaagccccccuccaacgcccaggaccucccccgcaaccagaaggagcaccgcaaccuccccuucaugcgcgagcuccgcuaccucuucgcccuccucgucggcaccaagcgcaaguacgucgaccccucccgcgccgucgagauccucaaggacgccuucaaguccaacgacucccagcagcaggacgucuccgaguucacccacaagcuccucgacuggcucgaggacgccuuccagaugaaggccgaggaggagaccgacgaggagaagcccaagaaccccauggucgagcucuucuacggccgcuuccucgccgucggcguccucgagggcaagaaguucgagaacaccgagauguucggccaguacccccuccaggucaacggcuucaaggaccuccacgagugccucgaggccgccaugaucgagggcgagaucgagucccuccacuccgagaacuccggcaaguccggccaggagcacugguucaccgagcucccccccguccucaccuucgagcucucccgcuucgaguucaaccaggcccucggccgccccgagaagauccacaacaagcucgaguucccccagguccucuaccucgaccgcuacaugcaccgcaaccgcgagaucacccgcaucaagcgcgaggagaucaagcgccucaaggacuaccucaccguccuccagcagcgccucgagcgcuaccucuccuacggcuccggccccaagcgcuucccccucgucgacguccuccaguacgcccucgaguucgccuccuccaagcccgucugcaccucccccgucgacgacaucgacgccuccuccccccccuccggcuccauccccucccagacccuccccuccaccaccgagcagcagggcgcccucuccuccgagcuccccuccaccucccccuccuccgucgccgccaucuccucccgcuccgucauccacaagcccuucacccagucccgcaucccccccgaccuccccaugcaccccgccccccgccacaucaccgaggaggagcucuccguccucgaguccugccuccaccgcuggcgcaccgagaucgagaacgacacccgcgaccuccaggaguccaucucccgcauccaccgcaccaucgagcucauguacuccgacaaguccaugauccagguccccuaccgccuccacgccguccucguccacgagggccaggccaacgccggccacuacugggccuacaucuucgaccaccgcgagucccgcuggaugaaguacaacgacaucgccgucaccaaguccuccugggaggagcucguccgcgacuccuucggcggcuaccgcaacgccuccgccuacugccucauguacaucaacgacaaggcccaguuccucauccaggaggaguucaacaaggagaccggccagccccucgucggcaucgagacccucccccccgaccuccgcgacuucgucgaggaggacaaccagcgcuucgagaaggagcucgaggagugggacgcccagcucgcccagaaggcccuccaggagaagcuccucgccucccagaagcuccgcgaguccgagaccuccgucaccaccgcccaggccgccggcgaccccgaguaccucgagcagcccucccgcuccgacuucuccaagcaccucaaggaggagaccauccagaucaucaccaaggccucccacgagcacgaggacaagucccccgagaccguccuccaguccaagcccgagaacaccaccucccagccccucuccaaccagcgcgucgucgaggucgccaucccccacgucggcaaguucaugaucgaguccaaggagggcggcuacgacgacgagaucaugaugacccccaacaugcagggcaucaucauggccaucggcaagucccgcuccgucuacgaccgcugcggccccgaggccggcuucuucaaggccaucaagcucgaguacgcccgccucgucaagcucgcccaggaggacaccccccccgagaccgacuaccgccuccaccacgucgucgucuacuucauccagaaccaggcccccaagaagaucaucgagaagacccuccucgagcaguucggcgaccgcaaccucuccuucgacgagcgcugccacaacaucaugaaggucgcccaggccaagcucgagaugaucaagcccgaggaggucaaccucgaggaguacgaggaguggcaccaggacuaccgcaaguuccgcgagaccaccauguaccucaucaucggccucgagaacuuccagcgcgaguccuacaucgacucccuccucuuccucaucugcgccuaccagaacaacaaggagcuccucuccaagggccucuaccgcggccacgacgaggagcucaucucccacuaccgccgcgagugccuccucaagcucaacgagcaggccgccgagcucuucgaguccggcgaggaccgcgaggucaacaacggccucaucaucaugaacgaguucaucguccccuuccucccccuccuccucgucgacgagauggaggagaaggacauccucgccgucgaggacaugcgcaaccgcuggugcuccuaccucggccaggagauggagccccaccuccaggagaagcucaccgacuuccuccccaagcuccucgacugcuccauggagaucaaguccuuccacgagccccccaagcuccccuccuacuccacccacgagcucugcgagcgcuucgcccgcaucaugcucucccucucccgcacccccgccgacggccgcuga

SEQ ID NO: 51566 - RNA, 2742 nt, Artificial Sequence
  derived and/or modified sequence opt2 from USP26__Homo_sapiens__NP_114113
auggccgcccucuuccuccgcggcuucguccagaucggcaacugcaagaccggcaucuccaaguccaaggaggccuucaucgaggccgucgagcgcaagaagaaggaccgccucguccucuacuucaaguccggcaaguacuccaccuuccgccucuccgacaacauccagaacgucguccucaaguccuaccgcggcaaccagaaccaccuccaccucacccuccagaacaacaacggccucuucaucgagggccucuccuccaccgacgccgagcagcucaagaucuuccucgaccgcguccaccagaacgagguccagccccccguccgccccggcaagggcggcuccgucuucuccuccaccacccagaaggagaucaacaagaccuccuuccacaaggucgacgagaaguccuccuccaaguccuucgagaucgccaagggcuccggcaccggcguccuccagcgcaugccccuccucaccuccaagcucacccucaccugcggcgagcucuccgagaaccagcacaagaagcgcaagcgcaugcucuccuccuccuccgagaugaacgaggaguuccucaaggagaacaacuccgucgaguacaagaaguccaaggccgacugcucccgcugcgucuccuacaaccgcgagaagcagcucaagcucaaggagcucgaggagaacaagaagcucgagugcgaguccuccugcaucaugaacgccaccggcaaccccuaccucgacgacaucggccuccuccaggcccucaccgagaagaugguccucgucuuccuccuccagcagggcuacuccgacggcuacaccaagugggacaagcucaagcucuucuucgagcucuuccccgagaagaucugccacggccuccccaaccucggcaacaccugcuacaugaacgccguccuccagucccuccucuccauccccuccuucgccgacgaccuccucaaccaguccuuccccuggggcaagaucccccucaacgcccucaccaugugccucgcccgccuccucuucuucaaggacaccuacaacaucgagaucaaggagaugcuccuccucaaccucaagaaggccaucuccgccgccgccgagaucuuccacggcaacgcccagaacgacgcccacgaguuccucgcccacugccucgaccagcucaaggacaacauggagaagcucaacaccaucuggaagcccaaguccgaguucggcgaggacaacuuccccaagcaggucuucgccgacgaccccgacaccuccggcuucuccugccccgucaucaccaacuucgagcucgagcuccuccacuccaucgccugcaaggccugcggccaggucauccucaagaccgagcucaacaacuaccucuccaucaaccucccccagcgcaucaaggcccaccccuccuccauccaguccaccuucgaccucuucuucggcgccgaggagcucgaguacaagugcgccaagugcgagcacaagaccuccgucggcguccacuccuucucccgccucccccgcauccucaucguccaccucaagcgcuacucccucaacgaguucugcgcccucaagaagaacgaccaggaggucaucaucuccaaguaccucaaggucuccucccacugcaacgagggcacccgccccccccucccccucuccgaggacggcgagaucaccgacuuccagcuccucaaggucauccgcaagaugaccuccggcaacaucuccgucuccuggcccgccaccaaggaguccaaggacauccucgccccccacaucggcuccgacaaggaguccgagcagaagaagggccagaccgucuucaagggcgccucccgccgccagcagcagaaguaccucggcaagaacuccaagcccaacgagcucgaguccgucuacuccggcgaccgcgccuucaucgagaaggagccccucgcccaccucaugaccuaccucgaggacaccucccucugccaguuccacaaggccggcggcaagcccgccuccucccccggcaccccccucuccaaggucgacuuccagaccguccccgagaaccccaagcgcaagaaguacgucaagaccuccaaguucgucgccuucgaccgcaucaucaaccccaccaaggaccucuacgaggacaagaacauccgcauccccgagcgcuuccagaaggucuccgagcagacccagcagugcgacggcaugcgcaucugcgagcaggccccccagcaggcccucccccaguccuuccccaagcccggcacccagggccacaccaagaaccuccuccgccccaccaagcucaaccuccagaaguccaaccgcaacucccuccucgcccucggcuccaacaagaacccccgcaacaaggacauccucgacaagaucaaguccaaggccaaggagaccaagcgcaacgacgacaagggcgaccacaccuaccgccucaucuccgucgucucccaccucggcaagacccucaaguccggccacuacaucugcgacgccuacgacuucgagaagcagaucugguucaccuacgacgacaugcgcguccucggcauccaggaggcccagaugcaggaggaccgccgcugcaccggcuacaucuucuucuacaugcacaacgagaucuucgaggagaugcucaagcgcgaggagaacgcccagcucaacuccaaggaggucgaggagacccuccagaaggaguga

SEQ ID NO: 51567 - RNA, 3234 nt, Artificial Sequence
  derived and/or modified sequence opt2 from USP28__Homo_sapiens__NP_065937
augaccgccgagcuccagcaggacgacgccgccggcgccgccgacggccacggcuccuccugccagaugcuccucaaccagcuccgcgagaucaccggcauccaggaccccuccuuccuccacgaggcccucaaggccuccaacggcgacaucacccaggccgucucccuccucaccgacgagcgcgucaaggagcccucccaggacaccgucgccaccgagcccuccgaggucgagggcuccgccgccaacaaggagguccucgccaaggucaucgaccucacccacgacaacaaggacgaccuccaggccgccaucgcccucucccuccucgagucccccaagauccaggccgacggccgcgaccucaaccgcaugcacgaggccaccuccgccgagaccaagcgcuccaagcgcaagcgcugcgaggucuggggcgagaaccccaaccccaacgacuggcgccgcgucgacggcuggcccgucggccucaagaacgucggcaacaccugcugguucuccgccgucauccagucccucuuccagcuccccgaguuccgccgccucguccucuccuacucccucccccagaacguccucgagaacugccgcucccacaccgagaagcgcaacaucauguucaugcaggagcuccaguaccucuucgcccucaugaugggcuccaaccgcaaguucgucgaccccuccgccgcccucgaccuccucaagggcgccuuccgcuccuccgaggagcagcagcaggacgucuccgaguucacccacaagcuccucgacuggcucgaggacgccuuccagcucgccgucaacgucaacuccccccgcaacaaguccgagaaccccaugguccagcucuucuacggcaccuuccucaccgagggcguccgcgagggcaagcccuucugcaacaacgagaccuucggccaguacccccuccaggucaacggcuaccgcaaccucgacgagugccucgagggcgccauggucgagggcgacgucgagcuccuccccuccgaccacuccgucaaguacggccaggagcgcugguucaccaagcucccccccguccucaccuucgagcucucccgcuucgaguucaaccagucccucggccagcccgagaagauccacaacaagcucgaguucccccagaucaucuacauggaccgcuacauguaccgcuccaaggagcucauccgcaacaagcgcgagugcauccgcaagcucaaggaggagaucaagauccuccagcagaagcucgagcgcuacgucaaguacggcuccggccccgcccgcuucccccuccccgacaugcucaaguacgucaucgaguucgccuccaccaagcccgccuccgaguccugcccccccgaguccgacacccacaugacccucccccucuccuccguccacugcuccgucuccgaccagaccuccaaggaguccaccuccaccgaguccuccucccaggacgucgaguccaccuucuccucccccgaggacucccuccccaaguccaagccccucaccuccucccgcuccuccauggagaugcccucccagcccgccccccgcaccgucaccgacgaggagaucaacuucgucaagaccugccuccagcgcuggcgcuccgagaucgagcaggacauccaggaccucaagaccugcaucgccuccaccacccagaccaucgagcagauguacugcgacccccuccuccgccagguccccuaccgccuccacgccguccucguccacgagggccaggccaacgccggccacuacugggccuacaucuacaaccagccccgccaguccuggcucaaguacaacgacaucuccgucaccgaguccuccugggaggaggucgagcgcgacuccuacggcggccuccgcaacgucuccgccuacugccucauguacaucaacgacaagcuccccuacuucaacgccgaggccgcccccaccgaguccgaccagauguccgaggucgaggcccucuccgucgagcucaagcacuacauccaggaggacaacuggcgcuucgagcaggaggucgaggagugggaggaggagcaguccugcaagaucccccagauggaguccuccaccaacuccuccucccaggacuacuccaccucccaggagcccuccgucgccuccucccacggcguccgcugccucuccuccgagcacgccgucaucgucaaggagcagaccgcccaggccaucgccaacaccgcccgcgccuacgagaaguccggcgucgaggccgcccucuccgaggucaugcucucccccgccaugcagggcgucauccucgccaucgccaaggcccgccagaccuucgaccgcgacggcuccgaggccggccucaucaaggccuuccacgaggaguacucccgccucuaccagcucgccaaggagacccccaccucccacuccgacccccgccuccagcacguccucgucuacuucuuccagaacgaggcccccaagcgcgucgucgagcgcacccuccucgagcaguucgccgacaagaaccucuccuacgacgagcgcuccaucuccaucaugaaggucgcccaggccaagcucaaggagaucggccccgacgacaugaacauggaggaguacaagaaguggcacgaggacuacucccucuuccgcaaggucuccgucuaccuccucaccggccucgagcucuaccagaagggcaaguaccaggaggcccucuccuaccucgucuacgccuaccaguccaacgccgcccuccucaugaagggcccccgccgcggcgucaaggaguccgucaucgcccucuaccgccgcaagugccuccucgagcucaacgccaaggccgccucccucuucgagaccaacgacgaccacuccgucaccgagggcaucaacgucaugaacgagcucaucauccccugcauccaccucaucaucaacaacgacaucuccaaggacgaccucgacgccaucgaggucaugcgcaaccacuggugcuccuaccucggccaggacaucgccgagaaccuccagcucugccucggcgaguuccucccccgccuccucgaccccuccgccgagaucaucguccucaaggagccccccaccauccgccccaacucccccuacgaccucugcucccgcuucgccgccgucauggaguccauccagggcgucuccaccgucaccgucaaguga

SEQ ID NO: 51568 - RNA, 1089 nt, Artificial Sequence
  derived and/or modified sequence opt2 from USP2__Homo_sapiens__NP_001230688
augcucguccccggcuccacccgccccuacuccaagaagcgccagaacuccaaguccgcccagggccucgccggccuccgcaaccucggcaacaccugcuucaugaacuccauccuccagugccucuccaacacccgcgagcuccgcgacuacugccuccagcgccucuacaugcgcgaccuccaccacggcuccaacgcccacaccgcccucgucgaggaguucgccaagcucauccagaccaucuggaccuccucccccaacgacgucgucucccccuccgaguucaagacccagauccagcgcuacgccccccgcuucgucggcuacaaccagcaggacgcccaggaguuccuccgcuuccuccucgacggccuccacaacgaggucaaccgcgucacccuccgccccaaguccaaccccgagaaccucgaccaccuccccgacgacgagaagggccgccagauguggcgcaaguaccucgagcgcgaggacucccgcaucggcgaccucuucgucggccagcucaaguccucccucaccugcaccgacugcggcuacugcuccaccgucuucgaccccuucugggaccucucccuccccaucgccaagcgcggcuaccccgaggucacccucauggacugcaugcgccucuucaccaaggaggacguccucgacggcgacgagaagcccaccugcugccgcugccgcggccgcaagcgcugcaucaagaaguucuccauccagcgcuuccccaagauccucguccuccaccucaagcgcuucuccgagucccgcauccgcaccuccaagcucaccaccuucgucaacuucccccuccgcgaccucgaccuccgcgaguucgccuccgagaacaccaaccacgccgucuacaaccucuacgccgucuccaaccacuccggcaccaccaugggcggccacuacaccgccuacugccgcucccccggcaccggcgaguggcacaccuucaacgacuccuccgucacccccauguccuccucccagguccgcaccuccgacgccuaccuccucuucuacgagcucgccuccccccccucccgcauguga

SEQ ID NO: 51569 - RNA, 4815 nt, Artificial Sequence
  derived and/or modified sequence opt2 from USP32__Homo_sapiens__NP_115971
augggcgccaaggagucccgcaucggcuuccucuccuacgaggaggcccuccgccgcgucaccgacgucgagcucaagcgccucaaggacgccuucaagcgcaccugcggccucuccuacuacaugggccagcacugcuucauccgcgagguccucggcgacggcgucccccccaaggucgccgaggucaucuacugcuccuucggcggcaccuccaagggccuccacuucaacaaccucaucgucggccucguccuccucacccgcggcaaggacgaggagaaggccaaguacaucuucucccucuucuccuccgaguccggcaacuacgucauccgcgaggagauggagcgcaugcuccacgucgucgacggcaagguccccgacacccuccgcaagugcuucuccgagggcgagaaggucaacuacgagaaguuccgcaacuggcucuuccucaacaaggacgccuucaccuucucccgcuggcuccucuccggcggcgucuacgucacccucaccgacgacuccgacacccccaccuucuaccagacccucgccggcgucacccaccucgaggaguccgacaucaucgaccucgagaagcgcuacuggcuccucaaggcccagucccgcaccggccgcuucgaccucgagaccuucggcccccucgucuccccccccauccgccccucccucuccgagggccucuucaacgccuucgacgagaaccgcgacaaccacaucgacuucaaggagaucuccugcggccucuccgccugcugccgcggcccccucgccgagcgccagaaguucugcuucaaggucuucgacgucgaccgcgacggcguccucucccgcgucgagcuccgcgacauggucgucgcccuccucgaggucuggaaggacaaccgcaccgacgacauccccgagcuccacauggaccucuccgacaucgucgagggcauccucaacgcccacgacaccaccaagaugggccaccucacccucgaggacuaccagaucugguccgucaagaacguccucgccaacgaguuccucaaccuccucuuccaggucugccacaucguccucggccuccgccccgccacccccgaggaggagggccagaucauccgcggcuggcucgagcgcgagucccgcuacggccuccaggccggccacaacugguucaucaucuccaugcagugguggcagcaguggaaggaguacgucaaguacgacgccaaccccgucgucaucgagcccuccuccguccucaacggcggcaaguacuccuucggcaccgccgcccaccccauggagcaggucgaggaccgcaucggcuccucccucuccuacgucaacaccaccgaggagaaguucuccgacaacaucuccaccgccuccgaggccuccgagaccgccggcuccggcuuccucuacuccgccacccccggcgccgacgucugcuucgcccgccagcacaacaccuccgacaacaacaaccagugccuccucggcgccaacggcaacauccuccuccaccucaacccccagaagcccggcgccaucgacaaccagccccucgucacccaggagcccgucaaggccaccucccucacccucgagggcggccgccucaagcgcaccccccagcucauccacggccgcgacuacgagaugguccccgagcccgucuggcgcgcccucuaccacugguacggcgccaaccucgcccucccccgccccgucaucaagaacuccaagaccgacauccccgagcucgagcucuucccccgcuaccuccucuuccuccgccagcagcccgccacccgcacccagcaguccaacaucugggucaacaugggcaacguccccucccccaacgccccccucaagcgcguccucgccuacaccggcugcuucucccgcaugcagaccaucaaggagauccacgaguaccucucccagcgccuccgcaucaaggaggaggacaugcgccucuggcucuacaacuccgagaacuaccucacccuccucgacgacgaggaccacaagcucgaguaccucaagauccaggacgagcagcaccucgucaucgagguccgcaacaaggacauguccuggcccgaggagauguccuucaucgccaacuccuccaagaucgaccgccacaagguccccaccgagaagggcgccaccggccucuccaaccucggcaacaccugcuucaugaacuccuccauccagugcgucuccaacacccagccccucacccaguacuucaucuccggccgccaccucuacgagcucaaccgcaccaaccccaucggcaugaagggccacauggccaagugcuacggcgaccucguccaggagcucugguccggcacccagaagaacgucgccccccucaagcuccgcuggaccaucgccaaguacgccccccgcuucaacggcuuccagcagcaggacucccaggagcuccucgccuuccuccucgacggccuccacgaggaccucaaccgcguccacgagaagcccuacgucgagcucaaggacuccgacggccgccccgacugggaggucgccgccgaggccugggacaaccaccuccgccgcaaccgcuccaucgucgucgaccucuuccacggccagcuccgcucccaggucaagugcaagaccugcggccacaucuccguccgcuucgaccccuucaacuuccucucccucccccuccccauggacuccuacaugcaccucgagaucaccgucaucaagcucgacggcaccacccccguccgcuacggccuccgccucaacauggacgagaaguacaccggccucaagaagcagcucuccgaccucugcggccucaacuccgagcagauccuccucgccgagguccacggcuccaacaucaagaacuucccccaggacaaccagaagguccgccucuccgucuccggcuuccucugcgccuucgagauccccguccccgucucccccaucuccgccuccucccccacccagaccgacuucuccuccucccccuccaccaacgagauguucacccucaccaccaacggcgaccucccccgccccaucuucauccccaacggcaugcccaacaccgucguccccugcggcaccgagaagaacuucaccaacggcauggucaacggccacaugcccucccuccccgacucccccuucaccggcuacaucaucgccguccaccgcaagaugaugcgcaccgagcucuacuuccucuccucccagaagaaccgccccucccucuucggcaugccccucaucguccccugcaccguccacacccgcaagaaggaccucuacgacgccgucuggauccaggucucccgccucgccuccccccuccccccccaggaggccuccaaccacgcccaggacugcgacgacuccaugggcuaccaguaccccuucacccuccgcgucguccagaaggacggcaacuccugcgccuggugccccugguaccgcuucugccgcggcugcaagaucgacugcggcgaggaccgcgccuucaucggcaacgccuacaucgccgucgacugggaccccaccgcccuccaccuccgcuaccagaccucccaggagcgcgucgucgacgagcacgaguccgucgagcagucccgccgcgcccaggccgagcccaucaaccucgacuccugccuccgcgccuucaccuccgaggaggagcucggcgagaacgagauguacuacugcuccaagugcaagacccacugccucgccaccaagaagcucgaccucuggcgccucccccccauccucaucauccaccucaagcgcuuccaguucgucaacggccgcuggaucaagucccagaagaucgucaaguucccccgcgaguccuucgaccccuccgccuuccucgucccccgcgaccccgcccucugccagcacaagccccucaccccccagggcgacgagcucuccgagccccgcauccucgcccgcgaggucaagaaggucgacgcccaguccuccgccggcgaggaggacguccuccucuccaagucccccuccucccucuccgccaacaucaucuccucccccaagggcucccccuccuccucccgcaaguccggcaccuccugccccuccuccaagaacuccucccccaacuccuccccccgcacccucggccgcuccaagggccgccuccgccucccccagaucggcuccaagaacaagcucuccuccuccaaggagaaccucgacgccuccaaggagaacggcgccggccagaucugcgagcucgccgacgcccucucccgcggccacguccucggcggcucccagcccgagcucgucaccccccaggaccacgaggucgcccucgccaacggcuuccucuacgagcacgaggccugcggcaacggcuacuccaacggccagcucggcaaccacuccgaggaggacuccaccgacgaccagcgcgaggacacccgcaucaagcccaucuacaaccucuacgccaucuccugccacuccggcauccucggcggcggccacuacgucaccuacgccaagaaccccaacugcaagugguacugcuacaacgacuccuccugcaaggagcuccaccccgacgagaucgacaccgacuccgccuacauccucuucuacgagcagcagggcaucgacuacgcccaguuccuccccaagaccgacggcaagaagauggccgacaccuccuccauggacgaggacuucgaguccgacuacaagaaguacugcguccuccaguga

SEQ ID NO: 51570 - RNA, 1803 nt, Artificial Sequence
  derived and/or modified sequence opt2 from USP33__Homo_sapiens__XP_011539358
augaccggcuccaacucccacaucaccauccucacccucaagguccucccccacuucgagucccucggcaagcaggagaagauccccaacaagauguccgccuuccgcaaccacugcccccaccucgacuccgucggcgagaucaccaaggaggaccucauccagaagucccucggcaccugccaggacugcaagguccagggccccaaccucugggccugccucgagaaccgcugcuccuacgucggcugcggcgagucccaggucgaccacuccaccauccacucccaggagaccaagcacuaccucaccgucaaccucaccacccuccgcgucuggugcuacgccugcuccaaggaggucuuccucgaccgcaagcucggcacccagcccucccucccccacguccgccagccccaccagauccaggagaacuccguccaggacuucaagauccccuccaacaccacccucaagaccccccucgucgccgucuucgacgaccucgacaucgaggccgacgaggaggacgagcuccgcgcccgcggccucaccggccucaagaacaucggcaacaccugcuacaugaacgccgcccuccaggcccucuccaacugccccccccucacccaguucuuccucgacugcggcggccucgcccgcaccgacaagaagcccgccaucugcaaguccuaccucaagcucaugaccgagcucuggcacaagucccgccccggcuccgucguccccaccacccucuuccagggcaucaagaccgucaaccccaccuuccgcggcuacucccagcaggacgcccaggaguuccuccgcugccucauggaccuccuccacgaggagcucaaggagcaggucauggaggucgaggaggacccccagaccaucaccaccgaggagaccauggaggaggacaagucccaguccgacgucgacuuccaguccugcgaguccugcuccaacuccgaccgcgccgagaacgagaacggcucccgcugcuucuccgaggacaacaacgagaccaccaugcucauccaggacgacgagaacaacuccgagauguccaaggacuggcagaaggagaagaugugcaacaagaucaacaaggucaacuccgagggcgaguucgacaaggaccgcgacuccaucuccgagaccgucgaccucaacaaccaggagaccgucaagguccagauccacucccgcgccuccgaguacaucaccgacguccacuccaacgaccucuccaccccccagauccuccccuccaacgagggcgucaacccccgccucuccgccuccccccccaaguccggcaaccucuggcccggccucgcccccccccacaagaaggcccaguccgccucccccaagcgcaagaagcagcacaagaaguaccgcuccgucaucuccgacaucuucgacggcaccaucaucuccuccguccagugccucaccugcgaccgcgucuccgucacccucgagaccuuccaggaccucucccuccccauccccggcaaggaggaccucgccaagcuccacuccuccucccaccccaccuccaucgucaaggccggcuccugcggcgaggccuacgccccccagggcuggaucgccuucuucauggaguacgucaagcgcuucgucgucuccugcguccccuccugguucuggggccccgucgucacccuccaggacugccucgccgccuucuucgcccgcgacgagcucaagggcgacaacauguacuccugcgagaagugcaagaagaacgccaccgccugcuga

SEQ ID NO: 51571 - RNA, 3372 nt, Artificial Sequence
  derived and/or modified sequence opt2 from USP36__Homo_sapiens__XP_005257599
augcccaucgucgacaagcucaaggaggcccucaagcccggccgcaaggacuccgccgacgacggcgagcucggcaagcuccucgccuccuccgccaagaagguccuccuccagaagaucgaguucgagcccgccuccaaguccuucuccuaccagcucgaggcccucaaguccaaguacguccuccucaaccccaagaccgagggcgccucccgccacaaguccggcgacgacccccccgcccgccgccagggcuccgagcacaccuacgaguccugcggcgacggcguccccgccccccagaagguccucuuccccaccgagcgccucucccuccgcugggagcgcgucuuccgcgucggcgccggccuccacaaccucggcaacaccugcuuccucaacgccaccauccagugccucaccuacacccccccccucgccaacuaccuccucuccaaggagcacgcccgcuccugccaccagggcuccuucugcaugcucugcgucaugcagaaccacaucguccaggccuucgccaacuccggcaacgccaucaagcccgucuccuucauccgcgaccucaagaagaucgcccgccacuuccgcuucggcaaccaggaggacgcccacgaguuccuccgcuacaccaucgacgccaugcagaaggccugccucaacggcugcgccaagcucgaccgccagacccaggccaccacccucguccaccagaucuucggcggcuaccuccgcucccgcgucaagugcuccgucugcaaguccgucuccgacaccuacgaccccuaccucgacgucgcccucgagauccgccaggccgccaacaucguccgcgcccucgagcucuucgucaaggccgacguccucuccggcgagaacgccuacaugugcgccaagugcaagaagaagguccccgccuccaagcgcuucaccauccaccgcaccuccaacguccucacccucucccucaagcgcuucgccaacuucuccggcggcaagaucaccaaggacgucggcuaccccgaguuccucaacauccgccccuacaugucccagaacaacggcgaccccgucauguacggccucuacgccguccucguccacuccggcuacuccugccacgccggccacuacuacugcuacgucaaggccuccaacggccagugguaccagaugaacgacucccucguccacuccuccaacgucaaggucguccucaaccagcaggccuacguccucuucuaccuccgcauccccggcuccaagaagucccccgagggccucaucucccgcaccggcuccuccucccuccccggccgccccuccgucauccccgaccacuccaagaagaacaucggcaacggcaucaucuccuccccccucaccggcaagcgccaggacuccggcaccaugaagaagccccacaccaccgaggagaucggcguccccaucucccgcaacggcuccacccucggccucaagucccagaacggcugcaucccccccaagcuccccuccggcucccccucccccaagcucucccagacccccacccacaugcccaccauccucgacgaccccggcaagaaggucaagaagcccgcccccccccagcacuucuccccccgcaccgcccagggccuccccggcaccuccaacuccaacuccucccgcuccggcucccagcgccagggcuccugggacucccgcgacgucguccucuccaccucccccaagcuccucgccaccgccaccgccaacggccacggccucaagggcaacgacgaguccgccggccucgaccgccgcggcuccuccuccuccucccccgagcacuccgccuccuccgacuccaccaaggccccccagaccccccgcuccggcgccgcccaccucugcgacucccaggagaccaacugcuccaccgccggccacuccaagaccccccccuccggcgccgacuccaagaccgucaagcucaagucccccguccucuccaacaccaccaccgagcccgccuccaccaugucccccccccccgccaagaagcucgcccucuccgccaagaaggccuccacccucuggcgcgccaccggcaacgaccuccgcccccccccccccucccccuccuccgaccucacccaccccaugaagaccucccaccccgucgucgccuccaccuggcccguccaccgcgcccgcgccgucucccccgccccccaguccuccucccgccuccagccccccuucuccccccaccccacccuccucuccuccacccccaagccccccggcaccuccgagccccgcuccugcuccuccaucuccaccgcccucccccaggucaacgaggaccucgucucccucccccaccagcuccccgaggccuccgagcccccccagucccccuccgagaagcgcaagaagaccuucgucggcgagccccagcgccucggcuccgagacccgccucccccagcacauccgcgaggccaccgccgccccccacggcaagcgcaagcgcaagaagaagaagcgccccgaggacaccgccgccuccgcccuccaggagggccagacccagcgccagcccggcucccccauguaccgccgcgagggccaggcccagcuccccgccguccgccgccaggaggacggcacccagccccaggucaacggccagcaggucggcugcgucaccgacggccaccacgccuccucccgcaagcgccgccgcaagggcgccgagggccucggcgaggagggcggccuccaccaggacccccuccgccacuccugcucccccaugggcgacggcgaccccgaggccauggaggaguccccccgcaagaagaagaagaagaagcgcaagcaggagacccagcgcgccgucgaggaggacggccaccucaagugcccccgcuccgccaagccccaggacgccgucguccccgaguccuccuccugcgcccccuccgccaacggcuggugccccggcgaccgcaugggccucucccaggccccccccgucuccuggaacggcgagcgcgaguccgacgucguccaggagcuccucaaguacuccuccgacaaggccuacggccgcaagguccucaccugggacggcaagauguccgccgucucccaggacgccaucgaggacucccgccaggcccgcaccgagaccgucgucgacgacugggacgaggaguucgaccgcggcaaggagaagaagaucaagaaguucaagcgcgagaagcgccgcaacuucaacgccuuccagaagcuccagacccgccgcaacuucugguccgucacccaccccgccaaggccgccucccucuccuaccgccgcuga

SEQ ID NO: 51572 - RNA, 2940 nt, Artificial Sequence
  derived and/or modified sequence opt2 from USP37__Homo_sapiens__XP_005246779
auguccccccucaagauccacggccccauccgcauccgcuccaugcagaccggcaucaccaaguggaaggagggcuccuucgagaucgucgagaaggagaacaaggucucccucgucguccacuacaacaccggcggcaucccccgcaucuuccagcucucccacaacaucaagaacgucguccuccgccccuccggcgccaagcagucccgccucaugcucacccuccaggacaacuccuuccucuccaucgacaagguccccuccaaggacgccgaggagaugcgccucuuccucgacgccguccaccagaaccgccuccccgccgccaugaagcccucccagggcuccggcuccuucggcgccauccucggcucccgcaccucccagaaggagaccucccgccagcucuccuacuccgacaaccaggccuccgccaagcgcggcucccucgagaccaaggacgacauccccuuccgcaagguccucggcaaccccggccgcggcuccaucaagaccgucgccggcuccggcaucgcccgcaccauccccucccucaccuccaccuccaccccccuccgcuccggccuccucgagaaccgcaccgagaagcgcaagcgcaugaucuccaccggcuccgagcucaacgaggacuaccccaaggagaacgacuccuccuccaacaacaaggccaugaccgaccccucccgcaaguaccucaccuccucccgcgagaagcagcucucccucaagcaguccgaggagaaccgcaccuccggccuccucccccuccaguccuccuccuucuacggcucccgcgccggcuccaaggagcacuccuccggcggcaccaaccucgaccgcaccaacgucuccucccagacccccuccgccaagcgcucccucggcuuccucccccagcccgucccccucuccgucaagaagcuccgcugcaaccaggacuacaccggcuggaacaagccccgcgucccccucuccucccaccagcagcagcagcuccagggcuucuccaaccucggcaacaccugcuacaugaacgccauccuccagucccucuucucccuccaguccuucgccaacgaccuccucaagcagggcauccccuggaagaagaucccccucaacgcccucauccgccgcuucgcccaccuccucgucaagaaggacaucugcaacuccgagaccaagaaggaccuccucaagaaggucaagaacgccaucuccgccaccgccgagcgcuucuccggcuacaugcagaacgacgcccacgaguuccucucccagugccucgaccagcucaaggaggacauggagaagcucaacaagaccuggaagaccgagcccgucuccggcgaggagaacucccccgacaucuccgccacccgcgccuacaccugccccgucaucaccaaccucgaguucgagguccagcacuccaucaucugcaaggccugcggcgagaucauccccaagcgcgagcaguucaacgaccucuccaucgaccucccccgccgcaagaagccccuccccccccgcuccauccaggacucccucgaccucuucuuccgcgccgaggagcucgaguacuccugcgagaagugcggcggcaagugcgcccucguccgccacaaguucaaccgccucccccgcguccucauccuccaccucaagcgcuacuccuucaacgucgcccucucccucaacaacaagaucggccagcaggucaucaucccccgcuaccucacccucuccucccacugcaccgagaacaccaagccccccuucacccucggcugguccgcccacauggccaucucccgcccccucaaggccucccagauggucaacuccugcaucaccucccccuccacccccuccaagaaguucaccuucaaguccaaguccucccucgcccucugccucgacuccgacuccgaggacgagcucaagcgcuccgucgcccucucccagcgccucugcgagaugcucggcaacgagcagcagcaggaggaccucgagaaggacuccaagcucugccccaucgagcccgacaaguccgagcucgagaacuccggcuucgaccgcauguccgaggaggagcuccucgccgccguccucgagaucuccaagcgcgacgccucccccucccucucccacgaggacgacgacaagcccaccuccucccccgacaccggcuucgccgaggacgacauccaggagaugcccgagaaccccgacaccauggagaccgagaagcccaagaccaucaccgagcucgaccccgccuccuucaccgagaucaccaaggacugcgacgagaacaaggagaacaagacccccgagggcucccagggcgaggucgacuggcuccagcaguacgacauggagcgcgagcgcgaggagcaggagcuccagcaggcccucgcccagucccuccaggagcaggaggccugggagcagaaggaggacgacgaccucaagcgcgccaccgagcucucccuccaggaguucaacaacuccuucgucgacgcccucggcuccgacgaggacuccggcaacgaggacgucuucgacauggaguacaccgaggccgaggccgaggagcucaagcgcaacgccgagaccggcaaccucccccacuccuaccgccucaucuccgucgucucccacaucggcuccaccuccuccuccggccacuacaucuccgacgucuacgacaucaagaagcaggccugguucaccuacaacgaccucgaggucuccaagauccaggaggccgccguccaguccgaccgcgaccgcuccggcuacaucuucuucuacaugcacaaggagaucuucgacgagcuccucgagaccgagaagaacucccagucccucuccaccgaggucggcaagaccacccgccaggcccucuga

SEQ ID NO: 51573 - RNA, 1431 nt, Artificial Sequence
  derived and/or modified sequence opt2 from USP3__Homo_sapiens__NP_001243631
auggagugcccccaccucuccuccuccgucugcaucgcccccgacuccgccaaguuccccaacggcucccccuccuccuggugcugcuccgucugccgcuccaacaagucccccugggucugccucaccugcuccuccguccacugcggcuccuaccgcugcgacgacuucgucgucaacgacaccaagcucggccucguccagaagguccgcgagcaccuccagaaccucgagaacuccgccuucaccgccgaccgccacaagaagcgcaagcuccucgagaacuccacccucaacuccaagcuccucaaggucaacggcuccaccaccgccaucugcgccaccggccuccgcaaccucggcaacaccugcuucaugaacgccauccuccagucccucuccaacaucgagcaguucugcugcuacuucaaggagcuccccgccgucgagcuccgcaacggcaagaccgccggccgccgcaccuaccacacccgcucccagggcgacaacaacgucucccucgucgaggaguuccgcaagacccucugcgcccucuggcagggcucccagaccgccuucucccccgagucccucuucuacgucgucuggaagaucaugcccaacuuccgcggcuaccagcagcaggacgcccacgaguucaugcgcuaccuccucgaccaccuccaccucgagcuccagggcggcuucaacggcgucucccgcuccgccauccuccaggagaacuccacccucuccgccuccaacaagugcugcaucaacggcgccuccaccgucgucaccgccaucuucggcggcauccuccagaacgaggucaacugccucaucugcggcaccgagucccgcaaguucgaccccuuccucgaccucucccucgacauccccucccaguuccgcuccaagcgcuccaagaaccaggagaacggccccgucugcucccuccgcgacugccuccgcuccuucaccgaccucgaggagcucgacgagaccgagcucuacaugugccacaagugcaagaagaagcagaaguccaccaagaaguucuggauccagaagcuccccaagguccucugccuccaccucaagcgcuuccacuggaccgccuaccuccgcaacaaggucgacaccuacgucgaguucccccuccgcggccucgacaugaagugcuaccuccucgagcccgagaacuccggccccgaguccugccucuacgaccucgccgccgucgucguccaccacggcuccggcgucggcuccggccacuacaccgccuacgccacccacgagggccgcugguuccacuucaacgacuccaccgucacccucaccgacgaggagaccgucgucaaggccaaggccuacauccucuucuacgucgagcaccaggccaaggccggcuccgacaagcucuga

SEQ ID NO: 51574 - RNA, 3744 nt, Artificial Sequence
  derived and/or modified sequence opt2 from USP40__Homo_sapiens__NP_060688
augucccucuuccuccgcgucgucuucuccuucaccauguucggcgaccucuucgaggaggaguacuccaccgucuccaacaaccaguacggcaagggcaagaagcucaagaccaaggcccucgagccccccgccccccgcgaguucaccaaccucuccggcauccgcaaccagggcggcaccugcuaccucaacucccuccuccagacccuccacuucacccccgaguuccgcgaggcccucuucucccucggccccgaggagcucggccucuucgaggacaaggacaagcccgacgccaagguccgcaucaucccccuccagcuccagcgccucuucgcccagcuccuccuccucgaccaggaggccgccuccaccgccgaccucaccgacuccuucggcuggaccuccaacgaggagaugcgccagcacgacguccaggagcucaaccgcauccucuucuccgcccucgagaccucccucgucggcaccuccggccacgaccucaucuaccgccucuaccacggcaccaucgucaaccagaucgucugcaaggagugcaagaacgucuccgagcgccaggaggacuuccucgaccucaccgucgccgucaagaacgucuccggccucgaggacgcccucuggaacauguacgucgaggaggaggucuucgacugcgacaaccucuaccacugcggcaccugcgaccgccucgucaaggccgccaaguccgccaagcuccgcaagcucccccccuuccucaccgucucccuccuccgcuucaacuucgacuucgucaagugcgagcgcuacaaggagaccuccugcuacaccuucccccuccgcaucaaccucaagcccuucugcgagcaguccgagcucgacgaccucgaguacaucuacgaccucuucuccgucaucauccacaagggcggcugcuacggcggccacuaccacgucuacaucaaggacgucgaccaccucggcaacuggcaguuccaggaggagaaguccaagcccgacgucaaccucaaggaccuccaguccgaggaggagaucgaccacccccucaugauccucaaggccauccuccucgaggagaacaaccucauccccgucgaccagcucggccagaagcuccucaagaagaucggcaucuccuggaacaagaaguaccgcaagcagcacggcccccuccgcaaguuccuccagcuccacucccagaucuuccuccucuccuccgacgaguccaccguccgccuccucaagaacuccucccuccaggccgaguccgacuuccagcgcaacgaccagcagaucuucaagaugcucccccccgagucccccggccucaacaacuccaucuccugcccccacugguucgacaucaacgacuccaagguccagcccauccgcgagaaggacaucgagcagcaguuccagggcaaggaguccgccuacaugcucuucuaccgcaagucccagcuccagcgcccccccgaggcccgcgccaacccccgcuacggcguccccugccaccuccucaacgagauggacgccgccaacaucgagcuccagaccaagcgcgccgagugcgacuccgccaacaacaccuucgagcuccaccuccaccucggcccccaguaccacuucuucaacggcgcccuccaccccgucgucucccagaccgaguccgucugggaccucaccuucgacaagcgcaagacccucggcgaccuccgccaguccaucuuccagcuccucgaguucugggagggcgacaugguccucuccgucgccaagcucguccccgccggccuccacaucuaccagucccucggcggcgacgagcucacccucugcgagaccgagaucgccgacggcgaggacaucuucgucuggaacggcgucgaggucggcggcguccacauccagaccggcaucgacugcgagccccuccuccucaacguccuccaccucgacaccuccuccgacggcgagaagugcugccaggucaucgaguccccccacgucuuccccgccaacgccgaggucggcaccguccucaccgcccucgccauccccgccggcgucaucuucaucaacuccgccggcugccccggcggcgagggcuggaccgccauccccaaggaggacaugcgcaagaccuuccgcgagcagggccuccgcaacggcuccuccauccucauccaggacucccacgacgacaacucccuccucaccaaggaggagaagugggucaccuccaugaacgagaucgacuggcuccacgucaagaaccucugccagcucgaguccgaggagaagcaggucaagaucuccgccaccgucaacaccauggucuucgacauccgcaucaaggccaucaaggagcucaagcucaugaaggagcucgccgacaacuccugccuccgccccaucgaccgcaacggcaagcuccucugccccguccccgacuccuacacccucaaggaggccgagcucaagaugggcuccucccucggccucugccucggcaaggcccccuccuccucccagcucuuccucuucuucgccaugggcuccgacguccagcccggcaccgagauggagaucgucgucgaggagaccaucuccguccgcgacugccucaagcucaugcucaagaaguccggccuccagggcgacgccuggcaccuccgcaagauggacuggugcuacgaggccggcgagccccucugcgaggaggacgccacccucaaggagcuccucaucugcuccggcgacacccuccuccucaucgagggccagcuccccccccucggcuuccucaagguccccaucuggugguaccagcuccagggccccuccggccacugggagucccaccaggaccagaccaacugcaccuccuccuggggccgcgucuggcgcgccaccuccucccagggcgccuccggcaacgagcccgcccaggucucccuccucuaccucggcgacaucgagaucuccgaggacgccacccucgccgagcucaagucccaggccaugacccucccccccuuccucgaguucggcguccccucccccgcccaccuccgcgccuggaccgucgagcgcaagcgccccggccgccuccuccgcaccgaccgccagccccuccgcgaguacaagcucggccgccgcaucgagaucugccucgagccccuccagaagggcgagaaccucggcccccaggacguccuccuccgcacccagguccgcauccccggcgagcgcaccuacgcccccgcccucgaccucgucuggaacgccgcccagggcggcaccgccggcucccuccgccagcgcgucgccgacuucuaccgccuccccgucgagaagaucgagaucgccaaguacuuccccgagaaguucgaguggcuccccaucuccuccuggaaccagcagaucaccaagcgcaagaagaagaagaagcaggacuaccuccagggcgcccccuacuaccucaaggacggcgacaccaucggcgucaagaaccuccucaucgacgacgacgacgacuucuccaccauccgcgacgacaccggcaaggagaagcagaagcagcgcgcccucggccgccgcaagucccaggaggcccuccacgagcaguccuccuacauccucuccuccgccgagacccccgcccgcccccgcgcccccgagaccucccucuccauccacgucggcuccuuccgcuga

SEQ ID NO: 51575 - RNA, 3951 nt, Artificial Sequence
  derived and/or modified sequence opt2 from USP42__Homo_sapiens__NP_115548
augaccaucgucgacaaggccuccgaguccuccgaccccuccgccuaccagaaccagcccggcuccuccgaggccgucucccccggcgacauggacgccggcuccgccuccuggggcgccgucuccucccucaacgacgucuccaaccacacccucucccucggccccguccccggcgccgucgucuacuccuccuccuccguccccgacaaguccaagcccuccccccagaaggaccaggcccucggcgacggcaucgcccccccccagaagguccucuuccccuccgagaagaucugccucaaguggcagcagacccaccgcgucggcgccggccuccagaaccucggcaacaccugcuucgccaacgccgcccuccagugccucaccuacacccccccccucgccaacuacaugcucucccacgagcacuccaagaccugccacgccgagggcuucugcaugaugugcaccaugcaggcccacaucacccaggcccucuccaaccccggcgacgucaucaagcccauguucgucaucaacgagaugcgccgcaucgcccgccacuuccgcuucggcaaccaggaggacgcccacgaguuccuccaguacaccgucgacgccaugcagaaggccugccucaacggcuccaacaagcucgaccgccacacccaggccaccacccucgucugccagaucuucggcggcuaccuccgcucccgcgucaagugccucaacugcaagggcgucuccgacaccuucgaccccuaccucgacaucacccucgagaucaaggccgcccaguccgucaacaaggcccucgagcaguucgucaagcccgagcagcucgacggcgagaacuccuacaagugcuccaagugcaagaagaugguccccgccuccaagcgcuucaccauccaccgcuccuccaacguccucacccucucccucaagcgcuucgccaacuucaccggcggcaagaucgccaaggacgucaaguaccccgaguaccucgacauccgccccuacaugucccagcccaacggcgagcccaucgucuacguccucuacgccguccucguccacaccggcuucaacugccacgccggccacuacuucugcuacaucaaggccuccaacggccucugguaccagaugaacgacuccaucgucuccaccuccgacauccgcuccguccucucccagcaggccuacguccucuucuacauccgcucccacgacgucaagaacggcggcgagcucacccaccccacccacucccccggccaguccuccccccgccccgucaucucccagcgcgucgucaccaacaagcaggccgcccccggcuucaucggcccccagcuccccucccacaugaucaagaaccccccccaccucaacggcaccggcccccucaaggacacccccuccuccuccauguccucccccaacggcaacuccuccgucaaccgcgccucccccgucaacgccuccgccuccguccagaacugguccgucaaccgcuccuccgucauccccgagcaccccaagaagcagaagaucaccaucuccauccacaacaagcuccccguccgccagugccagucccagcccaaccuccacuccaacucccucgagaaccccaccaagcccguccccuccuccaccaucaccaacuccgccguccaguccaccuccaacgccuccaccauguccgucuccuccaaggucaccaagcccaucccccgcuccgaguccugcucccagcccgucaugaacggcaaguccaagcucaacuccuccguccucguccccuacggcgccgaguccuccgaggacuccgacgaggaguccaagggccucggcaaggagaacggcaucggcaccaucgucuccucccacucccccggccaggacgccgaggacgaggaggccaccccccacgagcuccaggagcccaugacccucaacggcgccaacuccgccgacuccgacuccgaccccaaggagaacggccucgcccccgacggcgccuccugccagggccagcccgcccuccacuccgagaaccccuucgccaaggccaacggccuccccggcaagcucaugcccgccccccuccucucccuccccgaggacaagauccucgagaccuuccgccucuccaacaagcucaagggcuccaccgacgagauguccgcccccggcgccgagcgcggcccccccgaggaccgcgacgccgagccccagcccggcucccccgccgccgagucccucgaggagcccgacgccgccgccggccucuccuccaccaagaaggccccccccccccgcgaccccggcacccccgccaccaaggagggcgccugggaggccauggccgucgcccccgaggagcccccccccuccgccggcgaggacaucgucggcgacaccgccccccccgaccucugcgaccccggcucccucaccggcgacgccuccccccucucccaggacgccaagggcaugaucgccgagggcccccgcgacuccgcccucgccgaggcccccgagggccucucccccgccccccccgcccgcuccgaggagcccugcgagcagccccuccucguccaccccuccggcgaccacgcccgcgacgcccaggaccccucccagucccucggcgcccccgaggccgccgagcgcccccccgcccccguccucgacauggcccccgccggccaccccgagggcgacgccgagcccucccccggcgagcgcgucgaggacgccgccgcccccaaggcccccggccccucccccgccaaggagaagaucggcucccuccgcaaggucgaccgcggccacuaccgcucccgccgcgagcgcuccuccuccggcgagcccgcccgcgagucccgcuccaagaccgagggccaccgccaccgccgccgccgcaccugcccccgcgagcgcgaccgccaggaccgccacgcccccgagcaccaccccggccacggcgaccgccucucccccggcgagcgccgcucccucggccgcugcucccaccaccacucccgccaccgcuccggcgucgagcucgacuggguccgccaccacuacaccgagggcgagcgcggcuggggccgcgagaaguucuaccccgaccgcccccgcugggaccgcugccgcuacuaccacgaccgcuacgcccucuacgccgcccgcgacuggaagcccuuccacggcggccgcgagcacgagcgcgccggccuccacgagcgcccccacaaggaccacaaccgcggccgccgcggcugcgagcccgcccgcgagcgcgagcgccaccgccccuccuccccccgcgccggcgccccccacgcccucgccccccaccccgaccgcuucucccacgaccgcaccgcccucgucgccggcgacaacugcaaccucuccgaccgcuuccacgagcacgagaacggcaagucccgcaagcgccgccacgacuccgucgagaacuccgacucccacgucgagaagaaggcccgccgcuccgagcagaaggacccccucgaggagcccaaggccaagaagcacaagaaguccaagaagaagaagaaguccaaggacaagcaccgcgaccgcgacucccgccaccagcaggacuccgaccucuccgccgccugcuccgacgccgaccuccaccgccacaagaagaagaagaagaagaagaagcgccacucccgcaaguccgaggacuucgucaaggacuccgagcuccaccucccccgcgucaccucccucgagaccgucgcccaguuccgccgcgcccagggcggcuucccccucuccggcggccccccccucgagggcgucggccccuuccgcgagaagaccaagcaccuccgcauggagucccgcgacgaccgcugccgccucuucgaguacggccagggcgacuga

SEQ ID NO: 51576 - RNA, 3357 nt, Artificial Sequence
  derived and/or modified sequence opt2 from USP43__Homo_sapiens__NP_001254505
auggaccucggccccggcgacgccgccggcggcggcccccucgccccccgcccccgccgccgccgcucccuccgccgccucuucucccgcuuccuccucgcccucggcucccgcucccgccccggcgacucccccccccgcccccagcccggccacugcgacggcgacggcgagggcggcuucgccugcgcccccggccccguccccgccgcccccggcucccccggcgaggagcgcccccccggcccccagccccagcuccagcuccccgccggcgacggcgcccgcccccccggcgcccagggccucaagaaccacggcaacaccugcuucaugaacgccgucguccagugccucuccaacaccgaccuccucgccgaguuccucgcccucggccgcuaccgcgccgcccccggccgcgccgaggucaccgagcagcucgccgcccucguccgcgcccucuggacccgcgaguacaccccccagcucuccgccgaguucaagaacgccgucuccaaguacggcucccaguuccagggcaacucccagcacgacgcccucgaguuccuccucuggcuccucgaccgcguccacgaggaccucgagggcuccucccgcggccccgucuccgagaagcucccccccgaggccaccaagaccuccgagaacugccucucccccuccgcccagcucccccucggccaguccuucguccagucccacuuccaggcccaguaccgcuccucccucaccugcccccacugccucaagcaguccaacaccuucgaccccuuccucugcgucucccuccccaucccccuccgccagacccgcuuccucuccgucacccucgucuuccccuccaagucccagcgcuuccuccgcgucggccucgccguccccauccucuccaccgucgccgcccuccgcaagauggucgccgaggagggcggcguccccgccgacgaggucauccucgucgagcucuaccccuccggcuuccagcgcuccuucuucgacgaggaggaccucaacaccaucgccgagggcgacaacgucuacgccuuccaggucccccccucccccucccagggcacccucuccgcccacccccucggccucuccgccuccccccgccucgccgcccgcgagggccagcgcuucucccucucccuccacuccgaguccaagguccucauccucuucugcaaccucgucggcuccggccagcaggccucccgcuucggcccccccuuccucauccgcgaggaccgcgccgucuccugggcccagcuccagcaguccauccucuccaagguccgccaccucaugaaguccgaggcccccguccagaaccucggcucccucuucuccauccgcgucgucggccucuccgucgccugcuccuaccucucccccaaggacucccgcccccucugccacugggccgucgaccgcguccuccaccuccgccgccccggcggccccccccacgucaagcucgccgucgagugggacuccuccgucaaggagcgccucuucggcucccuccaggaggagcgcgcccaggacgccgacuccgucuggcagcagcagcaggcccaccagcagcacuccugcacccucgacgagugcuuccaguucuacaccaaggaggagcagcucgcccaggacgacgccuggaagugcccccacugccagguccuccagcagggcauggucaagcucucccucuggacccuccccgacauccucaucauccaccucaagcgcuucugccaggucggcgagcgccgcaacaagcucuccacccucgucaaguucccccucuccggccucaacauggccccccacgucgcccagcgcuccaccucccccgaggccggccucggccccuggcccuccuggaagcagcccgacugccuccccaccuccuacccccucgacuuccucuacgaccucuacgccgucugcaaccaccacggcaaccuccaggccuacugccgcaacucccucgacggccagugguacuccuacgacgacuccaccgucgagccccuccgcgaggacgaggucaacacccgcggcgccuacauccucuucuaccagaagcgcaacuccaucccccccugguccgccuccuccuccaugcgcggcuccaccuccuccucccucuccgaccacuggcuccuccgccucggcucccacgccggcuccacccgcggcucccuccucuccugguccuccgcccccugccccucccucccccagguccccgacucccccaucuucaccaacucccucugcaaccaggagaagggcggccucgagccccgccgccucguccgcggcgucaagggccgcuccaucuccaugaaggcccccaccaccucccgcgccaagcagggccccuucaagaccaugccccuccgcugguccuucggcuccaaggagaagccccccggcgccuccgucgagcucgucgaguaccucgagucccgccgccgcccccgcuccaccucccaguccaucgucucccuccucaccggcaccgccggcgaggacgagaaguccgccuccccccgcuccaacgucgcccuccccgccaacuccgaggacggcggccgcgccaucgagcgcggccccgccggcguccccugccccuccgcccagcccaaccacugccucgcccccggcaacuccgacggccccaacaccgcccgcaagcucaaggagaacgccggccaggacaucaagcucccccgcaaguucgaccucccccucaccgucaugcccuccgucgagcacgagaagcccgcccgccccgagggccagaaggccaugaacuggaaggaguccuuccagaugggcuccaaguccuccccccccucccccuacaugggcuucuccggcaacuccaaggacucccgccgcggcaccuccgagcucgaccgcccccuccagggcacccucacccuccuccgcuccgucuuccgcaagaaggagaaccgccgcaacgagcgcgccgaggucuccccccaggucccccccgucucccucgucuccggcggccucucccccgccauggacggccaggcccccggcuccccccccgcccuccgcauccccgagggccucgcccgcggccucggcucccgccucgagcgcgacgucugguccgcccccuccucccuccgccucccccgcaaggccucccgcgccccccgcggcuccgcccucggcaugucccagcgcaccguccccggcgagcaggccuccuacggcaccuuccagcgcgucaaguaccacacccucucccucggccgcaagaagacccuccccgaguccuccuucuga

SEQ ID NO: 51577 - RNA, 2139 nt, Artificial Sequence
  derived and/or modified sequence opt2 from USP44__Homo_sapiens__NP_001265322
augcucgccauggacaccugcaagcacgucggccagcuccagcucgcccaggaccacuccucccucaacccccagaaguggcacugcgucgacugcaacaccaccgaguccaucugggccugccucuccugcucccacgucgccugcggccgcuacaucgaggagcacgcccucaagcacuuccaggaguccucccaccccgucgcccucgaggucaacgagauguacgucuucugcuaccucugcgacgacuacguccucaacgacaacaccaccggcgaccucaagcuccuccgccgcacccucuccgccaucaagucccagaacuaccacugcaccacccgcuccggccgcuuccuccgcuccaugggcaccggcgacgacuccuacuuccuccacgacggcgcccagucccuccuccaguccgaggaccagcucuacaccgcccucuggcaccgccgccgcauccucaugggcaagaucuuccgcaccugguucgagcagucccccaucggccgcaagaagcaggaggagcccuuccaggagaagaucgucgucaagcgcgaggucaagaagcgccgccaggagcucgaguaccaggucaaggccgagcucgaguccaugcccccccgcaagucccuccgccuccagggccucgcccaguccaccaucaucgagaucgucuccguccagguccccgcccagacccccgccucccccgccaaggacaagguccucuccaccuccgagaacgagaucucccagaaggucuccgacuccuccgucaagcgccgccccaucgucacccccggcgucaccggccuccgcaaccucggcaacaccugcuacaugaacuccguccuccagguccucucccaccuccucaucuuccgccagugcuuccucaagcucgaccucaaccaguggcucgccaugaccgccuccgagaagacccgcuccugcaagcacccccccgucaccgacaccgucgucuaccagaugaacgagugccaggagaaggacaccggcuucgucugcucccgccaguccucccucuccuccggccucuccggcggcgccuccaagggccgcaagauggagcucauccagcccaaggagcccaccucccaguacaucucccucugccacgagcuccacacccucuuccaggucaugugguccggcaagugggcccucgucucccccuucgccaugcuccacuccgucuggcgccucauccccgccuuccgcggcuacgcccagcaggacgcccaggaguuccucugcgagcuccucgacaagauccagcgcgagcucgagaccaccggcaccucccuccccgcccucauccccaccucccagcgcaagcucaucaagcagguccucaacgucgucaacaacaucuuccacggccagcuccucucccaggucaccugccucgccugcgacaacaaguccaacaccaucgagcccuucugggaccucucccucgaguuccccgagcgcuaccagugcuccggcaaggacaucgccucccagcccugccucgucaccgagaugcucgccaaguucaccgagaccgaggcccucgagggcaagaucuacgucugcgaccagugcaacuccaagcgccgccgcuucuccuccaagcccgucguccucaccgaggcccagaagcagcucaugaucugccaccucccccagguccuccgccuccaccucaagcgcuuccgcugguccggccgcaacaaccgcgagaagaucggcguccacgucggcuucgaggagauccucaacauggagcccuacugcugccgcgagacccucaagucccuccgccccgagugcuucaucuacgaccucuccgccgucgucaugcaccacggcaagggcuucggcuccggccacuacaccgccuacugcuacaacuccgagggcggcuucuggguccacugcaacgacuccaagcucuccaugugcaccauggacgaggucugcaaggcccaggccuacauccucuucuacacccagcgcgucaccgagaacggccacuccaagcuccucccccccgagcuccuccucggcucccagcaccccaacgaggacgccgacaccuccuccaacgagauccucuccuga

SEQ ID NO: 51578 - RNA, 1080 nt, Artificial Sequence
  derived and/or modified sequence opt2 from USP46__Homo_sapiens__NP_001127695
augaacugcuuccagggcaccaacgccuccgcccucgagaaggacaucggccccgagcaguuccccaucaacgagcacuacuucggccucgucaacuucggcaacaccugcuacugcaacuccguccuccaggcccucuacuucugccgccccuuccgcgagaacguccucgccuacaaggcccagcagaagaagaaggagaaccuccucaccugccucgccgaccucuuccacuccaucgccacccagaagaagaaggucggcgucaucccccccaagaaguucaucucccgccuccgcaaggagaacgaccucuucgacaacuacaugcagcaggacgcccacgaguuccucaacuaccuccucaacaccaucgccgacauccuccaggaggagaagaagcaggagaagcagaacggcaagcucaagaacggcaacaugaacgagcccgccgagaacaacaagcccgagcucaccuggguccacgagaucuuccagggcacccucaccaacgagacccgcugccucaacugcgagaccgucuccuccaaggacgaggacuuccucgaccucuccgucgacgucgagcagaacaccuccaucacccacugccuccgcgacuucuccaacaccgagacccucugcuccgagcagaaguacuacugcgagaccugcugcuccaagcaggaggcccagaagcgcaugcgcgucaagaagcuccccaugauccucgcccuccaccucaagcgcuucaaguacauggagcagcuccaccgcuacaccaagcucuccuaccgcgucgucuucccccucgagcuccgccucuucaacaccuccuccgacgccgucaaccucgaccgcauguacgaccucgucgccgucgucguccacugcggcuccggccccaaccgcggccacuacaucaccaucgucaagucccacggcuucuggcuccucuucgacgacgacaucgucgagaagaucgacgcccaggccaucgaggaguucuacggccucaccuccgacaucuccaagaacuccgaguccggcuacauccucuucuaccagucccgcgaguga

SEQ ID NO: 51579 - RNA, 3105 nt, Artificial Sequence
  derived and/or modified sequence opt2 from USP48__Homo_sapiens__XP_011540564
auggccccccgccuccagcucgagaaggccgccuggcgcugggccgagaccguccgccccgaggaggucucccaggagcacaucgagaccgccuaccgcaucuggcucgagcccugcauccgcggcgucugccgccgcaacugcaagggcaaccccaacugccucgucggcaucggcgagcacaucuggcucggcgagaucgacgagaacuccuuccacaacaucgacgaccccaacugcgagcgccgcaagaagaacuccuucgucggccucaccaaccucggcgccaccugcuacgucaacaccuuccuccaggucugguuccucaaccucgagcuccgccaggcccucuaccucugccccuccaccugcuccgacuacaugcucggcgacggcauccaggaggagaaggacuacgagccccagaccaucugcgagcaccuccaguaccucuucgcccuccuccagaacuccaaccgccgcuacaucgaccccuccggcuucgucaaggcccucggccucgacaccggccagcagcaggacgcccaggaguucuccaagcucuucaugucccuccucgaggacacccucuccaagcagaagaaccccgacguccgcaacaucguccagcagcaguucugcggcgaguacgccuacgucaccgucugcaaccagugcggccgcgaguccaagcuccucuccaaguucuacgagcucgagcucaacauccagggccacaagcagcucaccgacugcaucuccgaguuccucaaggaggagaagcucgagggcgacaaccgcuacuucugcgagaacugccaguccaagcagaacgccacccgcaagauccgccuccucucccuccccugcacccucaaccuccagcucaugcgcuucgucuucgaccgccagaccggccacaagaagaagcucaacaccuacaucggcuucuccgagauccucgacauggagcccuacgucgagcacaagggcggcuccuacgucuacgagcucuccgccguccucauccaccgcggcgucuccgccuacuccggccacuacaucgcccacgucaaggacccccaguccggcgagugguacaaguucaacgacgaggacaucgagaagauggagggcaagaagcuccagcucggcaucgaggaggaccucgagcccuccaagucccagacccgcaagcccaagugcggcaagggcacccacugcucccgcaacgccuacaugcucgucuaccgccuccagacccaggagaagcccaacaccaccguccagguccccgccuuccuccaggagcucgucgaccgcgacaacuccaaguucgaggaguggugcaucgagauggccgagaugcgcaagcaguccgucgacaagggcaaggccaagcacgaggaggucaaggagcucuaccagcgccuccccgccggcgccgagcccuacgaguucgucucccucgaguggcuccagaaguggcucgacgaguccacccccaccaagcccaucgacaaccacgccugccucugcucccacgacaagcuccaccccgacaagaucuccaucaugaagcgcaucuccgaguacgccgccgacaucuucuacucccgcuacggcggcggcccccgccucaccgucaaggcccucugcaaggagugcgucgucgagcgcugccgcauccuccgccucaagaaccagcucaacgaggacuacaagaccgucaacaaccuccucaaggccgccgucaagggcuccgacggcuucugggucggcaaguccucccuccgcuccuggcgccagcucgcccucgagcagcucgacgagcaggacggcgacgccgagcaguccaacggcaagaugaacggcuccacccucaacaaggacgaguccaaggaggagcgcaaggaggaggaggagcucaacuucaacgaggacauccucugcccccacggcgagcucugcaucuccgagaacgagcgccgccucgucuccaaggaggccugguccaagcuccagcaguacuuccccaaggcccccgaguuccccuccuacaaggagugcugcucccagugcaagauccucgagcgcgagggcgaggagaacgaggcccuccacaagaugaucgccaacgagcagaagaccucccuccccaaccucuuccaggacaagaaccgccccugccucuccaacuggcccgaggacaccgacguccucuacaucgucucccaguucuucgucgaggaguggcgcaaguucguccgcaagcccacccgcugcucccccgucuccuccgucggcaacuccgcccuccucugcccccacggcggccucauguucaccuucgccuccaugaccaaggaggacuccaagcucaucgcccucaucuggcccuccgaguggcagaugauccagaagcucuucgucgucgaccacgucaucaagaucacccgcaucgaggucggcgacgucaaccccuccgagacccaguacaucuccgagcccaagcucugccccgagugccgcgagggccuccucugccagcagcagcgcgaccuccgcgaguacacccaggccaccaucuacguccacaaggucgucgacaacaagaaggucaugaaggacuccgcccccgagcucaacgucuccuccuccgagaccgaggaggacaaggaggaggccaagcccgacggcgagaaggaccccgacuucaaccaguccaacggcggcaccaagcgccagaagaucucccaccagaacuacaucgccuaccagaagcaggucauccgccgcuccaugcgccaccgcaagguccgcggcgagaaggcccuccucgucuccgccaaccagacccucaaggagcucaagauccagaucaugcacgccuucuccgucgcccccuucgaccagaaccucuccaucgacggcaagauccucuccgacgacugcgccacccucggcacccucggcgucauccccgaguccgucauccuccucaaggccgacgagcccaucgccgacuacgccgccauggacgacgucaugcaggucugcaugcccgaggagggcuucaagggcaccggccuccucggccacuga

SEQ ID NO: 51580 - RNA, 2067 nt, Artificial Sequence
  derived and/or modified sequence opt2 from USP49__Homo_sapiens__NP_001273483
auggaccgcugcaagcacgucggccgccuccgccucgcccaggaccacuccauccucaacccccagaaguggugcugccucgagugcgccaccaccgaguccgucugggccugccucaagugcucccacgucgccugcggccgcuacaucgaggaccacgcccucaagcacuucgaggagaccggccacccccucgccauggagguccgcgaccucuacgucuucugcuaccucugcaaggacuacguccucaacgacaaccccgagggcgaccucaagcuccuccgcuccucccuccucgccguccgcggccagaagcaggacacccccguccgccgcggccgcacccuccgcuccauggccuccggcgaggacgucguccucccccagcgcgccccccagggccagccccagaugcucaccgcccucugguaccgccgccagcgccuccucgcccgcacccuccgccucugguucgagaaguccucccgcggccaggccaagcucgagcagcgccgccaggaggaggcccucgagcgcaagaaggaggaggcccgccgccgccgccgcgaggucaagcgccgccuccucgaggagcucgccuccacccccccccgcaaguccgcccgccuccuccuccacaccccccgcgacgccggccccgccgccucccgccccgccgcccuccccaccucccgccgcguccccgccgccacccucaagcuccgccgccagcccgccauggcccccggcgucaccggccuccgcaaccucggcaacaccugcuacaugaacuccauccuccagguccucucccaccuccagaaguuccgcgagugcuuccucaaccucgaccccuccaagaccgagcaccucuuccccaaggccaccaacggcaagacccagcucuccggcaagcccaccaacuccuccgccaccgagcucucccuccgcaacgaccgcgccgaggccugcgagcgcgagggcuucugcuggaacggccgcgccuccaucucccgcucccucgagcucauccagaacaaggagcccuccuccaagcacaucucccucugccgcgagcuccacacccucuuccgcgucaugugguccggcaagugggcccucgucucccccuucgccaugcuccacuccgucuggucccucauccccgccuuccgcggcuacgaccagcaggacgcccaggaguuccucugcgagcuccuccacaagguccagcaggagcucgaguccgagggcaccacccgccgcauccucauccccuucucccagcgcaagcucaccaagcagguccucaaggucgucaacaccaucuuccacggccagcuccucucccaggucaccugcaucuccugcaacuacaaguccaacaccaucgagcccuucugggaccucucccucgaguuccccgagcgcuaccacugcaucgagaagggcuucgucccccucaaccagaccgagugccuccucaccgagaugcucgccaaguucaccgagaccgaggcccucgagggccgcaucuacgccugcgaccagugcaacuccaagcgccgcaaguccaaccccaagccccucguccucuccgaggcccgcaagcagcucaugaucuaccgccucccccagguccuccgccuccaccucaagcgcuuccgcugguccggccgcaaccaccgcgagaagaucggcguccacgucgucuucgaccagguccucaccauggagcccuacugcugccgcgacaugcucuccucccucgacaaggagaccuucgccuacgaccucuccgccgucgucaugcaccacggcaagggcuucggcuccggccacuacaccgccuacugcuacaacaccgagggcggcuucuggguccacugcaacgacuccaagcucaacgucugcuccgucgaggaggucugcaagacccaggccuacauccucuucuacacccagcgcaccguccagggcaacgcccgcaucuccgagacccaccuccaggcccagguccaguccuccaacaacgacgagggccgcccccagaccuucuccuga

SEQ ID NO: 51581 - RNA, 942 nt, Artificial Sequence
  derived and/or modified sequence opt2 from USP4__Homo_sapiens__NP_001238806
auggccgagggcggcggcugccgcgagcgccccgacgccgagacccagaaguccgagcucggcccccucaugcgcaccacccuccagcgcggcgcccagugguaccucaucgacucccgcugguucaagcaguggaagaaguacgucggcuucgacuccugggacauguacaacgucggcgagcacaaccucuuccccggccccaucgacaacuccggccucuucuccgaccccgagucccagacccucaaggagcaccucaucgacgagcucgacuacguccucguccccaccgaggccuggaacaagcuccucaacugguacggcugcgucgagggccagcagcccaucguccgcaaggucgucgagcacggccucuucgucaagcacugcaaggucgaggucuaccuccucgagcucaagcucugcgagaacuccgaccccaccaacguccucuccugccacuucuccaaggccgacaccaucgccaccaucgagaaggagaugcgcaagcucuucaacauccccgccgagcgcgagacccgccucuggaacaaguacauguccaacaccuacgagcagcucuccaagcucgacaacaccguccaggacgccggccucuaccagggccagguccucgucaucgagccccagaacgaggacggcaccuggccccgccagacccuccaguccaaggucuccuucuuccucccccgccucgagugcaacggcgccauccucgcccacugcaacuucugccuccccggcuccuccaacucccccgccuccgccucccgcgucgcccccucccaccucgccaacuucuucuucuucgagauggagucccacuccgucaccaagcucgagugcggcggcgccgucuccgccuacucccgcguccaggucaugcuccucccccagccccccgaguggcucggcuga

SEQ ID NO: 51582 - RNA, 2577 nt, Artificial Sequence
  derived and/or modified sequence opt2 from USP5__Homo_sapiens__NP_001092006
auggccgagcucuccgaggaggcccuccucuccguccuccccaccauccgcguccccaaggccggcgaccgcguccacaaggacgagugcgccuucuccuucgacacccccgaguccgagggcggccucuacaucugcaugaacaccuuccucggcuucggcaagcaguacgucgagcgccacuucaacaagaccggccagcgcgucuaccuccaccuccgccgcacccgccgccccaaggaggaggaccccgccaccggcaccggcgaccccccccgcaagaagcccacccgccucgccaucggcgucgagggcggcuucgaccucuccgaggagaaguucgagcucgacgaggacgucaagaucgucauccuccccgacuaccucgagaucgcccgcgacggccucggcggccuccccgacaucguccgcgaccgcgucaccuccgccgucgaggcccuccucuccgccgacuccgccucccgcaagcaggagguccaggccugggacggcgagguccgccaggucuccaagcacgccuucucccucaagcagcucgacaaccccgcccgcaucccccccugcggcuggaagugcuccaagugcgacaugcgcgagaaccucuggcucaaccucaccgacggcuccauccucugcggccgccgcuacuucgacggcuccggcggcaacaaccacgccgucgagcacuaccgcgagaccggcuacccccucgccgucaagcucggcaccaucacccccgacggcgccgacgucuacuccuacgacgaggacgacaugguccucgaccccucccucgccgagcaccucucccacuucggcaucgacaugcucaagaugcagaagaccgacaagaccaugaccgagcucgagaucgacaugaaccagcgcaucggcgagugggagcucauccaggaguccggcgucccccucaagccccucuucggccccggcuacaccggcauccgcaaccucggcaacuccugcuaccucaacuccgucguccagguccucuucuccauccccgacuuccagcgcaaguacgucgacaagcucgagaagaucuuccagaacgcccccaccgaccccacccaggacuucuccacccaggucgccaagcucggccacggccuccucuccggcgaguacuccaagcccguccccgaguccggcgacggcgagcgcguccccgagcagaaggagguccaggacggcaucgccccccgcauguucaaggcccucaucggcaagggccaccccgaguucuccaccaaccgccagcaggacgcccaggaguucuuccuccaccucaucaacauggucgagcgcaacugccgcuccuccgagaaccccaacgaggucuuccgcuuccucgucgaggagaagaucaagugccucgccaccgagaaggucaaguacacccagcgcgucgacuacaucaugcagcuccccguccccauggacgccgcccucaacaaggaggagcuccucgaguacgaggagaagaagcgccaggccgaggaggagaagauggcccuccccgagcucguccgcgcccagguccccuucuccuccugccucgaggccuacggcgcccccgagcaggucgacgacuucugguccaccgcccuccaggccaaguccgucgccgucaagaccacccgcuucgccuccuuccccgacuaccucgucauccagaucaagaaguucaccuucggccucgacuggguccccaagaagcucgacgucuccaucgagaugcccgaggagcucgacaucucccagcuccgcggcaccggccuccagcccggcgaggaggagcuccccgacaucgcccccccccucgucacccccgacgagcccaagggcucccucggcuucuacggcaacgaggacgaggacuccuucugcuccccccacuucuccucccccaccucccccaugcucgacgaguccgucaucauccagcucgucgagaugggcuuccccauggacgccugccgcaaggccgucuacuacaccggcaacuccggcgccgaggccgccaugaacugggucaugucccacauggacgaccccgacuucgccaacccccucauccuccccggcuccuccggccccggcuccaccuccgccgccgccgaccccccccccgaggacugcgucaccaccaucgucuccaugggcuucucccgcgaccaggcccucaaggcccuccgcgccaccaacaacucccucgagcgcgccgucgacuggaucuucucccacaucgacgaccucgacgccgaggccgccauggacaucuccgagggccgcuccgccgccgacuccaucuccgaguccguccccgucggccccaagguccgcgacggccccggcaaguaccagcucuucgccuucaucucccacaugggcaccuccaccaugugcggccacuacgucugccacaucaagaaggagggccgcugggucaucuacaacgaccagaaggucugcgccuccgagaagccccccaaggaccucggcuacaucuacuucuaccagcgcgucgccuccuga

SEQ ID NO: 51583 - RNA, 4221 nt, Artificial Sequence
  derived and/or modified sequence opt2 from USP6__Homo_sapiens__NP_001291213
auggacauggucgagaacgccgacucccuccaggcccaggagcgcaaggacauccucaugaaguacgacaagggccaccgcgccggccuccccgaggacaagggccccgagcccgucggcaucaacuccuccaucgaccgcuucggcauccuccacgagaccgagcucccccccgucaccgcccgcgaggccaagaagauccgccgcgagaugacccgcaccuccaaguggauggagaugcucggcgagugggagaccuacaagcacuccuccaagcucaucgaccgcgucuacaagggcauccccaugaacauccgcggccccgucugguccguccuccucaacauccaggagaucaagcucaagaaccccggccgcuaccagaucaugaaggagcgcggcaagcgcuccuccgagcacauccaccacaucgaccucgacguccgcaccacccuccgcaaccacgucuucuuccgcgaccgcuacggcgccaagcagcgcgagcucuucuacauccuccucgccuacuccgaguacaaccccgaggucggcuacugccgcgaccucucccacaucaccgcccucuuccuccucuaccuccccgaggaggacgccuucugggcccucguccagcuccucgccuccgagcgccacucccuccccggcuuccacucccccaacggcggcaccguccagggccuccaggaccagcaggagcacgucguccccaagucccagcccaagaccauguggcaccaggacaaggagggccucugcggccagugcgccucccucggcugccuccuccgcaaccucaucgacggcaucucccucggccucacccuccgccucugggacgucuaccucgucgagggcgagcagguccucaugcccaucaccuccaucgcccucaagguccagcagaagcgccucaugaagaccucccgcugcggccucugggcccgccuccgcaaccaguucuucgacaccugggccaugaacgacgacaccguccucaagcaccuccgcgccuccaccaagaagcucacccgcaagcagggcgaccuccccccccccgccaagcgcgagcagggcucccucgccccccgccccguccccgccucccgcggcggcaagacccucugcaagggcuaccgccaggccccccccggcccccccgcccaguuccagcgccccaucugcuccgccuccccccccugggccucccgcuucuccacccccugccccggcggcgccguccgcgaggacaccuaccccgucggcacccagggcguccccucccucgcccucgcccagggcggcccccagggcuccuggcgcuuccucgaguggaaguccaugccccgccuccccaccgaccucgacaucggcggccccugguucccccacuacgacuucgagugguccugcuggguccgcgccaucucccaggaggaccagcucgccaccugcuggcaggccgagcacugcggcgagguccacaacaaggacauguccuggcccgaggagauguccuucaccgccaacuccuccaagaucgaccgccagaagguccccaccgagaagggcgccaccggccucuccaaccucggcaacaccugcuucaugaacuccuccauccagugcgucuccaacacccagccccucacccaguacuucaucuccggccgccaccucuacgagcucaaccgcaccaaccccaucggcaugaagggccacauggccaagugcuacggcgaccucguccaggagcucugguccggcacccagaaguccgucgccccccucaagcuccgccgcaccaucgccaaguacgcccccaaguucgacggcuuccagcagcaggacucccaggagcuccucgccuuccuccucgacggccuccacgaggaccucaaccgcguccacgagaagcccuacgucgagcucaaggacuccgacggccgccccgacugggaggucgccgccgaggccugggacaaccaccuccgccgcaaccgcuccaucaucgucgaccucuuccacggccagcuccgcucccaggucaagugcaagaccugcggccacaucuccguccgcuucgaccccuucaacuuccucucccucccccuccccauggacuccuacauggaccucgagaucaccgucaucaagcucgacggcaccacccccguccgcuacggccuccgccucaacauggacgagaaguacaccggccucaagaagcagcuccgcgaccucugcggccucaacuccgagcagauccuccucgccgagguccacgacuccaacaucaagaacuucccccaggacaaccagaagguccagcucuccgucuccggcuuccucugcgccuucgagauccccguccccuccucccccaucuccgccuccucccccacccagaucgacuucuccuccucccccuccaccaacggcauguucacccucaccaccaacggcgaccuccccaagcccaucuucauccccaacggcaugcccaacaccgucguccccugcggcaccgagaagaacuucaccaacggcauggucaacggccacaugcccucccuccccgacucccccuucaccggcuacaucaucgccguccaccgcaagaugaugcgcaccgagcucuacuuccucuccccccaggagaaccgccccucccucuucggcaugccccucaucguccccugcaccguccacacccgcaagaaggaccucuacgacgccgucuggauccaggucuccuggcucgcccgcccccuccccccccaggaggccuccauccacgcccaggaccgcgacaacugcaugggcuaccaguaccccuucacccuccgcgucguccagaaggacggcaacuccugcgccuggugcccccaguaccgcuucugccgcggcugcaagaucgacugcggcgaggaccgcgccuucaucggcaacgccuacaucgccgucgacuggcaccccaccgcccuccaccuccgcuaccagaccucccaggagcgcgucgucgacaagcacgaguccgucgagcagucccgccgcgcccaggccgagcccaucaaccucgacuccugccuccgcgccuucaccuccgaggaggagcucggcgaguccgagauguacuacugcuccaagugcaagacccacugccucgccaccaagaagcucgaccucuggcgccucccccccuuccucaucauccaccucaagcgcuuccaguucgucaacgaccaguggaucaagucccagaagaucguccgcuuccuccgcgaguccuucgaccccuccgccuuccucgucccccgcgaccccgcccucugccagcacaagccccucaccccccagggcgacgagcucuccaagccccgcauccucgcccgcgaggucaagaaggucgacgcccaguccuccgccggcaaggaggacaugcuccucuccaagucccccuccucccucuccgccaacaucuccuccucccccaagggcucccccuccuccucccgcaaguccggcaccuccugccccuccuccaagaacuccucccccaacuccuccccccgcacccucggccgcuccaagggccgccuccgccucccccagaucggcuccaagaacaagcccuccuccuccaagaagaaccucgacgccuccaaggagaacggcgccggccagaucugcgagcucgccgacgcccucucccgcggccacaugcgcggcggcucccagcccgagcucgucaccccccaggaccacgaggucgcccucgccaacggcuuccucuacgagcacgaggccugcggcaacggcugcggcgacggcuacuccaacggccagcucggcaaccacuccgaggaggacuccaccgacgaccagcgcgaggacacccacaucaagcccaucuacaaccucuacgccaucuccugccacuccggcauccucuccggcggccacuacaucaccuacgccaagaaccccaacugcaagugguacugcuacaacgacuccuccugcgaggagcuccaccccgacgagaucgacaccgacuccgccuacauccucuucuacgagcagcagggcaucgacuacgcccaguuccuccccaagaucgacggcaagaagauggccgacaccuccuccaccgacgaggacuccgaguccgacuacgagaaguacuccaugcuccaguga

SEQ ID NO: 51584 - RNA, 2538 nt, Artificial Sequence
  derived and/or modified sequence opt2 from USP6NL__Homo_sapiens__NP_001073960
augcgcaccgaggccgucgucaacucccagggccagaccgacuaccucaccaaggacuccgaccaggacgucgcccucaagcucgcccaggagcgcgccgagaucgucgccaaguacgaccgcggccgcgagggcgccgagaucgagcccugggaggacgccgacuaccucgucuacaaggucaccgaccgcuucggcuuccuccacgaggaggagcuccccgaccacaacgucgccgucgagcgccagaagcaccucgagaucgagcgcaccaccaaguggcucaagaugcucaagggcugggagaaguacaagaacaccgagaaguuccaccgccgcaucuacaagggcaucccccuccagcuccgcggcgaggucugggcccuccuccucgagauccccaagaugaaggaggagacccgcgaccucuacuccaagcucaagcaccgcgcccgcggcugcucccccgacauccgccagaucgaccucgacgucaaccgcaccuuccgcgaccacaucauguuccgcgaccgcuacggcgucaagcagcagucccucuuccacguccucgccgccuacuccaucuacaacaccgaggucggcuacugccagggcaugucccagaucaccgcccuccuccucauguacaugaacgaggaggacgccuucugggcccucgucaagcucuucuccggccccaagcacgccaugcacggcuucuucguccagggcuuccccaagcuccuccgcuuccaggagcaccacgagaagauccucaacaaguuccucuccaagcucaagcagcaccucgacucccaggagaucuacaccuccuucuacaccaugaagugguucuuccagugcuuccucgaccgcacccccuucacccucaaccuccgcaucugggacaucuacaucuucgagggcgagcgcguccucaccgccauguccuacaccauccucaagcuccacaagaagcaccucaugaagcucuccauggaggagcucgucgaguucuuccaggagacccucgccaaggacuucuucuucgaggacgacuucgucaucgagcagcuccagaucuccaugaccgagcucaagcgcgccaagcucgaccuccccgagcccggcaaggaggacgaguaccccaagaagccccucggccagcucccccccgagcuccaguccuggggcguccaccaccucuccaacggccagcgcuccgucggccgccccuccccccucgccuccggccgccgcgaguccggcgccccccaccgccgccacgagcacuccccccacccccagucccgcaccggcacccccgagcgcgcccagcccccccgccgcaaguccgucgaggaggaguccaagaagcucaaggacgaggccgacuuccagcgcaagcuccccuccggcccccaggacuccucccgccaguacaaccacgccgccgccaaccagaacuccaacgccaccuccaacauccgcaaggaguucguccccaaguggaacaagcccuccgacgucuccgccaccgagcgcaccgccaaguacaccauggagggcaagggccgcgccgcccaccccgcccucgccgucaccguccccggccccgccgagguccgcgucuccaacguccgccccaagaugaaggcccucgacgccgaggacggcaagcgcggcuccaccgccucccaguacgacaacguccccggccccgagcucgacuccggcgccuccgucgaggaggcccucgagcgcgccuacucccaguccccccgccacgcccucuacccccccuccccccgcaagcacgccgagcccuccuccucccccuccaaggucuccaacaaguucaccuucaagguccagccccccucccacgcccgcuaccccucccagcucgacggcgaggcccgcggccucgcccacccccccuccuacuccaacccccccgucuaccacggcaacucccccaagcacuuccccaccgccaacuccuccuucgccuccccccaguucucccccggcacccagcucaaccccucccgccgcccccacggcuccacccucuccgucuccgccucccccgagaaguccuacucccgccccuccccccucguccuccccuccucccgcaucgagguccuccccgucgacaccggcgccggcggcuacuccggcaacuccggcucccccaagaacggcaagcucaucaucccccccgucgacuaccuccccgacaaccgcaccugguccgaggucuccuacaccuaccgccccgagacccagggccaguccuggacccgcgacgccucccgcggcaaccuccccaaguacuccgccuuccagcucgcccccuuccaggaccacggccuccccgccgucuccgucgacucccccguccgcuacaaggccucccccgccgccgaggacgccucccccuccggcuaccccuacuccggcccccccccccccgccuaccacuaccgcaaccgcgacggccucuccauccaggaguccguccuccucuga

SEQ ID NO: 51585 - RNA, 3261 nt, Artificial Sequence
  derived and/or modified sequence opt2 from USP7__Homo_sapiens__NP_001273386
auggccggcaaccaccgccucggccucgaggccggcgacaccgacgaccccccccgcaucacccagaaccccgucaucaacggcaacgucgcccucuccgacggccacaacaccgccgaggaggacauggaggacgacaccuccuggcgcuccgaggccaccuuccaguucaccgucgagcgcuucucccgccucuccgaguccguccucuccccccccugcuucguccgcaaccuccccuggaagaucauggucaugccccgcuucuaccccgaccgcccccaccagaaguccgucggcuucuuccuccagugcaacgccgaguccgacuccaccuccugguccugccacgcccaggccguccucaagaucaucaacuaccgcgacgacgagaaguccuucucccgccgcaucucccaccucuucuuccacaaggagaacgacuggggcuucuccaacuucauggccugguccgaggucaccgaccccgagaagggcuucaucgacgacgacaaggucaccuucgaggucuucguccaggccgacgccccccacggcgucgccugggacuccaagaagcacaccggcuacgucggccucaagaaccagggcgccaccugcuacaugaacucccuccuccagacccucuucuucaccaaccagcuccgcaaggccgucuacaugaugcccaccgagggcgacgacuccuccaaguccgucccccucgcccuccagcgcgucuucuacgagcuccagcacuccgacaagcccgucggcaccaagaagcucaccaaguccuucggcugggagacccucgacuccuucaugcagcacgacguccaggagcucugccgcguccuccucgacaacgucgagaacaagaugaagggcaccugcgucgagggcaccauccccaagcucuuccgcggcaagauggucuccuacauccagugcaaggaggucgacuaccgcuccgaccgccgcgaggacuacuacgacauccagcucuccaucaagggcaagaagaacaucuucgaguccuucgucgacuacgucgccgucggccagcucgacggcgacaacaaguacgacgccggcgagcacggccuccaggaggccgagaagggcgucaaguuccucacccucccccccguccuccaccuccagcucaugcgcuucauguacgacccccagaccgaccagaacaucaagaucaacgaccgcuucgaguuccccgagcagcucccccucgacgaguuccuccagaagaccgaccccaaggaccccgccaacuacauccuccacgccguccucguccacuccggcgacaaccacggcggccacuacgucgucuaccucaaccccaagggcgacggcaaguggugcaaguucgacgacgacgucgucucccgcugcaccaaggaggaggccaucgagcacaacuacggcggccacgacgacgaccucuccguccgccacugcaccaacgccuacaugcucgucuacauccgcgaguccaagcucuccgagguccuccaggccgucaccgaccacgacaucccccagcagcucgucgagcgccuccaggaggagaagcgcaucgaggcccagaagcgcaaggagcgccaggaggcccaccucuacaugcagguccagaucgucgccgaggaccaguucugcggccaccagggcaacgacauguacgacgaggagaaggucaaguacaccgucuucaagguccucaagaacuccucccucgccgaguucguccagucccucucccagaccaugggcuucccccaggaccagauccgccucuggcccaugcaggcccgcuccaacggcaccaagcgccccgccaugcucgacaacgaggccgacggcaacaagaccaugaucgagcucuccgacaacgagaaccccuggaccaucuuccucgagaccgucgaccccgagcucgccgccuccggcgccacccuccccaaguucgacaaggaccacgacgucaugcucuuccucaagauguacgaccccaagacccgcucccucaacuacugcggccacaucuacacccccaucuccugcaagauccgcgaccuccuccccgucaugugcgaccgcgccggcuucauccaggacaccucccucauccucuacgaggaggucaagcccaaccucaccgagcgcauccaggacuacgacgucucccucgacaaggcccucgacgagcucauggacggcgacaucaucgucuuccagaaggacgaccccgagaacgacaacuccgagcuccccaccgccaaggaguacuuccgcgaccucuaccaccgcgucgacgucaucuucugcgacaagaccauccccaacgaccccggcuucgucgucacccucuccaaccgcaugaacuacuuccaggucgccaagaccgucgcccagcgccucaacaccgaccccaugcuccuccaguucuucaagucccagggcuaccgcgacggccccggcaacccccuccgccacaacuacgagggcacccuccgcgaccuccuccaguucuucaagccccgccagcccaagaagcucuacuaccagcagcucaagaugaagaucaccgacuucgagaaccgccgcuccuucaagugcaucuggcucaacucccaguuccgcgaggaggagaucacccucuaccccgacaagcacggcugcguccgcgaccuccucgaggagugcaagaaggccgucgagcucggcgagaaggccuccggcaagcuccgccuccucgagaucgucuccuacaagaucaucggcguccaccaggaggacgagcuccucgagugccucucccccgccaccucccgcaccuuccgcaucgaggagaucccccucgaccaggucgacaucgacaaggagaacgagaugcucgucaccgucgcccacuuccacaaggaggucuucggcaccuucggcauccccuuccuccuccgcauccaccagggcgagcacuuccgcgaggucaugaagcgcauccagucccuccucgacauccaggagaaggaguucgagaaguucaaguucgccaucgucaugaugggccgccaccaguacaucaacgaggacgaguacgaggucaaccucaaggacuucgagccccagcccggcaacaugucccacccccgccccuggcucggccucgaccacuucaacaaggcccccaagcgcucccgcuacaccuaccucgagaaggccaucaagauccacaacuga

SEQ ID NO: 51586 - RNA, 3357 nt, Artificial Sequence
  derived and/or modified sequence opt2 from USP8__Homo_sapiens__NP_001122082
augcccgccgucgccuccguccccaaggagcucuaccucuccuccucccucaaggaccucaacaagaagaccgaggucaagcccgagaagaucuccaccaaguccuacguccacuccgcccucaagaucuucaagaccgccgaggagugccgccucgaccgcgacgaggagcgcgccuacguccucuacaugaaguacgucaccgucuacaaccucaucaagaagcgccccgacuucaagcagcagcaggacuacuuccacuccauccucggccccggcaacaucaagaaggccgucgaggaggccgagcgccucuccgagucccucaagcuccgcuacgaggaggccgagguccgcaagaagcucgaggagaaggaccgccaggaggaggcccagcgccuccagcagaagcgccaggagaccggccgcgaggacggcggcacccucgccaagggcucccucgagaacguccucgacuccaaggacaagacccagaaguccaacggcgagaagaacgagaagugcgagaccaaggagaagggcgccaucaccgccaaggagcucuacaccaugaugaccgacaagaacaucucccucaucaucauggacgcccgccgcaugcaggacuaccaggacuccugcauccuccacucccucuccguccccgaggaggccaucucccccggcgucaccgccuccuggaucgaggcccaccuccccgacgacuccaaggacaccuggaagaagcgcggcaacgucgaguacgucguccuccucgacugguucuccuccgccaaggaccuccagaucggcaccacccuccgcucccucaaggacgcccucuucaagugggaguccaagaccguccuccgcaacgagccccucguccucgagggcggcuacgagaacuggcuccucugcuacccccaguacaccaccaacgccaaggucaccccccccccccgccgccagaacgaggaggucuccaucucccucgacuucaccuaccccucccucgaggaguccauccccuccaagcccgccgcccagaccccccccgccuccaucgaggucgacgagaacaucgagcucaucuccggccagaacgagcgcaugggcccccucaacaucuccacccccgucgagcccgucgccgccuccaaguccgacgucucccccaucauccagcccguccccuccaucaagaacgucccccagaucgaccgcaccaagaagcccgccgucaagcuccccgaggagcaccgcaucaaguccgaguccaccaaccacgagcagcaguccccccaguccggcaaggucauccccgaccgcuccaccaagcccgucgucuucucccccacccucaugcucaccgacgaggagaaggcccgcauccacgccgagaccgcccuccucauggagaagaacaagcaggagaaggagcuccgcgagcgccagcaggaggagcagaaggagaagcuccgcaaggaggagcaggagcagaaggccaagaagaagcaggaggccgaggagaacgagaucaccgagaagcagcagaaggccaaggaggagauggagaagaaggaguccgagcaggccaagaaggaggacaaggagaccuccgccaagcgcggcaaggagaucaccggcgucaagcgccaguccaaguccgagcacgagaccuccgacgccaagaaguccgucgaggaccgcggcaagcgcugccccacccccgagauccagaagaaguccaccggcgacgucccccacaccuccgucaccggcgacuccggcuccggcaagcccuucaagaucaagggccagcccgaguccggcauccuccgcaccggcaccuuccgcgaggacaccgacgacaccgagcgcaacaaggcccagcgcgagccccucacccgcgcccgcuccgaggagaugggccgcaucguccccggccuccccuccggcugggccaaguuccucgaccccaucaccggcaccuuccgcuacuaccacucccccaccaacaccguccacauguacccccccgagauggcccccuccuccgccccccccuccaccccccccacccacaaggccaagccccagauccccgccgagcgcgaccgcgagcccuccaagcucaagcgcuccuacuccucccccgacaucacccaggccauccaggaggaggagaagcgcaagcccaccgucacccccaccgucaaccgcgagaacaagcccaccugcuaccccaaggccgagaucucccgccucuccgccucccagauccgcaaccucaaccccgucuucggcggcuccggccccgcccucaccggccuccgcaaccucggcaacaccugcuacaugaacuccauccuccagugccucugcaacgccccccaccucgccgacuacuucaaccgcaacugcuaccaggacgacaucaaccgcuccaaccuccucggccacaagggcgaggucgccgaggaguucggcaucaucaugaaggcccucuggaccggccaguaccgcuacaucucccccaaggacuucaagaucaccaucggcaagaucaacgaccaguucgccggcuacucccagcaggacucccaggagcuccuccucuuccucauggacggccuccacgaggaccucaacaaggccgacaaccgcaagcgcuacaaggaggagaacaacgaccaccucgacgacuucaaggccgccgagcacgccuggcagaagcacaagcagcucaacgaguccaucaucgucgcccucuuccagggccaguucaaguccaccguccagugccucaccugccacaagaagucccgcaccuucgaggccuucauguaccucucccucccccucgccuccaccuccaagugcacccuccaggacugccuccgccucuucuccaaggaggagaagcucaccgacaacaaccgcuucuacugcucccacugccgcgcccgccgcgacucccucaagaagaucgagaucuggaagcucccccccguccuccucguccaccucaagcgcuucuccuacgacggccgcuggaagcagaagcuccagaccuccgucgacuucccccucgagaaccucgaccucucccaguacgucaucggccccaagaacaaccucaagaaguacaaccucuucuccgucuccaaccacuacggcggccucgacggcggccacuacaccgccuacugcaagaacgccgcccgccagcgcugguucaaguucgacgaccacgaggucuccgacaucuccgucuccuccgucaaguccuccgccgccuacauccucuucuacaccucccucggcccccgcgucaccgacgucgccaccuga

SEQ ID NO: 51587 - RNA, 7713 nt, Artificial Sequence
  derived and/or modified sequence opt2 from USP9X__Homo_sapiens__NP_001034679
augaccgccaccacccgcggcucccccgucggcggcaacgacaaccagggccaggcccccgacggccagucccagcccccccuccagcagaaccagaccuccucccccgacuccuccaacgagaacucccccgccaccccccccgacgagcagggccagggcgacgcccccccccagcucgaggacgaggagcccgccuucccccacaccgaccucgccaagcucgacgacaugaucaaccgcccccgcugggucguccccguccuccccaagggcgagcucgagguccuccucgaggccgccaucgaccucuccaagaagggccucgacgucaaguccgaggccugccagcgcuucuuccgcgacggccucaccaucuccuucaccaagauccucaccgacgaggccgucuccggcuggaaguucgagauccaccgcugcaucaucaacaacacccaccgccucgucgagcucugcgucgccaagcucucccaggacugguucccccuccucgagcuccucgccauggcccucaacccccacugcaaguuccacaucuacaacggcacccgccccugcgaguccgucuccuccuccguccagcuccccgaggacgagcucuucgcccgcucccccgacccccgcucccccaagggcuggcucgucgaccuccucaacaaguucggcacccucaacggcuuccagauccuccacgaccgcuucaucaacggcuccgcccucaacguccagaucaucgccgcccucaucaagcccuucggccagugcuacgaguuccucacccuccacaccgucaagaaguacuuccuccccaucaucgagauggucccccaguuccucgagaaccucaccgacgaggagcucaagaaggaggccaagaacgaggccaagaacgacgcccucuccaugaucaucaagucccucaagaaccucgccucccgcguccccggccaggaggagaccgucaagaaccucgagaucuuccgccucaagaugauccuccgccuccuccagaucuccuccuucaacggcaagaugaacgcccucaacgaggucaacaaggucaucuccuccgucuccuacuacacccaccgccacggcaaccccgaggaggaggaguggcucaccgccgagcgcauggccgaguggauccagcagaacaacauccucuccaucguccuccgcgacucccuccaccagccccaguacgucgagaagcucgagaagauccuccgcuucgucaucaaggagaaggcccucacccuccaggaccucgacaacaucugggccgcccaggccggcaagcacgaggccaucgucaagaacguccacgaccuccucgccaagcucgccugggacuucucccccgagcagcucgaccaccucuucgacugcuucaaggccuccuggaccaacgccuccaagaagcagcgcgagaagcuccucgagcucauccgccgccucgccgaggacgacaaggacggcgucauggcccacaagguccucaaccuccucuggaaccucgcccacuccgacgacguccccgucgacaucauggaccucgcccucuccgcccacaucaagauccucgacuacuccugcucccaggaccgcgacacccagaagauccaguggaucgaccgcuucaucgaggagcuccgcaccaacgacaagugggucauccccgcccucaagcagauccgcgagaucugcucccucuucggcgaggccccccagaaccucucccagacccagcgcuccccccacgucuucuaccgccacgaccucaucaaccagcuccagcacaaccacgcccucgucacccucgucgccgagaaccucgccaccuacauggaguccaugcgccucuacgcccgcgaccacgaggacuacgacccccagaccguccgccucggcucccgcuacucccacguccaggagguccaggagcgccucaacuuccuccgcuuccuccucaaggacggccagcucuggcucugcgccccccaggccaagcagaucuggaagugccucgccgagaacgccgucuaccucugcgaccgcgaggccugcuucaagugguacuccaagcucaugggcgacgagcccgaccucgaccccgacaucaacaaggacuucuucgaguccaacguccuccagcucgaccccucccuccucaccgagaacggcaugaagugcuucgagcgcuucuucaaggccgucaacugccgcgagggcaagcucgucgccaagcgccgcgccuacaugauggacgaccucgagcucaucggccucgacuaccucuggcgcgucgucauccaguccaacgacgacaucgccucccgcgccaucgaccuccucaaggagaucuacaccaaccucggcccccgccuccaggucaaccaggucgucauccacgaggacuucauccaguccugcuucgaccgccucaaggccuccuacgacacccucugcguccucgacggcgacaaggacuccgucaacugcgcccgccaggaggccguccgcaugguccgcguccucaccguccuccgcgaguacaucaacgagugcgacuccgacuaccacgaggagcgcaccauccuccccaugucccgcgccuuccgcggcaagcaccucuccuucgucguccgcuuccccaaccagggccgccaggucgacgaccucgaggucuggucccacaccaacgacaccaucggcuccguccgccgcugcauccucaaccgcaucaaggccaacgucgcccacaccaagaucgagcucuucgucggcggcgagcucaucgaccccgccgacgaccgcaagcucaucggccagcucaaccucaaggacaagucccucaucaccgccaagcucacccagaucuccuccaacaugcccuccucccccgacuccuccuccgacuccuccaccggcucccccggcaaccacggcaaccacuacuccgacggccccaaccccgaggucgaguccugccuccccggcgucaucaugucccuccacccccgcuacaucuccuuccucuggcaggucgccgaccucggcuccucccucaacaugcccccccuccgcgacggcgcccgcguccucaugaagcucaugccccccgacuccaccaccaucgagaagcuccgcgccaucugccucgaccacgccaagcucggcgaguccucccucucccccucccucgacucccucuucuucggccccuccgccucccagguccucuaccucaccgaggucgucuacgcccuccucaugcccgccggcgccccccucgccgacgacuccuccgacuuccaguuccacuuccucaaguccggcggccucccccucguccucuccaugcucacccgcaacaacuuccuccccaacgccgacauggagacccgccgcggcgccuaccucaacgcccucaagaucgccaagcuccuccucaccgccaucggcuacggccacguccgcgccgucgccgaggccugccagcccggcgucgagggcgucaaccccaugacccagaucaaccaggucacccacgaccaggccgucguccuccaguccgcccuccaguccauccccaaccccuccuccgagugcaugcuccgcaacgucuccguccgccucgcccagcagaucuccgacgaggccucccgcuacaugcccgacaucugcgucauccgcgccauccagaagaucaucugggccuccggcugcggcucccuccagcucgucuucucccccaacgaggagaucaccaagaucuacgagaagaccaacgccggcaacgagcccgaccucgaggacgagcaggucugcugcgaggcccucgaggucaugacccucugcuucgcccucauccccaccgcccucgacgcccucuccaaggagaaggccuggcagaccuucaucaucgaccuccuccuccacugccacuccaagaccguccgccaggucgcccaggagcaguucuuccucaugugcacccgcugcugcaugggccaccgcccccuccucuucuucaucacccuccucuucaccguccucggcuccaccgcccgcgagcgcgccaagcacuccggcgacuacuucacccuccuccgccaccuccucaacuacgccuacaacuccaacaucaacguccccaacgccgagguccuccucaacaacgagaucgacuggcucaagcgcauccgcgacgacgucaagcgcaccggcgagaccggcaucgaggagaccauccucgagggccaccucggcgucaccaaggagcuccucgccuuccagaccuccgagaagaaguuccacaucggcugcgagaagggcggcgccaaccucaucaaggagcucaucgacgacuucaucuuccccgccuccaacgucuaccuccaguacaugcgcaacggcgagcuccccgccgagcaggccauccccgucugcggcuccccccccaccaucaacgccggcuucgagcuccucgucgcccucgccgucggcugcguccgcaaccucaagcagaucgucgacucccucaccgagauguacuacaucggcaccgccaucaccaccugcgaggcccucaccgagugggaguaccucccccccgucggcccccgcccccccaagggcuucgucggccucaagaacgccggcgccaccugcuacaugaacuccgucauccagcagcucuacaugauccccuccauccgcaacggcauccucgccaucgagggcaccggcuccgacgucgacgacgacauguccggcgacgagaagcaggacaacgaguccaacgucgacccccgcgacgacgucuucggcuacccccagcaguucgaggacaagcccgcccucuccaagaccgaggaccgcaaggaguacaacaucggcguccuccgccaccuccaggucaucuucggccaccucgccgccucccgccuccaguacuacgucccccgcggcuucuggaagcaguuccgccucuggggcgagcccgucaaccuccgcgagcagcacgacgcccucgaguucuucaacucccucgucgacucccucgacgaggcccucaaggcccucggccaccccgccaugcucuccaagguccucggcggcuccuucgccgaccagaagaucugccagggcugcccccaccgcuacgagugcgaggaguccuucaccacccucaacgucgacauccgcaaccaccagaaccuccucgacucccucgagcaguacgucaagggcgaccuccucgagggcgccaacgccuaccacugcgagaagugcaacaagaaggucgacaccgucaagcgccuccucaucaagaagcucccccccguccucgccauccagcucaagcgcuucgacuacgacugggagcgcgagugcgccaucaaguucaacgacuacuucgaguucccccgcgagcucgacauggagcccuacaccgucgccggcgucgccaagcucgagggcgacaacgucaaccccgagucccagcucauccagcaguccgagcaguccgaguccgagaccgccggcuccaccaaguaccgccucgucggcguccucguccacuccggccaggccuccggcggccacuacuacuccuacaucauccagcgcaacggcggcgacggcgagcgcaaccgcugguacaaguucgacgacggcgacgucaccgagugcaagauggacgacgacgaggagaugaagaaccagugcuucggcggcgaguacaugggcgaggucuucgaccacaugaugaagcgcauguccuaccgccgccagaagcgcugguggaacgccuacauccucuucuacgagcgcauggacaccaucgaccaggacgacgagcucauccgcuacaucuccgagcucgccaucaccacccgcccccaccagaucaucaugcccuccgccaucgagcgcuccguccgcaagcagaacguccaguucaugcacaaccgcaugcaguacuccauggaguacuuccaguucaugaagaagcuccucaccugcaacggcgucuaccucaaccccccccccggccaggaccaccuccuccccgaggccgaggagaucaccaugaucuccauccagcucgccgcccgcuuccucuucaccaccggcuuccacaccaagaaggucguccgcggcuccgccuccgacugguacgacgcccucugcauccuccuccgccacuccaagaacguccgcuucugguucgcccacaacguccucuucaacgucuccaaccgcuucuccgaguaccuccucgagugccccuccgccgagguccgcggcgccuucgccaagcucaucgucuucaucgcccacuucucccuccaggacggccccugccccucccccuucgccucccccggccccuccucccaggccuacgacaaccucucccucuccgaccaccuccuccgcgccguccucaaccuccuccgccgcgaggucuccgagcacggccgccaccuccagcaguacuucaaccucuucgucauguacgccaaccucggcgucgccgagaagacccagcuccucaagcucuccguccccgccaccuucaugcucgucucccucgacgagggccccggcccccccaucaaguaccaguacgccgagcucggcaagcucuacuccgucgucucccagcucauccgcugcugcaacgucuccucccgcaugcaguccuccaucaacggcaaccccccccuccccaaccccuucggcgaccccaaccucucccagcccaucaugcccauccagcagaacgucgccgacauccucuucguccgcaccuccuacgucaagaagaucaucgaggacugcuccaacuccgaggagaccgucaagcuccuccgcuucugcugcugggagaacccccaguucuccuccaccguccucuccgagcuccucuggcaggucgccuacuccuacaccuacgagcuccgccccuaccucgaccuccuccuccagauccuccucaucgaggacuccuggcagacccaccgcauccacaacgcccucaagggcauccccgacgaccgcgacggccucuucgacaccauccagcgcuccaagaaccacuaccagaagcgcgccuaccagugcaucaagugcauggucgcccucuucuccaacugccccgucgccuaccagauccuccagggcaacggcgaccucaagcgcaaguggaccugggccgucgaguggcucggcgacgagcucgagcgccgccccuacaccggcaacccccaguacaccuacaacaacugguccccccccguccaguccaacgagaccuccaacggcuacuuccucgagcgcucccacuccgcccgcaugacccucgccaaggccugcgagcucugccccgaggaggucaagaaggccaccuccguccagcagaucgagauggaggaguccaaggagcccgacgaccaggacgcccccgacgagcacgagucccccccccccgaggacgccccccucuacccccacucccccggcucccaguaccagcagaacaaccacguccacggccagcccuacaccggccccgccgcccaccacaugaacaacccccagcgcaccggccagcgcgcccaggagaacuacgagggcuccgaggaggucucccccccccagaccaaggaccaguga

SEQ ID NO: 51588 - RNA, 7668 nt, Artificial Sequence
  derived and/or modified sequence opt2 from USP9Y__Homo_sapiens__XP_011529771
augaccgccaucacccacggcucccccgucggcggcaacgacucccagggccagguccucgacggccagucccagcaccucuuccagcagaaccagaccuccucccccgacuccuccaacgagaacuccgucgccacccccccccccgaggagcagggccagggcgacgcccccccccagcacgaggacgaggagcccgccuucccccacaccgagcucgccaaccucgacgacaugaucaaccgcccccgcugggucguccccguccuccccaagggcgagcucgagguccuccucgaggccgccaucgaccucuccgucaagggccucgacgucaaguccgaggccugccagcgcuucuuccgcgacggccucaccaucuccuucaccaagauccucauggacgaggccgucuccggcuggaaguucgagauccaccgcugcaucaucaacaacacccaccgccucgucgagcucugcgucgccaagcucucccaggacugguucccccuccucgagcuccucgccauggcccucaacccccacugcaaguuccacaucuacaacggcacccgccccugcgagcucaucuccuccaacgcccagcuccccgaggacgagcucuucgcccgcuccuccgacccccgcucccccaagggcuggcucgucgaccucaucaacaaguucggcacccucaacggcuuccagauccuccacgaccgcuucuucaacggcuccgcccucaacauccagaucaucgccgcccucaucaagcccuucggccagugcuacgaguuccucucccagcacacccucaagaaguacuucauccccgucaucgagaucgucccccaccuccucgagaaccucaccgacgaggagcucaagaaggaggccaagaacgaggccaagaacgacgcccucuccaugaucaucaagucccucaagaaccucgccucccgcaucuccggccaggacgagaccaucaagaaccucgagaucuuccgccucaagaugauccuccgccuccuccagaucuccuccuucaacggcaagaugaacgcccucaacgagaucaacaaggucaucuccuccgucuccuacuacacccaccgccacuccaaccccgaggaggaggaguggcucaccgccgagcgcauggccgaguggauccagcagaacaacauccucuccaucguccuccaggacucccuccaccagccccaguacgucgagaagcucgagaagauccuccgcuucgucaucaaggagaaggcccucacccuccaggaccucgacaacaucugggccgcccaggccggcaagcacgaggccaucgucaagaacguccacgaccuccucgccaagcucgccugggacuucucccccggccagcucgaccaccucuucgacugcuucaaggccuccuggaccaacgccuccaagaagcagcgcgagaagcuccucgagcucauccgccgccucgccgaggacgacaaggacggcgucauggcccacaagguccucaaccuccucuggaaccucgcccaguccgacgacguccccgucgacaucauggaccucgcccucuccgcccacaucaagauccucgacuacuccugcucccaggaccgcgacgcccagaagauccaguggaucgaccacuucaucgaggagcuccgcaccaacgacaagugggucauccccgcccucaagcagauccgcgagaucugcucccucuucggcgaggccucccagaaccucucccagacccagcgcuccccccacaucuucuaccgccacgaccucaucaaccagcuccagcagaaccacgcccucgucacccucgucgccgagaaccucgccaccuacaugaacuccauccgccucuacgccggcgaccacgaggacuacgacccccagaccguccgccucggcucccgcuacucccacguccaggagguccaggagcgccucaacuuccuccgcuuccuccucaaggacggccagcucuggcucugcgccccccaggccaagcagaucuggaagugccucgccgagaacgccgucuaccucugcgaccgcgaggccugcuucaagugguacuccaagcucaugggcgacgagcccgaccucgaccccgacaucaacaaggacuucuucgaguccaacguccuccagcucgaccccucccuccucaccgagaacggcaugaagugcuucgagcgcuucuucaaggccgucaacugccgcgagcgcaagcucaucgccaagcgccgcuccuacaugauggacgaccucgagcucaucggccucgacuaccucuggcgcgucgucauccaguccuccgacgagaucgccaaccgcgccaucgaccuccucaaggagaucuacaccaaccucggcccccgccucaaggccaaccaggucgucauccacgaggacuucauccaguccugcuucgaccgccucaaggccuccuacgacacccucugcgucuucgacggcgacaagaacuccaucaacugcgcccgccaggaggccauccgcaugguccgcguccucaccgucaucaaggaguacaucaacgagugcgacuccgacuaccacaaggagcgcaugauccuccccaugucccgcgccuuccgcggcaagcaccucucccucaucguccgcuuccccaaccagggccgccaggucgacgagcucgacaucuggucccacaccaacgacaccaucggcuccguccgccgcugcaucgucaaccgcaucaaggccaacgucgcccacaagaagaucgagcucuucgucggcggcgagcucaucgacuccgaggacgaccgcaagcucaucggccagcucaaccucaaggacaagucccucaucaccgccaagcucacccagaucaacuucaacaugcccuccucccccgacuccuccuccgacuccuccaccgccucccccggcaaccaccgcaaccacuacaacgacggccccaaccucgaggucgaguccugccuccccggcgucaucauguccguccacccccgcuacaucuccuuccucuggcaggucgccgaccucggcuccaaccucaacaugcccccccuccgcgacggcgcccgcguccucaugaagcucaugccccccgaccgcaccgccgucgagaagcuccgcgccgucugccucgaccacgccaagcucggcgagggcaagcucucccccccccucgacucccucuucuucggccccuccgccucccagguccucuaccucaccgaggucgucuacgcccuccucaugcccgccggcgucccccucaccgacggcuccuccgacuuccagguccacuuccucaaguccggcggccucccccucguccucuccaugcucauccgcaacaacuuccuccccaacaccgacauggagacccgccgcggcgccuaccucaacgcccucaagaucgccaagcuccuccucaccgccaucggcuacggccacguccgcgccgucgccgaggccugccagcccgucgucgacggcaccgaccccaucacccagaucaaccaggucacccacgaccaggccgucguccuccaguccgcccuccaguccauccccaaccccuccuccgagugcguccuccgcaacgaguccauccuccucgcccaggagaucuccaacgaggccucccgcuacaugcccgacaucugcgucauccgcgccauccagaagaucaucugggccuccgccugcggcgcccucggccucgucuucucccccaacgaggagaucaccaagaucuaccagaugaccaccaacggcuccaacaagcucgaggucgaggacgagcaggucugcugcgaggcccucgaggucaugacccucugcuucgcccuccuccccaccgcccucgacgcccucuccaaggagaaggccuggcagaccuucaucaucgaccuccuccuccacugccccuccaagaccguccgccagcucgcccaggagcaguucuuccucaugugcacccgcugcugcaugggccaccgcccccuccucuucuucaucacccuccucuucaccauccucggcuccaccgcccgcgagaagggcaaguacuccggcgacuacuucacccuccuccgccaccuccucaacuacgccuacaacggcaacaucaacauccccaacgccgagguccuccucgucuccgagaucgacuggcucaagcgcauccgcgacaacgucaagaacaccggcgagaccggcgucgaggagcccauccucgagggccaccucggcgucaccaaggagcuccucgccuuccagaccuccgagaagaaguaccacuucggcugcgagaagggcggcgccaaccucaucaaggagcucaucgacgacuucaucuuccccgccuccaaggucuaccuccaguaccuccgcuccggcgagcuccccgccgagcaggccauccccgucugcuccucccccgucaccaucaacgccggcuucgagcuccucgucgcccucgccaucggcugcguccgcaaccucaagcagaucgucgacugccucaccgagauguacuacaugggcaccgccaucaccaccugcgaggcccucaccgagugggaguaccucccccccgucggcccccgcccccccaagggcuucgucggccucaagaacgccggcgccaccugcuacaugaacuccgucauccagcagcucuacaugauccccuccauccgcaacuccauccucgccaucgagggcaccggcuccgaccuccacgacgacauguucggcgacgagaagcaggacuccgaguccaacgucgacccccgcgacgacgucuucggcuacccccaccaguucgaggacaagcccgcccucuccaagaccgaggaccgcaaggaguacaacaucggcguccuccgccaccuccaggucaucuucggccaccucgccgccucccagcuccaguacuacgucccccgcggcuucuggaagcaguuccgccucuggggcgagcccgucaaccuccgcgagcagcacgacgcccucgaguucuucaacucccucgucgacucccucgacgaggcccucaaggcccucggccaccccgccauccucuccaagguccucggcggcuccuucgccgaccagaagaucugccagggcugcccccaccgcuacgagugcgaggaguccuucaccacccucaacgucgacauccgcaaccaccagaaccuccucgacucccucgagcaguacaucaagggcgaccuccucgagggcgccaacgccuaccacugcgagaagugcgacaagaaggucgacaccgucaagcgccuccucaucaagaagcucccccgcguccucgccauccagcucaagcgcuucgacuacgacugggagcgcgagugcgccaucaaguucaacgacuacuucgaguucccccgcgagcucgacaugggccccuacaccgucgccggcgucgccaaccucgagcgcgacaacgucaacuccgagaacgagcucaucgagcagaaggagcaguccgacaacgagaccgccggcggcaccaaguaccgccucgucggcguccucguccacuccggccaggccuccggcggccacuacuacuccuacaucauccagcgcaacggcaaggacgaccagaccgaccacugguacaaguucgacgacggcgacgucaccgagugcaagauggacgacgacgaggagaugaagaaccagugcuucggcggcgaguacaugggcgaggucuucgaccacaugaugaagcgcauguccuaccgccgccagaagcgcugguggaacgccuacauccucuucuacgagcagauggacaugaucgacgaggacgacgagaugauccgcuacaucuccgagcucaccaucgcccgcccccaccagaucaucaugucccccgccaucgagcgcuccguccgcaagcagaacgucaaguucaugcacaaccgccuccaguacucccucgaguacuuccaguucgucaagaagcuccucaccugcaacggcgucuaccucaaccccgcccccggccaggacuaccuccuccccgaggccgaggagaucaccaugaucuccauccagcucgccgcccgcuuccucuucaccaccggcuuccacaccaagaagaucguccgcggccccgccuccgacugguacgacgcccucugcguccuccuccgccacuccaagaacguccgcuucugguucacccacaacguccucuucaacgucuccaaccgcuucuccgaguaccuccucgagugccccuccgccgagguccgcggcgccuucgccaagcucaucgucuucaucgcccacuucucccuccaggacggcuccugccccucccccuucgccucccccggccccuccucccaggccugcgacaaccucucccucuccgaccaccuccuccgcgccacccucaaccuccuccgccgcgaggucuccgagcacggccaccaccuccagcaguacuucaaccucuucgucauguacgccaaccucggcgucgccgagaagacccagcuccucaagcucaacguccccgccaccuucaugcucgucucccucgacgagggccccggcccccccaucaaguaccaguacgccgagcucggcaagcucuacuccgucgucucccagcucauccgcugcugcaacgucuccuccaccaugcaguccuccaucaacggcaaccccccccuccccaaccccuucggcgaccucaaccucucccagcccaucaugcccauccagcagaacguccucgacauccucuucguccgcaccuccuacgucaagaagaucaucgaggacugcuccaacuccgaggacaccaucaagcuccuccgcuucugcuccugggagaacccccaguucuccuccaccguccucuccgagcuccucuggcaggucgccuacuccuacaccuacgagcuccgccccuaccucgaccuccucuuccagauccuccucaucgaggacuccuggcagacccaccgcauccacaacgcccucaagggcauccccgacgaccgcgacggccucuucgacaccauccagcgcuccaagaaccacuaccagaagcgcgccuaccagugcaucaagugcauggucgcccucuucuccuccugccccgucgccuaccagauccuccagggcaacggcgaccucaagcgcaaguggaccugggccgucgaguggcucggcgacgagcucgagcgccgccccuacaccggcaacccccaguacuccuacaacaacugguccccccccguccaguccaacgagaccgccaacggcuacuuccucgagcgcucccacuccgcccgcaugacccucgccaaggccugcgagcucugccccgaggaggagcccgacgaccaggacgcccccgacgagcacgagcccucccccuccgaggacgccccccucuacccccacucccccgccucccaguaccagcagaacaaccacguccacggccagcccuacaccggccccgccgcccaccaccucaacaacccccagaagaccggccagcgcacccaggagaacuacgagggcaacgaggaggucuccuccccccagaugaaggaccaguga

SEQ ID NO: 51589 - RNA, 3279 nt, Artificial Sequence
  derived and/or modified sequence opt2 from USPL1__Homo_sapiens__NP_005791
augauggacucccccaagaucggcaacggccuccccgucaucggccccggcaccgacaucggcaucuccucccuccacauggucggcuaccucggcaagaacuucgacuccgccaagguccccuccgacgaguacugccccgccugccgcgagaagggcaagcucaaggcccucaagaccuaccgcaucuccuuccaggaguccaucuuccucugcgaggaccuccagugcaucuacccccucggcuccaagucccucaacaaccucaucucccccgaccucgaggagugccacaccccccacaagccccagaagcgcaagucccucgaguccuccuacaaggacucccuccuccucgccaacuccaagaagacccgcaacuacaucgccaucgacggcggcaagguccucaacuccaagcacaacggcgaggucuacgacgagaccuccuccaaccuccccgacuccuccggccagcagaaccccauccgcaccgccgacucccucgagcgcaacgagauccucgaggccgacaccgucgacauggccaccaccaaggaccccgccaccgucgacgucuccggcaccggccgccccuccccccagaacgagggcugcaccuccaagcucgagaugccccucgaguccaagugcaccuccuucccccaggcccucugcguccaguggaagaacgccuacgcccucugcuggcucgacugcauccucuccgcccucguccacuccgaggagcucaagaacaccgucaccggccucugcuccaaggaggaguccaucuucuggcgccuccucaccaaguacaaccaggccaacacccuccucuacaccucccagcucuccggcgucaaggacggcgacugcaagaagcucaccuccgagaucuucgccgagaucgagaccugccucaacgagguccgcgacgagaucuucaucucccuccagccccagcuccgcugcacccucggcgacauggagucccccgucuucgccuucccccuccuccucaagcucgagacccacaucgagaagcucuuccucuacuccuucuccugggacuucgagugcucccagugcggccaccaguaccagaaccgccacaugaagucccucgucaccuucaccaacgucauccccgaguggcacccccucaacgccgcccacuucggccccugcaacaacugcaacuccaagucccagauccgcaagaugguccucgagaaggucucccccaucuucaugcuccacuucgucgagggccucccccagaacgaccuccagcacuacgccuuccacuucgagggcugccucuaccagaucaccuccgucauccaguaccgcgccaacaaccacuucaucaccuggauccucgacgccgacggcuccuggcucgagugcgacgaccucaagggccccugcuccgagcgccacaagaaguucgagguccccgccuccgagauccacaucgucaucugggagcgcaagaucucccaggucaccgacaaggaggccgccugccucccccucaagaagaccaacgaccagcacgcccucuccaacgagaagcccgucucccucaccuccugcuccgucggcgacgccgccuccgccgagaccgccuccgucacccaccccaaggacaucuccgucgccccccgcacccucucccaggacaccgccgucacccacggcgaccaccuccucuccggccccaagggccucgucgacaacauccucccccucacccucgaggagaccauccagaagaccgccuccgucucccagcucaacuccgaggccuuccuccucgagaacaagcccgucgccgagaacaccggcauccucaagaccaacacccuccucucccaggagucccucauggccuccuccgucuccgcccccugcaacgagaagcucauccaggaccaguucgucgacaucuccuuccccucccaggucgucaacaccaacaugcaguccguccagcucaacaccgaggacaccgucaacaccaaguccgucaacaacaccgacgccaccggccucauccagggcgucaaguccgucgagaucgagaaggacgcccagcucaagcaguuccucacccccaagaccgagcagcucaagcccgagcgcgucaccucccaggucuccaaccucaagaagaaggagaccaccgccgacucccagaccaccaccuccaagucccuccagaaccagucccucaaggagaaccagaagaagcccuucgucggcuccugggucaagggccucaucucccgcggcgccuccuucaugccccucugcgucuccgcccacaaccgcaacaccaucaccgaccuccagcccuccgucaagggcgucaacaacuucggcggcuucaagaccaagggcaucaaccagaaggccucccacgucuccaagaaggcccgcaaguccgccuccaagcccccccccaucuccaagccccccgccggcccccccuccuccaacggcaccgccgcccacccccacgcccacgccgccuccgagguccucgagaaguccggcuccaccuccugcggcgcccagcucaaccacuccuccuacggcaacggcaucuccuccgccaaccacgaggaccucgucgagggccagauccacaagcuccgccucaagcuccgcaagaagcucaaggccgagaagaagaagcucgccgcccucauguccuccccccagucccgcaccguccgcuccgagaaccucgagcaggucccccaggacggcucccccaacgacugcgaguccaucgaggaccuccucaacgagcuccccuaccccaucgacaucgccuccgaguccgccugcaccaccguccccggcgucucccucuacuccucccagacccacgaggagauccucgccgagcuccucucccccacccccgucuccaccgagcucuccgagaacggcgagggcgacuuccgcuaccucggcaugggcgacucccacauccccccccccguccccuccgaguucaacgacgucucccagaacacccaccuccgccaggaccacaacuacugcucccccaccaagaagaaccccugcgagguccagcccgacucccucaccaacaacgccugcguccgcacccucaaccucgagucccccaugaagaccgacaucuucgacgaguucuucuccuccuccgcccucaacgcccucgccaacgacacccucgaccucccccacuucgacgaguaccucuucgagaacuacuga

SEQ ID NO: 51590 - RNA, 1221 nt, Artificial Sequence
  derived and/or modified sequence opt2 from UST__Homo_sapiens__NP_005706
augaagaagaagcagcagcaccccggcggcggcgccgaccccuggccccacggcgcccccaugggcggcgccccccccggccucggcuccuggaagcgccgcgucccccuccuccccuuccuccgcuucucccuccgcgacuacggcuucugcauggccacccuccucgucuucugccucggcucccuccucuaccagcucuccggcggccccccccgcuuccuccucgaccuccgccaguaccucggcaacuccaccuaccucgacgaccacggccccccccccuccaagguccuccccuuccccucccaggucgucuacaaccgcgucggcaagugcggcucccgcaccgucguccuccuccuccgcauccucuccgagaagcacggcuucaaccucgucaccuccgacauccacaacaagacccgccucaccaagaacgagcagauggagcucaucaagaacaucuccaccgccgagcagcccuaccucuucacccgccacguccacuuccucaacuucucccgcuucggcggcgaccagcccgucuacaucaacaucauccgcgaccccgucaaccgcuuccucuccaacuacuucuuccgccgcuucggcgacuggcgcggcgagcagaaccacaugauccgcacccccuccaugcgccaggaggagcgcuaccucgacaucaacgagugcauccucgagaacuaccccgagugcuccaacccccgccucuucuacaucauccccuacuucugcggccagcacccccgcugccgcgagcccggcgagugggcccucgagcgcgccaagcucaacgucaacgagaacuuccuccucgucggcauccucgaggagcucgaggacguccuccuccuccucgagcgcuuccucccccacuacuucaagggcguccucuccaucuacaaggaccccgagcaccgcaagcucggcaacaugaccgucaccgucaagaagaccguccccucccccgaggccguccagauccucuaccagcgcaugcgcuacgaguacgaguucuaccacuacgucaaggagcaguuccaccuccucaagcgcaaguucggccucaagucccacgucuccaagcccccccuccgcccccacuucuucauccccaccccccucgagaccgaggagcccaucgacgacgaggagcaggacgacgagaaguggcucgaggacaucuacaagcgcuga

SEQ ID NO: 51591 - RNA, 1026 nt, Artificial Sequence
  derived and/or modified sequence opt2 from UTF1__Homo_sapiens__NP_003568
augcuccuccgcccccgccgcccccccccccucgccccccccgccccccccucccccgccucccccgaccccgagccccgcacccccggcgacgcccccggcacccccccccgccgccccgccucccccuccgcccucggcgagcucggccuccccgucucccccggcuccgcccagcgcacccccugguccgcccgcgagaccgagcuccuccucggcacccuccuccagcccgccgucuggcgcgcccuccuccucgaccgccgccaggcccuccccaccuaccgccgcgucuccgccgcccucgcccagcagcagguccgccgcacccccgcccagugccgccgccgcuacaaguuccucaaggacaaguuccgcgaggcccacggccagccccccggccccuucgacgagcagauccgcaagcucaugggccuccucggcgacaacggccgcaagcgcccccgccgccgcucccccggcuccggccgcccccagcgcgcccgccgccccguccccaacgcccacgcccccgcccccuccgagcccgacgccaccccccuccccaccgcccgcgaccgcgacgccgaccccaccuggacccuccgcuucucccccuccccccccaaguccgccgacgccucccccgcccccggcuccccccccgcccccgcccccaccgcccucgccaccugcauccccgaggaccgcgcccccguccgcggccccggcucccccccccccccccccgcccgcgaggaccccgacuccccccccggccgccccgaggacugcgcccccccccccgccgccccccccucccucaacaccgcccuccuccagacccucggccaccucggcgacaucgccaacauccucggcccccuccgcgaccagcuccucacccucaaccagcacgucgagcagcuccgcggcgccuucgaccagaccgucucccucgccgucggcuucauccucggcuccgccgccgccgagcgcggcguccuccgcgaccccugccaguga

SEQ ID NO: 51592 - RNA, 2160 nt, Artificial Sequence
  derived and/or modified sequence opt2 from UTP14A__Homo_sapiens__NP_001159693
augaccgccaaccgccucgccgagucccuccucgcccucucccagcaggaggagcucgccgaccuccccaaggacuaccuccucuccgaguccgaggacgagggcgacaacgacggcgagcgcaagcaccagaagcuccucgaggccaucuccucccucgacggcaagaaccgccgcaagcucgccgagcgcuccgaggccucccucaaggucuccgaguucaacgucuccuccgagggcuccggcgagaagcucguccucgccgaccuccucgagcccgucaagaccuccuccucccucgccaccgucaagaagcagcucucccgcgucaaguccaagaagaccgucgagcucccccucaacaaggaggagaucgagcgcgcccgcaccccccucgagcaggagaucuucaaccuccuccacaagaacaagcagcccgucaccgacccccuccucacccccgucgagaaggccucccuccgcgccaugucccucgaggaggccaagaugcgccgcgccgagcuccagcgcgcccgcgcccuccaguccuacuacgaggccaaggcccgccgcgagaagaagaucaaguccaagaaguaccacaaggucgucaagaagggcaaggccaagaaggcccucaaggaguucgagcagcuccgcaaggucaaccccgccgccgcccucgaggagcucgagaagaucgagaaggcccgcaugauggagcgcaugucccucaagcaccagaacuccggcaagugggccaaguccaaggccaucauggccaaguacgaccucgaggcccgccaggccaugcaggagcagcucuccaagaacaaggagcucacccagaagcuccaggucgccuccgaguccgaggaggaggagggcggcaccgaggacgucgaggagcuccucguccccgacgucgucaacgagguccagaugaacgccgacggccccaaccccuggaugcuccgcuccugcaccuccgacaccaaggaggccgccacccaggaggaccccgagcagcuccccgagcucgaggcccacggcgucuccgaguccgagggcgaggagcgccccgucgccgaggaggagauccuccuccgcgaguucgaggagcgccgcucccuccgcaagcgcuccgagcucucccaggacgccgagcccgccggcucccaggagaccaaggacuccggcucccaggagguccucuccgagcuccgcguccucucccagaagcucaaggagaaccaccagucccgcaagcagaaggccuccuccgagggcaccaucccccagguccagcgcgaggagcccgcccccgaggaggaggagccccuccuccuccagcgccccgagcgcguccagacccucgaggagcucgaggagcucggcaaggaggagugcuuccagaacaaggagcucccccgccccguccucgagggccagcaguccgagcgcacccccaacaaccgccccgacgcccccaaggagaagaagaagaaggagcagaugaucgaccuccagaaccuccucaccacccagucccccuccgucaagucccucgccguccccaccaucgaggagcucgaggacgaggaggagcgcaaccaccgccagaugaucaaggaggccuucgccggcgacgacgucauccgcgacuuccucaaggagaagcgcgaggccgucgaggccuccaagcccaaggacgucgaccucacccuccccggcuggggcgaguggggcggcgucggccucaagcccuccgccaagaagcgccgccgcuuccucaucaaggcccccgagggccccccccgcaaggacaagaaccuccccaacgucaucaucaacgagaagcgcaacauccacgccgccgcccaccagguccgcguccuccccuaccccuucacccaccacuggcaguucgagcgcaccauccagacccccaucggcuccaccuggaacacccagcgcgccuuccagaagcucaccacccccaaggucgucaccaagcccggccacaucaucaaccccaucaaggccgaggacgucggcuaccgcuccuccucccgcuccgaccucuccgucauccagcgcaaccccaagcgcaucaccacccgccacaagaagcagcucaagaagugcuccgucgacuga

SEQ ID NO: 51593 - RNA, 2301 nt, Artificial Sequence
  derived and/or modified sequence opt2 from UTP14C__Homo_sapiens__NP_067677
augaacgucaaccaggucgccgagaaccucgcccucucccaccaggaggagcucgucgaccuccccaagaacuacccccucuccgagaacgaggacgagggcgacuccgacggcgagcgcaagcaccagaagcuccucgaggccaucaucucccucgacggcaagaaccgccgcaagcucgccgagcgcuccgaggccucccucaaggucuccgaguucuccgucuccuccgagggcuccggcgagaagcucggccucgccgaccuccucgagcccgucaagaccuccuccucccucgccaccgucaagaagcagcucaaccgcgucaaguccaagaaggucgucgagcucccccucaacaaggagaagaucgagcagauccaccgcgaggucgccuucuccaagaccucccagguccucuccaagugggaccccaucauccucaagaaccagcaggccgagcagcucgucuucccccucggcaaggagcagcccgccaucgcccccaucgagcacgcccucuccggcuggaaggcccgcaccccccucgagcaggagaucuucaaccuccuccacaagaacaagcagcccgucaccgacccccuccucacccccauggagaaggccucccuccaggccaugucccucgaggaggccaagaugcaccgcgccgagcuccagcgcgcccgcgcccuccaguccuacuacgaggccaaggcccgcaaggagaagaagaucaaguccaagaaguaccacaaggucgucaagaagggcaaggccaagaaggcccucaaggaguucgagcagcuccagaaggucaaccccaccgucgcccucgaggagauggagaagaucgagaacgcccgcaugauggagcgcaugucccucaagcaccagaacuccggcaagugggccaaguccaaggccaucauggccaaguacgaccucgaggcccgccaggccaugcaggagcagcucgccaagaacaaggagcucacccagaagcuccaggucgccuccgaguccgaggaggaggagggcggcaccgaggucgaggagcuccucgucccccacgucgccaacgagguccagaugaacgucgacggccccaaccccuggauguuccgcuccugcaccuccgacaccaaggaggccgccacccaggaggaccccgagcagguccccgagcucgccgcccacgaggucuccgccuccgaggccgaggagcgccccgucgccgaggaggagauccuccuccgcgaguucgaggagcgccagucccuccgcaagcgcuccgagcucaaccaggacgccgagcccgccuccucccaggagaccaaggacuccuccucccaggagguccucuccgagcuccgcgcccucucccagaagcucaaggagaagcaccagucccgcaagcagaaggccuccuccgagggcaccgucccccagguccagcgcgaggagcccgcccccgaggaggccgagccccuccuccuccagcgcuccgagcgcguccagacccucgaggagcucgaggagcucggcaaggaggacugcuuccagaacaaggagcucccccgccccguccucgagggccagcaguccgagcgcacccccaacaaccgccccgacgcccccaaggagaagaaggagaaggagcagcucaucaaccuccagaacuuccucaccacccagucccccuccguccgcucccucgccguccccaccaucaucgaggagcucgaggacgaggaggagcgcgaccagcgccagaugaucaaggaggccuucgccggcgacgacgucauccgcgacuuccucaaggagaagcgcgaggccgucgaggccuccaagcccaaggacgucgaccucacccuccccggcuggggcgaguggggcggcgucggccucaagcccuccgccaagaagcgccgccaguuccucaucaaggcccccgagggccccccccgcaaggacaagaaccuccccaacgucaucaucuccgagaagcgcaacauccacgccgccgcccaccagguccagguccuccccuaccccuucacccaccaccgccaguucgagcgcaccauccagacccccaucggcuccaccuggaacacccagcgcgccuuccagaagcucaccacccccaaggucgucaccaagcccggccacaucaucaagcccaucaaggccgaggacgucggcuaccaguccuccucccgcuccgaccuccccgucauccagcgcaaccccaagcgcaucaccacccgccacaacaaggaggagaagcucuga

SEQ ID NO: 51594 - RNA, 8358 nt, Artificial Sequence
  derived and/or modified sequence opt2 from UTP20__Homo_sapiens__NP_055318
augaagaccaagcccgucucccacaagaccgagaacaccuaccgcuuccucaccuucgccgagcgccucggcaacgucaacaucgacaucauccaccgcaucgaccgcaccgccuccuacgaggaggaggucgagaccuacuucuucgagggccuccucaaguggcgcgagcucaaccucaccgagcacuucggcaaguucuacaaggaggucaucgacaagugccaguccuucaaccagcucgucuaccaccagaacgagaucguccagucccucaagacccaccuccaggucaagaacuccuucgccuaccagccccuccucgaccucgucguccagcucgcccgcgaccuccagauggacuucuacccccacuuccccgaguucuuccucaccaucaccuccauccucgagacccaggacaccgagcuccucgagugggccuucaccucccucuccuaccucuacaaguaccucuggcgccucauggucaaggacauguccuccaucuacuccauguacuccacccuccucgcccacaagaagcuccacauccgcaacuucgccgccgaguccuucaccuuccucaugcgcaaggucuccgacaagaacgcccucuucaaccucauguuccucgaccucgacaagcaccccgagaaggucgagggcgucggccagcuccucuucgagaugugcaagggcguccgcaacauguuccacuccugcaccggccaggccgucaagcucauccuccgcaagcucggccccgucaccgagaccgagacccagcuccccuggaugcucaucggcgagacccucaagaacauggucaaguccaccgucuccuacaucuccaaggagcacuucggcaccuucuucgagugccuccaggagucccuccucgaccuccacaccaaggucaccaagaccaacugcugcgaguccuccgagcagaucaagcgccuccucgagaccuaccucauccucgucaagcacggcuccggcaccaagauccccacccccgccgacgucugcaagguccucucccagacccuccaggucgccucccucuccaccuccugcugggagacccuccucgacgucaucuccgcccucauccucggcgagaacgucucccuccccgagacccucaucaaggagaccaucgagaagaucuucgagucccgcuucgagaagcgccucaucuucuccuucuccgaggucauguucgccaugaagcaguucgagcagcucuuccuccccuccuuccucuccuacaucgucaacugcuuccucaucgacgacgccgucgucaaggacgaggcccucgccauccucgccaagcucauccucaacaaggccgccccccccaccgccggcuccauggccaucgagaaguacccccucgucuucuccccccagauggucggcuucuacaucaagcagaagaagacccgcuccaagggccgcaacgagcaguuccccguccucgaccaccuccucuccaucaucaagcucccccccaacaaggacaccaccuaccucucccaguccugggccgcccucgucguccucccccacauccgcccccucgagaaggagaaggucaucccccucgucaccggcuucaucgaggcccucuucaugaccgucgacaagggcuccuucggcaagggcaaccucuucguccucugccaggccgucaacacccuccucucccucgaggaguccuccgagcuccuccaccucguccccgucgagcgcgucaagaaccucguccucaccuucccccucgagcccuccguccuccuccucaccgaccucuacuaccagcgccucgcccucugcggcugcaagggcccccucucccaggaggcccucauggagcucuuccccaagcuccaggccaacaucuccaccggcgucuccaagauccgccuccucaccauccgcauccucaaccacuucgacguccagcuccccgaguccauggaggacgacggccucuccgagcgccaguccgucuucgccauccuccgccaggccgagcucguccccgccaccgucaacgacuaccgcgagaagcuccuccaccuccgcaagcuccgccacgacgucguccagaccgccguccccgacggcccccuccaggaggucccccuccgcuaccuccucggcaugcucuacaucaacuucuccgcccucugggaccccgucaucgagcucaucuccucccacgcccacgagauggagaacaagcaguucuggaaggucuacuacgagcaccucgagaaggccgccacccacgccgagaaggagcuccagaacgacaugaccgacgagaaguccgucggcgacgaguccugggagcagacccaggagggcgacgucggcgcccucuaccacgagcagcucgcccucaagaccgacugccaggagcgccucgaccacaccaacuuccgcuuccuccucuggcgcgcccucaccaaguuccccgagcgcgucgagccccgcucccgcgagcucuccccccucuuccuccgcuucaucaacaacgaguacuaccccgccgaccuccaggucgcccccacccaggaccuccgccgcaagggcaagggcauggucgccgaggagaucgaggaggagcccgccgccggcgacgacgaggagcucgaggaggaggccgucccccaggacgaguccucccagaagaagaagacccgccgcgccgccgccaagcagcucaucgcccaccuccaggucuucuccaaguucuccaacccccgcgcccucuaccucgaguccaagcucuacgagcucuaccuccagcuccuccuccaccaggaccagaugguccagaagaucacccucgacugcaucaugaccuacaagcacccccacguccuccccuaccgcgagaaccuccagcgccuccucgaggaccgcuccuucaaggaggagaucguccacuucuccaucuccgaggacaacgccgucgucaagaccgcccaccgcgccgaccucuuccccauccucaugcgcauccucuacggccgcaugaagaacaagaccggcuccaagacccagggcaaguccgccuccggcacccgcauggccaucguccuccgcuuccucgccggcacccagcccgaggagauccagaucuuccucgaccuccucuucgagcccguccgccacuucaagaacggcgagugccacuccgccgucauccaggccgucgaggaccucgaccucuccaagguccucccccucggccgccagcacggcauccucaacucccucgagaucguccucaagaacaucucccaccucaucuccgccuaccuccccaagauccuccagauccuccucugcaugaccgccaccgucucccacauccucgaccagcgcgagaagauccagcuccgcuucaucaacccccucaagaaccuccgccgccucggcaucaagauggucaccgacaucuuccucgacugggaguccuaccaguuccgcaccgaggagaucgacgccgucuuccacggcgccgucuggccccagaucucccgccucggcuccgagucccaguacucccccaccccccuccucaagcucaucuccaucuggucccgcaacgcccgcuacuucccccuccucgccaagcagaagcccggccaccccgagugcgacauccucaccaacgucuucgccauccucuccgccaagaaccucuccgacgccaccgccuccaucgucauggacaucgucgacgaccuccucaaccuccccgacuucgagcccaccgagaccguccucaaccuccucgucaccggcugcgucuaccccggcaucgccgagaacaucggcgaguccaucaccaucggcggccgccucauccucccccacguccccgccauccuccaguaccucuccaagaccaccaucuccgccgagaaggucaagaagaagaagaaccgcgcccaggucuccaaggagcucggcauccucuccaagaucuccaaguucaugaaggacaaggagcaguccuccguccucaucacccuccuccuccccuuccuccaccgcggcaacaucgccgaggacaccgaggucgacauccucgucaccguccagaaccuccucaagcacugcgucgaccccaccuccuuccucaagcccaucgccaagcucuucuccgucaucaagaacaagcucucccgcaagcuccucugcaccgucuucgagacccucuccgacuucgaguccggccucaaguacaucaccgacgucgucaagcucaacgccuucgaccagcgccaccucgacgacaucaacuucgacguccgcuucgagaccuuccagaccaucaccuccuacaucaaggagaugcagaucgucgacgucaacuaccucauccccgucaugcacaacugcuucuacaaccucgagcucggcgacaugucccucuccgacaacgccuccaugugccucauguccaucaucaagaagcucgccgcccucaacgucaccgagaaggacuaccgcgagaucauccaccgcucccuccucgagaagcuccgcaagggccucaagucccagaccgaguccauccagcaggacuacaccaccauccucuccugccucauccagaccuuccccaaccagcucgaguucaaggaccucguccagcucacccacuaccacgaccccgagauggacuucuucgagaacaugaagcacauccagauccaccgccgcgcccgcgcccucaagaagcucgccaagcagcucauggagggcaaggucguccucuccuccaagucccuccagaacuacaucaugcccuacgccaugacccccaucuucgacgagaagaugcucaagcacgagaacaucaccaccgccgccaccgagaucaucggcgccaucugcaagcaccucuccugguccgccuacauguacuaccucaagcacuucauccacguccuccagaccggccagaucaaccagaagcucggcgucucccuccucgucaucguccucgaggccuuccacuucgaccacaagacccucgaggagcagaugggcaagaucgagaacgaggagaacgccaucgaggccaucgagcuccccgagcccgaggccauggagcucgagcgcgucgacgaggaggagaaggaguacaccugcaagucccucuccgacaacggccagcccggcacccccgaccccgccgacuccggcggcaccuccgccaaggaguccgagugcaucaccaagcccgucuccuuccucccccagaacaaggaggagaucgagcgcaccaucaagaacauccagggcaccaucaccggcgacauccucccccgccuccacaagugccucgccuccaccaccaagcgcgaggaggagcacaagcucgucaaguccaaggucgucaacgacgaggaggucguccgcgucccccucgccuucgccauggucaagcucaugcagucccucccccaggaggucauggaggccaaccuccccuccauccuccucaaggucugcgcccuccucaagaaccgcgcccaggagauccgcgacaucgcccgcuccacccucgccaagaucaucgaggaccucggcguccacuuccuccucuacguccucaaggagcuccagaccacccucguccgcggcuaccagguccacguccucaccuucaccguccacaugcuccuccagggccucaccaacaagcuccaggucggcgaccucgacuccugccucgacaucaugaucgagaucuucaaccacgagcucuucggcgccgucgccgaggagaaggaggucaagcagauccucuccaaggucauggaggcccgccgcuccaaguccuacgacuccuacgagauccucggcaaguucgucggcaaggaccaggucaccaagcucauccucccccucaaggagauccuccagaacaccaccucccucaagcucgcccgcaagguccacgagacccuccgccgcaucaccgucggccucaucgucaaccaggagaugaccgccgaguccauccuccuccucuccuacggccucaucuccgagaaccucccccuccucaccgagaaggagaagaaccccgucgcccccgcccccgacccccgccuccccccccaguccugccuccuccucccccccacccccguccgcggcggccagaaggccgucgucucccgcaagaccaacaugcacaucuucaucgaguccggccuccgccuccuccaccucucccucaagaccuccaagaucaaguccuccggcgagugcguccucgagaugcucgaccccuucgucucccuccucaucgacugccucggcuccauggacgucaaggucaucaccggcgcccuccagugccucaucuggguccuccgcuucccccuccccuccaucgagaccaaggccgagcagcucaccaagcaccucuuccuccuccucaaggacuacgccaagcucggcgccgcccgcggccagaacuuccaccucgucgucaacugcuucaagugcgucaccauccucgucaagaaggucaaguccuaccagaucaccgagaagcagcuccagguccuccucgccuacgccgaggaggacaucuacgacaccucccgccaggccaccgccuucggccuccucaaggccauccucucccgcaagcuccucguccccgagaucgacgaggucaugcgcaaggucuccaagcucgccgucuccgcccaguccgagcccgcccgcguccagugccgccaggucuuccucaaguacauccucgacuacccccucggcgacaagcuccgccccaaccucgaguucaugcucgcccagcucaacuacgagcacgagaccggccgcgaguccacccucgagaugaucgccuaccucuucgacaccuucccccagggccuccuccacgagaacugcggcauguucuucaucccccucugccucaugaccaucaacgacgacuccgccaccugcaagaagauggccuccaugaccaucaagucccuccucggcaagaucucccucgagaagaaggacuggcucuucgacauggucaccaccugguucggcgccaagaagcgccucaaccgccagcucgccgcccucaucugcggccucuucgucgaguccgagggcgucgacuucgagaagcgccucggcaccguccuccccgucaucgagaaggagaucgaccccgagaacuucaaggacaucauggaggagaccgaggagaaggccgccgaccgccuccucuucuccuuccucacccucaucaccaagcucaucaaggagugcaacaucauccaguucaccaagcccgccgagacccucuccaagaucuggucccacguccacucccaccuccgccacccccacaacugggucuggcucaccgccgcccagaucuucggccuccucuucgccuccugccagcccgaggagcucauccagaaguggaacaccaagaagaccaagaagcaccuccccgagcccgucgccaucaaguuccucgccuccgaccucgaccagaagaugaaguccaucucccucgccuccugccaccagcuccacuccaaguuccucgaccagucccucggcgagcaggucgucaagaaccuccucuucgccgccaagguccucuaccuccucgagcucuacugcgaggacaagcaguccaagaucaaggaggaccucgaggagcaggaggcccucgaggacggcgucgccugcgccgacgagaaggccgaguccgacggcgaggagaaggaggaggucaaggaggagcucggccgccccgccacccuccucuggcucauccagaagcucucccgcaucgccaagcucgaggccgccuacuccccccgcaacccccucaagcgcaccugcaucuucaaguuccucggcgccgucgccauggaccucggcaucgacaaggucaagcccuaccuccccaugaucaucgccccccucuuccgcgagcucaacuccaccuacuccgagcaggacccccuccucaagaaccucucccaggagaucaucgagcuccucaagaagcucgucggccucgaguccuucucccucgccuucgccuccguccagaagcaggccaacgagaagcgcgcccuccgcaagaagcgcaaggcccucgaguucgucaccaaccccgacaucgccgccaagaagaagaugaagaagcacaagaacaaguccgaggccaagaagcgcaagaucgaguuccuccgccccggcuacaaggccaagcgccagaagucccacucccucaaggaccucgccauggucgaguga

SEQ ID NO: 51595 - RNA, 10302 nt, Artificial Sequence
  derived and/or modified sequence opt2 from UTRN__Homo_sapiens__NP_009055
auggccaaguacggcgagcacgaggccucccccgacaacggccagaacgaguucuccgacaucaucaagucccgcuccgacgagcacaacgacguccagaagaagaccuucaccaaguggaucaacgcccgcuucuccaaguccggcaagccccccaucaacgacauguucaccgaccucaaggacggccgcaagcuccucgaccuccucgagggccucaccggcaccucccuccccaaggagcgcggcuccacccgcguccacgcccucaacaacgucaaccgcguccuccagguccuccaccagaacaacgucgagcucgucaacaucggcggcaccgacaucgucgacggcaaccacaagcucacccucggccuccucugguccaucauccuccacuggcaggucaaggacgucaugaaggacgucauguccgaccuccagcagaccaacuccgagaagauccuccucuccuggguccgccagaccacccgccccuacucccaggucaacguccucaacuucaccaccuccuggaccgacggccucgccuucaacgccguccuccaccgccacaagcccgaccucuucuccugggacaaggucgucaagaugucccccaucgagcgccucgagcacgccuucuccaaggcccagaccuaccucggcaucgagaagcuccucgaccccgaggacgucgccguccagcuccccgacaagaaguccaucaucauguaccucaccucccucuucgagguccucccccagcaggucaccaucgacgccauccgcgaggucgagacccucccccgcaaguacaagaaggagugcgaggaggaggccaucaacauccaguccaccgcccccgaggaggagcacgaguccccccgcgccgagacccccuccaccgucaccgaggucgacauggaccucgacuccuaccagaucgcccucgaggagguccucaccuggcuccucuccgccgaggacaccuuccaggagcaggacgacaucuccgacgacgucgaggaggucaaggaccaguucgccacccacgaggccuucaugauggagcucaccgcccaccaguccuccgucggcuccguccuccaggccggcaaccagcucaucacccagggcacccucuccgacgaggaggaguucgagauccaggagcagaugacccuccucaacgcccgcugggaggcccuccgcgucgaguccauggaccgccagucccgccuccacgacguccucauggagcuccagaagaagcagcuccagcagcucuccgccuggcucacccucaccgaggagcgcauccagaagauggagaccugcccccucgacgacgacgucaagucccuccagaagcuccucgaggagcacaagucccuccaguccgaccucgaggccgagcaggucaaggucaacucccucacccacauggucgucaucgucgacgagaacuccggcgaguccgccaccgccauccucgaggaccagcuccagaagcucggcgagcgcuggaccgccgucugccgcuggaccgaggagcgcuggaaccgccuccaggagaucaacauccucuggcaggagcuccucgaggagcagugccuccucaaggccuggcucaccgagaaggaggaggcccucaacaagguccagaccuccaacuucaaggaccagaaggagcucuccgucuccguccgccgccucgccauccucaaggaggacauggagaugaagcgccagacccucgaccagcucuccgagaucggccaggacgucggccagcuccucgacaacuccaaggccuccaagaagaucaacuccgacuccgaggagcucacccagcgcugggacucccucguccagcgccucgaggacuccuccaaccaggucacccaggccgucgccaagcucggcaugucccagaucccccagaaggaccuccucgagaccguccgcguccgcgagcaggccaucaccaagaaguccaagcaggagcucccccccccccccccccccaagaagcgccagauccacgucgacaucgaggccaagaagaaguucgacgccaucuccgccgagcuccucaacuggauccucaaguggaagaccgccauccagaccaccgagaucaaggaguacaugaagaugcaggacaccuccgagaugaagaagaagcucaaggcccucgagaaggagcagcgcgagcgcaucccccgcgccgacgagcucaaccagaccggccagauccucgucgagcagaugggcaaggagggccuccccaccgaggagaucaagaacguccucgagaaggucuccuccgaguggaagaacgucucccagcaccucgaggaccucgagcgcaagauccagcuccaggaggacaucaacgccuacuucaagcagcucgacgagcucgagaaggucaucaagaccaaggaggagugggucaagcacaccuccaucuccgaguccucccgccagucccuccccucccucaaggacuccugccagcgcgagcucaccaaccuccucggccuccaccccaagaucgagauggcccgcgccuccugcuccgcccucaugucccagcccuccgcccccgacuucguccagcgcggcuucgacuccuuccucggccgcuaccaggccguccaggaggccgucgaggaccgccagcagcaccucgagaacgagcucaagggccagcccggccacgccuaccucgagacccucaagacccucaaggacguccucaacgacuccgagaacaaggcccaggucucccucaacguccucaacgaccucgccaaggucgagaaggcccuccaggagaagaagacccucgacgagauccucgagaaccagaagcccgcccuccacaagcucgccgaggagaccaaggcccucgagaagaacguccaccccgacgucgagaagcucuacaagcaggaguucgacgacguccagggcaaguggaacaagcucaagguccucgucuccaaggaccuccaccuccucgaggagaucgcccucacccuccgcgccuucgaggccgacuccaccgucaucgagaaguggauggacggcgucaaggacuuccucaugaagcagcaggccgcccagggcgacgacgccggccuccagcgccagcucgaccagugcuccgccuucgucaacgagaucgagaccaucgaguccucccucaagaacaugaaggagaucgagaccaaccuccgcuccggccccgucgccggcaucaagaccuggguccagacccgccucggcgacuaccagacccagcucgagaagcucuccaaggagaucgccacccagaagucccgccucuccgagucccaggagaaggccgccaaccucaagaaggaccucgccgagaugcaggaguggaugacccaggccgaggaggaguaccucgagcgcgacuucgaguacaagucccccgaggagcucgaguccgccgucgaggagaugaagcgcgccaaggaggacguccuccagaaggagguccgcgucaagauccucaaggacaacaucaagcuccucgccgccaagguccccuccggcggccaggagcucaccuccgagcucaacgucguccucgagaacuaccagcuccucugcaaccgcauccgcggcaagugccacacccucgaggaggucugguccugcuggaucgagcuccuccacuaccucgaccucgagaccaccuggcucaacacccucgaggagcgcaugaaguccaccgagguccuccccgagaagaccgacgccgucaacgaggcccucgagucccucgaguccguccuccgccaccccgccgacaaccgcacccagauccgcgagcucggccagacccucaucgacggcggcauccucgacgacaucaucuccgagaagcucgaggccuucaacucccgcuacgaggaccucucccaccucgccgaguccaagcagaucucccucgagaagcagcuccagguccuccgcgagaccgaccagaugcuccagguccuccaggagucccucggcgagcucgacaagcagcucaccaccuaccucaccgaccgcaucgacgccuuccaggucccccaggaggcccagaagauccaggccgagaucuccgcccacgagcucacccucgaggagcuccgccgcaacaugcgcucccagccccucaccucccccgagucccgcaccgcccgcggcggcucccagauggacguccuccagcgcaagcuccgcgaggucuccaccaaguuccagcucuuccagaagcccgccaacuucgagcagcgcaugcucgacugcaagcgcguccucgacggcgucaaggccgagcuccacguccucgacgucaaggacgucgaccccgacgucauccagacccaccucgacaagugcaugaagcucuacaagacccucuccgaggucaagcucgaggucgagaccgucaucaagaccggccgccacaucguccagaagcagcagaccgacaaccccaagggcauggacgagcagcucaccucccucaagguccucuacaacgaccucggcgcccaggucaccgagggcaagcaggaccucgagcgcgccucccagcucgcccgcaagaugaagaaggaggccgccucccucuccgaguggcucuccgccaccgagaccgagcucguccagaaguccaccuccgagggccuccucggcgaccucgacaccgagaucuccugggccaagaacguccucaaggaccucgagaagcgcaaggccgaccucaacaccaucaccgaguccuccgccgcccuccagaaccucaucgagggcuccgagcccauccucgaggagcgccucugcguccucaacgccggcuggucccgcguccgcaccuggaccgaggacuggugcaacacccucaugaaccaccagaaccagcucgagaucuucgacggcaacgucgcccacaucuccaccuggcucuaccaggccgaggcccuccucgacgagaucgagaagaagcccaccuccaagcaggaggagaucgucaagcgccucgucuccgagcucgacgacgccaaccuccaggucgagaacguccgcgaccaggcccucauccucaugaacgcccgcggcuccuccucccgcgagcucgucgagcccaagcucgccgagcucaaccgcaacuucgagaaggucucccagcacaucaaguccgccaagcuccucaucgcccaggagccccucuaccagugccucgucaccaccgagaccuucgagaccggcguccccuucuccgaccucgagaagcucgagaacgacaucgagaacaugcucaaguucgucgagaagcaccucgaguccuccgacgaggacgagaagauggacgaggaguccgcccagaucgaggagguccuccagcgcggcgaggagaugcuccaccagcccauggaggacaacaagaaggagaagauccgccuccagcuccuccuccuccacacccgcuacaacaagaucaaggccauccccauccagcagcgcaagaugggccagcucgccuccggcauccgcuccucccuccuccccaccgacuaccucgucgagaucaacaagauccuccucugcauggacgacgucgagcucucccucaacguccccgagcucaacaccgccaucuacgaggacuucuccuuccaggaggacucccucaagaacaucaaggaccagcucgacaagcucggcgagcagaucgccgucauccacgagaagcagcccgacgucauccucgaggccuccggccccgaggccauccagauccgcgacacccucacccagcucaacgccaagugggaccgcaucaaccgcauguacuccgaccgcaagggcugcuucgaccgcgccauggaggaguggcgccaguuccacugcgaccucaacgaccucacccaguggaucaccgaggccgaggagcuccucgucgacaccugcgcccccggcggcucccucgaccucgagaaggcccgcauccaccagcaggagcucgaggucggcaucuccucccaccagcccuccuucgccgcccucaaccgcaccggcgacggcaucguccagaagcucucccaggccgacggcuccuuccucaaggagaagcucgccggccucaaccagcgcugggacgccaucgucgccgaggucaaggaccgccagccccgccucaagggcgaguccaagcaggucaugaaguaccgccaccagcucgacgagaucaucugcuggcucaccaaggccgagcacgccaugcagaagcgcuccaccaccgagcucggcgagaaccuccaggagcuccgcgaccucacccaggagauggagguccacgccgagaagcucaaguggcucaaccgcaccgagcucgagaugcucuccgacaagucccucucccuccccgagcgcgacaagaucuccgagucccuccgcaccgucaacaugaccuggaacaagaucugccgcgagguccccaccacccucaaggagugcauccaggagcccuccuccgucucccagacccgcaucgccgcccaccccaacguccagaaggucguccucgucuccuccgccuccgacauccccguccagucccaccgcaccuccgagaucuccauccccgccgaccucgacaagaccaucaccgagcucgccgacuggcucguccucaucgaccagaugcucaaguccaacaucgucaccgucggcgacgucgaggagaucaacaagaccgucucccgcaugaagaucaccaaggccgaccucgagcagcgccacccccagcucgacuacgucuucacccucgcccagaaccucaagaacaaggccuccuccuccgacaugcgcaccgccaucaccgagaagcucgagcgcgucaagaaccagugggacggcacccagcacggcgucgagcuccgccagcagcagcucgaggacaugaucaucgacucccuccagugggacgaccaccgcgaggagaccgaggagcucaugcgcaaguacgaggcccgccucuacauccuccagcaggcccgccgcgacccccucaccaagcagaucuccgacaaccagauccuccuccaggagcucggccccggcgacggcaucgucauggccuucgacaacguccuccagaagcuccucgaggaguacggcuccgacgacacccgcaacgucaaggagaccaccgaguaccucaagaccuccuggaucaaccucaagcaguccaucgccgaccgccagaacgcccucgaggccgaguggcgcaccguccaggccucccgccgcgaccucgagaacuuccucaaguggauccaggaggccgagaccaccgucaacguccucgucgacgccucccaccgcgagaacgcccuccaggacuccauccucgcccgcgagcucaagcagcagaugcaggacauccaggccgagaucgacgcccacaacgacaucuucaaguccaucgacggcaaccgccagaagauggucaaggcccucggcaacuccgaggaggccaccaugcuccagcaccgccucgacgacaugaaccagcgcuggaacgaccucaaggccaaguccgccuccauccgcgcccaccucgaggccuccgccgagaaguggaaccgccuccucaugucccucgaggagcucaucaaguggcucaacaugaaggacgaggagcucaagaagcagaugcccaucggcggcgacguccccgcccuccagcuccaguacgaccacugcaaggcccuccgccgcgagcucaaggagaaggaguacuccguccucaacgccgucgaccaggcccgcgucuuccucgccgaccagcccaucgaggcccccgaggagccccgccgcaaccuccaguccaagaccgagcucacccccgaggagcgcgcccagaagaucgccaaggccaugcgcaagcaguccuccgaggucaaggagaagugggagucccucaacgccgucaccuccaacuggcagaagcaggucgacaaggcccucgagaagcuccgcgaccuccagggcgccauggacgaccucgacgccgacaugaaggaggccgaguccguccgcaacggcuggaagcccgucggcgaccuccucaucgacucccuccaggaccacaucgagaagaucauggccuuccgcgaggagaucgcccccaucaacuucaaggucaagaccgucaacgaccucuccucccagcucuccccccucgaccuccaccccucccucaagaugucccgccagcucgacgaccucaacaugcgcuggaagcuccuccaggucuccgucgacgaccgccucaagcagcuccaggaggcccaccgcgacuucggccccuccucccagcacuuccucuccaccuccguccagcuccccuggcagcgcuccaucucccacaacaagguccccuacuacaucaaccaccagacccagaccaccugcugggaccaccccaagaugaccgagcucuuccagucccucgccgaccucaacaacguccgcuucuccgccuaccgcaccgccaucaagauccgccgccuccagaaggcccucugccucgaccuccucgagcucuccaccaccaacgagaucuucaagcagcacaagcucaaccagaacgaccagcuccucuccguccccgacgucaucaacugccucaccaccaccuacgacggccucgagcagaugcacaaggaccucgucaacgucccccucugcgucgacaugugccucaacuggcuccucaacgucuacgacaccggccgcaccggcaagauccgcguccagucccucaagaucggccucaugucccucuccaagggccuccucgaggagaaguaccgcuaccucuucaaggaggucgccggccccaccgagaugugcgaccagcgccagcucggccuccuccuccacgacgccauccagaucccccgccagcucggcgaggucgccgccuucggcggcuccaacaucgagcccuccguccgcuccugcuuccagcagaacaacaacaagcccgagaucuccgucaaggaguucaucgacuggaugcaccucgagccccaguccauggucuggcuccccguccuccaccgcgucgccgccgccgagaccgccaagcaccaggccaagugcaacaucugcaaggagugccccaucgucggcuuccgcuaccgcucccucaagcacuucaacuacgacgucugccaguccugcuucuucuccggccgcaccgccaagggccacaagcuccacuaccccauggucgaguacugcauccccaccaccuccggcgaggacguccgcgacuucaccaagguccucaagaacaaguuccgcuccaagaaguacuucgccaagcacccccgccucggcuaccuccccguccagaccguccucgagggcgacaaccucgagacccccaucacccucaucuccauguggcccgagcacuacgaccccucccaguccccccagcucuuccacgacgacacccacucccgcaucgagcaguacgccacccgccucgcccagauggagcgcaccaacggcuccuuccucaccgacuccuccuccaccaccggcuccgucgaggacgagcacgcccucauccagcaguacugccagacccucggcggcgagucccccgucucccagccccagucccccgcccagauccucaaguccgucgagcgcgaggagcgcggcgagcucgagcgcaucaucgccgaccucgaggaggagcagcgcaaccuccaggucgaguacgagcagcucaaggaccagcaccuccgccgcggccuccccgucggcuccccccccgaguccaucaucuccccccaccacaccuccgaggacuccgagcucaucgccgaggccaagcuccuccgccagcacaagggccgccucgaggcccgcaugcagauccucgaggaccacaacaagcagcucgagucccagcuccaccgccuccgccagcuccucgagcagcccgaguccgacucccgcaucaacggcgucucccccugggccuccccccagcacuccgcccucuccuacucccucgaccccgacgccuccggcccccaguuccaccaggccgccggcgaggaccuccucgcccccccccacgacaccuccaccgaccucaccgaggucauggagcagauccacuccaccuuccccuccugcugccccaacguccccucccgcccccaggccauguga

SEQ ID NO: 51596 - RNA, 360 nt, Artificial Sequence
  derived and/or modified sequence opt2 from UTS2B__Homo_sapiens__NP_937795
augaacaagauccucuccuccaccgucugcuucggccuccucacccuccucuccguccucuccuuccuccaguccguccacggccgccccuaccucacccagggcaacgagaucuuccccgacaagaaguacaccaaccgcgaggagcuccuccucgcccuccucaacaagaacuucgacuuccagcgccccuucaacaccgaccucgcccuccccaacaagcucgaggagcucaaccagcucgagaagcucaaggagcagcucgucgaggagaaggacuccgagaccuccuacgccgucgacggccucuucuccucccaccccuccaagcgcgccugcuucuggaaguacugcgucuga

SEQ ID NO: 51597 - RNA, 420 nt, Artificial Sequence
  derived and/or modified sequence opt2 from UTS2__Homo_sapiens__XP_011538839
auggagaccaacgucuuccaccucaugcucugcgucaccuccgcccgcacccacaaguccaccucccucugcuucggccacuucaacuccuaccccucccucccccucauccacgaccuccuccucgagaucuccuuccagcucuccgccccccacgaggacgcccgccucacccccgaggagcucgagcgcgccucccuccuccagauccuccccgagaugcucggcgccgagcgcggcgacauccuccgcaaggccgacuccuccaccaacaucuucaacccccgcggcaaccuccgcaaguuccaggacuucuccggccaggaccccaacauccuccucucccaccuccucgcccgcaucuggaagcccuacaagaagcgcgagacccccgacugcuucuggaaguacugcgucuga

SEQ ID NO: 51598 - RNA, 1170 nt, Artificial Sequence
  derived and/or modified sequence opt2 from UTS2R__Homo_sapiens__NP_061822
auggcccucacccccgagucccccuccuccuuccccggccucgccgccaccggcuccuccguccccgagccccccggcggccccaacgccacccucaacuccuccugggccucccccaccgagcccuccucccucgaggaccucgucgccaccggcaccaucggcacccuccucuccgccaugggcgucgucggcgucgucggcaacgccuacacccucgucgucaccugccgcucccuccgcgccgucgccuccauguacgucuacgucgucaaccucgcccucgccgaccuccucuaccuccucuccauccccuucaucgucgccaccuacgucaccaaggaguggcacuucggcgacgucggcugccgcguccucuucggccucgacuuccucaccaugcacgccuccaucuucacccucaccgucauguccuccgagcgcuacgccgccguccuccgcccccucgacaccguccagcgccccaagggcuaccgcaagcuccucgcccucggcaccuggcuccucgcccuccuccucacccuccccgucaugcucgccaugcgccucguccgccgcggccccaagucccucugccuccccgccuggggcccccgcgcccaccgcgccuaccucacccuccucuucgccaccuccaucgccggccccggccuccucaucggccuccucuacgcccgccucgcccgcgccuaccgccgcucccagcgcgccuccuucaagcgcgcccgccgccccggcgcccgcgcccuccgccucguccucggcaucguccuccucuucugggccugcuuccuccccuucuggcucuggcagcuccucgcccaguaccaccaggccccccucgccccccgcaccgcccgcaucgucaacuaccucaccaccugccucaccuacggcaacuccugcgccaaccccuuccucuacacccuccucacccgcaacuaccgcgaccaccuccgcggccgcguccgcggccccggcuccggcggcggccgcggccccguccccucccuccagccccgcgcccgcuuccagcgcugcuccggccgcucccucuccuccugcuccccccagcccaccgacucccucguccucgcccccgccgcccccgcccgccccgcccccgagggcccccgcgcccccgccuga

SEQ ID NO: 51599 - RNA, 4179 nt, Artificial Sequence
  derived and/or modified sequence opt2 from UTY__Homo_sapiens__NP_001245181
augaaguccugcgccgucucccucaccaccgccgccgucgccuucggcgacgaggccaagaagauggccgagggcaaggccucccgcgaguccgaggaggaguccgucucccucaccgucgaggagcgcgaggcccucggcggcauggacucccgccucuucggcuucguccgccuccacgaggacggcgcccgcaccaagacccuccucggcaaggccguccgcugcuacgagucccucauccucaaggccgagggcaaggucgaguccgacuucuucugccagcucggccacuucaaccuccuccucgaggacuacuccaaggcccucuccgccuaccagcgcuacuacucccuccaggccgacuacuggaagaacgccgccuuccucuacggccucggccucgucuacuucuacuacaacgccuuccacugggccaucaaggccuuccaggacguccucuacgucgaccccuccuucugccgcgccaaggagauccaccuccgccucggccucauguucaaggucaacaccgacuacaaguccucccucaagcacuuccagcucgcccucaucgacugcaaccccugcacccucuccaacgccgagauccaguuccacaucgcccaccucuacgagacccagcgcaaguaccacuccgccaaggaggccuacgagcagcuccuccagaccgagaaccuccccgcccaggucaaggccaccguccuccagcagcucggcuggaugcaccacaacauggaccucgucggcgacaaggccaccaaggaguccuacgccauccaguaccuccagaagucccucgaggccgaccccaacuccggccaguccugguacuuccucggccgcugcuacuccuccaucggcaagguccaggacgccuucaucuccuaccgccaguccaucgacaaguccgaggccuccgccgacaccuggugcuccaucggcguccucuaccagcagcagaaccagcccauggacgcccuccaggccuacaucugcgccguccagcucgaccacggccacgccgccgccuggauggaccucggcacccucuacgaguccugcaaccagccccaggacgccaucaagugcuaccucaacgccgcccgcuccaagcgcugcuccaacaccuccacccucgccgcccgcaucaaguuccuccaggcccagcucugcaaccucccccaguccucccuccagaacaagaccaagcuccuccccuccaucgaggaggccuggucccuccccauccccgccgagcucaccucccgccagggcgccaugaacaccgcccagcagaacggcuccgacaacuggaacggcggccagucccucucccaccaccccguccagcaggucuacucccucugccucaccccccagaagcuccagcaccucgagcagcuccgcgccaaccgcgacaaccucaaccccgcccagaagcaccagcucgagcagcucgagucccaguucguccucaugcagcagaugcgccacaaggaggucgcccagguccgcaccaccggcauccacaacggcgccaucaccgacuccucccuccccaccaacuccgucuccaaccgccagccccacggcgcccucacccgcgucuccuccgucucccagcccggcguccgccccgccugcgucgagaagcuccucuccuccggcgccuucuccgccggcugcauccccugcggcaccuccaagauccucggcuccaccgacaccauccuccucggcuccaacugcaucgccggcuccgaguccaacggcaacguccccuaccuccagcagaacacccacacccucccccacaaccacaccgaccucaacuccuccaccgaggagcccuggcgcaagcagcucuccaacuccgcccagggccuccacaagucccaguccuccugccucuccggccccaacgaggagcagccccucuucuccaccggcuccgcccaguaccaccaggccaccuccaccggcaucaagaaggccaacgagcaccucacccuccccuccaacuccgucccccagggcgacgccgacucccaccucuccugccacaccgccaccuccggcggccagcagggcaucauguucaccaaggaguccaagcccuccaagaaccgcucccucguccccgagaccucccgccacaccggcgacaccuccaacggcugcgccgacgucaagggccucuccaaccacguccaccagcucaucgccgacgccgucuccucccccaaccacggcgacucccccaaccuccucaucgccgacaacccccagcucuccgcccuccucaucggcaaggccaacggcaacgucggcaccggcaccugcgacaaggucaacaacauccaccccgccguccacaccaagaccgaccacuccgucgccuccucccccuccuccgccaucuccaccgccacccccucccccaaguccaccgagcagcgcuccaucaacuccgucaccucccucaacuccccccacuccggccuccacaccgucaacggcgagggccucggcaagucccaguccuccaccaaggucgaccucccccucgccucccaccgcuccaccucccagauccuccccuccauguccgucuccaucugccccuccuccaccgagguccucaaggccugccgcaaccccggcaagaacggccucuccaacuccugcauccuccucgacaagugcccccccccccgcccccccaccucccccuaccccccccuccccaaggacaagcucaacccccccacccccuccaucuaccucgagaacaagcgcgacgccuucuuccccccccuccaccaguucugcaccaaccccaagaaccccgucaccgucauccgcggccucgccggcgcccucaagcucgaccucggccucuucuccaccaagacccucgucgaggccaacaacgagcacauggucgagguccgcacccagcuccuccagcccgccgacgagaacugggaccccaccggcaccaagaagaucuggcgcugcgaguccaaccgcucccacaccaccaucgccaaguacgcccaguaccaggccuccuccuuccaggagucccuccgcgaggagaacgagaagcgcacccagcacaaggaccacuccgacaacgaguccaccuccuccgagaacuccggccgccgccgcaagggccccuucaagaccaucaaguucggcaccaacaucgaccucuccgacaacaagaaguggaagcuccagcuccacgagcucaccaagcuccccgccuucgcccgcgucgucuccgccggcaaccuccucacccacgucggccacaccauccucggcaugaacaccguccagcucuacaugaagguccccggcucccgcacccccggccaccaggagaacaacaacuucugcuccgucaacaucaacaucggccccggcgacugcgagugguucgucguccccgaggacuacuggggcguccucaacgacuucugcgagaagaacaaccucaacuuccucauguccuccugguggcccaaccucgaggaccucuacgaggccaacguccccgucuaccgcuucauccagcgccccggcgaccucgucuggaucaacgccggcaccguccacuggguccaggccgucggcuggugcaacaacaucgccuggaacgucggcccccucaccgccugccaguacaagcucgccgucgagcgcuacgaguggaacaagcucaaguccgucaagucccccguccccaugguccaccucuccuggaacauggcccgcaacaucaaggucuccgaccccaagcucuucgagaugaucaaguacugccuccucaagauccucaagcaguaccagacccuccgcgaggcccucgucgccgccggcaaggaggucaucuggcacggccgcaccaacgacgagcccgcccacuacugcuccaucugcgaggucgaggucuucaaccuccucuucgucaccaacgaguccaacacccagaagaccuacaucguccacugccacgacugcgcccgcaagaccuccaagucccucgagaacuucgucguccucgagcaguacaagauggaggaccucauccaggucuacgaccaguucacccucgcccucucccucuccuccuccuccuga

SEQ ID NO: 51600 - RNA, 2100 nt, Artificial Sequence
  derived and/or modified sequence opt2 from UVRAG__Homo_sapiens__NP_003360
auguccgccuccgccuccgucggcggccccgucccccagcccccccccggccccgccgccgcccucccccccggcuccgccgcccgcgcccuccacgucgagcuccccucccagcagcgccgccuccgccaccuccgcaacaucgccgcccgcaacaucgucaaccgcaacggccaccagcuccucgacaccuacuucacccuccaccucugcuccaccgagaagaucuacaaggaguucuaccgcuccgaggucaucaagaacucccucaaccccaccuggcgcucccucgacuucggcaucaugcccgaccgccucgacaccuccgucuccugcuucgucgucaagaucuggggcggcaaggagaacaucuaccagcuccucaucgaguggaaggucugccucgacggccucaaguaccucggccagcagauccacgcccgcaaccagaacgagaucaucuucggccucaacgacggcuacuacggcgcccccuucgagcacaagggcuacuccaacgcccagaagaccauccuccuccaggucgaccagaacugcguccgcaacuccuacgacgucuucucccuccuccgccuccaccgcgcccagugcgccaucaagcagacccaggucaccguccagaagaucggcaaggagaucgaggagaagcuccgccucaccuccaccuccaacgagcucaagaagaaguccgagugccuccagcucaagauccucguccuccagaacgagcucgagcgccagaagaaggcccucggccgcgaggucgcccuccuccacaagcagcagaucgcccuccaggacaagggcuccgccuucuccgccgagcaccucaagcuccagcuccagaaggagucccucaacgagcuccgcaaggagugcaccgccaagcgcgagcucuuccucaagaccaacgcccagcucaccauccgcugccgccagcuccucuccgagcucuccuacaucuaccccaucgaccucaacgagcacaaggacuacuucgucugcggcgucaagcuccccaacuccgaggacuuccaggccaaggacgacggcuccaucgccgucgcccucggcuacaccgcccaccucgucuccaugaucuccuucuuccuccaggucccccuccgcuaccccaucauccacaagggcucccgcuccaccaucaaggacaacaucaacgacaagcucaccgagaaggagcgcgaguucccccucuaccccaagggcggcgagaagcuccaguucgacuacggcgucuaccuccucaacaagaacaucgcccagcuccgcuaccagcacggccucggcacccccgaccuccgccagacccuccccaaccucaagaacuucauggagcacggccucaugguccgcugcgaccgccaccacaccuccuccgccauccccguccccaagcgccaguccuccaucuucggcggcgccgacgucggcuucuccggcggcauccccucccccgacaagggccaccgcaagcgcgccuccuccgagaacgagcgccuccaguacaagacccccccccccuccuacaacuccgcccucgcccagcccgucaccaccguccccuccaugggcgagaccgagcgcaagaucaccucccucuccuccucccucgacaccucccucgacuucuccaaggagaacaagaagaagggcgaggaccucgucggcucccucaacggcggccacgccaacguccaccccucccaggagcagggcgaggcccucuccggccaccgcgccaccgucaacggcacccuccuccccuccgagcaggccggcuccgccuccguccagcuccccggcgaguuccaccccgucuccgaggccgagcucugcugcaccgucgagcaggccgaggagaucaucggccucgaggccaccggcuucgccuccggcgaccagcucgaggccuucaacugcauccccgucgacuccgccgucgccgucgagugcgacgagcagguccucggcgaguucgaggaguucucccgccgcaucuacgcccucaacgagaacgucuccuccuuccgccgcccccgccgcuccuccgacaaguga

SEQ ID NO: 51601 - RNA, 2457 nt, Artificial Sequence
  derived and/or modified sequence opt2 from UVSSA__Homo_sapiens__XP_011511824
augcagggccacgcccacccccccgagaaggagacccccgcccgccgccgccgccccccccccugcacccagccccgcgagcccucccgcgccuccgcccuccgcggccucugccgcgccccccgcgaguggggcccccaccacgccccccccaagccccgcuuccccaagcgcggccuccagguccgccccuccgccgccgaccucgcccuccccugcguccgcggcugcggccuccgccgccaggacggccgccgccucugcuucuccuuccgccccggccccgcccgcgcccagggcuaccuccucugcgucuggcgccgcgacauggaccagaagcucuccaagcucgucgaggagcucaccaccuccggcgagccccgccucaaccccgagaagaugaaggagcucaagaagaucugcaaguccuccgaggagcagcucucccgcgccuaccgccuccucaucgcccagcucacccaggagcacgccgagauccgccucuccgccuuccagaucgucgaggagcucuucguccgcucccaccaguuccgcaugcucgucgucuccaacuuccaggaguuccucgagcucacccucggcaccgaccccgcccagccccucccccccccccgcgaggccgcccagcgccuccgccaggccaccacccgcgccgucgagggcuggaacgagaaguucggcgaggccuacaagaagcucgcccucggcuaccacuuccuccgccacaacaagaaggucgacuuccaggacaccaacgcccgcucccucgccgagcgcaagcgcgaggaggagaagcagaagcaccucgacaagaucuaccaggagcgcgccucccaggccgagcgcgagaugcaggagauguccggcgagaucgaguccugccucaccgaggucgaguccugcuuccgccuccucguccccuucgacuucgaccccaaccccgagaccgagucccucggcauggccuccggcauguccgacgcccuccgcuccuccugcgccggccaggucggccccugccgcuccggcacccccgacccccgcgacggcgagcagcccugcugcucccgcgaccuccccgccuccgccggccacccccgcgccggcggcggcgcccagcccucccagaccgccaccggcgaccccuccgacgaggacgaggacuccgaccucgaggaguucguccgcucccacggccucggcucccacaaguacacccucgacgucgagcucugcuccgagggccucaagguccaggagaacgaggacaaccucgcccucauccacgccgcccgcgacacccucaagcucauccgcaacaaguuccuccccgccgucugcuccuggauccagcgcuucacccgcgucggcacccacggcggcugccucaagcgcgccaucgaccucaaggccgagcucgagcucguccuccgcaaguacaaggagcucgacaucgagcccgagggcggcgagcgccgccgcaccgaggcccucggcgacgccgaggaggacgaggacgacgaggacuucgucgagguccccgagaaggagggcuacgagccccacauccccgaccaccuccgccccgaguacggccucgaggccgcccccgagaaggacaccgucguccgcugccuccgcacccgcacccgcauggacgaggaggucuccgaccccaccuccgccgccgcccagcuccgccagcuccgcgaccaccuccccccccccuccuccgccucccccucccgcgcccuccccgagccccaggaggcccagaagcucgccgccgagcgcgcccgcgcccccgucguccccuacggcgucgaccuccacuacuggggccaggagcuccccaccgccggcaagaucgucaaguccgacucccagcaccgcuucuggaagcccuccgaggucgaggaggaggucgucaacgccgacaucuccgagaugcuccgcucccgccacaucaccuucgccggcaaguucgagcccguccagcacuggugccgcgccccccgccccgacggccgccucugcgagcgccaggaccgccucaagugccccuuccacggcaagaucgucccccgcgacgacgagggccgcccccucgaccccgaggaccgcgcccgcgagcagcgccgccagcuccagaagcaggagcgccccgaguggcaggaccccgagcucaugcgcgacgucgaggccgccaccggccaggaccucggcuccucccgcuacuccggcaagggccgcggcaagaagcgccgcuaccccucccucaccaaccucaaggcccaggccgacaccgcccgcgcccgcaucggccgcaaggucuucgccaaggccgccguccgccgcgucgucgccgccaugaaccgcauggaccagaagaagcacgagaaguucuccaaccaguucaacuacgcccucaacuga

SEQ ID NO: 51602 - RNA, 1278 nt, Artificial Sequence
  derived and/or modified sequence opt2 from UXS1__Homo_sapiens__NP_001240804
auggucuccaaggcccuccuccgccucgucuccgccgucaaccgccgccgcaugaagcuccuccucggcaucgcccuccucgccuacgucgccuccgucuggggcaacuucgucaacauguccuuccuccucaaccgcuccauccaggagaacggcgagcucaagaucgaguccaagaucgaggagauggucgagccccuccgcgagaagauccgcgaccucgagaaguccuucacccagaaguacccccccgucaaguuccucuccgagaaggaccgcaagcgcauccucaucaccggcggcgccggcuucgucggcucccaccucaccgacaagcucaugauggacggccacgaggucaccgucgucgacaacuucuucaccggccgcaagcgcaacgucgagcacuggaucggccacgagaacuucgagcucaucaaccacgacgucgucgagccccucuacaucgaggucgaccagaucuaccaccucgccucccccgccuccccccccaacuacauguacaaccccaucaagacccucaagaccaacaccaucggcacccucaacaugcucggccucgccaagcgcgucggcgcccgccuccuccucgccuccaccuccgaggucuacggcgaccccgagguccacccccaguccgaggacuacuggggccacgucaaccccaucggcccccgcgccugcuacgacgagggcaagcgcgucgccgagaccaugugcuacgccuacaugaagcaggagggcgucgagguccgcgucgcccgcaucuucaacaccuucggcccccgcaugcacaugaacgacggccgcgucgucuccaacuucauccuccaggcccuccagggcgagccccucaccgucuacggcuccggcucccagacccgcgccuuccaguacgucuccgaccucgucaacggccucgucgcccucaugaacuccaacgucuccucccccgucaaccucggcaaccccgaggagcacaccauccucgaguucgcccagcucaucaagaaccucgucggcuccggcuccgagauccaguuccucuccgaggcccaggacgacccccagaagcgcaagcccgacaucaagaaggccaagcucaugcucggcugggagcccgucgucccccucgaggagggccucaacaaggccauccacuacuuccgcaaggagcucgaguaccaggccaacaaccaguacauccccaagcccaagcccgcccgcaucaagaagggccgcacccgccacuccuga

SEQ ID NO: 51603 - RNA, 474 nt, Artificial Sequence
  derived and/or modified sequence opt2 from UXT__Homo_sapiens__NP_004173
auggccaccccccccaagcgccgcgccgucgaggccaccggcgagaagguccuccgcuacgagaccuucaucuccgacguccuccagcgcgaccuccgcaagguccucgaccaccgcgacaaggucuacgagcagcucgccaaguaccuccagcuccgcaacgucaucgagcgccuccaggaggccaagcacuccgagcucuacaugcaggucgaccucggcugcaacuucuucgucgacaccgucguccccgacaccucccgcaucuacgucgcccucggcuacggcuucuuccucgagcucacccucgccgaggcccucaaguucaucgaccgcaaguccucccuccucaccgagcucuccaacucccucaccaaggacuccaugaacaucaaggcccacauccacaugcuccucgagggccuccgcgagcuccagggccuccagaacuuccccgagaagccccaccacuga

SEQ ID NO: 51604 - RNA, 2349 nt, Artificial Sequence
  derived and/or modified sequence opt2 from VAC14__Homo_sapiens__NP_060522
augaaccccgagaaggacuucgccccccucacccccaacaucguccgcgcccucaacgacaagcucuacgagaagcgcaaggucgccgcccucgagaucgagaagcucguccgcgaguucgucgcccagaacaacaccguccagaucaagcacgucauccagacccucucccaggaguucgcccucucccagcacccccacucccgcaagggcggccucaucggccucgccgccugcuccaucgcccucggcaaggacuccggccucuaccucaaggagcucaucgagcccguccucaccugcuucaacgacgccgacucccgccuccgcuacuacgccugcgaggcccucuacaacaucgucaaggucgcccgcggcgccguccucccccacuucaacguccucuucgacggccucuccaagcucgccgccgaccccgaccccaacgucaaguccggcuccgagcuccucgaccgccuccucaaggacaucgucaccgaguccaacaaguucgaccucgucuccuucaucccccuccuccgcgagcgcaucuacuccaacaaccaguacgcccgccaguucaucaucuccuggauccucguccucgaguccguccccgacaucaaccuccucgacuaccuccccgagauccucgacggccucuuccagauccucggcgacaacggcaaggagauccgcaagaugugcgaggucguccucggcgaguuccucaaggagaucaagaagaaccccuccuccgucaaguucgccgagauggccaacauccucgucauccacugccagaccaccgacgaccucauccagcucaccgccaugugcuggaugcgcgaguucauccagcucgccggccgcgucaugcuccccuacuccuccggcauccucaccgccguccuccccugccucgccuacgacgaccgcaagaaguccaucaaggaggucgccaacgucugcaaccagucccucaugaagcucgucacccccgaggacgacgagcucgacgagcuccgccccggccagcgccaggccgagcccacccccgacgacgcccuccccaagcaggagggcaccgccuccggcggccccgacggcuccugcgacuccuccuucuccuccggcaucuccgucuucaccgccgccuccaccgagcgcgcccccgucacccuccaccucgacggcaucguccagguccucaacugccaccucuccgacaccgccaucggcaugaugacccgcaucgccguccucaaguggcucuaccaccucuacaucaagaccccccgcaagauguuccgccacaccgacucccucuuccccauccuccuccagacccucuccgacgaguccgacgaggucauccucaaggaccucgagguccucgccgagaucgccuccucccccgccggccagaccgacgaccccggcccccucgacggccccgaccuccaggccucccacuccgagcuccagguccccacccccggccgcgccggccuccucaacaccuccggcaccaagggccucgagugcucccccuccacccccaccaugaacuccuacuucuacaaguucaugaucaaccuccucaagcgcuucuccuccgagcgcaagcuccucgagguccgcggccccuucaucauccgccagcucugccuccuccucaacgccgagaacaucuuccacuccauggccgacauccuccuccgcgaggaggaccucaaguucgccuccaccaugguccacgcccucaacaccauccuccucaccuccaccgagcucuuccagcuccgcaaccagcucaaggaccucaagacccucgagucccagaaccucuucugcugccucuaccgcuccuggugccacaaccccgucaccaccgucucccucugcuuccucacccagaacuaccgccacgccuacgaccucauccagaaguucggcgaccucgaggucaccgucgacuuccucgccgaggucgacaagcucguccagcucaucgagugccccaucuucaccuaccuccgccuccagcuccucgacgucaagaacaaccccuaccucaucaaggcccucuacggccuccucaugcuccucccccaguccuccgccuuccagcuccucucccaccgccuccagugcguccccaaccccgagcuccuccagaccgaggacucccucaaggccgcccccaagucccagaaggccgacucccccuccaucgacuacgccgagcuccuccagcacuucgagaagguccagaacaagcaccucgagguccgccaccagcgcuccggccgcggcgaccaccucgaccgccgcgucguccucuga

SEQ ID NO: 51605 - RNA, 351 nt, Artificial Sequence
  derived and/or modified sequence opt2 from VAMP1__Homo_sapiens__NP_001284367
auguccgcccccgcccagccccccgccgagggcaccgagggcaccgcccccggcggcggcccccccggccccccccccaacaugaccuccaaccgccgccuccagcagacccaggcccaggucgaggaggucgucgacaucauccgcgucaacgucgacaagguccucgagcgcgaccagaagcucuccgagcucgacgaccgcgccgacgcccuccaggccggcgccucccaguucgaguccuccgccgccaagcucaagcgcaaguacugguggaagaacugcaagaugaugaucaugcucggcgccaucugcgccaucaucgucgucgucaucguccgccgcggcuga

SEQ ID NO: 51606 - RNA, 351 nt, Artificial Sequence
  derived and/or modified sequence opt2 from VAMP2__Homo_sapiens__NP_055047
auguccgccaccgccgccaccgccccccccgccgcccccgccggcgagggcggcccccccgcccccccccccaaccucaccuccaaccgccgccuccagcagacccaggcccaggucgacgaggucgucgacaucaugcgcgucaacgucgacaagguccucgagcgcgaccagaagcucuccgagcucgacgaccgcgccgacgcccuccaggccggcgccucccaguucgagaccuccgccgccaagcucaagcgcaaguacugguggaagaaccucaagaugaugaucauccucggcgucaucugcgccaucauccucaucaucaucaucgucuacuucuccaccuga

SEQ ID NO: 51607 - RNA, 423 nt, Artificial Sequence
  derived and/or modified sequence opt2 from VAMP4__Homo_sapiens__NP_001172056
augccccccaaguucaagcgccaccucaacgacgacgacgucaccggcuccgucaaguccgagcgccgcaaccuccucgaggacgacuccgacgaggaggaggacuucuuccucggccccuccggcccccgcuucggcccccgcaacgacaagaucaagcacguccagaaccaggucgacgaggucaucgacgucaugcaggagaacaucaccaaggucaucgagcgcggcgagcgccucgacgagcuccaggacaaguccgagucccucuccgacaacgccaccgccuucuccaaccgcuccaagcagcuccgccgccagaugugguggcgcggcugcaagaucaaggccaucauggcccucgucgccgccauccuccuccucgucaucaucauccucaucgucaugaaguaccgcaccuga

SEQ ID NO: 51608 - RNA, 540 nt, Artificial Sequence
  derived and/or modified sequence opt2 from VAMP7__Homo_sapiens__NP_001138621
auggccauccucuucgccgucgucgcccgcggcaccaccauccucgccaagcacgccuggugcggcggcaacuuccucgaggacuucgagcgcucccgcgccuucaacuuccucaacgagaucaagaagcgcuuccagaccaccuacggcucccgcgcccagaccgcccuccccuacgccaugaacuccgaguucuccuccguccucgccgcccagcucaagcaccacuccgagaacaagggccucgacaaggucauggagacccaggcccaggucgacgagcucaagggcaucaugguccgcaacaucgaccucgucgcccagcgcggcgagcgccucgagcuccucaucgacaagaccgagaaccucgucgacuccuccgucaccuucaagaccaccucccgcaaccucgcccgcgccaugugcaugaagaaccucaagcucaccaucaucaucaucaucgucuccaucgucuucaucuacaucaucgucuccccccucugcggcggcuucaccuggcccuccugcgucaagaaguga

SEQ ID NO: 51609 - RNA, 303 nt, Artificial Sequence
  derived and/or modified sequence opt2 from VAMP8__Homo_sapiens__NP_003752
auggaggaggccuccgagggcggcggcaacgaccgcguccgcaaccuccaguccgaggucgagggcgucaagaacaucaugacccagaacgucgagcgcauccucgcccgcggcgagaaccucgagcaccuccgcaacaagaccgaggaccucgaggccaccuccgagcacuucaagaccaccucccagaaggucgcccgcaaguucugguggaagaacgucaagaugaucguccucaucugcgucaucgucuucaucaucauccucuucaucguccucuucgccaccggcgccuucuccuga

SEQ ID NO: 51610 - RNA, 1566 nt, Artificial Sequence
  derived and/or modified sequence opt2 from VANGL2__Homo_sapiens__NP_065068
auggacaccgagucccaguacuccggcuacuccuacaaguccggccacucccgcuccucccgcaagcaccgcgaccgccgcgaccgccaccgcuccaagucccgcgacggcggccgcggcgacaaguccgucaccauccaggcccccggcgagccccuccucgacaacgaguccacccgcggcgacgagcgcgacgacaacuggggcgagaccaccaccgucgucaccggcaccuccgagcacuccaucucccacgacgaccucacccgcaucgccaaggacauggaggacuccgucccccucgacugcucccgccaccucggcgucgccgccggcgccacccucgcccuccucuccuuccucaccccccucgccuuccuccuccuccccccccuccucuggcgcgaggagcucgagcccugcggcaccgccugcgagggccucuucaucuccgucgccuucaagcuccucauccuccuccucggcuccugggcccucuucuuccgccgccccaaggccucccucccccgcgucuucguccuccgcgcccuccucaugguccucgucuuccuccucgucgucuccuacuggcucuucuacggcguccgcauccucgacgcccgcgagcgcuccuaccagggcgucguccaguucgccgucucccucgucgacgcccuccucuucguccacuaccucgccgucguccuccucgagcuccgccagcuccagccccaguucacccucaaggucguccgcuccaccgacggcgccucccgcuucuacaacgucggccaccucuccauccagcgcgucgccgucuggauccucgagaaguacuaccacgacuuccccgucuacaaccccgcccuccucaaccuccccaaguccguccucgccaagaaggucuccggcuucaaggucuacucccucggcgaggagaacuccaccaacaacuccaccggccagucccgcgccgucaucgccgccgccgcccgccgccgcgacaacucccacaacgaguacuacuacgaggaggccgagcacgagcgccgcguccgcaagcgccgcgcccgccucgucgucgccgucgaggaggccuucacccacaucaagcgccuccaggaggaggagcagaagaacccccgcgaggucauggacccccgcgaggccgcccaggccaucuucgccuccauggcccgcgccaugcagaaguaccuccgcaccaccaagcagcagcccuaccacaccauggaguccauccuccagcaccucgaguucugcaucacccacgacaugacccccaaggccuuccucgagcgcuaccucgccgccggccccaccauccaguaccacaaggagcgcuggcucgccaagcaguggacccucgucuccgaggagcccgucaccaacggccucaaggacggcaucgucuuccuccucaagcgccaggacuucucccucgucgucuccaccaagaagguccccuucuucaagcucuccgaggaguucgucgaccccaagucccacaaguucgucaugcgccuccaguccgagaccuccgucuga

SEQ ID NO: 51611 - RNA, 885 nt, Artificial Sequence
  derived and/or modified sequence opt2 from VAPA__Homo_sapiens__NP_003565
auggccuccgccuccggcgccauggccaagcacgagcagauccucguccucgacccccccaccgaccucaaguucaagggccccuucaccgacgucgucaccaccaaccucaagcuccgcaaccccuccgaccgcaaggucugcuucaaggucaagaccaccgccccccgccgcuacugcguccgccccaacuccggcaucaucgaccccggcuccaccgucaccgucuccgucaugcuccagcccuucgacuacgaccccaacgagaaguccaagcacaaguucaugguccagaccaucuucgccccccccaacaccuccgacauggaggccgucuggaaggaggccaagcccgacgagcucauggacuccaagcuccgcugcgucuucgagaugcccaacgagaacgacaagcucggcaucaccccccccggcaacgcccccaccgucaccuccauguccuccaucaacaacaccgucgccacccccgccuccuaccacaccaaggacgacccccgcggccucuccguccucaagcaggagaagcagaagaacgacauggagcccuccaaggccgucccccucaacgccuccaagcaggacggccccaugcccaagccccacuccgucucccucaacgacaccgagacccgcaagcucauggaggagugcaagcgccuccagggcgagaugaugaagcucuccgaggagaaccgccaccuccgcgacgagggccuccgccuccgcaaggucgcccacuccgacaagcccggcuccaccuccaccgccuccuuccgcgacaacgucaccuccccccuccccucccuccucgucgucaucgccgccaucuucaucggcuucuuccucggcaaguucauccucuga

SEQ ID NO: 51612 - RNA, 300 nt, Artificial Sequence
  derived and/or modified sequence opt2 from VAPB__Homo_sapiens__NP_001182606
auggccaaggucgagcagguccucucccucgagccccagcacgagcucaaguuccgcggccccuucaccgacgucgucaccaccaaccucaagcucggcaaccccaccgaccgcaacgucugcuucaaggucaagaccaccgccccccgccgcuacugcguccgccccaacuccggcaucaucgacgccggcgccuccaucaacgucuccggccgccgcuggaccgccgacgaggaggacuccgccgagcagcagccccacuucuccaucucccccaacugggagggccgccgccccuga

SEQ ID NO: 51613 - RNA, 2772 nt, Artificial Sequence
  derived and/or modified sequence opt2 from VARS2__Homo_sapiens__NP_001161205
augugcauccccccccccaacgucaccggcucccuccacaucggccacgcccucaccgucgccauccaggacgcccucguccgcuggcaccgcaugcgcggcgaccagguccucuggguccccggcuccgaccacgccggcaucgccacccaggccgucgucgagaagcagcucuggaaggagcgcggcguccgccgccacgagcucucccgcgaggccuuccuccgcgaggucuggcaguggaaggaggccaagggcggcgagaucugcgagcagcuccgcgcccucggcgccucccucgacugggaccgcgagugcuucaccauggacgucggcuccuccgucgccgucaccgaggccuucguccgccucuacaaggccggccuccucuaccgcaaccaccagcucgucaacugguccugcgcccuccgcuccgccaucuccgacaucgaggucgagaaccgcccccuccccggccacacccagcuccgccuccccggcugccccacccccgucuccuucggccuccucuucuccgucgccuuccccgucgacggcgagcccgacgccgaggucgucgucggcaccacccgccccgagacccuccccggcgacgucgccgucgccguccaccccgacgacucccgcuacacccaccuccacggccgccagcuccgccacccccucaugggccagccccucccccucaucaccgacuacgccguccagccccacgucggcaccggcgccgucaaggucacccccgcccacucccccgccgacgccgagaugggcgcccgccacggccucuccccccucaacgucaucgccgaggacggcaccaugaccucccucugcggcgacuggcuccagggccuccaccgcuucgucgcccgcgagaagaucauguccguccucuccgaguggggccucuuccgcggccuccagaaccaccccaugguccuccccaucugcucccgcuccggcgacgucaucgaguaccuccucaagaaccagugguucguccgcugccaggagaugggcgcccgcgccgccaaggccgucgaguccggcgcccucgagcucucccccuccuuccaccagaagaacuggcagcacugguucucccacaucggcgacuggugcgucucccgccagcucugguggggccaccagauccccgccuaccucgucgucgaggaccacgcccagggcgaggaggacugcugggucgucggccgcuccgaggccgaggcccgcgaggucgccgccgagcucaccggccgccccggcgccgagcucacccucgagcgcgaccccgacguccucgacaccugguucuccuccgcccucuuccccuucuccgcccucggcuggccccaggagacccccgaccucgcccgcuucuacccccucucccuccucgagaccggcuccgaccuccuccucuucugggucggccgcauggucaugcucggcacccagcucaccggccagcuccccuucuccaagguccuccuccaccccaugguccgcgaccgccagggccgcaagauguccaagucccucggcaacguccucgacccccgcgacaucaucuccggcgucgagaugcagguccuccaggagaagcuccgcuccggcaaccucgaccccgccgagcucgccaucgucgccgccgcccagaagaaggacuucccccacggcauccccgagugcggcaccgacgcccuccgcuucacccucugcucccacggcguccaggccggcgaccuccaccucuccgucuccgagguccaguccugccgccacuucugcaacaagaucuggaacgcccuccgcuucauccucaacgcccucggcgagaaguucgucccccagcccgccgaggagcucucccccuccucccccauggacgccuggauccucucccgccucgcccucgccgcccaggagugcgagcgcggcuuccucacccgcgagcucucccucgucacccacgcccuccaccacuucuggcuccacaaccucugcgacgucuaccucgaggccgucaagcccguccucuggcacuccccccgcccccucggccccccccagguccucuucuccugcgccgaccucggccuccgccuccucgccccccucaugcccuuccucgccgaggagcucuggcagcgccuccccccccgccccggcugcccccccgcccccuccaucuccgucgcccccuaccccuccgccugcucccucgagcacuggcgccagcccgagcucgagcgccgcuucucccgcguccaggaggucguccagguccuccgcgcccuccgcgccaccuaccagcucaccaaggcccgcccccgcguccuccuccaguccuccgagcccggcgaccagggccucuucgaggccuuccucgagccccucggcacccucggcuacugcggcgccgucggccuccucccccccggcgccgccgcccccuccggcugggcccaggccccccucuccgacaccgcccaggucuacauggagcuccagggccucgucgacccccagauccagcucccccuccucgccgcccgccgcuacaagcuccagaagcagcucgacucccucaccgcccgcacccccuccgagggcgaggccggcacccagcgccagcagaagcucuccucccuccagcucgagcucuccaagcucgacaaggccgccucccaccuccgccagcucauggacgagccccccgcccccggcucccccgagcucuga

SEQ ID NO: 51614 - RNA, 3795 nt, Artificial Sequence
  derived and/or modified sequence opt2 from VARS__Homo_sapiens__NP_006286
auguccacccucuacgucuccccccaccccgacgccuuccccucccuccgcgcccucaucgccgcccgcuacggcgaggccggcgagggccccggcuggggcggcgcccacccccgcaucugccuccagcccccccccaccucccgcacccccuucccccccccccgccuccccgcccucgagcagggccccggcggccucugggucuggggcgccaccgccgucgcccagcuccucuggcccgccggccucggcggccccggcggcucccgcgccgccguccucguccagcagugggucuccuacgccgacaccgagcucauccccgccgccugcggcgccacccuccccgcccucggccuccgcuccuccgcccaggacccccaggccguccucggcgcccucggccgcgcccucuccccccucgaggaguggcuccgccuccacaccuaccucgccggcgaggcccccacccucgccgaccucgccgccgucaccgcccuccuccuccccuuccgcuacguccucgacccccccgcccgccgcaucuggaacaacgucacccgcugguucgucaccugcguccgccagcccgaguuccgcgccguccucggcgaggucguccucuacuccggcgcccgcccccucucccaccagcccggccccgaggcccccgcccuccccaagaccgccgcccagcucaagaaggaggccaagaagcgcgagaagcucgagaaguuccagcagaagcagaagauccagcagcagcagcccccccccggcgagaagaagcccaagcccgagaagcgcgagaagcgcgaccccggcgucaucaccuacgaccuccccaccccccccggcgagaagaaggacgucuccggccccaugcccgacuccuacuccccccgcuacgucgaggccgccugguaccccuggugggagcagcagggcuucuucaagcccgaguacggccgccccaacgucuccgccgccaacccccgcggcgucuucaugaugugcauccccccccccaacgucaccggcucccuccaccucggccacgcccucaccaacgccauccaggacucccucacccgcuggcaccgcaugcgcggcgagaccacccucuggaaccccggcugcgaccacgccggcaucgccacccaggucgucgucgagaagaagcucuggcgcgagcagggccucucccgccaccagcucggccgcgaggccuuccuccaggaggucuggaaguggaaggaggagaagggcgaccgcaucuaccaccagcucaagaagcucggcuccucccucgacugggaccgcgccugcuucaccauggaccccaagcucuccgccgccgucaccgaggccuucguccgccuccacgaggagggcaucaucuaccgcuccacccgccucgucaacugguccugcacccucaacuccgccaucuccgacaucgaggucgacaagaaggagcucaccggccgcacccuccucuccguccccggcuacaaggagaaggucgaguucggcguccucgucuccuucgccuacaagguccagggcuccgacuccgacgaggaggucgucgucgccaccacccgcaucgagaccaugcucggcgacgucgccgucgccguccaccccaaggacacccgcuaccagcaccucaagggcaagaacgucauccaccccuuccucucccgcucccuccccaucgucuucgacgaguucgucgacauggacuucggcaccggcgccgucaagaucacccccgcccacgaccagaacgacuacgaggucggccagcgccacggccucgaggccaucuccaucauggacucccgcggcgcccucaucaacguccccccccccuuccucggccucccccgcuucgaggcccgcaaggccguccucgucgcccucaaggagcgcggccucuuccgcggcaucgaggacaaccccauggucgucccccucugcaaccgcuccaaggacgucgucgagccccuccuccgcccccagugguacguccgcugcggcgagauggcccaggccgccuccgccgccgucacccgcggcgaccuccgcauccuccccgaggcccaccagcgcaccuggcacgccuggauggacaacauccgcgaguggugcaucucccgccagcucugguggggccaccgcauccccgccuacuucgucaccgucuccgaccccgccgucccccccggcgaggaccccgacggccgcuacugggucuccggccgcaacgaggccgaggcccgcgagaaggccgccaaggaguucggcgucucccccgacaagaucucccuccagcaggacgaggacguccucgacaccugguucuccuccggccucuucccccucuccauccucggcuggcccaaccaguccgaggaccucuccgucuucuaccccggcacccuccucgagaccggccacgacauccucuucuucugggucgcccgcauggucaugcucggccucaagcucaccggccgccuccccuuccgcgaggucuaccuccacgccaucguccgcgacgcccacggccgcaagauguccaagucccucggcaacgucaucgacccccucgacgucaucuacggcaucucccuccagggccuccacaaccagcuccucaacuccaaccucgaccccuccgaggucgagaaggccaaggagggccagaaggccgacuuccccgccggcauccccgagugcggcaccgacgcccuccgcuucggccucugcgccuacaugucccagggccgcgacaucaaccucgacgucaaccgcauccucggcuaccgccacuucugcaacaagcucuggaacgccaccaaguucgcccuccgcggccucggcaagggcuucguccccucccccaccucccagcccggcggccacgagucccucgucgaccgcuggauccgcucccgccucaccgaggccguccgccucuccaaccagggcuuccaggccuacgacuuccccgccgucaccaccgcccaguacuccuucuggcucuacgagcucugcgacgucuaccucgagugccucaagcccguccucaacggcgucgaccaggucgccgccgagugcgcccgccagacccucuacaccugccucgacgucggccuccgccuccucucccccuucaugcccuucgucaccgaggagcucuuccagcgccucccccgccgcaugccccaggccccccccucccucugcgucacccccuaccccgagcccuccgagugcuccuggaaggaccccgaggccgaggccgcccucgagcucgcccucuccaucacccgcgccguccgcucccuccgcgccgacuacaaccucacccgcauccgccccgacugcuuccucgaggucgccgacgaggccaccggcgcccucgccuccgccgucuccggcuacguccaggcccucgccuccgccggcgucgucgccguccucgcccucggcgcccccgccccccagggcugcgccgucgcccucgccuccgaccgcugcuccauccaccuccagcuccagggccucgucgaccccgcccgcgagcucggcaagcuccaggccaagcgcgucgaggcccagcgccaggcccagcgccuccgcgagcgccgcgccgccuccggcuaccccgucaaggucccccucgagguccaggaggccgacgaggccaagcuccagcagaccgaggccgagcuccgcaaggucgacgaggccaucgcccucuuccagaagaugcucuga

SEQ ID NO: 51615 - RNA, 1098 nt, Artificial Sequence
  derived and/or modified sequence opt2 from VASH1__Homo_sapiens__NP_055724
augcccggcggcaagaaggucgccggcggcggcuccuccggcgccacccccaccuccgccgccgccaccgcccccuccggcguccgccgccucgagaccuccgagggcaccuccgcccagcgcgacgaggagcccgaggaggagggcgaggaggaccuccgcgacggcggcguccccuucuucgucaaccgcggcggccuccccgucgacgaggccaccugggagcgcauguggaagcacgucgccaagauccaccccgacggcgagaaggucgcccagcgcauccgcggcgccaccgaccuccccaagauccccauccccuccguccccaccuuccagcccuccacccccguccccgagcgccucgaggccguccagcgcuacauccgcgagcuccaguacaaccacaccggcacccaguucuucgagaucaagaagucccgcccccucaccggccucauggaccucgccaaggagaugaccaaggaggcccuccccaucaagugccucgaggccgucauccucggcaucuaccucaccaacuccaugcccacccucgagcgcuuccccaucuccuucaagaccuacuucuccggcaacuacuuccgccacaucguccucggcgucaacuucgccggccgcuacggcgcccucggcaugucccgccgcgaggaccucauguacaagccccccgccuuccgcacccucuccgagcucguccucgacuucgaggccgccuacggccgcugcuggcacguccucaagaaggucaagcucggccaguccgucucccacgacccccacuccgucgagcagaucgaguggaagcacuccguccucgacgucgagcgccucggccgcgacgacuuccgcaaggagcucgagcgccacgcccgcgacaugcgccucaagaucggcaagggcaccggcccccccucccccaccaaggaccgcaagaaggacgucuccuccccccagcgcgcccaguccuccccccaccgccgcaacucccgcuccgagcgccgccccuccggcgacaagaagaccuccgagcccaaggccaugcccgaccucaacggcuaccagauccgcgucuga

SEQ ID NO: 51616 - RNA, 873 nt, Artificial Sequence
  derived and/or modified sequence opt2 from VASH2__Homo_sapiens__NP_001129946
auguggaugcacgucgccaagguccaccccaagggcggcgagauggucggcgccauccgcaacgccgccuuccucgccaagcccuccaucccccagguccccaacuaccgccucuccaugaccauccccgacuggcuccaggccauccagaacuacaugaagacccuccaguacaaccacaccggcacccaguucuucgagauccgcaagaugcgcccccucuccggccucauggagaccgccaaggagaugacccgcgagucccuccccaucaagugccucgaggccgucauccucggcaucuaccucaccaacggccagcccuccaucgagcgcuuccccaucuccuucaagaccuacuucuccggcaacuacuuccaccacgucguccucggcaucuacugcaacggccgcuacggcucccucggcaugucccgccgcgccgagcucauggacaagccccucaccuuccgcacccucuccgaccucaucuucgacuucgaggacuccuacaagaaguaccuccacaccgucaagaaggucaagaucggccucuacgucccccacgagccccacuccuuccagcccaucgaguggaagcagcucguccucaacgucuccaagaugcuccgcgccgacauccgcaaggagcucgagaaguacgcccgcgacaugcgcaugaagauccucaagcccgccuccgcccacucccccacccagguccgcucccgcggcaagucccucuccccccgccgccgccaggccucccccccccgccgccucggccgccgcgagaagucccccgcccuccccgagaagaaggucgccgaccucuccacccucaacgaggucggcuaccagauccgcaucuga

SEQ ID NO: 51617 - RNA, 1143 nt, Artificial Sequence
  derived and/or modified sequence opt2 from VASP__Homo_sapiens__NP_003361
auguccgagaccgucaucugcuccucccgcgccaccgucaugcucuacgacgacggcaacaagcgcuggcuccccgccggcaccggcccccaggccuucucccgcguccagaucuaccacaaccccaccgccaacuccuuccgcgucgucggccgcaagaugcagcccgaccagcaggucgucaucaacugcgccaucguccgcggcgucaaguacaaccaggccacccccaacuuccaccaguggcgcgacgcccgccaggucuggggccucaacuucggcuccaaggaggacgccgcccaguucgccgccggcauggccuccgcccucgaggcccucgagggcggcggccccccccccccccccgcccuccccaccugguccguccccaacggccccucccccgaggaggucgagcagcagaagcgccagcagcccggccccuccgagcacaucgagcgccgcgucuccaacgccggcggcccccccgccccccccgccggcggccccccccccccccccggccccccccccccccccggccccccccccccccccggccucccccccuccggcguccccgccgccgcccacggcgccggcggcggccccccccccgcccccccccuccccgccgcccagggccccggcggcggcggcgccggcgcccccggccucgccgccgccaucgccggcgccaagcuccgcaaggucuccaagcaggaggaggccuccggcggccccaccgcccccaaggccgaguccggccgcuccggcggcggcggccucauggaggagaugaacgccaugcucgcccgccgccgcaaggccacccaggucggcgagaagacccccaaggacgaguccgccaaccaggaggagcccgaggcccgcguccccgcccaguccgaguccguccgccgccccugggagaagaacuccaccacccucccccgcaugaaguccuccuccuccgucaccaccuccgagacccagcccugcacccccuccuccuccgacuacuccgaccuccagcgcgucaagcaggagcuccucgaggaggucaagaaggagcuccagaaggucaaggaggagaucaucgaggccuucguccaggagcuccgcaagcgcggcucccccuga

SEQ ID NO: 51618 - RNA, 1182 nt, Artificial Sequence
  derived and/or modified sequence opt2 from VAT1__Homo_sapiens__NP_006364
auguccgacgagcgcgaggucgccgaggccgccaccggcgaggacgccuccucccccccccccaagaccgaggccgccuccgacccccagcaccccgccgccuccgagggcgccgccgccgccgccgccucccccccccuccuccgcugccucguccucaccggcuucggcggcuacgacaaggucaagcuccagucccgccccgccgccccccccgcccccggccccggccagcucacccuccgccuccgcgccugcggccucaacuucgccgaccucauggcccgccagggccucuacgaccgccuccccccccuccccgucacccccggcauggagggcgccggcgucgucaucgccgucggcgagggcgucuccgaccgcaaggccggcgaccgcgucaugguccucaaccgcuccggcauguggcaggaggaggucaccguccccuccguccagaccuuccucauccccgaggccaugaccuucgaggaggccgccgcccuccucgucaacuacaucaccgccuacaugguccucuucgacuucggcaaccuccagcccggccacuccguccucguccacauggccgccggcggcgucggcauggccgccguccagcucugccgcaccgucgagaacgucaccgucuucggcaccgccuccgccuccaagcacgaggcccucaaggagaacggcgucacccaccccaucgacuaccacaccaccgacuacgucgacgagaucaagaagaucucccccaagggcgucgacaucgucauggacccccucggcggcuccgacaccgccaagggcuacaaccuccucaagcccaugggcaaggucgucaccuacggcauggccaaccuccucaccggccccaagcgcaaccucauggcccucgcccgcaccugguggaaccaguucuccgucaccgcccuccagcuccuccaggccaaccgcgccgucugcggcuuccaccucggcuaccucgacggcgaggucgagcucgucuccggcgucgucgcccgccuccucgcccucuacaaccagggccacaucaagccccacaucgacuccgucuggcccuucgagaaggucgccgacgccaugaagcagaugcaggagaagaagaacgucggcaagguccuccucguccccggccccgagaaggagaacuga

SEQ ID NO: 51619 - RNA, 1260 nt, Artificial Sequence
  derived and/or modified sequence opt2 from VAT1L__Homo_sapiens__NP_065978
auggccaaggagggcgucgagaaggccgaggagaccgagcagaugaucgagaaggaggccggcaaggagcccgccgagggcggcggcggcgacggcucccaccgccucggcgacgcccaggagaugcgcgccgucguccucgccggcuucggcggccucaacaagcuccgccucuuccgcaaggccaugcccgagccccaggacggcgagcucaagauccgcgucaaggccugcggccucaacuucaucgaccucaugguccgccagggcaacaucgacaacccccccaagaccccccucguccccggcuucgagugcuccggcaucgucgaggcccucggcgacuccgucaagggcuacgagaucggcgaccgcgucauggccuucgucaacuacaacgccugggccgaggucgucugcacccccgucgaguucgucuacaagauccccgacgacauguccuucuccgaggccgccgccuuccccaugaacuucgucaccgccuacgucaugcucuucgaggucgccaaccuccgcgagggcauguccguccucguccacuccgccggcggcggcgucggccaggccgucgcccagcucugcuccaccguccccaacgucaccgucuucggcaccgccuccaccuucaagcacgaggccaucaaggacuccgucacccaccucuucgaccgcaacgccgacuacguccaggaggucaagcgcaucuccgccgagggcgucgacaucguccucgacugccucugcggcgacaacaccggcaagggccucucccuccucaagccccucggcaccuacauccucuacggcuccuccaacauggucaccggcgagaccaaguccuucuucuccuucgccaaguccugguggcaggucgagaaggucaaccccaucaagcucuacgaggagaacaaggucaucgccggcuucucccuccucaaccuccucuucaagcagggccgcgccggccucauccgcggcgucgucgagaagcucaucggccucuacaaccagaagaagaucaagcccgucgucgacucccucugggcccucgaggaggucaaggaggccaugcagcgcauccacgaccgcggcaacaucggcaagcucauccucgacgucgagaagacccccaccccccucauggccaacgacuccaccgagaccuccgaggccggcgaggaggaggaggaccacgagggcgacuccgagaacaaggagcgcaugcccuucauccaguga

SEQ ID NO: 51620 - RNA, 2442 nt, Artificial Sequence
  derived and/or modified sequence opt2 from VAV1__Homo_sapiens__NP_001245136
auggagcucuggcgccagugcacccacuggcucauccagugccgcguccucccccccucccaccgcgucaccugggacggcgcccaggucugcgagcucgcccaggcccuccgcgacggcguccuccucugccagcuccucaacaaccuccucccccacgccaucaaccuccgcgaggucaaccuccgcccccagaugucccaguuccucugccucaagaacauccgcaccuuccucuccaccugcugcgagaaguucggccucaagcgcuccgagcucuucgaggccuucgaccucuucgacguccaggacuucggcaaggucaucuacacccucuccgcccucuccuggacccccaucgcccagaaccgcggcaucaugcccuuccccaccgaggaggaguccgucggcgacgaggacaucuacuccggccucuccgaccagaucgacgacaccgucgaggaggacgaggaccucuacgacugcgucgagaacgaggaggccgagggcgacgagaucuacgaggaccucaugcgcuccgagcccgucuccaugccccacuuccucaagccccuccagcgcuuccucaagccccaggacaucgagaucaucuucaucaacaucgaggaccuccuccgcguccacacccacuuccucaaggagaugaaggaggcccucggcacccccggcgccgccaaccucuaccaggucuucaucaaguacaaggagcgcuuccucgucuacggccgcuacugcucccaggucgaguccgccuccaagcaccucgaccgcgucgccgccgcccgcgaggacguccagaugaagcucgaggagugcucccagcgcgccaacaacggccgcuucacccuccgcgaccuccucaugguccccaugcagcgcguccucaaguaccaccuccuccuccaggagcucgucaagcacacccaggaggccauggagaaggagaaccuccgccucgcccucgacgccaugcgcgaccucgcccagugcgucaacgaggucaagcgcgacaacgagacccuccgccagaucaccaacuuccagcucuccaucgagaaccucgaccagucccucgcccacuacggccgccccaagaucgacggcgagcucaagaucaccuccgucgagcgccgcuccaagauggaccgcuacgccuuccuccucgacaaggcccuccucaucugcaagcgccgcggcgacuccuacgaccucaaggacuucgucaaccuccacuccuuccagguccgcgacgacuccuccggcgaccgcgacaacaagaaguggucccacauguuccuccucaucgaggaccagggcgcccagggcuacgagcucuucuucaagacccgcgagcucaagaagaaguggauggagcaguucgagauggccaucuccaacaucuaccccgagaacgccaccgccaacggccacgacuuccagauguucuccuucgaggagaccaccuccugcaaggccugccagaugcuccuccgcggcaccuucuaccagggcuaccgcugccaccgcugccgcgccuccgcccacaaggagugccucggccgcgucccccccugcggccgccacggccaggacuuccccggcaccaugaagaaggacaagcuccaccgccgcgcccaggacaagaagcgcaacgagcucggccuccccaagauggaggucuuccaggaguacuacggccucccccccccccccggcgccaucggccccuuccuccgccucaaccccggcgacaucgucgagcucaccaaggccgaggccgagcagaacuggugggagggccgcaacaccuccaccaacgagaucggcugguuccccugcaaccgcgucaagcccuacguccacggccccccccaggaccucuccguccaccucugguacgccggccccauggagcgcgccggcgccgaguccauccucgccaaccgcuccgacggcaccuuccucguccgccagcgcgucaaggacgccgccgaguucgccaucuccaucaaguacaacgucgaggucaagcacaucaagaucaugaccgccgagggccucuaccgcaucaccgagaagaaggccuuccgcggccucaccgagcucgucgaguucuaccagcagaacucccucaaggacugcuucaagucccucgacaccacccuccaguuccccuucaaggagcccgagaagcgcaccaucucccgccccgccgucggcuccaccaaguacuucggcaccgccaaggcccgcuacgacuucugcgcccgcgaccgcuccgagcucucccucaaggagggcgacaucaucaagauccucaacaagaagggccagcagggcugguggcgcggcgagaucuacggccgcgucggcugguuccccgccaacuacgucgaggaggacuacuccgaguacugcuga

SEQ ID NO: 51621 - RNA, 2637 nt, Artificial Sequence
  derived and/or modified sequence opt2 from VAV2__Homo_sapiens__NP_001127870
auggagcaguggcgccagugcggccgcuggcucaucgacugcaagguccucccccccaaccaccgcgucgucuggcccuccgccgucgucuucgaccucgcccaggcccuccgcgacggcguccuccucugccagcuccuccacaaccucucccccggcuccaucgaccucaaggacaucaacuuccgcccccagaugucccaguuccucugccucaagaacauccgcaccuuccucaaggucugccacgacaaguucggccuccgcaacuccgagcucuucgaccccuucgaccucuucgacguccgcgacuucggcaaggucaucuccgccgucucccgccucucccuccacuccaucgcccagaacaagggcauccgccccuuccccuccgaggagaccaccgagaacgacgacgacgucuaccgcucccucgaggagcucgccgacgagcacgaccucggcgaggacaucuacgacugcguccccugcgaggacggcggcgacgacaucuacgaggacaucaucaaggucgagguccagcagcccaugauccgcuacaugcagaagaugggcaugaccgaggacgacaagcgcaacugcugccuccucgagauccaggagaccgaggccaaguacuaccgcacccucgaggacaucgagaagaacuacauguccccccuccgccucguccucucccccgccgacauggccgccgucuucaucaaccucgaggaccucaucaagguccaccacuccuuccuccgcgccaucgacgucuccgucauggucggcggcuccacccucgccaaggucuuccucgacuucaaggagcgccuccucaucuacggcgaguacugcucccacauggagcacgcccagaacacccucaaccagcuccucgccucccgcgaggacuuccgccagaaggucgaggagugcacccucaagguccaggacggcaaguucaagcuccaggaccuccucgucguccccaugcagcgcguccucaaguaccaccuccuccucaaggagcuccucucccacuccgccgagcgccccgagcgccagcagcucaaggaggcccucgaggccaugcaggaccucgccauguacaucaacgaggucaagcgcgacaaggagacccuccgcaagaucuccgaguuccaguccuccaucgagaaccuccaggucaagcucgaggaguucggccgccccaagaucgacggcgagcucaagguccgcuccaucgucaaccacaccaagcaggaccgcuaccucuuccucuucgacaaggucgucaucgucugcaagcgcaagggcuacuccuacgagcucaaggagaucaucgagcuccucuuccacaagaugaccgacgaccccaugaacaacaaggacgucaagaagucccacggcaagaugugguccuacggcuucuaccucauccaccuccagggcaagcagggcuuccaguucuucugcaagaccgaggacaugaagcgcaaguggauggagcaguucgagauggccauguccaacaucaagcccgacaaggccaacgccaaccaccacuccuuccagauguacaccuucgacaagaccaccaacugcaaggccugcaagauguuccuccgcggcaccuucuaccagggcuacaugugcaccaagugcggcgucggcgcccacaaggagugccucgaggucaucccccccugcaaguucaccucccccgccgaccucgacgccuccggcgccggccccggccccaagauggucgccaugcagaacuaccacggcaaccccgccccccccggcaagcccguccucaccuuccagaccggcgacguccucgagcuccuccgcggcgaccccgagucccccuggugggagggccgccucguccagacccgcaaguccggcuacuuccccuccuccuccgucaagcccugccccgucgacggccgcccccccaucucccgcccccccucccgcgagaucgacuacaccgccuaccccugguucgccggcaacauggagcgccagcagaccgacaaccuccucaagucccacgccuccggcaccuaccucauccgcgagcgccccgccgaggccgagcgcuucgccaucuccaucaaguucaacgacgaggucaagcacaucaaggucgucgagaaggacaacuggauccacaucaccgaggccaagaaguucgacucccuccucgagcucgucgaguacuaccagugccacucccucaaggaguccuucaagcagcucgacaccacccucaaguaccccuacaagucccgcgagcgcuccgccucccgcgccuccucccgcucccccgccuccugcgccuccuacaacuucuccuuccucuccccccagggccucuccuucgccucccagggccccuccgcccccuucugguccgucuucaccccccgcgucaucggcaccgccgucgcccgcuacaacuucgccgcccgcgacaugcgcgagcucucccuccgcgagggcgacgucguccgcaucuacucccgcaucggcggcgaccagggcugguggaagggcgagaccaacggccgcaucggcugguuccccuccaccuacgucgaggaggagggcauccaguga

SEQ ID NO: 51622 - RNA, 2520 nt, Artificial Sequence
  derived and/or modified sequence opt2 from VAV3__Homo_sapiens__XP_011538805
augacccagucccucuccuaccucgccacccgcgccgcccccuucaagaaggagcgcacccucuacgaccucaucuccauguaccucaagcucgagcacacccaguccuccgucauccucggcgucuccgucuccuccggcucccccgcccuccagauccuccacucccuccccgucugccuccagcccgccggcggccagucccuccgcaagaaccgccacggcuccggcgagucccacaccuaccucaaguuccucugccucaagaacauccgcaccuuccucaccgccugcugcgagaccuucggcaugcgcaaguccgagcucuucgaggccuucgaccucuucgacguccgcgacuucggcaaggucaucgagacccucucccgccucucccgcacccccaucgcccucgccaccggcauccgccccuuccccaccgaggaguccaucaacgacgaggacaucuacaagggccuccccgaccucaucgacgagacccucgucgaggacgaggaggaccucuacgacugcgucuacggcgaggacgagggcggcgaggucuacgaggaccucaugaaggccgaggaggcccaccagcccaagugccccgagaacgacauccgcuccugcugccucgccgagaucaagcagaccgaggagaaguacaccgagacccucgaguccaucgagaaguacuucauggccccccucaagcgcuuccucaccgccgccgaguucgacuccgucuucaucaacauccccgagcucgucaagcuccaccgcaaccucaugcaggagauccacgacuccaucgucaacaagaacgaccagaaccucuaccaggucuucaucaacuacaaggagcgccucgucaucuacggccaguacugcuccggcgucgaguccgccaucuccucccucgacuacaucuccaagaccaaggaggacgucaagcucaagcucgaggagugcuccaagcgcgccaacaacggcaaguucacccuccgcgaccuccucgucguccccaugcagcgcguccucaaguaccaccuccuccuccaggagcucgucaagcacaccaccgaccccaccgagaaggccaaccucaagcucgcccucgacgccaugaaggaccucgcccaguacgucaacgaggucaagcgcgacaacgagacccuccgcgagaucaagcaguuccagcucuccaucgagaaccucaaccagcccguccuccucuucggccgcccccagggcgacggcgagauccgcaucaccacccucgacaagcacaccaagcaggagcgccacaucuuccucuucgaccucgccgucaucgucugcaagcgcaagggcgacaacuacgagaugaaggagaucaucgaccuccagcaguacaagaucgccaacaaccccaccaccgacaaggagaacaagaagugguccuacggcuucuaccucauccacacccagggccagaacggccucgaguucuacugcaagaccaaggaccucaagaagaaguggcucgagcaguucgagauggcccucuccaacauccgccccgacuacgccgacuccaacuuccacgacuucaagaugcacaccuucacccgcgucaccuccugcaaggucugccagaugcuccuccgcggcaccuucuaccagggcuaccucugcuucaagugcggcgcccgcgcccacaaggagugccucggccgcgucgacaacugcggccgcgucaacuccggcggccuccccaagaugcaggucauccgcaacuacuccggcacccccccccccgcccuccacgagggccccccccuccagcuccaggccggcgacaccgucgagcuccucaagggcgacgcccacucccucuucuggcagggccgcaaccucgccuccggcgaggucggcuucuuccccuccgacgccgucaagcccugccccugcguccccaagcccgucgacuacuccugccagcccugguacgccggcgccauggagcgccuccaggccgagaccgagcucaucaaccgcgucaacuccaccuaccucguccgccaccgcaccaaggaguccggcgaguacgccaucuccaucaaguacaacaacgaggccaagcacaucaagauccucacccgcgacggcuucuuccacaucgccgagaaccgcaaguucaagucccucauggagcucgucgaguacuacaagcaccacucccucaaggagggcuuccgcacccucgacaccacccuccaguuccccuacaaggagcccgagcacuccgccggccagcgcggcaaccgcgccggcaacucccuccucucccccaagguccucggcaucgccaucgcccgcuacgacuucugcgcccgcgacaugcgcgagcucucccuccucaagggcgacgucgucaagaucuacaccaagauguccgccaacggcugguggcgcggcgaggucaacggccgcgucggcugguuccccuccaccuacgucgaggaggacgaguga

SEQ ID NO: 51623 - RNA, 1005 nt, Artificial Sequence
  derived and/or modified sequence opt2 from VAX1__Homo_sapiens__NP_001106175
auguucggcaagcccgacaagauggacguccgcugccacuccgacgccgaggccgcccgcgucuccaagaacgcccacaaggagucccgcgaguccaagggcgccgagggcaaccuccccgccgccuuccucaaggagccccagggcgccuucuccgccuccggcgccgccgaggacugcaacaaguccaaguccaacuccgccgccgaccccgacuacugccgccgcauccucguccgcgacgccaagggcuccauccgcgagaucauccuccccaagggccucgaccucgaccgccccaagcgcacccgcaccuccuucaccgccgagcagcucuaccgccucgagauggaguuccagcgcugccaguacgucgucggccgcgagcgcaccgagcucgcccgccagcucaaccucuccgagacccaggucaaggucugguuccagaaccgccgcaccaagcagaagaaggaccagggcaaggacuccgagcuccgcuccgucgucuccgagaccgccgccaccugcuccguccuccgccuccucgagcagggccgccuccucuccccccccggccuccccgcccuccucccccccugcgccaccggcgcccucggcuccgcccuccgcggccccucccuccccgcccucggcgccggcgccgccgccggcuccgccgccgccgccgccgccgccgcccccggccccgccggcgccgccuccccccacccccccgccgucggcggcgcccccggccccggccccgccggccccggcggccuccacgccggcgcccccgccgccggccacucccucuucucccuccccguccccucccuccucggcuccgucgccucccgccucuccuccgccccccucaccauggccggcucccucgccggcaaccuccaggagcucuccgcccgcuaccucuccuccuccgccuucgagcccuacucccgcaccaacaacaaggagggcgccgagaagaaggcccucgacuga

SEQ ID NO: 51624 - RNA, 873 nt, Artificial Sequence
  derived and/or modified sequence opt2 from VAX2__Homo_sapiens__NP_036608
augggcgacggcggcgccgagcgcgaccgcggccccgcccgccgcgccgaguccggcggcggcggcggccgcugcggcgaccgcuccggcgccggcgaccuccgcgccgacggcggcggccacucccccaccgaggucgccggcaccuccgccuccucccccgccggcucccgcgaguccggcgccgacuccgacggccagcccggccccggcgaggccgaccacugccgccgcauccucguccgcgacgccaagggcaccauccgcgagaucguccuccccaagggccucgaccucgaccgccccaagcgcacccgcaccuccuucaccgccgagcagcucuaccgccucgagauggaguuccagcgcugccaguacgucgucggccgcgagcgcaccgagcucgcccgccagcucaaccucuccgagacccaggucaaggucugguuccagaaccgccgcaccaagcagaagaaggaccagucccgcgaccucgagaagcgcgccuccuccuccgccuccgaggccuucgccaccuccaacauccuccgccuccucgagcagggccgccuccucuccgucccccgcgcccccucccuccucgcccucacccccucccuccccggccuccccgccucccaccgcggcaccucccucggcgacccccgcaacuccuccccccgccucaacccccucuccuccgccuccgccucccccccccucccccccccccuccccgccgucugcuucuccuccgccccccuccucgaccuccccgccggcuacgagcucggcuccuccgccuucgagcccuacuccuggcucgagcgcaaggucggcuccgccuccuccugcaagaaggccaacaccuga

SEQ ID NO: 51625 - RNA, 702 nt, Artificial Sequence
  derived and/or modified sequence opt2 from VBP1__Homo_sapiens__NP_001290472
augaacguccacggcgacggcgaggccggccuccagguccgcaccucccagucccgcaaccccggcggccgccgccccggccgccagucccgcgcccgcauccccaagauggccgccgucaaggacuccugcggcaagggcgagauggccaccggcaacggccgccgccuccaccucggcauccccgaggccgucuucgucgaggacgucgacuccuucaugaagcagcccggcaacgagaccgccgacaccguccucaagaagcucgacgagcaguaccagaaguacaaguucauggagcucaaccucgcccagaagaagcgccgccucaagggccagauccccgagaucaagcagacccucgagauccucaaguacaugcagaagaagaaggaguccaccaacuccauggagacccgcuuccuccucgccgacaaccucuacugcaaggccuccgucccccccaccgacaaggucugccucuggcucggcgccaacgucaugcucgaguacgacaucgacgaggcccaggcccuccucgagaagaaccucuccaccgccaccaagaaccucgacucccucgaggaggaccucgacuuccuccgcgaccaguucaccaccaccgaggucaacauggcccgcgucuacaacugggacgucaagcgccgcaacaaggacgacuccaccaagaacaaggccuga

SEQ ID NO: 51626 - RNA, 1968 nt, Artificial Sequence
  derived and/or modified sequence opt2 from VCAN__Homo_sapiens__NP_001119808
auguucaucaacaucaaguccauccucuggaugugcuccacccucaucgucacccacgcccuccacaaggucaaggucggcaaguccccccccguccgcggcucccucuccggcaaggucucccuccccugccacuucuccaccaugcccacccucccccccuccuacaacaccuccgaguuccuccgcaucaagugguccaagaucgaggucgacaagaacggcaaggaccucaaggagaccaccguccucgucgcccagaacggcaacaucaagaucggccaggacuacaagggccgcgucuccguccccacccaccccgaggccgucggcgacgccucccucaccgucgucaagcuccucgccuccgacgccggccucuaccgcugcgacgucauguacggcaucgaggacacccaggacaccgucucccucaccgucgacggcgucgucuuccacuaccgcgccgccaccucccgcuacacccucaacuucgaggccgcccagaaggccugccucgacgucggcgccgucaucgccacccccgagcagcucuucgccgccuacgaggacggcuucgagcagugcgacgccggcuggcucgccgaccagaccguccgcuaccccauccgcgccccccgcgucggcugcuacggcgacaagaugggcaaggccggcguccgcaccuacggcuuccgcuccccccaggagaccuacgacgucuacugcuacgucgaccaccucgacggcgacgucuuccaccucaccguccccuccaaguucaccuucgaggaggccgccaaggagugcgagaaccaggacgcccgccucgccaccgucggcgagcuccaggccgccuggcgcaacggcuucgaccagugcgacuacggcuggcucuccgacgccuccguccgccaccccgucaccgucgcccgcgcccagugcggcggcggccuccucggcguccgcacccucuaccgcuucgagaaccagaccggcuuccccccccccgacucccgcuucgacgccuacugcuucaagcgccccgaccgcugcaagaugaaccccugccucaacggcggcaccugcuaccccaccgagaccuccuacgucugcaccugcguccccggcuacuccggcgaccagugcgagcucgacuucgacgagugccacuccaaccccugccgcaacggcgccaccugcgucgacggcuucaacaccuuccgcugccucugccuccccuccuacgucggcgcccucugcgagcaggacaccgagaccugcgacuacggcuggcacaaguuccagggccagugcuacaaguacuucgcccaccgccgcaccugggacgccgccgagcgcgagugccgccuccagggcgcccaccucaccuccauccucucccacgaggagcagauguucgucaaccgcgucggccacgacuaccaguggaucggccucaacgacaagauguucgagcacgacuuccgcuggaccgacggcuccacccuccaguacgagaacuggcgccccaaccagcccgacuccuucuucuccgccggcgaggacugcgucgucaucaucuggcacgagaacggccaguggaacgacguccccugcaacuaccaccucaccuacaccugcaagaagggcaccgucgccugcggccagccccccgucgucgagaacgccaagaccuucggcaagaugaagccccgcuacgagaucaacucccucauccgcuaccacugcaaggacggcuucauccagcgccaccuccccaccauccgcugccucggcaacggccgcugggccauccccaagaucaccugcaugaaccccuccgccuaccagcgcaccuacuccaugaaguacuucaagaacuccuccuccgccaaggacaacuccaucaacaccuccaagcacgaccaccgcuggucccgccgcuggcaggagucccgccgcuga
